United States Patent 9,518,277 (GENETICALLY ENGINEERED MICROBIAL STRAINS INCLUDING CHLORELLA PROTOTHECOIDES LIPID PATHWAY GENES) - sequence listing, part 13

SEQ ID NO: 42941 - DNA, 26727 bp, Chlorella protothecoides
  modified_base (400)..(409): a, c, t, g, unknown or other
  modified_base (626)..(635): a, c, t, g, unknown or other
  modified_base (918)..(927): a, c, t, g, unknown or other
  modified_base (1218)..(1227): a, c, t, g, unknown or other
  modified_base (1422)..(1431): a, c, t, g, unknown or other
  modified_base (2221)..(2230): a, c, t, g, unknown or other
  modified_base (3095)..(3104): a, c, t, g, unknown or other
  modified_base (3159)..(3168): a, c, t, g, unknown or other
  modified_base (3244)..(3253): a, c, t, g, unknown or other
  modified_base (4297)..(4306): a, c, t, g, unknown or other
  modified_base (5420)..(5547): a, c, t, g, unknown or other
  modified_base (5760)..(5769): a, c, t, g, unknown or other
  modified_base (6551)..(6560): a, c, t, g, unknown or other
  modified_base (7890)..(7899): a, c, t, g, unknown or other
  modified_base (8623)..(8632): a, c, t, g, unknown or other
  modified_base (9488)..(9537): a, c, t, g, unknown or other
  modified_base (9747)..(9756): a, c, t, g, unknown or other
  modified_base (9850)..(9859): a, c, t, g, unknown or other
  modified_base (9953)..(10051): a, c, t, g, unknown or other
  modified_base (11880)..(11889): a, c, t, g, unknown or other
  modified_base (12843)..(12852): a, c, t, g, unknown or other
  modified_base (13215)..(13224): a, c, t, g, unknown or other
  modified_base (13904)..(13913): a, c, t, g, unknown or other
  modified_base (14132)..(14317): a, c, t, g, unknown or other
  modified_base (14752)..(14761): a, c, t, g, unknown or other
  modified_base (16447)..(16456): a, c, t, g, unknown or other
  modified_base (16665)..(16750): a, c, t, g, unknown or other
  modified_base (17581)..(17590): a, c, t, g, unknown or other
  modified_base (17840)..(17849): a, c, t, g, unknown or other
  modified_base (18228)..(18237): a, c, t, g, unknown or other
  modified_base (18703)..(18712): a, c, t, g, unknown or other
  modified_base (18938)..(19101): a, c, t, g, unknown or other
  modified_base (19849)..(19858): a, c, t, g, unknown or other
  modified_base (21014)..(21023): a, c, t, g, unknown or other
  modified_base (21483)..(21492): a, c, t, g, unknown or other
  modified_base (21736)..(21889): a, c, t, g, unknown or other
  modified_base (21996)..(22005): a, c, t, g, unknown or other
  modified_base (22646)..(22655): a, c, t, g, unknown or other
  modified_base (23289)..(23298): a, c, t, g, unknown or other
  modified_base (23677)..(23686): a, c, t, g, unknown or other
  modified_base (23900)..(23909): a, c, t, g, unknown or other
  modified_base (26429)..(26438): a, c, t, g, unknown or other
ccgctgcccgcggggggcgccgtgtcgtcctccgccaggcggaacaaggaccagaaggagggcagctcgggctggaggtaatccacaaaggcctgacagccggtcagctcgccggcgggggggttcatgtagaccacgggccagtggctggggccggtgtcgatcaccacgatgggctccaccaccgcgtccagggactgcacaatggagtttcggtgcagggcgtagtcggtgatggcctccttctgcagggccaggacctgtgaggatcatggagaatgaggggggcggggggcagggtaggtgccaagatgtgcctgatcggtccctgctcccctcgattcaccctacaaccacccgtatcctgatggctgacagtgtgtgggagacagtgctgttnnnnnnnnnntggggggcagggtcggtgccaagatgtgcttgatcggtccctgctccccccgattcaccctacaaccacccgtatcctgacggctgacagtgtgtgggagacagtgctgttccccaagaaaggaaagtacagcctccacgattccctgccttggaggtggcgccacccaaaaacctcacatcaactatgtaacagcggcagctacaccctccagccnnnnnnnnnncggaggtggcgccacccaaaaacctcgcatcaaccatgtaacagcggcagctgcaccctccagccacctgctgctcaaccctaccttgtcacgctccagctcccgggtcactatctcggcaaactgggccaggatggcatacatgtgcgggggaaaagagcgaggcttgaagtccacgaggcacctggaaggcaaagttgcggggaaaggggggggattggaggacgctgagggtatgccctggattccgtcattcgttgcattaatctcaggctgttgctannnnnnnnnnatggggaaggggaggggattggaggacgctgagggtctgccctggattccgtaattcgttgcattaatctcaggctgttgctacaaaataaacatcacacatcctaatccggtggttactgcagtgcagagcacacggcaggccccagataggctccatgggaccgaggataatttcggatcgtgcgcttcaaacccccttcgcacaagcagaagatgagtcacatgtaagtcccagaaacaactcccctggaaaacaagacccatctcacagggtgccgtagctggaccnnnnnnnnnngacatgtaagtcccagaaacaattgccccggaaaacaaaacccatctcacagggtgccgtagctggacccatcaaagcttgagatcaggggagcaccagcatagaaagaaatgttgggtggtcccttcacaaaagggttgttcataaatctgcaaaagggaatgtaggagtgggacatacactacattcagttannnnnnnnnncggtcccttcacaaaagggttgtccatgaatctgggaaagggaatataggagtgggacatacactacattcagttactgtcccgggggtcgactgtgcgtgcaggtggacccctgagcaaccttgcatgccctcacgcaagactggcaagtggcactggtgcccactccatcgccacacttcccccacccacctggggtccgtctgcacattctccacgaccagcagcttggagtcgttgcaagcagacaggcactggcacaacgtcatcttgcgcggggcgccgggggcccagtccccggcacgggacatgaagtaggccatgtcgccctcgatgatggacaccgtggacaagcccaccccaaagatgctcttcaccagggcggtgatgttgtcgaagcggttctggggcgtgtggaagtcgacgcccaggctggccaggatctcactcctccgagcctcattcagctccagctgccggtgcatgaaggtttcatagtcgctgaccgccttgtcgctcagggaggcctgggaggcgctgcgaatgatcggacatgattcaaaacgcaggccgtacccctcatccccgtcctgcgcctcccctgaatcctcctcgggggccgacggtgcaggcccgggctggccggggctggggacgggatgcttctgggaactccgtcgagcctattgttggaagatgggcattggctcaatatacgcaaaggattttttgccaactcgatgagagggtcctgggagcgcacgcaccagcacctcaccgtacgggtcgnnnnnnnnnngtacgcaaaggattgtttaccaacttgatgagagggtcctgggagtgcacgcaccagcacctcaccgtacgggtcgacaccttgttgcccatacgctcaaccccacactccgaaggcgggactccacgctcctcttgatgggcgctcgcgagcctgtacgagcatactatgcgagtaggctagctcgtaaagctcatactgatcgagaagtgcattgctaatgccgatttgcgcttcaccctttccctaccctcccccataccacttcctgatcacgtggggtcctcgcgcgcgcccgtgagctcgaatcccaccccgtcagcctcatacacatcaccagtgacattgatcgatgctgaatgagggatgatcggtgtcatgccttagattcaggcccgacacgccaattacagacagtcgctgtctccagatcactccccattttggcacttttgatgtgtacggttctcctgcccgggatgcccggggccatcctcatcagcaagcagccactgtgatcaataacgagcgtcgaaaacaaccagaaacgtttatatgaccacccttttgcccacgttcgcgagctctggctggacaatgactcacaggctgccaatggatgcagatgagatcgtctcggaggccctgcacgagcggctgtgtgcgtcaggtgcactccccacatcttgccacgagctggaaagcatcctgcaggtacgtgaactatgcgtggcgtgcatcattgcgtagcttgccagcgtgcgtcatgcgcatcacctctccccaccccctccccggccagaccctggaagagtccatgcacctgagtgatcgggccagaccgacacaccctgggggatcccgnnnnnnnnnngttgccagcgtgcgtcatgcgcagcacctctccccaccccctccccggccagacnnnnnnnnnnggcagcccctctgccatcctgtggggtggtgacaatgctcaggcgcgacacgcttgcccagctggggcgggccctnnnnnnnnnncgcagcccctctgccattctgtggggtggtgacaatgctcaggcccgacacgcttgcccagctggggcgggccctccagggctgcttccagcacaccctggacaccctcagccgggatgacacggtgcgcctctgcctgtcgcacgcaggatgctggcctgtgaatgtcgattgttcaacatgttgattccctggtcagcaagctccagccgctctgcctcatcctcatggccagggccgggcgcttgaggaggcacgcagcctcgccgcgctgctggagcgcatgggagcaaaggtgctggagagtgagggcactgggacgaccttcctgctggcccatcggccacgaggaatcccatatgctctgaaaccatcacgcaatggtcctgattggaccaccgcgccctgtcatggcatccggggtcgcttgctgccatgtttccccagcaaaacaccatgcgtccccgccccccccaaaccttccaccaggagctgagcgtcgaggcggcggtggcggggacgctgagccacctgcaggcccacctcgaggagcgggcgacgcgggacgcttctgcgccctggctcgccgaggctcttgagtacactgcctcctggccactccgcctcctgcagcagctcctgcccgaggcgggggtatgtagggattggttttggcacattgtgtttcgggcgcatgtgaggttaacatttgtagaggccgtggccaggcgatgccaggcagagggtccgccattgccacacgatccggggtcacaatgtcaaacaccagactgcccagttctccagggttctcaccaccatcaaacctcccctcacaggcctctggctggcacctgtgggagcagcgcctgcgctactttgtctacgagcgggccggcctcatcttcaccgactccctttttgacctggtggtggacttccccgacaggtattgctcgtctggtcgaccgggggttgctggggttccctggagctttgaattcttgcaggtcggggagctgcgtgcatagaaagatggatggnnnnnnnnnntctggagcattgaatcttgcaggttggggagctgcgtgcatagaaagatggatggagcgctgtgcatgtcgcaaaccatacccatgccgctgccaatactgcccttgaccccaatcttccgcactgctgtccccgccgccccagcctgccgaccctgcacgacctgcgtgcctgcctggagaacaccagtctcctcagccatgtggcgcagtgctttgctgcagccaccaagaagcgcctgctccatccaggtggaggagcctgcttatttcgataagttttggggacagtcttgctcctcgacctttccccccatggggtcaacgcctgatgaaggacgccgctggctcctggtctgtgcctggtcagtcatgccccaaggtcccttgtttccattgccagtccacactcttgcttcccttccctccaggcgcggccacatcggacatcgtgcagcagtacatcttctccattcgggccatgcgccatgtggaccccacaggtcggtgaaccactgttgctgggctggatcgatcatcccagggtgcagccaggcgcggccctggctgcaaggatcggcccccaggtgcgccccgcacagcattgtgagtatttgcacctactcctcccacctccctcccccccaaccgtcctcagacacggccctggccccggcacgcgcggccacacaggactacctgcgcacgcggcgggacgccatccgctgcattgtgggcctgctgacggccgacgaggagggcgaggacaacgtggtgctggaggagctggagggcgagggcgaggccggcggcgcaggggtgggctggggcatgggggtggggaggggcgcgaggccggtgttgtcaacggtgcagttgagctcggtcttccagcagagcagtatcaagctgaacgacccctgtggcccctgcgtcctcgtatgcaggtccctctgacaccctgctttgacgggccggatgcggacctccaggccctggccgaggctgagcgctggcgccccgagccaggtgcggggccggggtgggtgggcttcatgtgcgtagcgaatggggggagggcttcgagcaggccatgccctgtctccttcttgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaaggacctcctggtgaccgagtaccggtgggttggcgcatcggtgtggtggaatggtgcagtgtgtttggtgcgacactcgaggggcctgcactctacgggggctgtcggaccagtcatggctggtgaagggctgcatgcaggtgatccgctcgaggggtaggatccgcgtggggagggtcaccacccgcacctgatccaatcaggcccctnnnnnnnnnntgccgggggggggggggcttcctgtgcgtagcgaatggggggagggctttgagcaggccatgccctgtctccttcttgggggtccaagcgcccacaagccacaccctcggacacaaacaccggcttgcgtcattgccgcgcagtggatgccgtggagcgtgtgaccggcagcgatgccgtgtcgcagctggtgggcatctgggggtcaaaggacctcctcgtgaccgagtaccggtgggttggcgcattggtgtggtgggatggtgcagtgtgtttggtgcgacactcgaggggggtgcactctactggggctgtcggaccagtcgttgctggtgaagggctgcatgcaggtgatccgctcgaggggcaggatccacatggggagggtaaccacccgcacctgatccaatcaggccccttgccaccctggccccaacagcgaacccaccacccctcccactgcacaggtccctgctggccgacaggctgctggccaagcagggctacgactgcgaccgggagctgcgcaccctggagctgctcaagctgcgcttcggggacgccgtcctgcacaccgccgagatcatgctcaaggtgacccggcttgggcctgggagcctgctgcgctgttccacttgggtatccagggggggtggggaaggttcgggcggtgtggggggttgaggtggtggggtggagggggagcggtggtctctgcgtggtgagatctgctgccatctgaggggtgccacgcctcggagctgccaggagttgatgcccannnnnnnnnnaggggggagcaatggtctctgcgtggtgagatctgctgccctctgaggggtgccgcgcctcggagctgccaggagttgatgcccagcgagccgcaggaggaacatcgccatatgcagctgtgtgccgacttctccggtccatctccatgccatcaggcaatcgccctccgtgccgtacaaaccaccgttcctggcatgcatccctcaccaaacacccaggacctggcggattccaagcgcatcaacgccaacatccggtcggcagcccgaggcgctgcccgcggcgagcgggccgccaccgtcaccgccaccatgctctccgccctgtactggccccaaggcagcgcgcctgcccccgaagaagcggacctgaggctgccgcccgacgtgggcagctggctggaggagtacggccaggcctaccacgcgctcaaggcgccgcgcaagctgcagtggcgcccgtcccagggcgtggtgcagctggaagtgacggtgggggaccaggccctggagctcacggtgagtagctgtgggtccagggggttggtttgtggagggggcgtggttcaggactggtgtgcctggatcatgccttcgcgaaacccaggacttgggtggcactgcatgtgtctgtccgctgggacaaaggacggtcttggctgtggaaaatcatcctggatcagtcgatttgagtactcatggtgtcctgattgtgtcatctggaggcaacagtgcagtgacaggcaccaaatatctcgattctgccactctgaactgcgttgatgacatctgatcgccccccccctcgaccttgcaggtgacccctgcgcaagccatcaccctactgagcttccgagagcgcagcgaatggggcgaggctgagctggcagagcagacgggccagacgcccgccatggcgcgacggaatgccagcttctgggtccagcaaggcaggctgtggggaatcgtggaggaattgcacataggttcgaggggttgatttgcgaagaagggccattgctcccttgttccagctcacccagactgctacactctgtgcacaggagtgctgcatgaggctgctcagcctggaggagccagggtgtacgccaggaacagggtccttcaggccagcaccggtggctggagcggtccacccgccgaggacgagggggcggagggcggagcgccggcactggatgcaggcctgcaggtgggtgtgagtcgatgtcgggtaacaggctggacacgctcctgacccagatcccaactgctcagcacctgtcagcatgctgcgaccaaccccggcgctctgttgctctgcaaaacnnnnnnnnnnggccggcactggatgcaggcctacaggtgggcgtgagtcgatgtcggggtacaggctggacccgctcctgacccagatcccaagtgctcagcacctgccagcatgctgcgatcaaccccggcgctctgttgctctgcaaaactccatcaccccgactcggacattgcccaccccatgccaggccatggcagcatacgagccgttcatcctgggaatgctggcgaatttcgacagcctgccccaggaccgcatccacaacatgctcaaggtgtgacttttgaggaagcacaaggagatggcaatgcgagcggctctgcctgctcatgcagacactggggcatggtgatcattgttctgccctgcctggctaacacctgactttagatagcagcaccctgtcggaaggcctgacgcacgctccacaccctctcgcagatgtttgtgtccgatccgccctacgacaagaccctggaccagctgtctgcctttctcgctcacctggtggcccaggagcgcctcacgtgcgaggggggcaccatgtacaagcagaaactttagactgggacgcatgctggcccagtcctacttgcctaccagggcggttgtccttgtacagcagccacgttacacgttttgaggatgatgacattcggggggaagagagatatgggtggccaggtgcagcgacattgagttggacttcatgtgttgcttttcaggcacnnnnnnnnnntaaactttagactgggacgcatgctggccagttttacttgcctaccagggcggttgtgcttgtacagcagccatgtttcacgttttgaggatgatgacatttggggggaagagagatacgggtggccaggtgcagcgacattgcgttggacttcatgtgttgcttttcaggcactagcctccaccagatggctgcactccaagcacagactctgcatgggcattgatagagggaatgggcgtcgcaggactgacaagatcgaggtggatgccggtccttgcacctaccggccgtgccgggcaatcatcccggcaattgaagatcctcccgcacctgaactgtccttgctcttgtccatgggcgacccgccctcggcatttccagactccgcaggcgtgacgttggtggccgcagtgtcctcctgaactatgtcagaggtatccctcccctctgtgggctgtacgcctgcaacgaggcatgtgatggcttggtcttcagacatcatgattgagagtataatactgcactcacgaataaaagggtagaaggatcctcttgctccctgggcaatagtcatcattccggaatccatgtcaatcaaggtgactacacggcatggttccttggccaacaccacacccacattcttattcgtgtggcaccaaaccccattttccgtccacaaagccccaacacgcatcaccaaacgaccttgaacaccttgcgcgctggggtcgtccctgtcaccgtacgctccccctgctgtcttgtcctgcttgtacatcttgtgacccttgttggtctgggggtcaccacccttccctacatgctcctgagccttctcttctccatctgnnnnnnnnnnnnnnnnnnnnnnnnnnnnnnnnnnnnnnnnnnnnnnnnnncttaagcagggccctctgtgagtggaacccggcagaccatgacgtgaggtccagccctgtgcacacaaccagggtgagaagggtcgcggtatctctggcggtgaggacaaatctttgtttccggaatcaatcattcactcactcacagcatttccctcgtcgcctcacccttggacatcgaggccactacgtcgccctgcggatgcaggnnnnnnnnnnccgtgcaggaaaagaaaaagttgtaattgaatgagcagcaatgggttaacacaaatgcatctctaattcattgaacagccaagccgactcaccnnnnnnnnnntcgtgcaggaaaagaaaaagttgtgattgaatgatcagcaatgggtaaacacaaatgcatctttaattcattgaacagccaagccgactcaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttatctctggcggtgaggacaaatttttgtttccggaatcaatcattcactcagtcacagcatttcctcgtcgcctcacccttggagatggaggccactacgtcgccctgcggatgcaggcgagagggtgttaatactgccaggcggctcgtgaatgatcgcatcgagtttcggttgtgttgaaccaatggggagatcttgttggaagatgcgtttgtgaactcgcggatgtgtgacgttggctgggccacaacagcactattggtcccgacaacggaacccgggacgaagctacccactcacagttagggtttgtcatgggatggcatgacattttcgaaggtatggagacagtatacaaggtacctcgaaaaaagtaggcacatggaaaatttgaaagggatgaaaggttggagcacttatcgtaaaaaggatttgttgggaccagggaaaggtactccctgactccctccgctctattccagcccggtggggtttcagctcctccccatgccgagcatttggttacattggtgccccagttctgggctattgcaaacaatcgggccaggtcgcgtcactggtcggccatgccccgaggtcagagtcggggagagcgcacatgctgtgcagctgttgtgcagtaaagctctccatgtgctgggaatgtcgtagcatgcacttggagcatgctcggattagttgcaggtaatgccggcaaggggaggcactgcctcctcccccacgcgccatgcgatgaggttgacagggcaaaggcgccccgggcgaggcaccgggagcacccactcacggggaactcgctcatcaggccaggcaggcgccgcgctgggcgcaggccagcatcgtcgaccggtccagcgcatgctgcgcgtcgtccttcatttccaggacgcggttcagcaggtcctgccgcagaggtgggcgtcaggtgggcgcgggttcggacctggcctgaacaggactgcatgcgtaaacgatgcgcctgatggagtctggcacaccccgacctggcactcttgcgtggggtctctccaccctttcccgttgtccgtcagtcacctcccccctccaactcctccaagcaatggccgcctcacatgcgtctgttcgaagagggcgttccccgcgccgtgcgccgacgcgatgtcggccagcgcctccgccaggtgcggagtggcggcgcccatgtgcgccattgccgcggcgatgcgcgccgcggcgtcggcgcccgggcgccccgtcagcgccggccctcgccgagcctcgggcgatgccgcggcccacggcggcgtgaacacgttgctgaaggggggcgtggggcaggcgtccaggtcctccaccaggctggacccgacgggggaggcggtcccggcccagtcggagcccggcccaccgccgggcggcgcgcagggcgagcgcggcgcgctctcctccacgctgctcagcagcatgcgcggcagcgtgcgctggggcgccgaggcgtaggcggcggggccctgcgggcggccggcctggggcgagggggtggccacgcccagacccgactcctcctggctcagggcgcgagccagggtggacaccgccagcttgcccggggcgggggagggtcgcagggggtgcgagggtgtcaggcagggggcctggcgagagggtgcgtgtgtagggggggtgaggatctcttgccaaggcccctgcctccagccggctccctggagctcaggacacaggcaaggcatcctcctgcctgcatgacccgtgccttgggattgctgcgtgcgccgcaccagaggtgcatgacatgcagtcannnnnnnnnngccagtgccttgggattgctttgtgggccgcaccagaggtgcatgacatgcagtcacgaccccacgccgcccgacccagacaggcctaaaagttaacaacggcatgcccaacctggtccagacgggacacgaggccctccagggtgtcctcatcggcgtgggccaggagggctgtgtagtgcatggccacggggccggggggggcaccgctccagtacaccccgcagtccagcagcacctcccctccggggtgcgtggccttgatggcgacggacacgcgggacccagtccccgccgcggcgggactgagctgggcacagggcaccgcgatgcgcagggagggggaggccgccagcaaggcgaggaggggcgccttggcctcagagcggtacaggatctgcagcagctcgcgtcggcggagcgacgccatggcgaggtgggatggacctacgtgataatagttggtggctcggggtcattataagcaactgggatgcatctggaggtgtgagaacgtgcgtcgcgccccgtacggcaggtacttgcgcgatcggtgtacctggcacagagtgcacccggggtctctggtgatggtctgagggctgccctgatggatgatgggtattgaaggatctgatggtatggatacgagtagattgtctcgtgcaagagctgctcgacttgctcctcaaatgccccatttcgtattcgaatcccaagggtgtcggggcgcaggctccagcgtcccggaaagcacgagtcggaacagctgtcccatggctgcctgaaacagggaggaagggttagacgcggcctctatgcgattcttgctcctgtcgtgcctgctaagtatgacctgagtaaagtatcgtggcacgaacgaatctggggagaagcgctgccatcggtggacagggaagcgcggatatcattgggtctgtgagccggagcacnnnnnnnnnncgcgattcttgctcctgtcgtgcctgataagtatgacctgagtagagtatcgtggcacgaaaagaatctggggagaagcgctgccatcggtgaacagggaagcgtggatatcattgggtctgtgagccggagcacggataccgcttgtcgacgatggagcaatgctcagcttctccagcctacggattgtcatgtccacatcaatgctgttccatccctagcgctcgggtatgtgtggagcctagactgaatgcttgccacgtgcttgtacgacaatctacagagcacaccttggatagtgcgggcacgacccatggtcttccgtgagaaaggtgaggagaagaagaagcacccatgggttgnnnnnnnnnnagctcgggtatgtgtggaacctagactgaatgcttgccactgtgtatgtacgacaatctacagagcatacctcggataatgcgggcgcgacccatgttcttccgtgagaaatgtgaggagaagaagaagcacccatgggttgagcgggttgggaaccagtgattacttcttggaatctattatcgcgattcgcgccatgcgacgaaccagcctatgtgatgttgggaggttgatcccaagccccatccataatttcccacgattgtagcgacaccccgacccctttggcgatcgactccaagcggtgctcaagttcattggaggcgcatcagtaagagcgtgttcagcggaaacccttcacggaactccgtaaacgtgtcgagccacagtgcaaaccgcgctatgacacccggagaggcagcaccagacttcatccagatccttattcgaactggagataggttgggtgactttctcgaggatgcagccttgtaccgagtaggcttcacatgccgcgcagcgtaggcttataccagcggtgtcttccaccccgacgtgtacgcgcgccgttgggcagaggaacctgccgcatactacccagacggtgtactcacacgagcaacagcacaagatattttctagaggctttgggtgaggcggagtgccttgtctgcaaggtnnnnnnnnnntgcagaggaacctaccgcatactacccagacggcgaactcacacgagcaacagcacaagattttttctagaggcttcgggtgaggcggagtgccttgtctgcaaggtacctgtgcattgtacgtcggaggcaggacgacgaggatctcatcatgctttacgccggtcactcccccaggacgagaccgaggcacttaaagcgatagcgcgcctgcagtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtgagagaccttaccaggtacaaaattcccctgttgtgacagggactcctgacatgctggagcaagatgcccgtgacccaatgtggagatcgattctggggtaccctattgttagattttgtcaaggagtactaggtcaagaatgaagagattaggctcccacccccaaagcgacaccgcaaaattcacctccacacatgcctcctgcgccctatcaatctgttggtgagttgagaggaaacgcaggagagggccacccactagaaatctggggatgctggtgatgggggagctgtgaccggcttgccaaggatacctaggcctgcgtgccctcccagagtcttcatatgacccttccttgcccctgacagcactcgatgtccgaccccagcaagccagtctcagcaccttcacgtcttaatatgtgggagccnnnnnnnnnnatgccctcccagagtcttcatatgacccttctttgcccctgacagcactcgatgtccaaccccagcaagccagtcttagcaccttcacgtcttaatatgtgggagcctgtcctggcaagagtcagtagggcgctgacagatctggacacaggtgagctgaggctcgcttttctatggtgccttggctatttttcgaggcagactttgttcgtcaggacatggagagtttttccttggatgtggtcggaaaacttcggctcctcacctggcttatcatatgcgcagcagcttgcaggttgtgtgctccaagcatgctgttggccactcacactcctaggcatggcatcaaatactgcagacgaaacaaagctggcgtgcatagtccgcgtgggaggaaattcagacagctgaagcagcccataaacatccactttgaaccacttcctggtagacatcagctatgttggtgagaggaggtgggataggtgagatcttccatgcatgacagctgatgtgcatgaaatatgcttgcctggcctgagagctagccctttgacagagcctggtccttgtgcataccatgcttgcatatcctccctctacacatgcagtgtcatacggactgagcctaaaccctgggattgcccccagtatgttgtccagcatcctggtcactactattactggggggacctcctcctcaagtacagcgtacagagctacgagagagcctcccggcggtggcaacttccaaggtacttgctattggcggctgtgggagcatgcttgcaatccttgatgttggtttgattgtctgcatcacgcgtttccaccagctcccgtctatgccctggaagccaccctcgcaatgccacttgtcttctcctcacgcttatcgccctcgcccttgccagggaccaatatgtcgctcgtagagcacttgccattcttggcgcgctgtacatctgggtgagaaaggagcatggcagctggcgcgacagcgaaactgctgagcatgtccgcgctcttcaggccgaggtttgtgcatagtggatgttgaggctgtgaatgactctggtagccacctcatccttccaacatcttcagtggcagctgaagatctcttgtccatacagcccatgcaaagcgtgcgatgtcctggtcttgtaggtagagaatgagcaacacctttctaggatccgggttgggatgcgtgatgaggccatgctcgaaaaatactggaggaacaacaactggaggcaacttcctgcgacagcatgcattgatgttcccagcgatgcaaggcaagcatgatgttgtcatcatgaagcgcatgtctatctttgggtctgacctccaacctattgcgagtgaagcctgcacagtctctgaccttgcgagcttcaccggctgtcaaggattttggttagtatgagatcccccatgtccatcatatcccactctgaactaccttcactcacaggcaactgctgcgccatgaactgggacagtgccgctatgctcctggcacagttgtgaggcttacgagcgatcttgggtcctcctaccgcattgttatgtacactggacgccatgcactcccagatgtggaggccaacaccaacgggcagggtatgtgcctctccccaggaaacggcatggcacatgatacccctgtcagacagnnnnnnnnnncatcatcatgaagcgcatatctatctttgggtctgacctccaagccattgcgagtgaagcccgcacagtctctgaccgtgggagcttcaccggctgtgaagttttttggttagtatgagatcgcccatgtcgttcagatcccactctgaaccaccttcactcacaggcaactgctgcaccatgaactgggacagtgccgctatgctccnnnnnnnnnnnnnnnnnnnnnnnnnnnnnnnnnnnnnnnnnnnnnnnnnnnnnnnnnnnnnnnnnnnnnnnnnnnnnnnnnnnnnnggccatgcactcccagatgtggagactaacgccatcgggcagggtatgtgcctctccacgggaaaaggcatggcacatgatacccctgtcagacaggcttcacactatgctgactcagccccattattgatccagggaatctgtgtgcaacgctgtgtatggaccagacgagggtgaggcggggccaagacccaaatttctcctgggtgagatatgctcctgaaaggagccttgtagccgtgccgcaggaggagctgaagaggtgcatcattggtgggtatggtcatgagtctgttggtgatgccctgattacatgtctgattactgcctgttggacaatagctgctgctatgctgagctactccctgaagttacgtcaagcgcttccccttctcagaatggttgaagctcaggcccggcatcggacgtttcttcgattcttgggacaggatcctctgctccttcgttccaaactgcgccctggccgctctgaacggccaccttccccccaccgcgctctttcaagacatgcggaataattatgtcgcgctgcgagtgagtccaggtgcaggtctttcgtatgtgagtaatacagggttgcacatgtactgacaccactgctgtccccgcaggtgggtgagaggaggaaagaaaatccataccttgagctagccaaaaggatggttagcagatggtgaagtgcctctgtgtgtgtacggagagggtgtgaaggcaacaggaggtcatctctagcactatgggatatcatcaacaagccagcagctgttcggattgtttgttctcattgaattatgcaaggtctccatttcnnnnnnnnnntaaggcaacaggaggtcatcactggcactatgggatatcatcagcaaggcagcagctgttcggattgtttgctctcattgaattatgcaaggtctccatttcaaatgcaacatcgctttggaggagccgggtacgccatggagggcgtgcatgaggcttgtgacacagaatagtggagcacaatctaaatcttggcaatcgatttgaatcagccaaacatctggagggtacatgctcttaaagacttcgnnnnnnnnnncgtgacacagaatagaggagcacaatctatatcttggcaatcgagttgaatcagccgaacgtctggagggtacatgctcttaaagacttcgcggtggttcaacagatagtccagaatcggcgacaggcgcagcgcacggacacacgttcggacagccgatggagtcagcgagagacacatgcaatggaaaggaatacggcgcattcgcagattctcatgtggggtggaggggaggaagggtgacatttagaaaattatggttgccagctggcagggtcattgcttctcagttcgcctcccccggatctcgctattggtagagcgatgctccaaatcctttcgcgatcaaccttgtaatgtgccaaatgtatatagaggnnnnnnnnnnagcgcattcgcagattctcgtgtgggggggaggggaggaagggtaatatttagaaaagccatggttgccagctggcagggtcattgcttcccagttcgcctcccccggatctcgctattggtggagcgttgctccaactcctttcgcgatcgaccttgtaatgtgccaaatgtatatagaggcatagtaaaaccggcatttttagcgaaagcgctctcacgacgtctcgtaaatattctggagcgcagtgcaaccaggccatgtctcctaatggcgcggcgccaaatttcatccacatccttgttcgaactggagaaatattgggtgacttccttgaggatgcagccatgtgtcgagtaggcttcacatgccgggaagcatgggcttacaccgacaggatctacttcccctacttgtacgcacttcgatgggcaaaggcgccttccgcacactatcctgatggcannnnnnnnnnggacaggatctacttcccctacgtgtacgcacatcgatgggcagaggcgccttccgcacactatcctgatggcattggcacacgggcaacagcaagcatctatggcgacaggagtcgggtgaggtgaagtgtcttgtctgcaaggtgcgtatgcatggcagctttgtagcagggtctcaggccgagccacagtctcccccaggccgagaacgaagcaattcgcgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncggggttgatgtggtggaccaggctctgtggttggaagggaattgacaaggtgcaccataatgcccttttgtgacagggactgctgacaggctggatcaagatgcctgtgacccagtgtgggaagcgattctgggctgtgctcatctcagactttctcaagggacactttgtcaagccaagtgaggctcaatgtctagcccaaggaggacgactcggtccctccctgcactcatgcctcatgcgcctggtcaacctgctggtgagttatgatgagggtcaagagcagggcagcgcaaccgcattgccaagatcttggcgtgcagacgccagtggctggcttgtcaggagcaccttgagctccaggctctgcccaaaagaccctatgacatcttagtgccttgtcactcctcacagcacttgatggctgaccccagcaacccagtttcaacaccttcacctcctgatatttgggaaccagtcatgaccaaagccaggacggcgctggcagagcaggagacaggtgaactgggactcaatcttgaatgtccaagcttcattgaggctaactttgtttgaaaaagacaggagtttctgtttactcgaggctgtcggttagaaatggctccgacctgtctggtcgctgcactgcatcctgcagcaaagcaccctgtcggccacgcacactcctaggcatggcaactaaggctgcaaattacgcaaagctggagtgtatagtccgcgccctcnnnnnnnnnntggggttgatgtggtggatcaggctctgtggttggaagggaattgactaggtgcaccataatgcccttttatgacagggactgctgacaggctggatcaagatgcctgtgacccagtgtgggaagcgattctgggctgtgctcatcgcagactttctcaagggacactttgtcaagctaagagtggctcaatttctagcccaagggggacgactcggtccctccttgcactcatgcctcatgcgcctgatcaacctgctggtaagttgtgatgagggtcaagagtcgggcatcacaacggcattgccaagatcatagcgtgcagaggcctgtggctggcttatcaggagcaccttgagctccaggctctgccgaaaagaccctaggacatcttagtgccctgtcaatcctcacagcacttgatggctgactctgggaaaccagtgtcaacaccttcacctcctgatatgtgggagccagtcatgacgaaagccaggacagcgctgggagagcaggagacaggtgaactgggactcaagcttgaatttccaagtttcattaaggctaactttgtttgaaagggacaggagtttctgtttactcgaggctgtgggtcagaaatggctccgacctgtctggtggctacactgcgtcttgcagcatgtgtgctccaagcaccctgtcggccactcacactcctaggcatggcaactaaggctgcgaattatgcaaagctggagtgtatagtccgcgccctctttcccacacccggcgtccctgatgaaacagaggtgctggcactctggcgctgaggcacacagcgtgaagttgagagatcttgcattttccctcaaggccctgtgagtgaaacaacctcctgcatcccctgttcgtgtagggtgagcaaccctatttcgagctagctctggtcagcgaaaactcagctggctactgccccaccattctccccgactttgccattgacaagtgcttgacaccctgtcaagcctacttggtgctcctcctggtaagagcaaggagtgattgagtgcccattgtttatgctgcctggattggacttgttatggtgcacctgcttacggttttccacacgggacgacgcttaaagtggccactgaccctcgcaggttgccaannnnnnnnnngcgtttttccaaacgggacgacgcttaagtggccactgaccctcgcaggttgccaactccctttccgtactcatagagccttggcgaggcaggggcctagacttcagagggagtgctttcgctgtcgcccttgaaaatggggagggacgccgcccggtgtgcatggacctgtgcttcacaaagccgccagaggcagggcgtgctttgtggtacggtgggctgtgctcagggttcatgctgagaggcttgggtgaggatgtgtatgagctcgaagggcagaggaagcatgcattaatcacgtcatgtggcgctgcgccagtgcacacgccagcgttcagcacatgagaccctttcccctttcacagcgtcctgcgatccagaggaccgacagagcccaggctgccctacgacctcggcatggaggaggacagattctggttagaacgcatgctgcatctcnnnnnnnnnnagacagagtccaggctgccctactacctcggcgtggaggaggatagattctggttagaacgcatgctgcatctcagcgtgcagggctacgtagacgctgttgcaaaggaatgggtccttccaaggtgctgtagagttcagtaagctggatggggctcttctcctcggtctggcacatcctcaaagcgctccctgcctgacgcactcggcagactgctgtcctgcacctactcttccacacccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcacatgggcaggggaactgaggggcggctgaggtcctgcgccggggcagcgtgagctgccgttgaagcacgtgccccgcacctcccacactccctcctgctctgnnnnnnnnnncgttcagtaagctggatagggctcttctcctcggtctggcacatccttggggcgctccctgcctgacgcactcggcagattgctgtcctgcacctactcttccacacccgcacatctgtcccttccacccccctgtcaccgttgattatcgcagggacgcatggcgtgctcagcgtgcacaaaccttgctgggagtactctggagccaagctggtgccagaccatacccgggtgacacgagacccaacgcataccatcagctacagccggtgtgtgaacttggccctgctgatcacatgggcaggggacctgagggtcggcagaggtcctggggcggggcagcgtgagctgtcgttgaagcacgtgtcccgcacctcccacactccctcctgctctgcagatctggcagcattggcacctggcccacctctttgatgccatgacaattcttaaaagtggtggcatctcgatgaattctgaccatcgggacccagaaaccaacggcctcatcaccatcccgccaatggcagagtaggaaactggcgaggggtcgctgggagggctgcctgcagatgatagcacgggggttagccactccatgctgtgactctactcctcaaccttgtggcctgagagcccannnnnnnnnncgtggtggcatctcgatgaattctgatcatcgggacccagaaagcaacggcctcatcaccgtcccgccaatggcagagtaggaaactggcgagggggcgctgggagggctgcctgcaggagatagcacgggggttagccactccatgctctgactttactcctcaaccttgtggcctgagagcccagccgccttggagttcaaatcctcctgcgggcctcttcactgcagccaactgcagcggcacgagcatgggctgtgccgcttccggcccggcacggttgtcagcgccgtggatcatgttcaggcctactgcatcgtgatctacacaggctgcgagagggaggaggggacctggcacccagaatacatcccaggtgggtgggtgtgggaggacatcgacctcttgcttggcatcacagaccagcatgcctaattcctggctcagcccaggccccttcccctgttcaccaggctcaatctctgcatcacagacaactactgcgcgctgctgtgcctgaatcgcacaaaggtaccgacggtgaatgacatcgctgacgatcccatcaactttgttcctgaggatcagctggagcccgtggatgaggagcagctcaagaccagcattccaggcnnnnnnnnnnatgttcaccaggctcaatctctgcaccacagacaactactgcgcgctgctgtgcctaaatcgcgcaacagtgccgacggtgtacaacgctgctgaagacccagtccagtttgttcctcagtatcagctggaacccgtggacgaggagcagctcaagaccagcattccaggcgagttgagtgaccagggattcggagtgagggagcctgactgggtgaggaaaccggccctctgacgtggcgtcgaattgcacaggagctaattccatgccagacccgatcacagagtggttggagggtagattcgacgtcggtcgctactttgagtgctgggacaggtccagctgccactttgttcccaatgctgccacggccagcatnnnnnnnnnnccagtgctgggacgggtccacctgccgcttcgttcccaatgctgccacggccagcatcaatggccaccctccacaccactccatcttcaagccgtcgaggtattgatgaacgtgcaccattgatggtgacgggcaaggattccagtggcagtgttttggatgcaccatgttactgctgagcggtgaagaatccagcgcttgggtgctcctctgnnnnnnnnnngttctggaacgggtccacctgccgctttgttcccaatgctgccacggccagcatcaatggcctatccagccacccctccatttagatgtcgccgaggcacttgtgaaagcgcatccttggtggtgccatacgaggctcaaattggcagcatcatagatgccatgtgcggggctgttttggttagcccaccagcgctgaagttcccctcatcctgcatgtgtacgctcgtgtgtagaagatcctggcttgacccaggctatttacaatccaactggtcggcatccttgtgcctggtgacgggatggtcgcacccgagtgccactggaagaccagtgaaaccccactcagcagaatggttaccacctctgcatgtctgcatgtatgaccgtctcgtcaccccccgaccgagatgaatgagcttggctataaacatagcatcattataagcttagctccccaaaagctctacccaaggcgtcgaacatctgtaaatcttgtgagcggcgacatcgtgatgaactcggaaggatgccctctgtgacgtgctctgatgaacatcccccgttcctccaattcattcgacatgatcagaccatatggcacactgcgtcacccaacagcgcacgtcgatgacgtgtgattaccacctctagaggggtcttttgatagaggtaccttctaacgccgggcatggattccaacgagacgaacactggagggagacctgggaaggtggcgcatccactattgacaaccttgctgacacatcatgaaatcttttgtgggctcctcgatgcccagagcgtgtgcagtctcgctggtgccagcaaggaggctagattgtacctgtcatccaccttcatgcattggattgaatgggaatgggagactcaacggatgatggagtctccctctccccatgggtctggcttatccaggagaaagaggaagcgaagaatcaggaacaacgtgagttttgccttgctggaggctcctgttccccgttccagcaatgatgaaaagcctggagtgtacttcatgtgcaggaacaacatgaggctcgtgccgcgctcacatgtctacaatggggtcgtgagttctgcgcagcaaatctgttctacctccccaacctgaggcccggtgtggtgcaggtaggtcactgggtcatggcccagcgtgcgcgcctggggtgcgctccccaagggggtggggctccctgactgccagaggaggcggccctggattcctgcaggcaggaatcacagcgctgccttgctctccgtcgttttcacacaggatctgctgcgggattggagagccaggccagtcacacaatgtggcaagaggttctggggtgggatgttggatgactacctcagggctgcggagcttgtgcatgcaaaggctgccagcatgctccaaggggggtggacgacgacaaacacctggccagccctcctcattctcatccttcgactcgtgagtggtgcatgcttccagccaggcatgcagtgccacccaccgcgtggctagacagcttgacaagattactctatggtgaagattgcatatacgtactggacacactcaacccctctgcatcttccccccacaataacagcacatcatgtacactcctggacgcaccgtgcgcacagagcacgaatggcgaatgtgggaacctgtctttgacagagtttcgcgcagtttgcgctgtcatacttcaggtaggccgaggagttcaaactggttctgaaatgtgatttgcctggagtgttgagggcaggggcgcaagcaacctggtgttgatgccacaggcatgtcagtcagggtctctggaaatggtcccagcgagcagcatgtgcaggacacccacatgccagtcttccacccaccttggaactccttatgggcgcagacaacgaggcacaaggtctacagaaggaattcttcatcattaaatgcatggcccgagccctcttcccggaccagggtatctgcgcaggatcagaggtatggagggtcgctgaggggtggggatgggctcattgtcgtcttgtaaacctgccacgaagttgatgcgacctttgacacagcgctgcagcttgcaagcgctcttttctaaaccccaaattgtgcagggggacctgccgctcttttcccttcggccctactcccaggatcctgcagaggactattgccccacagtgttgccagacttcctggagaggacctgcctcaccccctttgaagctttcatagtccttcagatagtaagtgacctgggggcaccttcttccctcaaacatgattggaatcgcctgcacctggggtggtacccaacctaggtcatgtagctgcttacgatttcccgaccccgctcctgcaggtcatctatagatttgaggtcgcggtgtcgcccaagcctggctgggagactgacctgttcagcactgtcttcagcatgcgtgggaggaaactcagacagatgaagcagcccataaacatccactttgaacnnnnnnnnnntgacgaggatctcatcatgcactacgccggtcactcccccaggacgagaccgtggcacttaaagcgatagcgcgcctgcagtgggatgaaagatggtctagggaccatctttgcgatattatctgcctagggttctcaaagttgcaggtattatgtggtttcatattgatgtggtaccggtgctggattgtgtgctgggtgtgacttgatgggacaggcagtgaggcaagaaagaccttaccaggtacgaaattcccccgttgtgacagggactcctgacatgctggag

SEQ ID NO: 42942 - DNA, 61 bp, Chlorella protothecoides
atctaaatttcaatcagacgatgcggcagggcaggactcacatcggccacggctgggaggg

SEQ ID NO: 42943 - DNA, 67 bp, Chlorella protothecoides
gaagctcaagtggccgggagcggctcgcgctgcatggagacagggtcgtgtggtagggaagtggacc

SEQ ID NO: 42944 - DNA, 61 bp, Chlorella protothecoides
cgtgtagagctggacctcctgtggcggaggggatgagggtggggtgaatatgagaggctct

SEQ ID NO: 42945 - DNA, 4391 bp, Chlorella protothecoides
  modified_base (209)..(262): a, c, t, g, unknown or other
  modified_base (1677)..(1686): a, c, t, g, unknown or other
  modified_base (2634)..(2643): a, c, t, g, unknown or other
  modified_base (3539)..(3548): a, c, t, g, unknown or other
  modified_base (3734)..(3743): a, c, t, g, unknown or other
  modified_base (3820)..(3829): a, c, t, g, unknown or other
ctgcggtggcagcgctggcggcggagccgcgcgggggcggtgcaggcgccgccgcgcccgcgcaggagcacgtgttggagagctggcacgggtcgcgcgccctgcggcgtctggcgctgcagggcagcgaggcgcggggcggggaggaaagcgcgccccggcgcttcgtggccgcgctgtggcggggggcgctgcgcggacggggcgcnnnnnnnnnnnnnnnnnnnnnnnnnnnnnnnnnnnnnnnnnnnnnnnnnnnnnnggcgggcacgcacgctgccaaggtcctggcggcggtgtacgccggggcggggccagaggacagggcggagatcgaggcggagctggggggcgtggtggagaagggggacgtgggggcctgggccgcgcgcttccttgcgcacagcaaggcgtgagggggtggtggcggaggagggttgccgctcgcgagatctgcgagcccctgtactcacccccagaatccctgccgatccagccctgtgcacacttcctcggcgctctgctgaaatgtacttgatacatccttactgcaatgtacacttactgacggcctggcgtgggtgcctgctggcgatttggccgagaccacaccgaacccgaacaggattcaaaagcaaatcttggcacgtgatgccacgtccataaaccgtccgacgtcacggccccatgactcatcataatcgatgtcccccggtccggctgtgcagatagaatgcctaggtctcgcatggcatcgaaacaaaccaacaacaggaaaaggtatctttgaagctccattcggcgcgtgacacctgccatagaccgaccatgacctgcgcaacgacttccgcgagggggtgccctccctccctgacagcaggtgtgcatcggtgttccctgatgtgtcagtctcagtgcactttgaccgtcatgtggtgctcataatgctactcgcacgtcgcgtaggaagtccctcggtgctgaggatacaggcgaacagtgccgtgctcggcactcggcagccaagccctaccggaccgagcatggccaccaggcccagcacctccaacgccgtgctgagctttccgtccagcacatggcctcgatccaagaataatacactcacattgagccgaccggtggcagcgaagcccaaggtacggtggatgcatttcctggaagggagaggagatgctggcaacactctggcggaagcctagatgctggatactctgaacatacaattatatgctgcggcaagaagcccatgcattgattgcgtggcctcatcgcgcccttcccctctacccatgcaggtttggaaggctccaaggctgccgcaccgtgttgagcttaccagtcaagaaaagaaggagctcatagctctcaagacggagaatgagttcctcaggtaggatggttggacatgaatgtgccaacgagtgagagcagacgtgattactctggtgacgtttcacagatacactcggcttgaccctgaaaacccacttcctccattccttatctgcaggcactacttggagtgcctgcagcgccaagaacagggactcgttgcgctgttgcagactcaatgaataaaggcggatcgcatgccatgcacaccgagcgagctcccaattgtcaccaccatcccctcaaaccatgtcctgcgccgcnnnnnnnnnngaaggcggatcgcatgtcatgcacaccgagcgagctcccacttgtcactaccatcccctcaaaccatgtcctgcgccgcagttttcggacgtgagaggtgggtcctgcacaaggctccacatgtccacacatccctgagattttcctatttgttcctagcgtgtatcgtcaacacatttcccaagtagcgctcgttggtctttgtgtagctcaatctttttctgtagccagtcatcgcaccctgtactctctcccttccgacttgtcatacttacagcgaccatgtgtgtaggaaccctggacacactacagaatgcggcaaagggaaagttccgtggcgcccccacgagaggcaagggtgtcaacaggcgcgacctgcgtgctgcgagactcctgtgcatgcggcgacggagagtggtgcgggcagggaatactatgaggagcctcgacactagctcaacaatgatgccaagagtgcatattatatcaacacctccaggctatcaaggccttgcctgcgtcgtcctcgaaatcgactcctagacctccccgttatgctgtactgaggggccccagggggcatcgcacgcacgatggtggtggccaagacaaactaccgcattgagtcatcgctggaagtgttttacaccggaggcccggcggccctgttccccgatggagaccgccttgcttgcgcatgcggcgacgaaaccaaggtgctggggtggcagggggtgtgtgcgtgcaggagcaagacatgcgtagatactcacgatgaatattttcaaccctggcagatcatcgacctggaaactggcgccgtgctccgctccctgcctggggtgggttgcgctttgggccaaggatcagggaccagggagcgcacccatgctctcgctgcgtgcatgctgagcacgctgcattcttcagtgagttcctcggtgacannnnnnnnnnggctgcgggcatgctgcgcacactgcattcttcagtgagttcctcggtgacacgcgctctgacctcttttttctccacgccgcaggactctgagcccgtgacagctctggccatcagccccgatggacgcaccatcttctccgccagccgcgccctgctcctccgcgcctggtctgcggagacgggcaaggtggtgcagacatatgtcgggcacaaggcccccgttgccggcatcgccgtggaccccacgggctccctcctggccaccgtctccgccgaccactccacgcgggtgtgggacgtggccggcggcttctgcacccactcctttgggggtcacaggtagagtgagggggtggggtgtgctggaagtctgggtgggaagggcgtggttggggctgggttatttggcccagggcggccccccaaaccccaacaaactgcacggcccttaagatccgcctccgtgagcggagtcccagcccctcattcctccctcatgggggatgaaaggtggcggctgggatctgcgcatcactgcaatggagtgccgctcgagtcatagctgtgccacacgaacgacggcggggtgcgggtggttcccacccgcaccccctgggcccgcgccatgttcccatgtcacccatcggacctatgacctatgggtctgattcctcgtgactgggtgccgtgtcaaggacgggccgacatccccgaaccccccttcaggacctttagccatttggttgtgattttgtgcaattatggaacctttctccgcgatttcttgattctcacacagcaaacctctgcatctcacccgtgctcttccttccatcagtgccttgggctcacaagacttcgcccccgatctggcaccagactggcacgaccgnnnnnnnnnncccccgaacccccttcaggacctttgaccatttggttgtgatcttgtgcaattatggaacctttctccacaatttcttgattctcacacagcaaacctctgcatccccccccgtgctcttccttccatcagtgtcttgggatcacaagactgccaccccgatctggcaccagactggcacgaccgnnnnnnnnnnctgcagcagaggtggggcacggaggtgggggggcatgccagtgtaggacagcatgttcagttgttggttccagcgtnnnnnnnnnntggccgcaccaacccctactcatcccacctgtcgcccatctttccaccaggggcattgtgctggccgcctgcttccacccccacgagatgctgctcgtcaccgcgagcgatgacacggagatccgggtgtgggacctggtcgccaagtcttgcagaagaggtggggcacggaggtggaggggcatgccagtgtaagacagcatgttcagttgttggttccagcgtatctccttggctgcccctgaggatgtgcgacagggcaacctattcctcgtgcccctcctgtccaccacccctcacgaaccctgctcgcccacaccgccgccgtccacgcagtcctcaaggggcacttctcggcggtgacctgcctgggcctgtctgccgacggctggaccctggtctccggctcccgcgacggcgtctgcatcgcctggaacctgcgctccggcgccaagctttccaccacccccgtgctggaggccgtggaggcgctggccgtgctggaccccgggtcggcgctggccgcgggcgccgcgcccgccgcccccgccgccgtcttcgc

SEQ ID NO: 42946 - DNA, 61 bp, Chlorella protothecoides
gggcgtgtggtatggcggtggaagcaggggggggcatgtgcgacgaggcattgggcaccga

SEQ ID NO: 42947 - DNA, 74 bp, Chlorella protothecoides
accacccctacatcccaccccccaaactcccgtcctcccgcagacgacctcagcgacgatatggtgcagggaca

SEQ ID NO: 42948 - DNA, 61 bp, Chlorella protothecoides
ccgcgagctcgggcagggcatgctggctggggccctccatcccccacgccgccgagtgagc

SEQ ID NO: 42949 - DNA, 73 bp, Chlorella protothecoides
tgcgtcaggtatcacgtgggagcgtcactgaagttgggtttgcacaaggggtcgcaggatggccagctcgctg

SEQ ID NO: 42950 - DNA, 94 bp, Chlorella protothecoides
gcaggccgccgccttttgccaccccctctctcaaggtgggagcggatgtggcgtgctttgcacttgacgtgccgctcgtagggaatggtatcag

SEQ ID NO: 42951 - DNA, 74 bp, Chlorella protothecoides
tgtaagataagctacaggagcagctggtctgggacaaacgcgttcgcaaggaggatccctcgaatgaattcaaa

SEQ ID NO: 42952 - DNA, 61 bp, Chlorella protothecoides
gtgtgcgtcgcgaatgaggaccggcgggcggggtttgaaagaacacgacatcccggccaga

SEQ ID NO: 42953 - DNA, 61 bp, Chlorella protothecoides
tgtacttgaccgtctgtgcttgagggggggggttgagggcggtgacgggggagggcaatcg

SEQ ID NO: 42954 - DNA, 61 bp, Chlorella protothecoides
aggaagtcactcagatgggggtgcagggggtgtgcaaggcaatcgcatgctttgctctggg

SEQ ID NO: 42955 - DNA, 10016 bp, Chlorella protothecoides
  modified_base (125)..(134): a, c, t, g, unknown or other
  modified_base (396)..(405): a, c, t, g, unknown or other
  modified_base (905)..(914): a, c, t, g, unknown or other
  modified_base (1863)..(1931): a, c, t, g, unknown or other
  modified_base (3718)..(3747): a, c, t, g, unknown or other
  modified_base (3818)..(3827): a, c, t, g, unknown or other
  modified_base (4297)..(4306): a, c, t, g, unknown or other
  modified_base (4603)..(4612): a, c, t, g, unknown or other
  modified_base (4865)..(4874): a, c, t, g, unknown or other
  modified_base (5064)..(5073): a, c, t, g, unknown or other
  modified_base (5201)..(5210): a, c, t, g, unknown or other
  modified_base (6154)..(6163): a, c, t, g, unknown or other
  modified_base (7146)..(7155): a, c, t, g, unknown or other
  modified_base (7498)..(7507): a, c, t, g, unknown or other
  modified_base (9094)..(9168): a, c, t, g, unknown or other
  modified_base (9340)..(9349): a, c, t, g, unknown or other
  modified_base (9446)..(9455): a, c, t, g, unknown or other
  modified_base (9552)..(9561): a, c, t, g, unknown or other
gccgcctggcagctgcggcgcctggtggcgaccggcgccgcgcccgccgcgccgcagatcctcttcgtgcccccgggctgcgagctggcgggcgcggcgagcggcgcgacgcacccggggtcaannnnnnnnnngccggcgccgcgcccgccgcgccgcaggtcctcttcgtgcccctgggctgcgagctggcgggcacggcgagcggcgcgacgcacccggggtcaagccccctggtcctcctggggccggacaggcactactccctcctgcgcagggccggcgcgggcgcgggagtggccgtggcagcgaccatgaccggccccgtcgccgcggcggaggtgggcggagacccggttcgatcgccggcgcagggtttgtcggccatgtttgcgnnnnnnnnnntgtggacggggacccggttcaatcaccggcgcagggtttgtcggccatgtttgcgccggaggcggcgggacaggcgggggacaaaagcctcgcgcggggcaccccgctgggctctgccgcgccctgggccaccctcctggacgcaccctcgcacgtgctgccgtctctggacgcgctgtgccccgccttcctcaagctcctgctgccggaaggagaggtcgtgtgagcgcccacccgatattccttggacgctgctccgcccgctctgttctgcacccttttaccccccctcctcccacatgtacactccaacactggtcagggggaggtggaggtgtgctgagaatgcaggctgggtggggaacaccgatgaggcttgccgcgaggatggagggcagcgcagaaatgtggcatgattcttaggccgctgtgggtcatctacagggacaagggcacaatctcccccctcgctgcgatgttcaccagccgaccacggccannnnnnnnnnaaatgattattaggccgctgtaggtcatttacagggaaaagggcacaatcccccccctggctgcgatgttcaccagccgaccacggccagggttctggagagcgcgggctggagcacggccctctccagcgcccccagcgccgcagcggtggccagcgaggcacaccacacagccaggaccagagcggccaggccgacgaggggcgccgccagggtcaagcgcagcaatgccccccggggcgccagccaggcctcggcccagtacatgacagggatgtgcaggaggaatgcgtgaaacgtatacggctccaggggcgagagccggcccagggcgcgggccggggcggcgcggggaaagagcatgagggcagccaggcctgtggccacgaggaaggacacggggagggaagcgtggtagcccagggccgcccagacagcgctggcgcgtgcaggccaggcctgggccgtggcgcggtccggcggggccagaaaagggcgccggagggggaccagcgcggcccaggcagcgagggccgccagggaaaccgccgcccaggcgccacgccggcggcgcagcgccgcccagcgcccggggtcgagcaccaggaggcccagcagggcgccgaccaggaagttggtggcgcgggtgagggtggagtagtagcccagggggccgtggaagtagctcaggattggctcgatccaggcggggtccagctgtcggagcgggtgggtgaccgtggggtgagctcgggggttggggccgggttagaggcacagaggcgggcatcagcatccctgcaacccctttcccagttggtgcgtgctctttgagtgcacttgctgtccccattcatcttgcacaccggtggatgctctgaggagatgatcctctcacccccaatcacagcctcacatctgggtggcccagggcgggcagcggcagggnnnnnnnnnnnnnnnnnnnnnnnnnnnnnnnnnnnnnnnnnnnnnnnnnnnnnnnnnnnnnnnnnnnnnggccaggcttatggcaggaatgatgagcgagaagaggatggccgaggtccgtgccaggcgctctggtccgacgctgctaggtttgtggtgttggaagagaagtcgagtcaccgccaggtccgtccagcaggcagccaatgtgtgtcttggcacggcaaacgaatgtagtcaagaatacacactactgcaaactcttccaaaagccacggcggtgggtggagggaatgtcagccagaatcatccccctgcaggctggagtcacctggtatggagcagggccagcaggagagggtataccaggaagaggtgcagctgcactgccacagtccagtacacctgccccggcacatggcagacaacttagtaggacacccattcaatcctgcaacaaggttgatggctgtctccctccctcacatccagctgcagggccagccacatgcaatgcctcagccagcaaccactcaccacgccgcaccctccaaatcccacggcgttgttcagcagcatgaagttgagggggaggctaaggtggcaatactccatgcacgtgtcgtgatttttcttcagatggtgatcggagggaaggtggtgatctatggcaaatgccaccgccagctgcaccaccaaataagatggcaaaatccttgccacgcgatttctgcaggcggtgggcggttgggatgataaggcctgggctgggcatggcgacgcaagtgggcagttgggcttgactggaagcaaaatgcggcatcgcagtcacgttctctccccactcagcctttctgggcacaccgcgcgcacctgtagtatttcctcaccacatggatggctggaccgtgctctttttggaaagcagggaccagctgaagggtggcccagaaccctgagaggaccagaaacacgtcgggacccaacatgttttgccataacgcctccagcacgatgttgtgggagagcagctatagtaagagattgggggttgaagcctttgctcgggttgagatgtgactctcatcaacaagaggcggtgcaggtcggcacagcctacctggtgcacagtctcgggtgagagcaggaggccccagtacatgaggcaatgaaaggcaatcaccccagcggataccagcacgcgcaatccgctgagagccgcggatgcgccggggctaagagcctccggtctacagctgacattgaatgctattgccggctgctggatttgacgaacttctacctcgaccatgcggacgcgcacgttgattcttcaatattcaattggcccttcaatacttgcagcacatcctgcgcatagcatgtcaatgtccaaccggggccatcgtgggtatgggtccagcgtcctgcatgagctgatcgccacgcacttcgcctcgtcgtctcctctccgaccctcaggctgattcgacacttgagtgacacaaaatcatcagtggaatacaaacataagtttgtgtcttcgtcaacaggtcaaatcgagacctgtgctgtcctggcagtcgaacaagatcatggcggatccgacgacctacaacggcacatggagaaaagatgcagctgcctccgatgacctcaaacccgtatccgacatactacaggcaggccggatgtgtcaaaattgtgccgatcagactgtatagctgcctcgatcgatttccaagtacaggtgcgcatcctgatatccgcagttgggctggctggtccgcaaggcactgcccctcatgaacacgctgaccatcgagagctcgccgaccgagttcaagagcagagcnnnnnnnnnnnnnnnnnnnnnnnnnnnnnngtggctgtggatgatgttcccgtgagtgatctctccccgcctgcacgcaagatcgacgactctcaaccatnnnnnnnnnnatggctggggatggtattcccttgagtgatctctccccgtctgcacgcaagatcgacgactctcaaccatgcagaagcgggagcactccaggcgcgacaatcgaaagggaaccttcgagggatacctagtacccaaagaagatggaattgaaatcaagtgagctgcctgaatggcgtccatgggtgggactgggtactcgaatcttggcaaaatccgggcggcagcgcggtgatcacctgtccagctcaggacctctgcgtaccacacaaaccgatccgcagagctgtctgggcagacccgctggccggccagaacgtcgacttctaccgcatttcggaggacaaggcaacgctcaccatgacacagagcatcaaggcacgagggaaggccatgtgtgtgaagagtctctgtgctcatggtccatgccctcttaacgcgatccccgttgcacttccttgctgcaggtggnnnnnnnnnncatgctcatgttccatgccctcttaacgcaatccccgttgcacttccttgctgcaggtgggggagaaagctcacacctacaagaccgtgtaccggcgccagtagctagtatatgttgcgtgcttttgttcaagcacgaaatgaatccgctttagcctgactgtgtttcagccatatggccccagaggctgactacagaaatgcacttgtccatctgctgcacgccccaccttccatcgtggcactgcgagccagatggactcccgtaatcttgaaatgtgatccgggcaggcaagannnnnnnnnncgtttctgccacatggccccaggggctgactacagaaacgcacttgtccatctgctgcatgcccccaccttccattgtggcactgcgagccagatggactctcacaatcttgaaatgtgatccgggcaggcaagaaggcagcttttgaacacatagtggaccccccatcataaaaggccctctggcagcaactcattaaaaccagctcaagggattagatttagatctaggatgctcatcctgcagtggtcannnnnnnnnnggtggaccctccatcatagaaggccctctggcagcaacacgttgaaaccagctcaagggattagattcagatctaggatgctcatcctgcagtggtcaatcttataaaccaacaatactgccacagatttgtatcatctaaaagcatctgactgacacctaatctgagggtgggagtggaggcctgtcannnnnnnnnncgctgccacagatttgtatcatctcgaagcatctgactaatacataatctgagggtgggagtggaggcctgtcacagggagagcaggtgtcccgcccgggcatgtatgatttccatgaagcgggcccnnnnnnnnnncgggagagcaggtgtccccgccccggggcatgtatgatttccatgaagcgggccccgggcgccattgcctgggcatgcgatcatctaccatctacctgggccacatctgcccagcctgtgccagaagggcgcattcttactcaaggacagccgacgcaacctcctcgaaatccccctcgcggggcaacgctgccatggcccccctgcgcgggtcctgcctggtcttcgacctggaggcgtgcgtggaggaggtgccccgcctactcccccttgcctctttgtcatcgtgcgccggtgacgctcccagctgcagcggcaggagggtgggaaacctgcggacgagggccccccgggctgctggccgccagccctgccttgtgctcaacctggcgagcctgggcgagggcgaggtggtcacccagcgcctgtccttggaccgggcgattgccgatgcacagaccgcgctgctggccttcctggcctcgggcatgcaccgggccagggccctgccctctgcttccagacgcctcattgctggcggcgtgtcaggtgggccagggctgtgggaggtgttgcacaatgcacatgtgccggacctggaagtctacgcagaagtgaagagtggaactgcggccatgtctgtgcagaggatggcaggccggtctgtgccgaaggggggtctcgtgatggacctccctgcatagtttctgtttcattctcgccccatctccttgtacatgtgaatgctgccaccccctttccgggtgggggcctactctatatgccacactcgcacgccgttctggtggcatgaggcagaatgcacttctctttcccccctcacttgttctctgatcccaccgaagtgccgacccctaccacccaacccttcctctccccaaaccacatcaatcgaccaggtgccgtctccaagaccgtgacannnnnnnnnngtgaggcagaatgcacttctctttccccccacacttgttctctgatcccaccggagtgccggcccctaccacccaacccttcctctcccaaaccacatcaaccgaccaggtgccgtctccaagaccgtgacagcgccgctggagaccctcaagatgaagctggtccagggtgggagcgtgacggtggtggaggcggcgcgcgcggtgctggcctcccgaggcgtgggcggcttcttcgccggcaacaccatcgacgtcttgcgcaccgtcccctccaaggccctggagctggcggccttcgactcctacaagcgcaccctgcgcgccacaccttgggtccccgaccgcgccatcggcgccgtggcgggcggcctggccggcatcacctccaccgtcgccatttacccactggagacggtgcgcacgcgcatggcggtcaacggccacacctttgtgcagacgctgcagcgcgtgggctcgcacggcggccttccgggcctctacagggtgagccggcaaggggaggatgagggggggagtgaggggcctaggggggtgggggtgcaagttggcatgcccaagagtgcaccgggtcgaggaatcctgcgccgcacttgcgccgctgccgccctccctgggcatccatgcgcatgcgcgcggaagctgatgcagggatccccaccgcatcccctctcccccaccgtcgattgcactgcagggtttggatgcgagtctgattggcacggtgccctacacggccatccgactgggactgtacgacgccctcaagtactcctggaagcgggcgaccgggaaggagcaccttgaccctcaggcatcgctggtgtttggagccgtggcaggtgtggcctgaaggggtttggtgcgggggctgtttggccgctgcctgatgcaggcagcagacttgatgctcgtccacactcgtccaatcgctgccagtgtatattcgtatgctttgcacnnnnnnnnnnacgggggctgttcggccgctgcctgatgcaggcagcagacttaatgctcgtcgacactcatccaattgctgccagtgtatattcgtatgctttgcacgacttgatcgcaccaccattaccgcaccccttgcaggagtcgtttcggcgaccgtgactttccccctggaggtggcaaggcggcggatgatggtgggggcggcctacccaaatacggccgtcgccctggcaaccattgcacggacagagggcgcctcggcgctcttcaacggtgagcggctggcgtggggaggaggtggggccaggttctgcaatcccctggctgacccgaggaggaccagggacnnnnnnnnnnatggcgtggggaggaggtgggggcaggttctacaagcccctggctgacccgaggaggaccagggactgaagattcaggggacaaagttctggcctccacatcgcccccgaggggaggtgagtgctatgtctcatcacagccccgcaacatcccctcccccccccacctacacacttcaggcgtttggctggcgttggtgaagcaggcaccccagtacgcgatagggttcatggtgtacgagcagtgcaagcgagccctggccctctgatatgcacgcatgccctcgtgccagcccggccctttgcaactccggctcttcctcaaactctgtccagcgtgtctcgcccagcgaggcacgcaactccgtctcttgttcccgctctgtcgccctgttgccatgcagctggcactgcggctatgctcaccttcctgaccctcttttagaacattgtgcagtggagagggtgcgcccgagattgggagtacacttttagtccgggtggaattgatccggggggcacaggatactcgtcttcctccggccggcagctggcacgtccttaaccagtcagcagggagcggggtgaagcctggaaccaccatgccgtccccgagttgattcaaagttgaacgcagatatctcttcgctgttcggagttaggggtgcccacagggtgtcagagtcgggtccaccccccctttgccccagggtgcacggctgcaggtgtgcggattccctgcggggcatgggtgggggatccagactgctgtttgcgccccatgccgttttctgaggcgccatccgtacatcctggcgccatcgagcagcgggctctgttggtcgctggtgggcgggttctaggttaataatccgcggagtagctgcatcagggggaggccacaccacctggacccctcctccggcccccgaaccccatgagacgcgattcgcgttgtgtgggctggacatgcccagttcctgtccaggagcgttgcgccgtgtggatgacgccctgctcccgttccccccggacaccacaggatctgtacggaattgtgggaggcgcagggccctctggccggctctggaccccgcatcgactcgaccatccccagtaacagcatgtctccgcactttgcgtcctccaaatcacagcagacgcgggtcaaggaggtgtgtcggggtgtgtggcaacccctcaatgttggcatggagcgggcatggcgatgcgagctgcatgcccccctgcttccagcgatccccctcccgcctccctcccagccaccggcctggaaggatgaggtgccggcgaagctccacctgaccctggcgccctccctggcctccagcgaggggactcccggcagccaggaaggggccctgggacactgcctggagaccccggacgagagctccgcggggcagggcgggagcctggagcgacactcccccccgccccaggtctcggcctttgccagcgccgcggtgcagtccggggtccggggcaccgaccgcccccccgcggcccccgcgcgcgccgccaccgcgtccccgcttggatctctcagcgaggccgacgcgctgcnnnnnnnnnnnnnnnnnnnnnnnnnnnnnnnnnnnnnnnnnnnnnnnnnnnnnnnnnnnnnnnnnnnnnnnnnnntggattggaggggcggcgtgatcgtgcggtgggcccctcgacaggcgccgtggcctggccgcagcagatgcaacgttgctgggccccaacctgtagccgatgcgctccatacacacacacacacacccctccctcctcgttcacccctcctcctccagggcctggcgtcccnnnnnnnnnngcctctccgtcctgctcgcccacgcccggctccagatccagaaggaggcgcagcaggtgcggggtgctttgtcaggggttgggtggaggaggctgcnnnnnnnnnnacctctccgtcctgcttgcccacgcccggctccagatccagaaggaagcgcagcaggtgcggggtactttgtcaggggttgggtggaggaggctgcnnnnnnnnnnggcagctgcagcgttgctgggcccccacctgtagccgatgcgctccagacacacacacacacacccctccctccccgtccacccctcctcctccagggcctggcgtcccgctcgccctcgtccggcagcgaggcctcccccgccgccgacatccacccgctgctgatgcaggggctgaccgcgctgtgcatgggcagccagggcagcggcggcgcggccgtgccgccccccccgcccgcctccctgccctcggtccgctccctgggtcagatgcacggggcccccgcgcccgccgggccccggccccccatgggcaataccatcacctcgggcgtcccgggcatgcgcggtcccgtcggcttccagcgctccgcctcggtgccggggcacgtgggcggcgcagcggatctggggtcccgcgcggctgcgtgcggctcggccgccgccacgcagcc

SEQ ID NO: 42956 - DNA, 684 bp, Chlorella protothecoides
  modified_base (336)..(345): a, c, t, g, unknown or other
  modified_base (492)..(501): a, c, t, g, unknown or other
acgccctcgggcccggtggcatcgccgctgggcgcggggcactccaacgccgcccccgtgccccccaccccccggcccctgtccccgacctcgcccacgctgggcaccgatggccggggtccgccggcaccctttgcggtcgtcggcgagggccccgcgcgggacgatgctgtcgacctgcgcggcgtctccgcccagggtcgcccggtgacctggcgcgagacgtgcctgctggaatccggcccgccggtcatcgtggtcggcgaccccggcacgcaggaggacgggggcgagagcttcgaggcagtcccggcttcgggcaccgacaacctgccnnnnnnnnnntcccggcacacaggaggacgagggcgagagcttcgagggagtcccggcttcgggcaccgacaacctgccttctccaggcaccagggaccacccgtcccccacccccctcgcgccgttgccccccggcgagacgcggctgcgcttcannnnnnnnnnggccgccccccacccccctcgcgccgctgccccccggcgagacgcggctgcgcttcacggtgagcccgctgcgtcccggcgtgctggtcccccgcacgctccgcgcgctgctggccggccagacgctggaggtgcccgtggcgggccccgcgacccgcgccgcccccgtccacccccgcgacg

SEQ ID NO: 42957 - DNA, 116 bp, Chlorella protothecoides
tcataaggtccgtgctgatcggagatcccgaacgctgcgactgcaccccatgaatcgatgtccatgctgtgggcgtggggaacatgaaaaccttcagaatgcgtcttgactgtctg

SEQ ID NO: 42958 - DNA, 80 bp, Chlorella protothecoides
gccgctggaccccgcccaccacttggacgacgcagcctcctggaatgtacccacgccctgcaccctgggcggtggtcttt

SEQ ID NO: 42959 - DNA, 61 bp, Chlorella protothecoides
agggggagagggcttggtgggtggaggaggtggcagaaccgatggagtggggggtgatgga

SEQ ID NO: 42960 - DNA, 61 bp, Chlorella protothecoides
cctccccccctttagcgtcaccctccccccttttccccccgcaatccctcactgcaacaac

SEQ ID NO: 42961 - DNA, 114 bp, Chlorella protothecoides
tccgcccgcccgcctgcatcaagccatgggtcccctgtcactggcccgggatggcactcctgtccattgctccaggacctggggggggccggggcaccagaggagtgctcagtc

SEQ ID NO: 42962 - DNA, 21903 bp, Chlorella protothecoides
  modified_base (654)..(663): a, c, t, g, unknown or other
  modified_base (1687)..(1696): a, c, t, g, unknown or other
  modified_base (2331)..(2340): a, c, t, g, unknown or other
  modified_base (4026)..(4035): a, c, t, g, unknown or other
  modified_base (4270)..(4279): a, c, t, g, unknown or other
  modified_base (4624)..(4633): a, c, t, g, unknown or other
  modified_base (6246)..(6255): a, c, t, g, unknown or other
  modified_base (6359)..(6368): a, c, t, g, unknown or other
  modified_base (6471)..(6480): a, c, t, g, unknown or other
  modified_base (9185)..(9194): a, c, t, g, unknown or other
  modified_base (9797)..(9806): a, c, t, g, unknown or other
  modified_base (9991)..(10000): a, c, t, g, unknown or other
  modified_base (11308)..(11317): a, c, t, g, unknown or other
  modified_base (11814)..(11823): a, c, t, g, unknown or other
  modified_base (12067)..(12076): a, c, t, g, unknown or other
  modified_base (13401)..(13410): a, c, t, g, unknown or other
  modified_base (14669)..(14678): a, c, t, g, unknown or other
  modified_base (15831)..(16019): a, c, t, g, unknown or other
  modified_base (16793)..(16802): a, c, t, g, unknown or other
  modified_base (17376)..(17385): a, c, t, g, unknown or other
  modified_base (17588)..(17597): a, c, t, g, unknown or other
  modified_base (17950)..(17959): a, c, t, g, unknown or other
  modified_base (18656)..(18665): a, c, t, g, unknown or other
  modified_base (19366)..(19375): a, c, t, g, unknown or other
  modified_base (20138)..(20147): a, c, t, g, unknown or other
  modified_base (21258)..(21267): a, c, t, g, unknown or other
cacccacccacccacctcgggcacgttggtgaggatctggacgatgccgaagcggccgaacaccagcacggcgatgaggaagaactggagcagggaggtgaggaggacgccggtgcaggccgcacgcgcggcggcgcggcccagccccgcgcccagcgcgttgccgacgcgcgtggagcaggcggcggacagccccgcgggcagcatgtagaggagggtggagatgttgaggcacacgcccatgaccgccagcgtgacctcagggtcaggcagccaacccgcctccagcacgcagacctcaaaggcgctccactccaccaggaccatggccacggagggcaggccgatgcggacgtaggagccccagccgcgcagggccgcggagctcctgggggcaaaggggtgggttggaggagggatgggttggaaaaggaggagctttgggtgataggggtgggtggggccggtggggtggagtgctgatctcgctgcgtcagatcatcaggcaacaacacattgccttgcatgaccacatgcactctgattcctggaattggaggtattacgtgtggaaacctggagcagggggtgtcactgtggcgccagtccgagacgccctggtcccttgcacaagcacctcatgtcgaggctcannnnnnnnnnatcagagcaacaggcaacaacacatggccttgcatgaccacatgcactctgattcctggaattggaggtattacgtgtggaaaccaggtgcagggggtgtcactgtggcgccggtccgagacgcccaggttccttgcacaagcacctcatgtcgaggctcaaccgggtatactccgctggcagtcacggagcagggcgaggtccttcggatcccttgggaaaagacctccctctctccccccagaccatgccctcaataaaactgcaccagctcaccagccgtgccaggtctgcttgaacgtgccctccagccccctgttgaagcgccacgtcagccaggccagggagaccaggagcgtggcctcggtgaggtccagggccagcgcggcgccgtccaggccccaccccgcccgcagcaccaggaggtagttgtagactggggccagcaggactgcaatggccgccgaccaggtgggcagccggctctggccctgggccagcaggtagcgcgtgagcacgccatacagcgcccccgcgaacagggcgggggagctgagccaaaggaagcgcgccgcccccgccgcgatggccggctcctggcccagcatggtcatcagcggcgcggcgtggaaccagccggcagtgatggcgctgcagaggaccagcgccatgagcacggcacgctgcagcgccaggcccaccgcgcggtagtgcgcggcgccgtaggcctgcccgcacacggtctccagcacgcctgcaaaccctaggacgatggccatgcctgtgacgttgaagaagctggtggccagcagggtgatggacagctccagcttgcccaggcggcccacaaaagcgatgctgatgacgctgagaccgtaggagaggaaaccggagcagacgatgggccaggccagctcggtcatcctgggatgcaggaggacaaagggtgggggggggttggtgtgtttgggcggggcaggcagggcggggcaaccctggggctcgcaaactcggcatggggggnnnnnnnnnngtgcaggaggacaaagggtgtgtggggggggggttgtttgggcggggcaggcagggtggggcagccctggggctcgcaaactcggcatggggggcatggcacagtgcgggaccggcacacctcgacgggccccaccccctcctcactcactttgccagctcgtgtcgacacgcatcggggtcaaacagtttatcattttcgtgcgagaggacgctgcggctgggagcgggggggaggcgcggtcccgacgccgaggacatccggggggtgaggaggggggcctcatccctccaggatcccgacgtctcggcatccatggagaccttgaatgttttgtccagctcgaatgagttatcggggtggccaagatcagtaagaggcgaaacggggtacgggggttccgtcggcgccatgtggtgcgagaaactcggagggtccgaaagatccaggggtgcaggcctgagagtctctgcaatggattccaatcgattgcgactcggattgtatttcctgtgcgcccaaatcgatgagctgattggtggtgcacaccaacgcttgacgagacttgcagcacgccctccgcgcccacaagctgggtgcgcaggttctttgctgccacttcaccaattataatnnnnnnnnnnggacgagacttgcagcacgacttccgcgcccacaagctgggtgcgcaagttctttgctgccacttcaccaattataataacaaaagacaggcaggcacactgtccacaatgctccacgcgctctgtccctaggagtcgcggtccactgtgagccggatcggaggtcgtcaagcacactgcaggatccatgatttgccatgctggcaacttccgatcgtagcacatgcgcgcaacagcgcgacggccccgtgatcagaggaaattgacgattgttgcaagacagatctattaagttgggaatgatggcccatgccggcgagcaggcggctggagatgggagcggtctggcaccggccaccgtagcggtggccgtggtgattgcgggatctgcggcagtgatcgtggtgcagctgctccgttccatcgttttcagggtgaccggtatatacaggtggctcagtccgaccagggatgcacctgcatcccgcgccgcccctccccactcggacgacttcaggcaagggaaatcgagggctggaaggtggagtggtcccaacgctattcttccaaaagcgatccccgacagcccccaaaaacattgcggtgcatcttgacaaggacgatgaaaacttccaccatacctcctcccctcacagcacaccaaagcggggtcagcgccctgccgcggcgcagcacgcctccaccacccccggcacgggcctcaagtcgctgatgaagcaggcggccatggccaagcgcgccgccggacccgactttgtccccgactccgagctgcacctggccagcctgcgcagcaccaccggcgcggtcctgggcctggcctggtcggcagacggggacgccctggcggcggccactgacgggggtagcctgcaggtctggcggctgccccccgggctggacgtggcggcgccgggcgggcgccagccgccccactcctcccacgagctgcgacagggggccagcgacgtggccttcggcgcagggcccagcagcctggcggtgctcacgcggggcgagggcggcgcgcccgccgtgacattgctgacactgcccaagggcccacgtggcgacccggagccggcctggacgcggcacggggcgcacgcggccgccaacgaggggcggtgcctggaggccagcgccggcagcaaggcggggtaccccatcatcatcagcagctcaaacaagacggacatccagtgagtgccttctgaaggaggggtggggtgtgcctggggagcagcgtggcattgcctctgcgcgcatgctccatgctcatggcctgttcaaggggacccagagcctggatgaccgacgtcgaacacagtccatgtggcggctgcttgtgatggaagagctgctgggaatgatggtgacgcgcatcaacatgattgtgctcgactgcacgcagaatatcaggatcatcatcccaccacccgcagcgtctactctggctcgggggaggacctgggcaccatagacactggcggcttcgaggtgcgcaagtgtggggatgggcggcatggcagcagatgctcgcattggttgggatggggtattgtgcagcgacccagacttgagagtgccggaggcagggctctaggtgtgtccttgctacctatagcatgccagcatgcacgcctgcaccagcaccccggcatnnnnnnnnnncgaaggggggtggggtgtgccgggggagcagcgtggcattgcatctgagcgcatgctccatgcgcatggcctgttcaaggggacccggagcctggatgaccgacgctgaacacagtccatgtggtggctacttgtgatgaaagaacagctgggaatgatggtgacgcgtatcgaagtgattgtgctcgactgcacgcagaataccaggatcatcatcccaccacccgcagcgtcnnnnnnnnnnattgggatggggcaatgtgcagcgacccagactcgagagtggtggaggcagggttttaggtgtgtccttgctacctgtagcatgccggcatgcacgcctgcaccagcaccccggcatggttgagtagtcgctcccctgtgccatccctacgcagaactatgccgccgcggtgtcctccgacgggcgatgggtggcggctgcgacgttcaccaacgatgtcaaggcaggtcgctgggctaggagttccagggcctgcgcactctgcaagagagtcactgaagcattcgctgccccttgctttttcaaaccatctctgttcgtgacaactttaacaccccccccccnnnnnnnnnncgcgacgttcaccaatgacgtcaaggcaggtctcagggctgggagtttccagggcctgcgcactctgcaggagagtcactgaagcattcgctgccccttactttttcaaactttatctgtttgtgacaactttaacgcccccccttctcaatcccctcgtgacagatctacgaggtgtcattcgacaggcagggcaccttcaccggcctgcacaaggccatggccctgaagggccatgccgcgcgcgtgctggccctggccttctccccggatctggggcgctgcgcgacggcctccgccgacggcacgctccggctgtggaacatcggcgtgcgctacgcgctggccgaggaccccaagctgctggcgacggcgcggctgccgctggcgctggaccccaagctgcgcgcgcggctggcgtggggcgcagggggggtgatcgcgctgtccaacgggcaccgcctcgccttcttcgacgaggcgggggccgacctcctggccagcgtgcccgacgcgcacaccgcgcccatcgccgcgctggcctggtgcccgggcaggctgaccgccctggagcggcccacctggacgctggcgacggggggtggggacgccagggtcaggctgtggcgctccccggagcgcagcgcgggcaggagggtttgagggcatgtcgctgcctcacactggttcctcgtggcacgcatagctgttgacgcggattttcaattgtaggttcggcaggtggagcgcggggatcgtgactcctggcctaggtgatggctactctccacttcacagacagccagcggggttttgcgggcgcgcgcggaagggaaatagagcagatcgattttttgccgatgctagagtgatcaggcgaaacacaaagctgctgtcgattccttcaaagtagaagtagcaaaggggtatttgctcagagcacatgcagcgcgactgaggacctcctcttcgctccgcgatctgtgtttcaagacacagaagcgggcgtgcgaccctgcccaagtccctcaactcctgaattcatgctctatggaacagtcagatgggatcctttgctgatagtcgtccagatagtggcgttccaatgctacttttacggcacccttggcttgctgctcttcctcctcaccggtgcgagtgcagccatggggtgttcatcaacttgcaccagacacaattcagtttctgatgaataattctcacggtttaactacctccgacacctctccaggaccgtatgtgccggatgtgaacctcttccatgtgtttgactggcgatggatccagctgaagaccttcgtgggggccatggtgatcctggcttttgtcatcacgtccgtcctcaacgccgtcttcctcagactgatggtatggaggtattgttgtgggctcgtgcacgacaggcctcaccgtggcgttccacgcaactgcccactccctctccatatttacaatgcttttgtgcagatcaggcgcgccaagaagtgtctggacttcacggccaccctgtacggcatccatctcatacttgtgtggtcgacctatggcctgccccggacaaagacatggtgggtggccgctcaaggggtacnnnnnnnnnnggttgttgtgggctcgtgcacaacagggctcactgtggcgttccgcgcaactgcccactccctccccactttaacaatgcttttgtgcagatcaggcgcgccannnnnnnnnnggagagtgccactcagaaatatggtgacatgtattctaatccaatatgggttgacttacagtgccattatacctctcaacaggtggatctgtaatctggcgtnnnnnnnnnnagagagcgccactcagaaatatggtgacatgtattctcgtccaatatgggttgacttacagtgccattaaatctctcaacaggtggatctgtaatctggcgttcctagccatcacgaccggccttggggagtggctctgcatgcagaaggagctgcaggatatccctatgagcagcctgtccacggcaggcgctcgaatagagcaagagctggtgcgtcagattccagttgttaccatcctctcctagggcatgcccagaccttagcgtgaccgtgttcaatgcaccaagcttgccttatctctgttccaatgcacttgttcaaatttctctcgacttattcgtttgtatccaaaggccaatgttaccgaacccagaagacttctgcctctgtcctccagcacttccagatgacagcttccccagaccggaacatcgcgccctggcgaaggtggtcgaagcccgatgcaaacactcacgaaccgccttccgacgccaatgaattgcattgctcaatcatcagaacggacaatagcgaggtcgcggcaatttcatcgaggttctgtgtcggggagggcccggcgacggtgctccttgtgccaaggccatgacagactatctcaagtactcccgacgcacatcccttgtcgcggggatcgcatcctctgtcctagcatacgtggctgtgaaggtgaggtttccttgtggtttgaatcggacggccggcgacatgattgagcaatgcccaacaggtcacgtccctgaaattgtgtaccacccttgctgcgcagaggagcatctggcacgcgacggccgatgtagcgcagcagcttccactcgtggatgtggagcccgttggaatagaggtgagcttgttgtggatttcactactatgcctcggtgtctcaaattgcgcagggttccacctgcattgtgtgcaaagacaaacctgtaaaagaataatctgtaaggtgatcctatacaaccttacaggagccagtttcgtggtggggaccagctactcgaggtcagatagctcatagctggaatgaggtaagaagccctgggcatgtgtgtgacttcttggtttcatgtgcatgctcatcgcaggagattcctgcatgagtggagaattgagtacctttcgtcaactgctgatcagccgaccaatccaaacgcagggcgtggatgccgtcttcaagcccattgtgacccgtcttgcgcagcggcaactatgagagctcttgctgcttgctgtgtgaatttggaattcttcccggccacagtgtgtgcccaagaactatgcattttaagccatcagactgagtccctagaatgaggttcacaactgtaagggatgcgtcctctggtgggcagcaccacctcatggacctccgcgtgacccatttcggctcatgcaaagcaggggcgatcatgaccatgcgtcccgatacatgcgaccaccaccctcgccccgagaccatcgatgcggtcgtcatgggcttttagaaagggcagggacatgccagcactgcatgcatcgggcccattgctgggggctgcgggcccccgcagcggcaccgtgcgctgcgctctgcggtgcgcgaggaccgccctgacaccatgggccggcgtggcaagggcgccattctcccccagggttccatgcacgccgcttcgctcggcgagtacggccaccacccagccggaaaccgagacggggcctgtgccggagtccggcaccggcccagccacccgccacgcagcctacccctttgccgagctggagcccaagtggcagcggtactgggaggagaaccagaccttcaggaccccagaattcaaggacctggacaccagcaagccaaagttctacgtcctggacatgttcccctaccccaggtgggtgtgtggaagtgtgggggggggggctctgctactctggatgctgggcggcgggcttgggagtgtgtgcggatcacgcagcactccacgttctgtcggacatccagtcgcggctctcttccccggtggccatcacctacccccgcacacctcctgccgtgcccatccctcacgattcagtgggtcgggattgcacgtgggccaccccgagggctacaccgccaccgacatcctggcgcggtacaagcgcatgcgaggcttcaacgtgctgcaccccatgggctgggacgcgttcggcctgcccgccgagcagtacgccatccagacggggacgcaccccgccgcgaccacggcgaccaacatcacacgcttccggcagcagctgcgcgcgctggggttcagctacgactggcggcgcgaggtgtccaccgccgacccggcctactaccgctggacgcagtgggtcttcctgcagctgcacgccgcggggctggcctaccaggcggaggtgccggtgaactggtgccccgcgctgggcaccgtgctggccaacgaggaggtggtcgacggcctgagcgagcgtggggggcacccagtgatgcgcatgcccctgcgccagtggatgctgcgcatcaccgcctacgcagaccgcctgctggccgacctgcccaccctggactgggaccccgccatcctggaccagcagcgcaactggatcgggaggtcggaggtggggcgccggggcggggtgttctctgggtagtgggaagggggggttggggagggaatgcctgtgagggnnnnnnnnnnaggccggggtgttctctgggtggtgggaaggggggttggggagggaatgcctgtgagggctgtggaggagtacgttgccctgcaacggagcagatgccccagaatgcggctggagagtgcttggggctggtcgtgggagtgggcctgggagcgcacaggcgacgttgcgtgcaaggctcagccgcggtgtgtttgcctgcacagtgagcccccacaacaagaatccaaccctctccacacggcagggggcggcgatcagcttcccgctgacgcagcgcccagacgcttctggcgccagcgccagcccgccaccttatccagaggccatcgaggtgtacaccacccggcctgacaccctctttggcgccacattcctggtcctggcgcccgagcacccggccacgctggccgtggccaccccggaccgcgccgcggaggtgcaggcctacgtcgccgccgccacggccaagtccgaccggcagcgcgcggcgtcgggcgtcacgggggtcttcacaggtgtgggggttgaaaggagagaggcgttaggtatgatgatggagttggtggggccttgtgggatgggcatgccttgagagctggagnnnnnnnnnnttttagaggagagaggcgttgggtgggctgatggagttggtgggaccctgtgggatgggcatgccttgagagctggaggggcgagcccatgggccctagggcggccgccggcacagtgccccattcgtgtctgtctgggattttgcagttgaccgcacacacctgtgtccatccccccccccccnnnnnnnnnntgccggcatagtgccccatgtgtgtctgtctgggattttgcaattgactgcacacacctgtgtccatcccccccccccttctcacctccgcactcaccctccaaaacatcctcaggcgcgtatgcgctgcaccccgccacgcgcgagcccctgcccatctggacggccgagtatgtcctgggcgcatacggcacgggcgccataatggccgtgcccgcccacgacgagcgcgacgcggcctttgccgcgcagtaccgcctgcccagccgcgcggtggtgcgggacggcgaggcgggcgggacggtggcctgcgcctccgccgcgccgggtctgaccctggacgggctgggccgggcggaggccagccgcgccgtgatcgactggctggaggcgcggggggcggggcggggcaggacgcagtacaaactgcgcgactggctgttcgcgcggcagcgctactggggcgagcccttccccgtcgtgttcccgctggggcccgatggcagccctgatcaggtaggcagagatgctgggtcctggggggagtgggaggcctgttgatgggttggtggttaggtacgggatataactcccgaaaggtggatgatgtacgtgtggcgtcctgactgggccccctgcgtccttgtgtctgatccaggcacctgtccgtcatgaaacacccccacacgatcaaggctcggaacacaatccgcaacgccctctttcatcaacagacctcagttgccattccggagtctgagctgcccctggtcctgcctgaggtggaggacttcacgcccacaggcaccgcagaccccccgctggccaaggccacggcctggatgcagaccgtggtgcccggcacaggtcggtggtgtgctgggcggggcttcgtgtttttgtatcgttccgaaaggggtgcgcagcagcgtgcaggctgggggagagctgggtgagcgggcggaagcggacccgcgggggagtccaagacagcgagagccatggtgcgcttgtgggactcggcagaattgccctgatcgcattacacccctgcgcagagtcccccgcgatccgcgaagcgtccaccatgccccagtgggccgggtcatgctggtactacctccgctacatcgaccccgacaacagcagcaggtgtgggggggtattgttttgctggcaggagcctcttgggaatggtacgctgcacccattcccgatcgtgaggctgccctgccggaagtgtgtagcccccctgccaccttcaaccacgcgcaattctaggttacacccctccaaagctcacattgnnnnnnnnnngggatgtgtgtagccccccctgccaccttcaaccacgcgcaatcctaggttacacccctccaaagctcacattgaccctctgtgtctggtgctggcttcccagaaccaccctgctcatgacccattcctcgctcacctcaacctggcacccccgacatctaggctggtgagcaaggaagcagaggcctactggatgcccgtggacctgtacgtcggcggcgccgagcacgctgtgctgcacctcctctacgcccgcttctggcacaaggtcctcttcgatctgggccacgtcagcacgcccgagcccttccagcgcctggtcagccagggcatgatcctgggggaggtggagtactccgtgcaccgagggccgggcggcgagcccgtgcgcgagggtgacgcgggcgcggcggctgtcaggtgcggggtccggtgcacggagggacctgggagcgggttttgctgtacaagggcgcaggagagcgtggggaagcctnnnnnnnnnnccgggcgcggcggctgtcaggtgctgggtccggtgcacggagggacctgggagtgggttttgctgcacaagggcgcaggagagcgtggggaagcctgcacgcagagcgctgactgtgatgcggtggccctttcccgcgtattagaagcccaatgcgcccctgctctgtccatcacgccatcttcactccgagcaatggctcccccacccccaaaccgcccctgcagggtccggccggaggaggnnnnnnnnnnaaggcccaatgcgcccctgctctgtcaatcacgccatcttcactcggagcaatgcctcccccacccccacaccgcccctgcagggtccggccggaggaggtggagccgtgggctgccagtccaacggggtaccgcctgcgcgcggacccgtccacccctgtgtcggcccgcgcccacaagatgagcaagagccgggggaacgtgatcaatccggacgacgtggtggcggggtacggcgcggattcgctgcgcctctacgagatgttcatgggcccgctgcgtgacactaaggttggtgggacttggtacggggagagcaatggatgctgaggtgggggcggggtttggagaccgcagcgaggcagaacctgtgggcatgctgggggtgccaggtgggtggattcccggggacgacctggcggccgctgatcctggtgagctgccgggagaaacgtctgtgagggctctcgtgacttcccctcccgcgcacgcctaaaccgcaaggtctggagcaccaagggcgtggagggggtccaccgcttcctcgcccgcgtctggcggctgggcactgagcgcctggcgcagcccggcgtcgcctccacgccggcgcaggcggcggtcatgaaccggacggtggggcgcgtcacggaggacaccgaggccatgcgcttcaacaccgccatcgcggcgatgatggaggcggtgaacgccgcgtacaagtgggatgcctgcccccgccccctgttcgagacgctggtgctgctgctggcgccctacgccccccacattgcggaggagctttggcaggtgcggttttgcgtggttgctgtaggggtcccctgggtttgggtcaggggacggctgggcgcgcaggacatgcgtgcggtggcgagtgggacctggtgcggcagcgggcggagtgcagtctcctgacgatggcgaggtgatgatgacgatctggcagccttgcctcatgggctctttgcacaaccttctcgccatgtgcagcggctcgggcacgaggggtcgctggcctacgcgagctggcccgcctttgacccgagcctggtccaggtcgacagcctgaagctgccggtccaggtgaacggcagggtgcgggctgtgatagaggttgagcgcgagatcgggcagggggcggcgctggaggcggcgcgcgccaacgaggcggtcagccgccacctggccggcaagcaggttgtgaaggtggtgtgggtgccggggagggcgctcaacctcatagtcaagtgaggctggagggttgggcctgccctgtccagcaagatgtaactgcaaaggcaacttgnnnnnnnnnngaagtgagggtgcagggttgggcctgccctgcccagcaagatgtaactgcaaaggcaacttgcagcaaggcagcgacagtccaggtggcttgagagctgagaatggacagctgtgagtggacctgtcccaaggagttgcctgctagattcctcatgcttcagcaccacgtgcagcacgtgaggacaagaaccgggaggggcgcaggttgggactgaccctgctgggggcaatatggcgtcgacgggcttgcagcaatcccacaattgcgcagaacaaaggatcgtaattcttgacattctcgtcacccgccatcctctccaacagcgccttcgacccttgggccgagaaaccctttcccactgacaattcctggaaaccatctctgcaatccaaaccaacatgcagtcgctctccagctcgcgaggtgttaccgttgcgtctttcccgagcactcggcgtgcccagcgcaccagagcatcgcgcctgccggtcgtgacccgtgcggtggtggcggagagggacccccccgcagtcaatgaaacgagcagcaagtccagcgacaagactcgcgtcggcatcaacggtaatgcacgtgcaaatatgtagcgatggagggcgccaattccccactcgccctgcagcgcgtcccatttactaatttctgtccttcatgccctgcctcagggttcggacgcatcggccgactcaccctgcgcgcagcaatgcagaacccagatgtcgagatcgtggccatcaacgatccctttgtcaaccccgagtacatggcgtacatgctgaaatatgacacaggtgagcaggtccacgccgggatacccggcctgaatgtgctgcacagcgctgggcatcgtcggggcggcgctcgcaatctgaggaacatcgaccgaatttccggcgttccaccctcaagcccatgcctcacctgcagtccacggaaggttcaagggagacattgactacgatggctccagcctgtacctgaacgggaagcagttggccgtctcagcctgcatgtgagtacttggtatgtaggggtcattatcacccactccagatacctgggcgcaggaagcttgccagtggtaccccacaaccgaatggacagcaaactttgatcaaaagtgctgccaactctccccaacgcgctgcagggaccccagcgagatcgcttggggcaagtcgggcgccgactacatctgcgaagccaccggcgtgttcaccgacaccgccaaggtgtgcnnnnnnnnnnaagtggacagcaaactttgatcaaaagtcttgccaactctcctcaacgcgctgcagggaccccagcgagattgcttggggtaagtcaggcgccgagtacatctgcgaagccactggcgtgttcaccgacaccgccaaggtgtgctgtgatgtcccgggcggggatcagctgttgtctgcaaacatctgaacgcccaaatttatcatgacgtcggtcagaggcttgcaaaattgctccttgtgacctgggcgggacatgctgcaggaacacatctctgatgctccttcctcccaatccatgtaccatgcaggcatcggcccacttcaagggcggcgcgaggaaggtggtcatctccgcgccctccaaggacgcccccatgtttgtcatggtgtgttgtggtgtatgtcgcggggcgaggctcacaagaggcggccatctgcgatcctgccgctcggctgggacgtgagagcatgcaggcctagatcgtggcgttcactgaacctccagtcatgcattcccagcggtcatacctgcatcacatgctcattacagtgtcctcaggctcccaacatctgccacccacccagggcgtgaaccaccacgagtacgaagcatgccaggacgtggtgtccaatgcctcctgcaccaccaactgcctggccccgctggccaaggtggtgaacgacaagtggggcatccaggaggggctgatgaccacagtgcacgccaccaccgccacccagaagacggtggacggcccctcgcgcaaggactggcgcggtgggcgcggcgcggccttcaacatcatcccctcctccaccggcgcggccaaggccgtgggtaaggtgttgcccgcgctcaacggcaagctgacggggatggccttccgcgtgcccactgccgacgtctcggtggtggacctgacggtgaacctagagcgcggcgcggagtacggcgagatcatggccgagctgcgccgtgcctctcaggccgagctggcgggtatcctgggcttcaccgaggaggcagtggtgtcctcagacttcatctccgacgcgcggtcgtcgatcgtggacgccagcgccggcatccagctgtcgcccacctttgtcaagctgctggcctggtacgacaacgagtggggctactccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaacacacccactccctgctgctgccatccccatcagatccagaggaacgaatctcatgatcaagaagggggggatgcgtcgtgccgatgcactcatgcgacgcccctcctcaccctgtaccatcagcagaaccgcaaaccctcctcgccttgaaattgaatccgacatgccacatgcaaaccacgtgcaccctttccacttctgctctgtaactggagcgggttgcagcgaggcacacagcagctgggcacccccagctgcggccctcttgggatccgcaccacacaccatgcctcgatgtcagccccctcaggcgaagaacttgaccccagtgtcgtcgttggcgtcgcccctgaacacgcgcgccttgccccgctcctccagcgtgcgcagcgcggcagagagcagctcgcgaggcatgcccgccagctcgctgccgcggacatcctcgccgcccagcagctcctccaggctcaccacgctgtcctccaggccgttaacccgcgcccaggcatggatcacgtcggcccactcgcctacgccgcgccagaggaccagcaggcggcgcctgtcggggcccagccaccggccccgccccgaggccgccaggtcctccaggagcagggagcgggcctccgggctcagcttgcctgcacgatgttattcatcaagagaggggccgggcaagggggcttgggaaacaagcttgtgatgcacaggcatgggggaggttcagacgacggagcatcccacacaggaagtgccaatctgcnnnnnnnnnnaggctcagcttgcctgcatgatgttatttatcaagagaggggttgggtaggggggcttgggaaacaagtttgtgatgcacaggcatgagggaggttcagatgacagagcatcccacacaggaagtgccaatctgcggaccatcactgctggatcccccacgaggcctcacgctggatcgccttgttctcaaacaggggaaactcgtctgcggccgcgtccaggctgacgatgaatatctgtggaagggaagtgtggaggtatcgcttgtcaacctgctgctgctgccgtggagggtacccgtctcgtcctgggtgcgccgctcgagaacccaacacaccctctgtcagccacagcagcatggccagggactgaccctatggtggcgacagtaggacaggatgaggtctttccaggactcgcgctgcttcctctgtgtctctttcactggttgaagcctgcaaggtggggcttgtggcctggctgagaacctacaccgggtgcggtgatggctacagaataggaacacgatctcttacaacaaatctcacgtgaagtagggagggtagctgtagnnnnnnnnnnaggtgtggtgaaggctacaaaataggaacacgatctcttacaacaactctcacgtgaagtagggagggtagctgtagaagacgggcatgggaaagtccgccatggtcgcacggatgggacgaggtcatggtgacacacacatgatgtattgtttactgcgtcgccagattggtatgctgccccattctatgtcaaaaattacnnnnnnnnnncggtcatggagacacacacatgatgaactgtttactgcgtcgccagattgctatgctgccccattctatgtcaaaaattactagcaatttaatatcgattgctgctgtgtagtgctaggtttgtctcacccaacccggtcggagctgagcttgtaatggcttccgaaacgggaggaggcaacagcacgcgcgcagcacaggaaggccaaggcagatgtatatgattgcatactgctgacgagcaccacgtcaacaaaggccatcaacctctaaattacatatacagcaattcaaagaaggcccattcttgtagaggtgtattttgccaggctatgggcatgccagggatggcnnnnnnnnnncacgtatgcagcaagtcaaagaaggcccattcttgtagacgtgtgacttgccaggctatgggcatgccagggatggccagatccagcaacaaggatggattgttgctctgcaaaggtccgtgttgcacattggcctgcaatgatgtctctgtttgacacatatttactttttataccagcacctgcgcttcctttcagaaacaacatcagctgcaagagacattaattacaaaattgtagacagagctgatcaaaccagacgagtaagtgagcacaatctgctgaaacccatgtcaacactgatgtcgacatccctcagtgcctgccatgatgattgcaaagatgacgccctgatgtcgactgtattgcctgccttgcacaactgagcaatcgcccacatggtgtgattggcgcccctgtaccgcaccctcacttagcatatgtatcggattctgagcaagtaggccgaatgccccgtcacacccgcatatataccacaaggagggcgtgacagcatcaaccttttagcgggtaccttgcagcacctcatcagccagccaatgccttctcccctgagatcggtcctggggcatggtggccagtgttgcaggtgcatggagaaattatgagcgtatgtatattcatatgcttgcaggaaggctatcaatggatcttagagttcgagtacggtggcacnnnnnnnnnncatggtggccggtgttgcaggtgcatggagaaatattgagagtatgtatattcatatgctgcagaaaggctatcgatggatcttagagttcgagtacggtggcactttggactctaaaaccacagttgctgctgcttgttaacctggcgggaggcgccatcatcggaagaacctcaccacgaaaccgatcatggcgacgacacgaaacggatcctggtgcattactggcaatggtacggcgctgtatttggaagcctgatgctattggatgatgcagcggacgtaagaagcgagatcgcccaggctaccacctcatgtacgaggacgggggagcctattacgagcttgccaccgggcaggcgacctctgccccgatcagttgcctggcattcgaccagcatgaggaggcggcctggtttggctgctccaatggctggatctcgcagagcactgtgccaggcttggagagggtttgtgcaagcagggctcatgccagccaggtgctggagctcagatccctgggggccagctgtctcagcctctccaacaaggagttgctagcccatgtgaccggtggcgccatacgacagagcatcagatccagcgtgagtggaggtgtaggtatttgcatgatggttgctggccagcagagactgacacattgcgaaaatgcaagctgaagcctgcacatccactcctcnnnnnnnnnnatgctagcccatgtgaccggtggcgccatacaacagagcatcagatccagcgtgggtggggttgtaagtatttgcatgatggttgctggccagcggagactgacacattgagagagtgcaagctgaagcctgcacatccactcctcttaccccacgtgccgcaaccacaggacggcaccttctcctgcatggagctgtaccggaatggtacccaggttctcatcggctgcggccagaagggaatggtggcgtacgacctcgtatctggcaagtccaccggccaggtacacgatgatgagaacaaagctatctggtgtggttcagccagccttcctctgaacgctctttttgggtttcagttgccttgcagccattctggccagcccactgacctctcccacccattccctgtcccagtgggagacagaaggcatgggcgcggtggcgctgaggggccccctctctgggggtggctacctggcggcctctcccgccggcaagatcttcgtcatggacggccgtagccggagcgtgcgcccaggcacctccctgaccgctcacgtcggcggctttgctgccgtggatgctgcaggctccctggtggccacggcggggtactcgatcaggggcgggcatccggtcctggagcgggccgtcaaggtatgggagggttccggacgggtcctcagtggggcatgtttacgtggagagggagggttgtcaaataagaataactaagagtggcaagaaggccctgcgcatnnnnnnnnnntcgtggggcatgtttttgtggagagggagggttgtcaaataagatgaactaagagtggcaagaaggccctgcgcatgtcatggattgctgacattcccctttgggacgtgacggtgctgagggcaggattcatgcattgcaagagcgtcaaagcacattcatcaaattcgggccaggtgtttgacatccggatggcgccccgcctgctgtgcacgctgccctttggcgcgggccccgtcttcctgcgcttccacccgcacctgccctccacgctgctggcggggtccgcttccggcgccgtctcgctcctggacgcggccgggtacggggccgggacgcacctgagcctgcccggcctggagcagggcgcggggggcatcacctgcgcggacttcagcccctccggccagtgcatcggcctgggctcggcgagcggctgggtgcacatgctgggcgtgggcagcatgcccagcgtggcgggccggggcgcggaggtgagtcatgtgcaggggcccggttgggtggacggcgtggcatcatttgtggggcgatcagcgattgcagcccctcaccggcgcagcgcgcccgcgggtgtcggactctccacccgggctccctgccgccattcccaggacctgcgcccgacgcactctcgctcatgcctccttccgcacgcaccaggtgcccgcaccgcccgcgggcaaccccgctcccatggtgagcctgggggagggcgaccccctctcccgcgcgccgctcttctacaacctggaggggccgcgcccgctttcctccctgcaccctggcgagcgggccagcgtgggcctggcgcccagggtcgtggaccccaccctccagcccctcatcaaatgggtgcgttggcgggcgtggaaccaggggcagccagcgctggcacgcagggtggagggcgtgcgtccctgtgcgcggtgtggtgtggcgccccgagtgcacctgccctgacagctgggagtctgctgtggtcgtttccgggagcttgggcactgcagtttggaatgctgccagctctctctgccctgggaacgcgtgcacgggtcgccgatgcacccttgcaccgcgcccatgacgaccnnnnnnnnnnctggaatgctgccacctctctctgccctgggaaagcgtgcacgggtcgcccatgcacccttgcaccgcgcccatgacgacctcctccccccgccgcgcccatcgtactcgtgccacccctccccccgcccacacaatccccagtccgacttcgtgggggtgatccccaaccccttctacgaccccgcggcccccccgggcaccgccgcggcggcctcggccaggctgcgcgcggagcgcgcgcagccggcctgcgtcccagtcgacgtcgcggcccggcgcgcggagcgcgctcagcgccgcgccgcggagggcggcgtggtcctgcccgatcgctaccggcgcgtgctggtggcgacccagcaggctgcggcggcgcagtcctggttccaggactacgactactcggcgtgcaacgcctcgccctttgtcgggctggagaacgacctggccaactcctactgcaacgcgctggtccaggcgctcttcttcgtccccggcgtgcgcgccgcgctgctgcgccacgtcccccgctccaacgacgagttctgcctggcgggggagctggccctgctcttccgcctgctgcagacgcgcggcgccgtcgtatgccgggtgggggccgggggtggaggct

SEQ ID NO: 42963 - DNA, 103 bp, Chlorella protothecoides
ccctcgcagagcgtccatgcccctgcccaccccttgagcgtcggaagttcccaaaccacctcccccaaggccccacaccggcgtccacccccctctccacccc

SEQ ID NO: 42964 - DNA, 61 bp, Chlorella protothecoides
tattgactgcagggcctcgacaggaaggggccggccagtctccccattccattggcccagg

SEQ ID NO: 42965 - DNA, 425 bp, Chlorella protothecoides
  modified_base (112)..(333): a, c, t, g, unknown or other
tgacaagcgctgcagcctctcgaccttggcaggcagctcggcgtcgcccttggccctggcctggcggagcctggcgagtgaagggggtgtggtgagaggatgagatgagtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntagggagcgctggggtggagcgaagacggcagcaattcaatatcatgtgaagatgatggttccctgaaccattgacaaactcgccctctgtc

SEQ ID NO: 42966 - DNA, 117 bp, Chlorella protothecoides
aagtgctcacatctcaaggccaaaacctcaatcagaggacacagtaagatctacatcccaatccctgtgacccatacccccctcccgaccctcccgcggtcccaagtagcacaccgg

SEQ ID NO: 42967 - DNA, 61 bp, Chlorella protothecoides
accgtcggcgttcaggctggtggaaggaggaggcgcgcgcagggcctcctcgtcgccctct

SEQ ID NO: 42968 - DNA, 151 bp, Chlorella protothecoides
aggatgcggtacctgcggcatgaggcacatttgagtgaggggggatggtggtgatggaaggccttgggtggggggccagcgggtgtcagcagggcatggtgaaggcctcccagaggtttatcccgcggggggggggggggggggggggggg

SEQ ID NO: 42969 - DNA, 73 bp, Chlorella protothecoides
atctctcccctcctggcacattattgttcaacagcgtgacaaatcacgccgttgccacctggctccgggtctc

SEQ ID NO: 42970 - DNA, 61 bp, Chlorella protothecoides
atgtccattcattcatgcgtggcggctctgcccatgtccatgcacgtccatccatgcgtcc

SEQ ID NO: 42971 - DNA, 20143 bp, Chlorella protothecoides
  modified_base (227)..(319): a, c, t, g, unknown or other
  modified_base (1582)..(1591): a, c, t, g, unknown or other
  modified_base (2541)..(2564): a, c, t, g, unknown or other
  modified_base (2843)..(2852): a, c, t, g, unknown or other
  modified_base (3181)..(3190): a, c, t, g, unknown or other
  modified_base (3456)..(3465): a, c, t, g, unknown or other
  modified_base (3939)..(3948): a, c, t, g, unknown or other
  modified_base (4569)..(4578): a, c, t, g, unknown or other
  modified_base (5600)..(5609): a, c, t, g, unknown or other
  modified_base (5741)..(5750): a, c, t, g, unknown or other
  modified_base (5942)..(6022): a, c, t, g, unknown or other
  modified_base (14869)..(14878): a, c, t, g, unknown or other
  modified_base (15491)..(15500): a, c, t, g, unknown or other
  modified_base (15709)..(15718): a, c, t, g, unknown or other
  modified_base (15872)..(15881): a, c, t, g, unknown or other
  modified_base (16178)..(16187): a, c, t, g, unknown or other
  modified_base (16251)..(16260): a, c, t, g, unknown or other
  modified_base (16581)..(16590): a, c, t, g, unknown or other
  modified_base (16816)..(16825): a, c, t, g, unknown or other
  modified_base (16973)..(16982): a, c, t, g, unknown or other
  modified_base (17432)..(17441): a, c, t, g, unknown or other
  modified_base (17822)..(17831): a, c, t, g, unknown or other
  modified_base (18188)..(18197): a, c, t, g, unknown or other
  modified_base (18310)..(18319): a, c, t, g, unknown or other
  modified_base (18779)..(18788): a, c, t, g, unknown or other
  modified_base (19275)..(19284): a, c, t, g, unknown or other
  modified_base (19397)..(19406): a, c, t, g, unknown or other
  modified_base (19563)..(19572): a, c, t, g, unknown or other
  modified_base (19640)..(19699): a, c, t, g, unknown or other
  modified_base (19815)..(19824): a, c, t, g, unknown or other
gagctcccagccctgcgggccgacggaggagccgccgacagacgcctcgtcgtccttgccgctggccggcaactccgcgccgccgggcacgggcacaggcccgccgggaggcctccgccgcgcggtccacacccagatcgccaccgccaccgaggcgagggcggtgagggcgcccagggcgaccagcacccacacccaggccggctgggcggaggagggtggggcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagagctggtaggggtccaggacgcaggtctggaagctgccgtccatctggatgtaggtgtactcgccggcgatggggcgcagggcggaggtgcccatctggatggtgacgcgggtgccgcccagcatgaagatggacgagccgtcaaagaggcccacgttgctggggccgtacagctgcgtgtaccgcagcacgtccgcctggcgcgtggcgtaggagcagtcggagcgccaagtgtcgatcaccgtgctgtcgtacaccatcaggctgccggccatgaagtagagggtggggaagacgttgctctgcagggggcgcaccatcgccgcgctcacaacggcggggaggtagcgcgaggccaggttggcgatgtggatgttgctcagcaccagcgtcccaccctggaccaccaggaacacgggccagaggccgccgaaatccagcgtactcacgtcggggtccaccgtcagggtgcgggaggtgctgttgaaggtgacctcgcctggagatggggtgggggttcggggcaaggtcgagaaggagcttggggttcaagggtgttcagggtaaggcagaggggcggggggcggcaaccagcccaactcctcctgcaggggaggctgtccacccctgtcgagagtcccattccgtaccttcggatgtgagcgtgacggagcgctggctcacctcgatgacctggccagcgggccatgtctcgttcgtcagggtgaggttgcctgcagggaaaggggagggactaggccggggttcaccgtcgcacgctccctgtcgagcaaacccgggatcgggctacccagcgagcgcctgcccccactcacgtataattacgatctctgtcacactcgtgtcgtttccggccagccacagctcctccgccgtctccacgtacacgcgcggggatgccgctcctgccacgagcagggggaccagtcccagcaccagcagggccgcgactgagggaccccatcgggcctgcatgcctggtagctagcgctctatttcagcgggagtcatggcgatgtttcgccgactgttgacggggccgctgggccaggggatcatgtcccgaagtggccgctccgccgcgccgggcaggcctgctcgcgcgctcgctcgagccgacctgggaacgttcgcttttcttgtctttcccctcgtcctatcctctgcgatgggacctccaagtgctctgtaaaatgcacagcatgctcacacccaattcaccccggccgggcagtgcctnnnnnnnnnngtcatgtcccgaagtggccgctccgcagcgccgggcaggcaggcctgctcgcgcgctcgctcgagccgaggatcaaacctgggaacgttcgcttcccgcttatctttccctatcctctgcgatgggaagtgctctgtaaaatccacagcatgctcacccaattcaccccggccgggcagtgcctgcgcatgcacagagactggccgggtggggaccgccacaccgcacaatcagcgcaggcattcatgcactcatacctccagctccttcaggagggctgcagccctgccctgccagctggtaagcgcctcgcgcgctcggcctgactcggcaccgccctccagaggcagctcggcaaactcgagcagggcggcctgcagggccgcgtccgaccccgccttctgccgctttgacgccgagacctcactgtcagcctagagatagtcagacgcggcaggacgggctgagacaagtagcatgcgggtgcctggctgccgcgacacgaacagaggcacatgtgtcatgcaacggtctcgcacaccaggcacgctgcataccacagcgctgcatgtggcacaattgtaccgagatctcagtatccccccacacctggtgcttatcggacgcggcagccgccgccgccttcctggccgcctccacgatggcaggggggaacctggcgaattccgcgacgtggatgccgaaagacttgtcgcaggacccctcctccacctggtacagcatggtgagcgcgcccgaggcgtggtcgatggccgcgccgacgtgcaggttcttcacgccgccagccccccgcagcgccgtcagctcgtggaagtgggtggcaaacagggtggggcagccaatggcgttcatgaggtgctcagagatggcccacgctagacccatgccgtccctgtggaaaggaggggggggggggggggggggggggnnnnnnnnnnnnnnnnnnnnnnnngaggcaaggcgcattgggcatttgagggcgcgcgtccatcctgccatcacacatctgttaccccgctcctggacgctttctcggccctcaccaagtggatgtgcccctcccaagctcgtcgatgatgaccagggaggctggcgtggcgccctgcatttgaggcagcggcggaatcatgcgagacagcgagaaacgcagggacccatgagctctgcacttcacacgcacgttcacggcccaccaccattccccctcaccttgaggatggccgcgctttcnnnnnnnnnnggcgcagggaccccacgagctctgcatttcacacgcacgttcatggcccaccaccttcccccctcaccttgaggatggccgcgctttccagcatctcggccatgaaggtggagacgccgcgggcctggctgtccccggcgcccacgcgcgcgaaaatggcgtcccgcacggcgatgctggcctgggtgcagggcacccaggaccccacctgcgccagcagcaccgagatgccgacctgcatgacgcgaggggtggggcgcttgagtctgggagtgggttcctggggggcagcaacttgacaggcgggttgctgggggcggaaggacaannnnnnnnnntgcggggtggggcgcttgagtatgggattgggttcctgaggggcagcaactctacaggcgggttgctgggggcggaaggacaagggccgcactgggctgggggaggatgatacatcggagcggccagacgccaacccaggccatggagagcatggagttcccaatgctgctgctcggagcctccctataccaccacccagtgccctgtcgcctagacattgcatccatctggtcgctgcatcagtgcccctacccaaggtggctgnnnnnnnnnntaatgctgctgctcggagactccctataccaccacccagggccctgtcacctagacattgcatccatctggtcactgcatcagtgcccctacccaaggtcgctggatcactcccacctccccgaccacacacctgccggatgaaggtgctcttcccacccatgttggggccggtgatgatctggaaccagctctccccgcgctgcatgacgcagtcgtttggaataaaatcgacgccctcctgcagctccacacaggggtgccggcagccgaccagctccacgcgaccccctgcagtgaggcgtagcgcctgggtgtggataactgtggcagcagaccaggatgcgggggtggcaagggccgtatgcgcataccaggggtcaagcgatgagggttgtgatgccccccccccccgcttggccgaggaatccagacacactgatcgtcgcccatgtcttggccgaggtgcatacannnnnnnnnntgtatgagcataccatgggtcaagcgatgagggttgtgatgctccccgacttggccgaggtatccaggcacactgattgtcgcccatgtcttggccgaggtgcatacaagcagccagagtgccgcaggatccatggaaactagcacagcggccgctccccagcctcgccgagcaaagctccggtgcaacagccatcccaaacaccccactccgcaccgtcggcgggcagcatggagggccggacgtagggcctgggggcggtgacagcgacgtccgcaaacgccaccaggacgtccagctcagcgagtacgctgcgcacctgctcccacacctggcagaaggtggccgccacagacaccacctgcggccgggggtgggggtgcaggaacgcgcgaagctgggctggaattctaagctcggtgtgcgagaggtggaagccgggcccgtgcgcagattctgagttttaggggaaactcgtcccttcacacccgtgcgcacactgcacaacccccacacaaggggaagccgggggccagcaaggtcctctgaccacgcgaaagatgctcccatgtccctcctttccttgccgagccaacccacctgcgccacgagagtcgactnnnnnnnnnntgtaggagggggcgaagctgggctggaatttgaagctgggtgtgcgagaggtggaagccgggccgggcccgtgcgcagattctgtgtttaagtggaaactcgtcccttcacacccgtgcgcacactgcacagcccccacacaagggagagccgggggccagcaaggtcctctgaccacacgaaagatgcccccatgtccctccttcccttgcccggccaacccacctgcgccacgagagtcgactggcgcgaatcgtactcggatgccagtgcctgcaaccgctcggcggccgccttgagcgccttgttggtgaacttgaggccatccttgcgggtctcaagctcgaggtatcgggcctgggcagggagtggatgggctcagggcgtggtgcccgccggtgcgtgggtgaatgcgctcaagagcagccagtctttggtcgacccatcgctggtgacagcaactggaaaggcaggcagcatgggtcaccacctgagacacccacattccaaccttccccctcctcacccgcagcttggaccggaccgacttctcctccttcgtggtgatcctgagacaccgcaggcgctggttggcaaacttgtgccactccagcctggaaggggagaggggggttggaggaggatccagagggaggtggatttgaaggcagctggctggacttttcaggatcataacaagaccgatggctgaagagtgcaggcggcacgccgccctcgcctggggacaacagcatggcaacgcttcaagacatgtatctgcagcttgacgagactccagaccgcccagcactcacttgatggtcttgtccaggcacagccccaggtcctgggcggcctcctccgccaggccctggatcttcttctccaggttcagcttctccacctccacctcttgcagaccctacatcatgcggggggggcgccgagagggtgtgcagggccttggttctgcagcaggcacgcctgggcgcttggccacagggagggtctgacagctccannnnnnnnnngtccacatggggagccgacggcggcatggatggagctgccacaaatggagccctgaaccgcaggcaatcctggactctttgacctttccttgcagggcggtaccgagcgtcacctccctcacccaggccccnnnnnnnnnngacacacaatgacgaaaggtcacaccacccagccctcctcatcatgcgtacgcaccgggtcgtagctggcggcaatgaggtactcatctgggatgcggtccaggtcgatcgccgtctccagcagcgcctcgaaacgcacgaggtggtcggcgtcgtgggccagggccagggggtcggcgaatctgagcgggnnnnnnnnnnnnnnnnnnnnnnnnnnnnnnnnnnnnnnnnnnnnnnnnnnnnnnnnnnnnnnnnnnnnnnnnnnnnnnnnncgcctcgcaacccacctctccatcagggtcgaggcgtgtggccctgagtgcgcccggaggacggcctcgatcaggggcagacgtgaggaggcgcggtacagctggcacaggtcgctgagggaggccttgccgcgctccagcttccgcgacagcatctccaggtccggcaagcctgtgagcaagcgcaagtggggattgagagagtgcaaggtgaggcctactgacctcgagctgttggccaggaggaggggcctgtcttgagccccggtgcaagccagacccaccggcaaacacccttcaatcacaccctgagccttgcccctcctgcatcatgcagctgatccagccattataccactggggccttccccgctatgccatcccgtgcccacacctctgaggtgcatctgctgcagcgcttggcgcagctccgcatcccccaccagcgcctccaccacatcatgcctcatcctcagggtgtccaggtcgagcagcggctgcttcaaccaggtctgtgcgaggtggatggaggatggatacgggaggggtggcaggggtgggatgaactttcacacagagcatgtgccttcatctggctggtgacatgccgctccgtcccccacacatgcaaagacccaccctgagcaggcgcttccccatggcggtcttgccccggttcagcagtccaaacagcgaaaaggtgtctgaggcgtcgccccgcccccgcatcacgctcagtgcgcgctgtgagaggagtaggtgagggcaatgggggggagtgatctacacctcatgctcgcagggcgccagcggcctcttgcctttgccctctcggaacacacctggtctcccggggtagagaggcccaagtccaccccccccacacctcaacccactccctcaacccccgccatcatcaccacccacaccgcccacccacctgggcggcggcatccatgcgcatgaacttgcccaggtccagccggtccaggccgtacttgccatgccccgacccgtcggccagcagctcgccaaaggccagcacgccggccagggccgcggaggcatggtgcccctccagcacatgccggtgctgctccagggttcccgggagcagcaggcgctgcaggtcctggtccaggttgcgcgccgagaaggacgcgcgcgggcgcggcgcgggggcggcgcccgtgcgcgccagcacgtccatggccctgtgcaggtcaagggactgggcgccgggctgccccgcctcagacgccgtgtcctgccgcatttttggggggcgggggttgaaagttgggcaccatgttggggaggcgggcgaggcgccggtgcgcgcagcgcactgccgcttgcatgaggagtacagaaaacctccgggagaatctggcagcgggtgtgcctgactcaaaccctccagcgcccacccacagggcgatgcgcaccttgatgaccgcgcactcgcgcactcccagctgcaccagggcgctctccaggtggttgaagtggtcgtcgtcggtgaactcgaccgtcctcagcacgcgtgccccggggtcgacgtacgccaggcccaccgtgcgcagacctgcatgcaagccgggggtggcagtgccgggtggcatctgttggcacaggcttggacagaccacgaccagcccatcctatcatatcgcaccgacactgcggtacaaccagctcaacaaaggttgcgcagcagcagcgatctggtgtgtgacacacgacagccgagatggatccataccacatctcggactccttccagagacgaggactccatacccccaccgaccttcggtttgccctagagacagggcggccaggagggggacctccccaagatcccctgatcgagtcagctcggcctcaaagtcactcaacaagctgggcgagcccctcctgcaagtcaaggatggaatggtggaggatcatgtgaatggacgcggggacactgtagtgctggggcagaagcacatcaggaacttggacaccttggatccaaggcaagtgaaggcgccccaagacagaacacctcgctgtcctggctggccctgatgagtcagagggccacaccagccccagggaaccgacgtacttggtgcacgaccagttagtccccgccccctcatagaactccacactgtgctcgccggggtcaatcaagaggtagcgcagggtggaggggagcaaggcccagctcagtgtcacccctggatgggttgagagtcgtcaggcaagtagaatgtattgattggggtggcaggtttaaaaccttgtagggcgattggcgacaggctgccaccagtgctgcgtctcatcagcatctgtggctcacccagggtgccctgctgcactgatcagacagcttcaagctcacctggaaggccgttgtctgccacaccgctgcgggacacctgggcagtgctgcgatacaggtgcttggcaagcgcgtaggccacctcgccatgcacagacaagcatgacttgcggtcgaagatgcggaccagaccagcttgctgcgggagtgcaaaaccaataagaattctggactcgtgcatgccaaggtccggggcatgtaaggcaaagcccaaacacaaggtggtgggcttgcactggggtgcacacccacgcccctccctccatatcaccacatggcgggagcctcctcacctgcggcagcgatgcataccagttttcaaatgcagactggtctacgccagacacttccaacagcggcgcctcctccggcatggctcaggcgagatggcgttcacagtgaaaggtgcccgagatcacttcggcggaagtgtacgccccatccacctctccagcacttctaatcgagcacaacctctctcctcggctgtacagggtaacgatttccatcgagcatgcagggccgggagcagggattcgaatcgcgaggtgtgatgaattgtgccatgctgcggcgtgcggggattcaagtcccattccacaagggcagtgttcctccagtgctgagggcagcagaatggcatgttggatgtatatcaacagaaagttctagtttatgagtattatttgatgccgtggctggagtgttgacaggaaggatgtgccccttggcttgcgaggaccccaatggaccgggtttcggtgaagcggaacgacaaggccgctgcttggcgagacaaggtcagtaaggggatcgtctgtgcaatgattgcactttcaaccgtcgactctgccgacattgacgccgtgatcggatttactccatcattgtgcagctccggagcgagtgtctggcacgggtacgcgagcagcggcagtctattctggacaagttgagagccagcagggaagagacgcctgcgggagggcgagcctccctcaaccttattctacataatgcgctcgattcacgaaaaaatggagacagaagcctggccatggattacaccctccctggaccagagtatgaagagctcatgcaggtgagtgtttaggtagtgtggtcgtcaatactgttcaccggcaaggcaggttcgcgcatgaaggtctgtgaatcgaaagtctacaacagggctcccatttttggcctcatttgcgcatagtccctggaggaagccctttggcaagacgccactgctctgggacacaatgaatgcgactaccttgacgacctggaggcagcagagatggaggcaagctggcaagcagctgaggcagagggttccaccccaactccctgcccatgctgtggctatcatgcactgtactgtggtcctggcggcagagtctcgtgcaaggcatgccacctcgatcttcaagttgcttcccttgaggccctgagggagctcctcgctgttgtcctgcaggtcagtcatgcacgggggtacattttccatagcagtgcccaaggatgcggcatccacctgcttctgccagcatggcctcccggcgcatgatcactacctgcttgtaggtttataccagcccacgtgtggaccctgcgacattccccccattcctgacctccaacaggagcactggcagaggggctgcaaccacacaccgtccttccaggcacacaggagccaagcaggagagtccacgcgcctatgggcccgctgtcagggctgcggcatgcgagtgcaagttttgtgatgcacagcatcccatctggccgggtaaactggtgcagagttgagcttcggtgccactgtgtgttcaacggtggacaaacaccagccttgcagccttacaatgctcgaccatggcttcacaagacaccgttgacggagggatgcagaagatcccggcgccgagatcgtgcggaagaggtcgatgagcaaccacaggcccacatttcgatgctgaggcacgcgaggacaacataaacatcatgagattcctaaaccataaggcattgatgaagatggtatcctgaggtatccccaccataggcagcctccaaggcctccatgtccgtgcgcataccccgtgagaaggtgtccgctgacaagtgggctgtatcgcacagcagcgacgaggccaagcgtgcgaagaagagggcgagacagggtgtcttgtccaggacgaccagcacggtggtcgagggcaccaggccaccccacgtgagtggctcatggtggtggccaggccacccctgcccgagatgcgaggttctgcagggctagcaactcatgtgatagaacttatccaccctgccatctccctttaaaaccctgcagcctctagctggcgcgggcgatgtcatcctgcaggcactccctcctgcggtccgtgaccccttgcagcgagccttgaccgatatgggcaccttcctgcaccagctctttcaccgacagcaggcgaaacagcccgagtcgagctcaagaccaggcaggacttgacctcatggtcattgccattgatcggatggggatcacacatgcgggagaggggggaggtgaatggcctcgtccctggtgcaagcaaatcagcccgggcccactgtaatacatgcacacctagcagaggcaggcaccaatacatcgtaccaccgcgcatggcactcgggtggccgcggccctcgcatgacggccgggcccttcagcgcgttacgcctccctcatgtcctggcccagccgtggcacggcctcgtcccagggcccattgatcttggccttgaatttgtgggccccccccagccacagcgggcacagcacgcccaggaaaactacaaccagcgcgaagagggcgccggcgtggcgcgaggcgccccagaccgctgcccccgcccccgccagcatgcccgccgtcagcgcggcacgcgcgccggcgccggcggcgcccacctggcgccgggcgtagggcgccagcacgaatgccagcagggagagcaggagctgggccgccacgtcagccacgtccctcaacctgctcgccaccaggatggccgccgccaggatggcggcgaggctgagggagccctgcagggaggccgcggggccggaggacgccgggcggtagtcggcgaggtagaggtgcgccagggccaggcccaggacgcaggccagcaccgtgtccgaggagatggagagggtgagcgtggagtacagggggctcatcagcgccgtggcggcggccagctgtagcatcgcggccgccgcggagcgcgggtcggcgggcaggggggcgggggcgggggcgagggtgcggatcagtgcccagccggcggtggagaacaaggcgcagcgcagcaggagacccgtgctcgtcaatcgaccctgcgagggatggggtgggcggagagggggggtggagacggaggggaacaggaagtcgagtgaaggagggtgtgggaaggaggcgagatgcagtgtggcacgtccagggtgcctgccaggaacagacgcaaggtgagttcatgcaatgggaccagtctagaccaacctttctcaatccaaaagctataatcaggctttggcaagcacgcgactcacggtgtataaattgtgggtgagtgcgcccacccagcagacggtggcgagctgctcaaggacagggcaagcctggctcacaactcgtgcgtagctccgcaccggcacacggtcgttgacgacaagggattccaggaaggcgggactggtgtagttgtcgggccatggctgctccttgtatagtaccttttgccagggcgagggagggggcggtggggggtcgcccccagggggcataccccgcccggcccggaatgacaagccctagggtgccagggcgatgcaaggagtcgtcaaatcaggcattgagacagcccaacatgtgcatttcatggctgtggctgcaagttacattgatcggtggggtgtcgggacttcctatcgcaggttcaaattggggcgcgcgggcgcgatgattggagttcttcttgctgccttgatgccacagcagtaggccatcgtactgtacaacgtgggggtttgcctgctttctgccacctttggagtagaatggaggcaccgtcaagcgcgccggctgcagaaccgcagtttctcgccagcggcaccgggaccgaaccggcccagccctccgcaacaggagacggtccatccacgagcaaagcgcagctggtaagggggcttagcagtgctggttttccatgatcaaggtcaagacagatccttaccctcccgatggttccaaccttctccggcgtcaatcctgtcccacacccctagattctcactctgggaagagtgaagaccctgatcaaagaggacgctgatgtcaagtttgtttcctcagaagcttacttcgcgattgccaaggcgacagtgagtgttgagggttgggacacagctgctgttgtctctcgagcatcccaccttacctggtggcactatcaagaggcacagctggggtgatgtacctgctgtctctggcaaacatcagaccgttcccttccctcctggcgcacgctccagtacctcctcttgcccacaccgcctcccaggagctgcttctagaagccatgacggaacgtgctgctcagccaatgctccagtctggacggagccaattggggtatggcgatgtcgcccaggcggtctccagctggcagtcgctggacttcctcggggacgttatcccgcacaagatccccgccggcgtcgtgctacagaagatgctggccgccaaggctgctgccgccgtggcataggcgtctcctctatggagcagagttgggggtggtgccctttccagctttgtgtcccatgggcatgctctcacaagtggatgctccacatactaccagccccaaacgtgatggaactgggaccaagagcctcccaggcttgtccttggcctctcttgaactgccatgactctgcaggcatgcaactgcgtggggcatccctgctctgtatgtgcggactgctcaagtatcatgtcaggcctctgaaggtgcttgagctggagcacatgcccatgccttaaagggaacaaacactgtgctcctgatgcagggggggtgccgtctactcagaggaatcagggggggtcaaagtggtgggcacatgccttggaatttcaccaagtgcctcacgcatagatgccagccagatacgttggcagttgcagggtcgatcaggcggaggtggcaaggacctcgggggcggccccggctcctgcgttgatcttctgctcgcgggccgtggcctgggagcatgcagcctgagcgacgcaatcgtgcccgatgaagttctgaagtggtagtgatgaatggcatcgccgtgagtcccgggttgtgaatgcagagatccataccagacaacgcaacattttgtgtgtccaagtgcatgcgctgtgccccatgagcacccattctgggtcttgagaagatgacccgggctcccaaaacccaccaggaagttgaagacggcgatcagcgtgaagcccacaaaggtcagggtgaggcgggagaagaggatcccagcggcgtcatccatggcctgcggaggggcatgggtatggcatgaggttgccagagctccatcacatgcacagcgtagcttggaaaattggtgatcacaagcccaggtcccctccagccatgacacatactcttcccccctgctcccagaaacacaaacacacacaccgaccttgaggttgtcgttggcaaagagcatggccaggacggtggctgtggcgcccaggatgtggatgcccaccgccggggtgcagctgctccgcgcggcattcagggtggcgcccgccaggtaggccagctggagggcccagccccaccactggaaacggtaggtcttcacgcaggatgcgacaagggcatccagcaccggctcctggtccagcaggagcttgcgggagttggtgcccaccacgtcccgggaccagcacagggactggagggcggccaggccgcacagggtcagggcggtggcgcaccagcccatggccagcgggccgtggcgcagcatcgtgttccttgggcaagccatcctaagcctctgtgggtcggtagcggtcgagaaaaggtcaacgcagggtggctgctggattcaaggagttttaatcatttggagtcttgtatggacaaccacagtcataataatggccatggccagccttcgagggcgggatctcggtcagacatgcccggtacgcacgacaccatgaaccctcgccctgagctccatcgcacccttttcctgtgtcaaatgactcaaacaatacaaagatgataaaaacacggtgttgccggagtgctttgcagaaacggtacgtatgggccagggtcttcgtctccacggnnnnnnnnnntggccatgagtaatggccatggccagccttcgagggtgggatctcggtcagacatgcccggtacgcacgacaccctgaaccctcggcctgagctccatcgcacccttttccggtggtaaatgactcgaacaatataaagatgattaagacacggtgtaaacggagtgctttgccgaaacaggacgtatgggccagggtcttcgtctccacggtcatctcgaccgtcgttttccggattgcgggcttgagaaagaaagtggtgggtttgtgctaaacgctcggtcctaaggcagcccgggccgacccatgcctcgataagggacacaaatgctaatgatggctcggaaggtctccaatgagtccccgctagacccgaagccctttttcccacttcgcgaggcttgcaggggctagtcggggtacgcacacatgttacgaagcagcgttttagattaaattagtaaaaaatgggtgaggaatcgagggcaggggcgttccactgcagtccgggcatctccgtgctgctcgacgggcccccgttgggctcgacgaggccaaggagcaattcctcacagccgttcacctcaccaggccccagatgccagccacccannnnnnnnnnaataagggacacagatgctaacgatggctcggaaggtctccaacaagtccccgctagacctgaagccttttcccacttcgcgaggcttgcaggggccagtcggggtacgcacacatggtacgaagcagcgttttagattaaattagtatcaaatgggtgaggaatcgagtgcaggggtgttccactgcagtccgggcatctccgtgctnnnnnnnnnnatggcaaacatgggatgcacagcaaacctatggtcgccttggccttcatttgccagcagaagcagtctgccgcctattgccattccccctctcgagatagggccggatatggcgtactcccccgtcaagatgccgcgcaaagatgatggcctcnnnnnnnnnngttccccctctcgagatagggcaggatatggggtactccccggtcaagatgccgcgcaaagatgatggcctcctctgtccagcaggcagcccagattgcagcttccgtcaggacgtagtacagtgcgccgcactcctccaaccaatcattctctgcgatcagggttatccagattgcgagagtctagaatgcttcagtaaacactggctggccctcacctagcaagcccaggttgccagggatggtcaggagtgatgtgtgtgtgctatttctgtccatcatgtgtaggatggtagnnnnnnnnnnctcgcaagcatgggatgcacagcaaatctatgatcgccttggccttcatttgccagcagaagcnnnnnnnnnncgcgagagtcaagactgctgaagtaaacactggctggccctcacctagcaagcccaggttgccagggatgatcaggagtgatgcgtgtgttatatttctgtccatcatgtgtaggatggtagctctgtctgctctttgggggtaaagctatatggatctgaagccgggacaagacgggtttcaagtggcaggtctgcctctggcacctgcccattgctacgccttcagccggtgctggccttggatgctgcgatgcgccctctgttattgctaggaaaattggatccatcatcggctcgatgcgtcaaattaaaaggacannnnnnnnnnttctgccggtgctggctttggatactgcgatgcgtcctctatcagtgctagtacaagtggatccatcatcggctcgatgcatcaaatagaaaggacatccccgccggtgtctcccagttgtgttgatgtgggccagtttccatcagatatttcatcatatggccaaggacatggcatggcggctgctacttttcgaatttgtgcaggaggcggaggcatgggtccnnnnnnnnnngaatcagcatacaagtggggatgggcaacaaatacagcactgaatacaatggtttaaaaagagtgcatcaaggcaattcaaggaccacgagtattgatgtttctcttagcccatgtattcactcctcagcggcagggaagcttgcccnnnnnnnnnntacagatacttcattatatggccaaggacatgacatggcggctgctacttttcaaatttgtgcaggaggcggaggcatgggtccccttgcagtggccctaataggatctttttcggtgattgacgcagtttgcagcatataatcagcatacaggcggggatgggcaaagaatacagcactgaatacaatggtttgaaaagagtgcatcaaggcaattcaaggaacacaagtattgatgtttctcttagcccatgtgttcactcctcagcggcagggaagcttgccctaggaaacacttataactgagccgaaagggtcccgatgggcatgcggagctgctgggcaagcaggcagcagcgcggatgcagtgctgaattaccgaccctgggagcgatcactgtgcatgatgtccaatgttcctttgcactcgaaatgagcctcaatgtgtcnnnnnnnnnngcagcaggcagcagcgcggatgcagagctgaattaccgccctggaagcgatcactgtgcatgatgtccaatgtttctttgcactcgaaatgagcctcaatgtgtcatttctgaatcgtactgcttcatgcagtgagccttcaggaggtcgtactctaggacaggtcgcaaatatacagcatccgtggaagttgtgacagaagtcattcctgcgcaatttgagagggcacgatggcccacagctcaagcatctattgattttgtatgtgtgccttaattggatcgaatccgccaactgattgaacgtcggtgtgagtcctcttgtcgcccgggggtatggcaggaagctggctcatcgtgtccggggcctcccatgtccggnnnnnnnnnnccaatttgagagggcacgatggcccacagcttaagcatctattgattttgcatgtgtgtcttaattgaattgaatccgccaactgattgaatgtcggtgtgagtcctcttgtcgcccggggatatggcaggaagctgcctcatcgtgtccggggcctcccatgtccggataggagcgagagagggggggtgggggtaagatggacatacaagcgacctcggtatacgtaatactagctcaaaaatctttaatttatttttctcccaaggtacatcgcggtacccatctggtggacgttgaggccctgtacgggtttgtgcggcaaaatggcgccgcgtgggcaggctaccctgatgnnnnnnnnnntgaagttgttttggaaatgcatggtgcgcgtatctatctatgttcagttggtgacgtccgcccgcccgccatctctgccgcaagggcgcttgctcgacgaagttcttcccgcnnnnnnnnnnttctttagtttgtttttctcccaaggtacattgcggtacccatctggtggacgttgaggccttgcacgggtttgtgcggcaacatggcgccgcgtgggcaggctaccctgatgagctacgcgcttctcgtactaagccttggtgtattctcaagggtgagtcagatggaagttcttactatacgaagctgtttgggaaatgtatggtgcgcgtatccatctatgttcagttggtgacgtccgccagcccaccatctttgccgcaagggtgcttgctcgacaaagttctttccgctcccaactgttacatgagcaaggccattcacatatgactgttttttcagggcttgatgctgtcgaagtttgccctctgagagtctagatgttgctgtccgacgggcaagattcgcctcgtacagcccggatgtacagcgtccgggccacggaagctggatcctcannnnnnnnnnaactgtcacgtgagtaaggccattcacatatgactgtttttccagggcttgatgctgtcgaagtttgctctctgagagtctagatgctgctgtccgatgggcaagattcgcctcgtaaagcccggatgtatagcgtccgggccacggaagctggatcctcaaccaacaccaacacccccaaacaccccttgttctcccataggtacggaccccacgtgtatatgctggaggccagcagcgcagatgacatttgcaggttcgttctgagttgggtttggtcttggtcctggaatgcagatccaaactagtgacggactcaaatggctggctccttctattgaattccctccatcacaagcacaacaggtggatgggctacagcaaggcggggtcgattagggggacaacccttcacgttcttggcgtttctgccagcgccttcaagatgacgccctttgagatcatcaaggagaggtccaccaggatnnnnnnnnnncctgagttgggtctggtcttggtcctggaatgcagatccaagccagtgaccgactcaaatggatggttccttctaatgaatcccctccatcacaagcacaacaggtggatggnnnnnnnnnncattggtgtgcaggcttgggaaatcgattgtgtggcgctggggtcctgattgttgcacaagctgggtggagagatgcgccatgcatgagtatgaccttgctcaacgacagcatcccgactctatcgtgcgcagggagctacaacaagggatacctgnnnnnnnnnntattggtgtgcaggcttgggaaatcgatggtatggcactggggtcctgattgttgcacaagctgggtnnnnnnnnnnnnnnnnnnnnnnnnnnnnnnnnnnnnnnnnnnnnnnnnnnnnnnnnnnnngcccaagaaggcatcccctcaaccctccaagaaagccgccccccctcctctcaaaattgcatccccgccgcctcccgcaaaggcgtccccgccactctttccaatcggatcactgnnnnnnnnnntcccaagaaggcatccccaccgcccaccaagaagacgttcccctcgccgccactcaagaaggcaccccccccacctcccaaaaaggcatccccgccactctttccaatcggatcactgcctccaccatcatctcccagccctccgccctcctcaccgcccccaaaccctccaccaccatcccgaccacccagccctccaccaccatcccgaccacccagtcctccaccaccatccccaccacccagccctccaccaacctcaccgcctcatagccctccaccatcaccaccaccaacgtcttcccccccgagcccgcca

SEQ ID NO: 42972 - DNA, 71 bp, Chlorella protothecoides
ctgccggatgctgcggcgtgtggcttggggggggccagggggcctgtcagccggctccagagtcgtgggac

SEQ ID NO: 42973 - DNA, 61 bp, Chlorella protothecoides
ggcctccccccggcgctgcagcgcggccttggcggtcttgatcccggcgatgtcgcgctcc

SEQ ID NO: 42974 - DNA, 61 bp, Chlorella protothecoides
gtccatgtccattcattcatgcgtggcggcgctgtccatgtccattcattcatgcgtggcg

SEQ ID NO: 42975 - DNA, 14248 bp, Chlorella protothecoides
  modified_base (177)..(236): a, c, t, g, unknown or other
ggcggtggggctactggccccgccccctgccctggccccgctgctgggcctggcagacctgggccagggcgccgcctgggacgcgcaccgcgcggcgcggctggcgcccggcgcgcgctgcttcctcaccggtgcccccgccacgcgcctgctgccagactggcgggcggggggcgnnnnnnnnnnnnnnnnnnnnnnnnnnnnnnnnnnnnnnnnnnnnnnnnnnnnnnnnnnnnccacttggcgggcttcctccccgcctgcaccccagtccacgcgctgctcagttccaccgccccggacacgggccaggtcgatgctctcgccgcgctcaaccagtggaccgaggaggagggcgaggcctatgttgggcacctccagcgcggcaaacagtgggaggggcggtggagcgtcgacgtctcgctgctgaccagggagaggctccccacgccgccgggcctgccgctggggatttgagccgctctgggcggcatgtgctgatatcttctgtataggactacaagaacacttgtggaaaacctcaagatcactgttactacggggcaagggcggtgcatgcatggatcatgggcagttggatgggggtggagcacgagaagggtataggtggctggacagcacgggaaggttgcgggggtggagtgcaggggtgacgggcgcacagagctctggggtcgcatcggggtgatggttggttcagcaagccacatcataccagggaaaaggtaaaagggtcgctgcaggcgttcttcattctgtgggtacgtggaggggtcttggcagctactggatcactggaggagttctgggcgagatggatgcaaatgcctcgggagcccagttcactcctcgaagtcgaggggtcccgggaggggttcatgaatgtaagagtcacggccctgtacatagtctgcctcatcctcctccgtgtcccagtctgccatggggtcctcctgcaggtggcgtgcctggctggtctgagacggagggccaggtacaggcatcttgtggacgctggatccactgtgagcactgccgaacagctgccccaaagcctgggagctgcatgcacccattggtgcaccataccctaataacacacacctggcaccaagagggagagctggactggtcctgggagggatatggcgtggcggctcgcttcgaagggcccaatatcctggcagcgagctcatcctccagcccctcctcgtagaggggtgggaagggacgcaggcaggagacggcttcgtcaccatcctcatctccactgcagagaggcaggttgagggtacacgtagaatgtggagcttgagacagggtttcaagccttcctgtcgaggtataaacccttccttgctcatcgccagagatcacctggaatggctgtcatgggcgctgggagcgtgcatgagcctgactcgctttggagctgggccatccaccgtgacgctgtccgagggcccagggggcattctttggacgatggggggggtgatcacgggcaggtgggccacggagtccaagccatggcttcccattgaccaatggctgggggagggatgggcagcatgccatggagctagcagatctgcaatagtgaaggagtgcgcatcgggctgatgatacgtcctgcgacgcaccggattacattaatatcgcttttttatgccacttaccgacgcgctggggggttcccatgtctttcgcggccattgcgatgtcatgaaagtcggctgccggcgactcgtgccgttccatgccggggtaggaactgggacactccgggaaggcgtcttggtgcatgatcactagagagtggtgcgtaatgtgctcttgggtatcagttattgattctggtggctgtttttgggggatgcaagtccgcacatcactcgttcatgaaggcgtgtgctttcaatattcaaacaatcatgcttttccatgctttccggcagatgcgtaacaacagacatgtgcgtgtgttacgtagctggggtgcaggcaccccctgcccgcatagtcattgaagcgctctctgggcccacttcccacgatggacgaccccctgcaccgcaggtttggtcgcagggatgggcgcaggtgcggacttggctgcaggtggcctgtgcgcgctggaggctgcccgggccttctcgtcctcacgctgctgcagagcgcgagccgcctcaaacaacccctgagcgtcgagctgcggcgcggcgccgatcacggccgatcgtctgggctgctgtgtttgagctgcaccaggccctggccccgatgcagccacagtcgcagcacccgcagctcgccgccgctcctgctctattgtctcatgggcggccgccaggctggcttccgccgcggagctcacgcccgtgctggccaagccaggctcctggtacggcgcaaaggcgccggtctcgccatccagggtgccccacacccccaggctggggtggcagtacatgccggagttggcatcgtagtagtaccccgacccgggatcatacatgtagccggaggcggggtcgtacgcgaaccccggcgccgctgagggagcctggctcgcttcttcggtggtggacccatgcccccttgcttccatgacggctgacgagccgggcccatcccctgggcgctcgcaatccacggcaaccggagcagcagctgcctcggcatcgccggtctcctgctcctcaaagctggcgggctcccagctggtgccctccaggacaccattgggtccaagctccacctgcgctgcctcgcccccacgcagtccctcctccgcaaactcgatggtcagcggcccaaactgtgcctccagtgcctctgtgtgggtctgcgccacgtcatgaagaagcaggaggcaggggttatggtgtggctgagatgtacttccatcccaggatagaaaaacagtggcatgaactgcgactcgtacgcgtagaccgcccaggcaggccgcgtcggcccacctgcaccgcagccagcgcctggctggcctcctggtgactagagaataccacaaaggcggagtcggcgggagctgtgggcccacctggacctcgcacgatgcgcacctccttgactgcgcacagatggaaggggggggggatgtagccccgatctgtttgtcctgtgttgtcgctcatcagcctgcatccctgcagaacaccattgcccgagaggcagaggctggggcgtgccggcgaagagcgctggcagcgacctcatgcctgcattcctgagatcctcccgcacttcctgacgagggacttgcccactgccatccacgcgcaccctctgcaacgggccggaacacggcttggagggcgggcccgtccacgtgccggctcaggccggtgactcgcagcgtgctcgacgcacgctgcctcacctcccgggcgcctgccgcctgcacgccctcgcgcgaggaggagcagacaaagcaggcctggcgcctgccaaagttgagcgcctggcaccgaccgcagacccagtcctccctgggtgtcttctgcggagggggctcccagtgggggggaggctgctgccgcccatctgcgggcggggaccgccgcgatcgcactgcctcggaaaggtatggctcggcgtcccgcccatcgtccaatccagcctccaggctcgcctcataccgggtccgggagtcgttggggaggtaggctcggcgtctaccgtcctcctctcctgcgcccatggcggggtggaagaccagggataatgccggtgtaccacagcacgtagcagcaagatggacacaaggcttctccatcaccaatgtgctcagctctaggactcacgtcggcgctcgccctcgtatctgtcgtgctgccagacttgctcagggctcacccgccgacgcaggtcccgcccaggctcgcgctcgcgccgctcggggcttccagacctttcccgttcgtcacggccatctcgccggccgcaggagcttgcagctctgtggcgcacgcttgagtcgctcctgctgcgatgctcctgggtcaagttctcctcgttggtctcgcgccgatgccggtggcgaaagttctccctcgactgtgtggcccacacagtcgactccccctctggggcccgccattcctcaggaggtgtccatcgatcaggctcccgcgccccacgagacctgtcccgtcttgcatgagcatgcggagatggggggcgcctccatccatcctcgcgtcttggagagtgcctgtgataagggtgatggcaggattatcacgctggagggacaggggtgcgggcagggtctggagtggcgaaatggcgctctgccagagcctcattggcgcatgcagctgcttgccagcatcacctgcgcctgctcctgctccgtggccgcgagcgagaccgcctcctcctccgcctgtctgttgttgggtggcgcaagggaagtcagggcccggaagagtcatcacaacatgtggggccgcaacacccggcgccgcgcattgttggaaaccttgggatcctgagggggagcgactgcggtcgtgcatggtgtgtcagcggcttcagcggaacctcatcgatggcgcggcttgggggacgcccactccggtgctgtgctgtgcagtcccgccgacaatgggcacagctgaccgtcagggtgtgtgtaatagttgtctgttccctgcaagaaacttcggtgtcgtgccggccctgcgtgccatcgaatttctgagttcgccacttgagctcaagcatgctgatttcgagcgcgcgatgtcgacgttgaaggtttaccgctgcccatccctcatcccctacaccttggacacagtacgtgtgaagcttgtactgttcccaatatgattacaccccttccgacagtactgaaggggtgggctgtagattgtgacagtatggaccaaagggcagcatgtttgccagagtggtttgtgtctagactggacagcctaccacaaccccagagcagggcgttaatcattgctgccctcaacctcagccgacagaccatggatgtcaacccatcgaccctgctgctcatctggcatgggccagtgcgaggaggcgaggcaggtccacctcgccaagacctcggctgcaccggcggggtctcgaagactgtcggcgctccaggccagcggtcccctcttggttacggcgacactcggcgacggaacggctctaccatggccacagctgccgcacccgcctcgccccctgcgcagccaatcccaaccttcctcacgcgcccttcttgtacaccgtctcctccgcccccgcccgcttcgcggccagccgcgcggcggtgaacaggtagtcgctgaggcggttgaggtacacccccaccgcctcatccgtggccccagcccccaccagtgggaccacggcgcgctcggcgcggcggcacacgctgcgcgcgaggtgcagagcggcggcggcgtgcccgcccgagggcaggatgaagttggtcagcggcggcagctcggcgctggcctcgtcgatccaggcctccagcaggggtgtgtgggcgggatcgaaggccgcccggcgcagcttggcctcgctggcgctggccagtggcgtcgccaccgccgacccgacgtccagcagccggctctggatggtggcgagctgttgatttggatgtcaccatggctcggtgttaggtttggtgttgaagaagctgtgccatcaggatgccggggcgacttgggtaatggcacatgtggcagcggcccctccagaccctcaacatgctggaaaggcttgggatgctgcctttgttgcgtgtcgcacgcgaccgggaagaacacaccgtagcgcacctggagggccatgctggggtcgaggcccctgacatgctcccctgccacgccgatggcggagttcagctcgtcgacgtcgcccagggccgcaaaggtggcatcatccttggcacgacgctcgccggtgtacagcgatgacgtgcccttgtctccggtcttggtgtagattttcatgctggtgaaggttgggggcaggggtgaagcacgggaacccatctagaatgaccatgggcggcgcatcccatcaccgatcagccgtcagcaatcttcaatcgatctcttgatacctgatgccggtggagtggtaggatctgacggcgatgctgggtgctgtcctcctgaacaagccggtcgccaacagggccaggccagacatgcaggcgggggggctgggatccttgcaggcgcttagctggcgatcgatgtggggagaaggttcaacctaagcctgaatgtggatggcctccctggtcgtatcacatggacggcgaggctgtgtggacccgaatgcaaggaatgccggacccgctccatatcagattccccgacatgccatgtcgtgcgtgctgtcccgctggctggccatttcgaaactgcaaactgaaggatgccgacgacctcgccaatcaacggggccggaatccgaggggaacgcgtgatagagcagctctgcagagtatcgcccgtgaagatggcaggcagtggagctcctcgtgtcctcatcagccccagtgagtggggatgcgagactcgacagcgcgtggtgtgtgccgattcccttagctgacagatcgcatgaataagtaagactcagtgaacccacgaaactgcaacatagagctggaagccgcatgcggtcatggcgacggagctccctgtttcttcacaatgtcgcatccggcaacaggtgtgtgtcgttgccaaccataatgcatggctcaggcatcccgctgcaaagatggaaactgcaggctgcaatccatcattactgctcctgcaggtgatgatgtcacgtacctggccactgccagcaccatctgtgaggtcaatgtgcacaagccaagctacacatcatggtttgtgggcgacagcgtggtggaaggtacgccctgacagcaatgattgcagcgttggcgagctaagggcatatgggtttcaacatgaccttgaatacagcagggttctcatcaaatattcagtccctgacttaatgcccacccacagatgggtcaacctaccttgcaacgcccatggacccgctgtttctcattctgcccgccttggagcgagcctgcacccgaggtttctgcgacaccgaaaccctgcttgaagcctcagggctaccgccctgctgtttctacatccttgccaagactaacctggacagtgtgtgtagctccaaggccgtcatggaccagaagtactatcagcttgacgagacaaaggtaggacggagagatgttgagctgtaatggggcacacatagtaattgatccctgcgtgtgttgcacctatgtccataccaagcatctcatctggactaggaaggggagactatgctgttgaccccaatagtaatgtcaggatcaccctgcactctcatcacgttccaccaaccacatcctcctcatagaccctcaactggctgaagaccaaggtcgaaaacaccaagaatggactgcgatccctcaggtatgggggccaaactcctgcatgccgtcgacgcgagtgtgaagggccgacgagcgcaggttccattgtttgccataggcctccgatgctgcagcctgtgctcacgtcaactgatcgaattgagagttacacgctgcaggaatccagaagctcacatccgaaacccctgcatagcacccacagatcccttggctgggctgatgcggaggagggggtgctcctgccgtatgctgtgggcctagtgtgtgagtatcttcctccccaccgtgtggagagtctacgaacttatttgaatgttgggatggagccagccagccctgctgtggcaggcatgccctatccagtatctgaggtcgacacccagccaaaaaggaaaaaggtgagctgcttggggcggtatcctgttggatgcattcagatggggacagtgcctgcacgagttctatgtggaacagagagtaccttcatcgtctccatttggggctcattgccctccctcccttgcttcttcagttgaccccggcggaggcagctaagctgaaggcagctgagtcacgacagctgaacaaggcagcaaaagcagcaaaggaggcagcaggcacgagaaaactgtctggtttcttcaagcccagggcaggcaccaaccagagtgcatgattgcagctccagctcgtctcactgatgtgttttgctttgctcctcagatcaagcatggtatgtgacagcatattgggatcttgagaaagcagacctacatttcacattcagaatatatattatgaaacatgatttgccacaatcccgcacagaggtgacttgggcaaaccgaagtgatggtaatgaccctttgcatcaccacctagcaccctctcagggccgtcagggcttgcgcagcagcctggatgatgtgcagctgcgcctccacccggtcctccccgctcagcaggtgcgtcgcccgcgccatttgccggagcaccgccgccttggcgtctgctatgatgacgccagcttcaagctggctgccggtgtccggtagcgaggcatgagcaggggccgcttggtcgtcccgcgccgccgctgctgcttcaggggagccaaggggtgggagggcgccgctcccagactggtcggacgtggtactcgcctcgccaatctgctcggcggcggcaggcggacgagcagccgggccagactgcgttggctgcgcctcgctttccaggcggaccggcatcttgcaggagacgcagaacacctggcgctcccggctcctgaccagcaccgtcgagcagctgcaaggggagggagggcatcgttgagggaatggtaatctactgccgaggcttcatccgcgcaacaaggttgccagccccatgcaccgccatgcctgtacccagcaaaggctgactacactcgcagtggctccccatccagcccacacccgccgcccgctcacatcggacacgactggcccagcagcgtccagccatggagcatgcggtccgccaggctctgtgagatctcctgctcccgctcgtcctcggcggcacgctgaatgcgctgggccagggtggggccctggagcaccgaccccgggctgctcaggtcttcggagatctcagcctgcaagcccggtcctggtgcaggtgcggcctgcgccggcctggcctcacaggtgacgcacacggtgtcctcagagtttggcttcctcatcagaggggtctgcgcgggagttgtgcagatgtcatgaagatgagctctggtagccaggggtgccgtcctggaactcttgaccctgtgtagcaaccaagcctctcctctgatggctacccaccccgcagtgctcgcagccgtcggccagcatggcccaaccttggagcaggagacttcccatgctcgctgaggtgttggatcggtctgtgggggagctcacgtccatcgctggttggcccatgggtggtcacaagggtaggggtcccccgcggcgatgtcagcgaaaagatggtcgatgagcagctcaaagtaagtactgcgattcaagaatttaccagcgtacttgcagccgcgcttgctcgtgcagagcctcgcgggtccgaaaagtcaaatcgcgcgccagacgacggagtggttttttgggtgcgccatgcttgctgcaggtccaaagcaagcatcaattcccaaatcaggaaagcttgtcacgtgcactgaaatccacattagaagcgtgtagcagcacatgtaagaaaccgcgcaatgttacacgtgaatgccaggaggtgcaaagaatgagacgggtgcaggggtccctcatcgcttgcccctgctcttaaggggcgcaggtttccctccctttccccccttcttcccgcccgcctccttggcctccgccttgcgcccgcccttgccgcctgtcttggggcccggctgcttgaagcccccggcactccgcttgccctccagctttagcttggtccgcgctatcgcacgcagggtggccttggacacgtgcgtccgaacgcgcgccggctcccctcccccgccgttgccgccgccactctgcactgcggactttttagccctggcgactccaggccctggccactcgcccaggtcgcggtcgtcatcgtcgtcattgggccccggccccgcctcctcctcgtcgctgctgttcaggtcgatggcagacaccgtcacccggctctccaccgccccgtggctgaagacatgcaccctgcgctccacgtcctccgccagggaaggcgccgccggatccaggtcggggcccagggtggagtaccgctccttcagcgcctcgcgacgctagagtggaggagggaaacggggagggtgtgagggctcggcacgagcgtggcacacctggaagccgcagacgccccgccagtggagtataggggatggtcgcatgcgtcgcagccgtcctccaactggggcggggtattttctgctcagccagcttccccaggcttgcggcatagacccggtgatcccatcccctgtcatagccatgccataagtgtacggcaaccctggctccttgaaccccttcccaaactcacatcagcgcgctcctccaggcgctgctgtttcagttccttctcgaccctggcaacggcatccttgcgccgctgctgcttccgcttgtggaacccgttcaagtactccctgtggtggcgagggatatattagaaggctggatagagttccgcactaccagatgcctgcatactgtggacaccaaaacccacttggcggagcctgaccacacaaggacaggccctgcaagctgacagcatccgctgggcgacacacttgtggtcctgggggtcgaacacgacggacagggccttgttccgctgcgcgcgtttggctacatgcacgggcgccttggtcggtcctcggggaacgagcagaccgtccgtctccttctcgcccatgctctgccgccctcttcctccggcagcactgcccgtcgccgagtgtcaacgacctgaaaggtgcaaaaagcggactcaccgcaggacgactgcgtatattgataaggtcgagggcataaattgacgtatgtatgcagtcgacccgaggagcaagcgcaccgtttatcaccttgcatgaatgtcgtgccgacacattgtcagggcgcgcgcgctcgcccgctggcttctcctggcctggagtcctgattcaacattttacactgcatccccgttcacagtggtcagcagactcggcgcgtcgcaccacccggtaacgtgcacatcctgcagctcggctcttcccccctgagactgcaggagcgggctcccccagtcggggcgcaggggccgcaggtactcgaccgcagaatcccgcacggccaccgccgccccctcggtcacgaacagggcatgtgaggtggtccctggcaccacgccgcggtcgctgggccggaagtccagccccgcgtacggccagtcggagcgccaggccatggtcaggtgcgcttggctgatgcgcaggtcgctgacacgccccgccacaaacacccccgtctcggaccgcgcctgcacgcgctccacgctcacgcccctcaccctgcccaaggggccccctgccacgcgagggacggcggtgacgtgcagcgcctccccgcccccccaccagctggggtggtagtggcgggcgtgcaggccaatgtcccggaaggcgatgcgctcaacgctgccctcgtcccgcaactggatggccaggcctcggtgggagggcaggatctgttgcacgtgagcggggaggcggtgggttgggatcagggtcagatcggccaaggctgggcaggtccagggggtcgtcccctagaggggctggcgggtcgtggggtctgatgggtgaggggcggctggattcccagggacacattcggtcgcgcttggccatgcaccctgaggtgatgcacagagtccactctccttgccacatgagttgaccacccagggtccgccaccccatgcgcagcacccttcccacctcgttccccgctcccaccttccctacagcccaccctcacgcccacaccgtgaggtcaccgaaggtcacgtcgctgatgtcggcccgggtctcgctcccaaccttgacggcggcggagcgggagcgcagcgtgcagtttgtgacgctgacgcggcgcgtgggacgccccggcgtacacgccttgaggcacactgcgtcgtcggcggtgagcacggtgcagccccgcacgtccacgtcccaggagccgtccacatccacgccgtcggcgttggccacgccccactcgctgcggatgtccaggccgtccagcgcgacgtgcacgctgtgcctgacatgcagggcccagtacacggggtcgcgcagggccaggccccgcacgctgacctggcgggagtccagcacccccagcagccgggggcggcactcgctgggcacggggcaggaggggtcagcccagtccaccagcgctcggcgcccgggcgcgcgaaccttgtcccaggcgcgggcgtccccgtccagggtgccgccgccgcgcaggctgcatccggtgcagttgcgcagggcaatcaggtaccagtctggctgggtggggccgtagtccgagcgctgctcgaagggaaagggggggggggtgcctgagctctgcgcccatgggaagggggggaacaccacatgaaacaacaaatccatggaccatgtcaatctcaccccagaacccgcccaccttgtggctggccagcaatcgcacgccccgcgggatgacgatgtcgatcgatccatgagcgaccagcccccctgccaggaaggtgccgggccggtccaagaccagctgccccccttgggcacagtcgtccagccccgcctggagggctggggcgctggatgacctgccagtggggtccaggccagggtagccagatgccaggcagatccggcctgcttgcgagcgcgtggacgtgtacaggacgacgaggtagagagtcaggatccgaggacccatgctgacactgaggccgtgggcgcgggcgcggcggactttcgtaaaccttgcggacgtgctgggcaccgacaggaaaggcaggccccagggttactcatgccacgcgatgaaaatcatgtgctcataaactgaagactgaatgtagatcgatgcatattcaaattgtttgctcaaggtcgatactttcccagctccatctacagcggtatcgtcgcggggatactccccacagcaggctacacacttcccagctgagagcgagcgcaaggtcagtgagacctcagaattacggctcgataccttctagacccataatacatcttgtacaaggaaaaatgccgggactggacgtcagaagctcgacccagcaggtgagcgggagggcatcgtaggggtgtgtcatcgaagccggagagtagtcatgccgcacagcggcacctcgcggggcgcggcatcggaaccaagatcgcgagccatgcatccgcttaagcctggccttcgacctttttcaggccaacggaaagatgtatgcccagaaggcatcgagcgagggctcctacaccacccccgagggcgtgacggtgttgggagcatacaagccggagttcgagtccatcctgaccgaggatgcactgtccttcgtggcgtccctggcccgcaaatactcctccaggtatgtagaatggtttcctggcggatcttcgatctggttaccctgtctttgattgtcggaaaaccctgccagtcgcttggacagacaccaacatcagctgacgcacaccgcagggtcacagagctgctggctcgccgcaagagcatccaggccgccttcgatgccggagcaaagcccaattttttcgccgagacccaacatgtaggttcatcaggattgattgtggttggacgaggtggcatcttcatttggaaaaaggggggaagaagtctatttggtcatgacatgttgaaggcctgccaccccatcaaggaccatgttgggaacctgacacgcaagtagtgcctgcagctggctttcccctgttaccaactacccccacctatcataaccccctcgtaggtgcgggacggcgattggcgcgtgggccccctgcccgccgacttcctggaccggcgcgtggagatcaccggccccaccgaccgcaagatggtgatcaac

SEQ ID NO: 42976 - DNA, 77 bp, Chlorella protothecoides
cgattggcagctgcatgaagtcgcccggacacaagtgcgagtgagtacatgaggcgttcgtcatgaacattccggtg

SEQ ID NO: 42977 - DNA, 67 bp, Chlorella protothecoides
aggtcaacggttcgagcccgtttggggccatactgtcctggccccatagctcagttggttagagcgg

SEQ ID NO: 42978 - DNA, 61 bp, Chlorella protothecoides
actcgggtgaggggcgtggacttgtggcggggtgatgcgctgcagagcccggtgccactgc

SEQ ID NO: 42979 - DNA, 62 bp, Chlorella protothecoides
gcggccagccccgcatcgtcgccatccccggaatccagccccgcatcctccccctctccagc

SEQ ID NO: 42980 - DNA, 121 bp, Chlorella protothecoides
ggaggaagaggtgaaggtggagagcgatgcagaggaggaggatggtggggagcgtgcgggccccgccgccgggccgagtcggaagcggggcgccgcctccgcccccgcgcccgccagggcg

SEQ ID NO: 42981 - DNA, 310 bp, Chlorella protothecoides
cgcgtcggcgagccgtccgacgccgcgcccccgaccctagagcggtcgagcggggcggccccggcgccgctgcgccggcacagctcgtcgcgccaggtcagcgcctcgctggagacgctggactcgctgacgccgctggtggacgtctgggacctgctggccggccacgcgcgggcgctggtggaggacgccgcgtacgcgcgcctggcgggcttcagcgccgcgctgcgtgcgctgccgggcacctcgctggcgacgctgctgggcggcacgggcgggacggtcgattcaggcgccgggctggatgcgg

SEQ ID NO: 42982 - DNA, 61 bp, Chlorella protothecoides
aggtggctgcacacagggcccagagccgggggcaggccgggctcagggccagggccccgcg

SEQ ID NO: 42983 - DNA, 26148 bp, Chlorella protothecoides
  modified_base (420)..(429): a, c, t, g, unknown or other
  modified_base (2341)..(2380): a, c, t, g, unknown or other
  modified_base (2433)..(2442): a, c, t, g, unknown or other
  modified_base (3296)..(3305): a, c, t, g, unknown or other
  modified_base (3900)..(3909): a, c, t, g, unknown or other
  modified_base (4196)..(4205): a, c, t, g, unknown or other
  modified_base (4519)..(4528): a, c, t, g, unknown or other
  modified_base (5403)..(5412): a, c, t, g, unknown or other
  modified_base (6093)..(6102): a, c, t, g, unknown or other
  modified_base (7639)..(7743): a, c, t, g, unknown or other
  modified_base (8453)..(8462): a, c, t, g, unknown or other
  modified_base (9082)..(9091): a, c, t, g, unknown or other
  modified_base (9728)..(9737): a, c, t, g, unknown or other
  modified_base (9805)..(9814): a, c, t, g, unknown or other
  modified_base (10600)..(10609): a, c, t, g, unknown or other
  modified_base (11453)..(11462): a, c, t, g, unknown or other
  modified_base (12368)..(12377): a, c, t, g, unknown or other
  modified_base (13244)..(13253): a, c, t, g, unknown or other
  modified_base (13599)..(13608): a, c, t, g, unknown or other
  modified_base (14918)..(14927): a, c, t, g, unknown or other
  modified_base (14997)..(15035): a, c, t, g, unknown or other
  modified_base (15947)..(15956): a, c, t, g, unknown or other
  modified_base (16027)..(16036): a, c, t, g, unknown or other
  modified_base (16124)..(16133): a, c, t, g, unknown or other
  modified_base (18000)..(18009): a, c, t, g, unknown or other
  modified_base (18381)..(18390): a, c, t, g, unknown or other
  modified_base (19658)..(19667): a, c, t, g, unknown or other
  modified_base (19878)..(19887): a, c, t, g, unknown or other
  modified_base (20308)..(20317): a, c, t, g, unknown or other
  modified_base (21146)..(21155): a, c, t, g, unknown or other
  modified_base (21229)..(21395): a, c, t, g, unknown or other
  modified_base (21664)..(21673): a, c, t, g, unknown or other
  modified_base (22089)..(22098): a, c, t, g, unknown or other
  modified_base (22304)..(22313): a, c, t, g, unknown or other
  modified_base (24728)..(24737): a, c, t, g, unknown or other
  modified_base (25392)..(25401): a, c, t, g, unknown or other
  modified_base (25932)..(25941): a, c, t, g, unknown or other
ccgacctggcggacctggcggccgcagcggtgccggggacggcgcgcgcgccggggtccgacgcgccgggacccgccgacgtcgccaccgcagtgcacaactgccactaccggccctacctggagaagcaggccgcggaggtggcggagatggcgcgggacgaggcgctgcacctgcccccggacctggactacgcggccatgccggtgagtggtgaggggaggggagggtggtgagaggctcctgcaccgccagatgtttcctgtgaatgagttgctgcgatgccttggttcccctgttgaccactaggcacttatcaccgataccgccacctgacaagagcagtcactcgattgttcatccctcccatatcccccaacccccacaaccaaccaaaataaaaacagctgtcgtcggagnnnnnnnnnnaccttgattcccctgttgaccgctaggcacttatcaccgataccaccacctgacaagagcagtcactcgactgttcatcccctccatatccccccaccccccacaatcaaccaaaataaaaacagctgtcgtcggaggatgtggagaagctgagcacggtgaggcccacttgcctggccgcggcccgtcgcatcccaggcgtcaccccggcggccatcgtgctcctgctgcagcacgtccggcggcgccagaaggccagggcggccgtggaggcgctgggcaccgaggcggggcgagagctggcagaccggcgagcccagagggcggcgacggtctgatggcctgcctgatgcggtgtgtcctcgtatgttgcaggaaactgttgtgcagtgggatgtcacggcatcacaaagtgaaagtcactccatggtgctccgtggcagaatccatccaccgcgccccctctccccgcatgtgagatgggtcgagcaagacccgcgacgacgccatgcaaaggctgcatgccccagtgcatggccacacaaaatacatgaaagcatcgtcctacatctcgaattcaatgcacgggtcatcctgctcggtatcatgaacatggaacgctgcatggcggcatcgacccgtcatggagggcgatcggcaacatcgctccgaggcccgctcattaccgcgcaccggatcgcatgtgctgccagccgcgagacctcgagtcgccatcaggaatccgggagcctcggcgcgcccgtgctgtcgcgcaggcagatcttcctgatgctgcagacggctggggcggcatccctggcgcccatggcgagtcccccccaagccctctcccagggcttgcctgccgagccgcggggcaccacccagctcctctccaaggccgacatggcggccctgacccccacccagcgccagctctatgagtacaaccatcggctgcaggtctccaatggggctccagcaggcttcccaggattcgtcagggagggctacgacatgcgcgtgatcgccgaagagggatttcaggtgaggacgcagggcgtgcgggtgaggcatggggaggctggccaccgtgattgggcagccactgattgagcaccgttaagtttccattgcagaccacgccggagggtctcatatacaaggactacgaagctgggacaggggagctcccccagggggagcagcaggtgctctttgactacacggcctacaatgaagcaggcaagatggagtgggtggttgccatgggtgttgggatggcattccctttgtacgcctatttacatccttgccatctgccaccgcctccactaccaacagcgggagtgattgacagttcataccgcaagaatgccatcgccaaaacgcggttgggcatcggaagcctgattccaggtaggtcgatcggaatcaggatggtggaagaaaaggctggtcgttcaggggcccttgtccatgtgtcactggggtaccagtgggatggaggattagagcaacgcctccgcttccccaccacccattaccaccctcccaccccctcaggcttcgagatgggcctgaagaccatgcgtgtgggtggaaagcgacgcatcgtcgttccccccgagctcggcccccccgtggggccagccacattcttctcggccaagcagtttgaggtgtttgacgtggagctgcgtggcacacagaactgccgcaggcgccagaccggtttcttctctgacgtcgtgtgcgagtgacatggtggttcagcatctcatacattggccggggtggcttcctgcagggcagggagggccctcccgcagagaggggcaggtgtgaaaaagaggcgtggcatagggaaagggctggctgtcaacatgcgctacgccgtgtggctgtgacnnnnnnnnnnnnnnnnnnnnnnnnnnnnnnnnnnnnnnnncgagttcccggggggatgcccggcagctgttgcgtgggtcactccccatcaannnnnnnnnngggcacaaggggcctctgcgttgttggtcagtgcaggacgatgacaggctgcttgatgtggtgcgtcacatactgcaaggagggggggttggggggcaagatgtgagatgcagtggtgatgctcgatggatgagttcccggggggggatgcccagcagctgttgcgtgggtcactccccatcaagtgcagcctcgattaatagatgtaccagacctccaaggcgccgatgtccaccatgcctggcagccagcccatgcaaggcacccctccccacacgcaccttggtgacggagcccatgaagaactcggcgatggcgccgcgctggtgcttggcgaggaccacggccgcggccttcagcgcggccgcacgtgtgacaatggcctcccctatggagtcattgtcggtgaggaagtggacaatctccacctgcagggtgtggaatcgagagtgatgagtgctcagcggctgtaggaccctgctggcggagcagcatcgacacaggctgttgtgccccattgagcaatcgaagggcatgcctgcctcaccttgtaggcaatgttttttgtggcaaccttggtcacgaaacggcgcttgataaactccttggcatccgagatctatggaccagaggaatggcagttctcctcgtttgagtctggagtttgaaggtgatgcaggctagaagtcgccatgcatgacctctatcccgggcaaccagctcacatgcttaatgtcctccttcgggtcgggatccaccgacacgaggcccgtgtccatcccgcccaggccgcccacaatctcaggcagcggcacaggaaccacatgcaggaggtggatctgcgcgaggccggnnnnnnnnnnagcgcggttccagcagcgctctccaagccgaccctggccttggaacccaaagaagcaacctcacctcatccccttcctggtaaagattctctactgtccagtccaggacacgatccgatgcctacgacatggaggccaagggcggacgatcacttggctggcacgacaagctgagtcacggccacgcatgcaccgcactttgccactcccaccagaagccaacatgcgtgcccgatgcatggacaggcttacatctgagtcgtcgacggccagcaggaggacgcgcttgggcgctccggaagtcatgcttaagacttgtcgagggtatcgatcagaggaaactgggtggatattgagtatgcttgcgagtgaattaaatgattagttgatactgtggaaacttacggaagcaaccgggccgatggcgaggctccttttacacgtgccctccattcccgaaacctcgcggggtacggttaaataggtaccctgttaaggacaggcggtgtggagcagcacacggtgggcagtctgccgaagggtgaatggtcaaagccgatctgtgttcttgatccacagtgtttgtaaggcagcnnnnnnnnnnctggagcagcacacggtggggcagtctgccgaagagtgaatggtcaaagctgatctacgttcttgatccacagtgtttgtaaggcagcagctcgtgatgtaaaacaaggtggctagtgcaggggcttggtgttgcacaagatgaatttgacagctgctgctctcgtgagaatctggcacgaatttggacaaacacaagactgacacagcattattcacgtgatgcccttgagcttcgaccagatcaggattcttatccagcggttccagccaatggttgaacctggnnnnnnnnnngcgacggttgctgctcatgtgagagtctggcacgaatttggacaaacacaagcatgacacagcactattcacgtgatgcccttgagcttctaccagatcaggattctttcccagcggttccagccaatggttgaacctggagtcccatggctggatattagacctggctattgaaagtgcctggccccctctcagccacccatagcttatttacactgaggaagaaacttcactacaatagcaggcgtccagacaatggcttcacaagagattctcaaagtaggaaagggtggcaactcggtgaagctgctacnnnnnnnnnngttgacagtgcctggccccctctcaggcacgcatagcttatttacaatgaggaagaaacttcactacaacagcaggcgtccagacaatggcttcacaggaggctctcaaagtacgaaagggtggcaactcggtgaagctgctaccagcagcagtgtcactgagcaatgtgtgggagctctttttgggcttttccagagataataccagggctccacgcttcagttgatgatgatgacgggcatggtggcactcttcaggatgacctgcatgagagactcacagacctcttgtacagagcctgccagtgaaggaggggagctcagcataccctaaccgcatgcaaggcgctcctcaccttggcgacagacccgatgaagagctcctggagggcgctgcggtccgacttgcccatcacaatggcgctggcatggaccttctcggcatagctgacgagcacctccccgattgccttggtcttggatggcgtgagcaggacagcaactgcaggaagggtgaacatgagcgccttggggttgggattattgcgtttggagctccctccagacccttcttaagacggcagtaagcgtagggcataccttcgtagtgaacgccagtctccttgaggaccggggcgtagagggagttgaaattgtcctcgacctccttcacctgtggcggctcaatgcaggggaatgatagtgagcagaaggtgtgtacgccaccacgtgatactcagccaatgggctgatgaagccacacagtacaagtgtgattcactcttttgctggcacagggaacccccccatcattcttctacccctcaccctgcgcttcagcttgtctgcccccgactcgggctcggtgtagccgnnnnnnnnnngacgccaccatgtgatactcaaccaatgggctgatgatgccttgcactacaagtgtgattcactcacttgctggcacagggaaccccccatcattcttctaccctcaccctgcgcttgagcttatctgcccccgactcgggctcggtgtagccgctacccagagagcctgccactcccactgccgttgtcgtttccgtggccgggtcagggatcaccgcggcgatatgaacctgcgtgtgcgagggatgagtgcaagggaatggatctaactgcaggggaaccagcgtgcacactcacagactacacatgaatctccaagatgtggtttcagcttgttttccaggcaaaccctatgcctacatggtcaccagggttgacaaagtttgcgagagtcttcttcaagcggtccacggatgcctggaggaaaaccgagtcgctgggactgagctgtatgcccccagtacacattatacaacttcacatcttcatagcacctgagcacgtaatgtgcacaccttggtgctgtccactccgatcacgtacacacgaccagttcccggcatgatgtctcgagataacagggttaaagcttgcaaagatcttgtttcagaaggaggatacgcgctatttatgccgtcagaagaaaatcttggtaattaagtcgtaagacgtatgtatgnnnnnnnnnncttcccggcatgatgtttcgagataacagggttaaagcttgccaagatcttatttcagaaggaggatacgcgcaatttatgccgtcagaagaaaattttggtaattaagtcgtaagacgtatgtatgagtaaagcatttgggttaagttctttgctgaagatgcgaatctcgtgagcacgtagcctcgagcctcgagagcgttccgcagacaagttccttccgggttttccagctttcttcaattatcccccctgcggcatgaaatttttgtgcaccatcctatcgaggtggaggggtgggacaacgcacctgcagacgctcattataggccgaacataacctttgctgtgcgatcattccttgcattggcgcccatgtgcctgtgattccgcgtgtccccggtgcgaccagcggccgagcacaccgtatgcaccgcgccgcgggattagggagaccacgcatgcccttgcataggcccgcggtcaatcatcaagcttgtaaggcatggggcctgctcgccgcggggagagccccagctgcctcctgcagggctgccaaccctgtgcaccagccgtccagtgcccagccccagcgcctggggcaggatgcccatgcgctatccccccgggacgctgcccccccggcccagccggcaccggtggatcctgtgctcaagaggacacgtaagcgcaacgtctccaatcgcctgcacatcacccccgagctgccgccggaggaggcgctgcgccgcatgcgcatcagcgatgcaaacaccggcaagccggcctggaacaagggccgcaagcactccgaaggtgccaaggtttttttttgtgttttcctgccaatggggctgcaggaggagtcagacggtgaccaagatgtgttcaggccttagtgccggaagtgattcgtcttgtgcgctcagagtccctttcgctggcccgctctgcagagaccaaggccaagatccgagctgcgacggcggctgccatgcagcgtccagacgtgcacgccaaggtcatcgcagccttggagtaccgcaaccctgtctcccaggaggaccgggtgagtgtggcgtcttggcaaggctccacatgtcgagtgttcatgcacagtctaagggtgcttctgcagcctctgcatgcctctgcatgctccaagaggctgggacatggtccagcaaggggtcttcgacctgtccgtcatccgcgctagtgcccatcagctccaagattgtcctgcgttcacactgccgcctcgcaggacaagatctcgcagaaggcacggatcaagattgctgaggctcgcgccatcatgctgcctcaggcgcaggagctgcgggaccagctgcgggtcagcgaagaatcagacctgcggacggtggcagagtcccaccacgtcatagatgacatcatggctctggcgtggtgcaagctgcgacgaaaggagaaggtgaggtggacgaatgggaaggtactgggaatctgggagcgggcctgtgcgtgctgttacagaggccccctggtcttttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgctggctcctggccggcgccggggccatgcccctgtgggtggaggtgcaacctttggagcaatctcggtctttccccccctctcgacgcattgggatctcgcagctggtcgaagcggcttgggctcacgagaccttcatgaaggacctggtgcggagggtctacgccaagatgaagcgtgatgagcgtatggccgcgcggcaggaggtgggcggggtgggtgtgtcatgtgatcaagggccacatgtgctgcgtagagggttccacaagattttgtggaggcaggcagcctcctggatccctcctgcgcaagggctcgagggccggaaggagcatgcagcgtccacagctccacctgctttccatcccagtacgataccctcatcggagcctccacctcatccccctcttcccaccccctccctctgcagagcaagcgcgtgatggccgtcgcgacgtcgcagctgcgccagctgcgccgcgccgaggccaagctgcagctggtggagcgagccctggtcaacctagaacgagcggtgagtgtccttgcatgctgttccctggggcctgtcctgccgattcattgctccacatgatcagagcgggggtccagcatgccccttggtgctggcatgtggcagtccagtgatgtcttggtctcagagagtgcgccgggaggggaagtctcactgacctgctgcgtccttgnnnnnnnnnntgtgatgtctcggtgtcagagagtgcgccgggatgggaagtctcactgacctgctgcgtccttgctgtcgttcagtcagcagccccagcaatgcccttctttctctctgcccttgttccagcgacccagcatggagcagtcgcagcagctggagcgctacaggacgacggagctggaggccaaggaattggtggagcgctgccgcaagcaggtcacggagctgagcgaggccttgcacgccgtggcgacatcctcccgtgccagccggtctgagggagcggaggggcaggactgaggtacagcgctgtggttggtgccatgtccgaattgtttcttcctgattcagtacaggcaagtatctggcaggactctgcgctcgctccctcagccctcccattgtttgctgaggtcccttgctgacccagtcccactcagaaccccttgctcccctgagttcctctcagtattgatattcttgtgggtgatccaatgtacagcttcaatttggtgtcaggcctggcacgctggggaagccagtcccggcaagtacctttgggtggtatgtcgtcaatggcctatacgtaaacagtacacatggtcgtcgcggcaacccaagaacnnnnnnnnnngtttggtgtcaggggtggcacgctgggaaagccagtcctggcaagtaccttcgggtggtatgtcgtcaatggcctatgcgtaaacaatacacatggtcgtcgcggcaacccaagaacaggctgcccgtctctacatcaaaggttggagctgaaaagatgggcgcaggcaggcaaatggcctccctgatctgccaggcacgcacggccccttcagagggtgccagcagggcgacatgcccagaggcagtggtggccactaggaggggctgggcgagggaggtgcccggggccgtgacatgcaccagccccgtgatgcgtgagccgaggcccgggaggctgatttgcaggggttgctcctgccagccggccccagaatacgcctgcaggatgcacagccgcccgtcttcgcaccccatcgccaagcccccatcgcccagcgcgaccagcggggcatagaccccggagggcgctggcgcgcagggcagggcgattgggctgcacccatcgcagtccttcaggctggcattcaggtcgatacgggcgcagtcgcccacggcgctcacggcgaccacggacagaccggtgcggccagggcaagcggcgactggcgcaaacaggggcgcgcgccgcatccccnnnnnnnnnnaatattgtggcggcactgccaaggtaagtcatataagtaaagcaggcctggtccatcagcaccccgannnnnnnnnnccgcccacggcgctcacagcgaccactgacagacctgtgcggccagggcaaacggcgaccggcgcaaacaggggcgcgcgccgcatccccagctcactgctgccgagggtccaggccacggtttctggctgcccacgacgggccctgcaggagatgcccaccaccgacccgtccaggcatgcagccaccgccagttgcagggcaggcacgaatgtgacggccgcggagacggggccgagaagggggatggattgctggcgaaattgggcgactgtgcaggaaagagggggggtgcagtggcaaaacttcagccgaggggatgcaggatactgtggcgacactgccaaggtacgtcacataaataaagcaggcctggtccatcagcaccccgaatctcgccagcagccatgccctccccacctggatctgcgtcagaaatggtgagtatgagcatggacctggcgtgggtgccgatccaaacccggtggtgaatgtctgtcactggccgtgccctcacggggccgccggcgtccacgtccccaaccacgccgcctgtgctttgatatgcaggggtgggagggcttgaggagattgaagtcgagccgtcgaggatcctcctccagacccctatttgatgaacacacaggcctcgctgcttctcaaacattcactcagcctgccaccctccaacacccccccattcccatggcaaaatctccgcagtcctgcctgtgtcagcgtgcaggatgctcagaacgcccgtggatgctgcgacggtcaggaagnnnnnnnnnnagacttgaggagattgaagttgagccgtcgaggatcctcctccagacccttgtttgatgagcacgcaggcctggctgcttctcaaacattcagtcagcatgccaccctcaaacacacccccactcccatggcaaaatctccccagtcctgcctgtgtcggcatgcaggatgctcaggacgcccgtggatgctgcgacggtcaggaaggcaagggagggcccgcagacacagaccccggcatccaggggggccctgccctcgcaccgccagacgacgtcgccagagggcacggccaggcacgccacggagcccccatgcgaacaggcatacacgcggctgccgtgcaggcaggcgggggcgtcgacgcacatggacaatgcaacccgccatccctcgaccaggagcgagggaccggcccgcgccggcgccccgccccagaccctggccccctgcagcgcaggatggaggctgaagctgtccgactcggcgtcgtgcccagaacagggggtgaggcggcgtgccagaccgcggatggtggggttggccaccaccacggccgggggaatccggagggaggccgccagcgccgcaatcgccaggctgtcggccccccccaggatcatgtcctcgcatgcctccggggcacgtcccaaaactgctgcgacggcggcagccacgtcggcctctgtccaggacgccggggggggcagcgcgccggcatcgccgcttccccgcccagccacggccggcggccacccagtgagcgtcagtcgcggccgcttgcccaagcccctggcggtaagcctccgggacaccagcggccgagccagcgcctgcgcagccnnnnnnnnnnccggccacccagtgagcggcagtcgcggccgcttgcccaaacccctggcggtgagcctccgggataccagcggccgagccagcgcctgcgcagccatccggtccagcttgcccgaagttgtgtatggcacctgggcggccggcagcagaaggacgacagcaggcacggcggccgcgtgcagacgcgccgccgcctgggagcgcagagcctctccgtgcatcgcacttggctcattgcagaagacgagggccagcaggctgctgtccagccaggccactgcctccttcacgccctctatctcgcccaaaaccatttccacctcggccagatccacccgcgtccctgtggcaagtgtttgtggcagaggactgaaggtgggttgagacgacagggtgcatgcacagtaccttgttggtgagtcggacgtcaggtctcgctttggatccctttcatagcttcgtacacgtgaagagaaattccagtctaacatcgtgccagcacgcaatccactggggagcaccaatgctcggtagcagcgcctcgcctcccaccaccacctgccgcctcacccgagaccttgacgcagcgatctgtccgtcccagcagggtcaggcacctcgcgtcgtccatgcagccccagtcccccgtgtcgaagaagggcatgcggtcgggcatgtcatcagagtggccggccagcgacacaggaccctctctcgcccgcgtcagaccctcgaaccagcgcagggccaggcatccgtcgcccgttgtgccctccgcaaggcacaggccggccaccaggacgcgcccgggggacccgagctcgcacagggcggaggcgcctcggtcgtgggtcacaacagggtcctgttgggttgcccccatggtcgacgtctgaggtgcgccggnnnnnnnnnntgatcgtgggtcacaacagggtccttttgggttccccccatggtcgacgtctgaggtgcgccggcaaaatgcccgctttcctcccggcacaccgccaccacgacgcccgggagggggcggccgacagggatgggcgcggctgagtgggccgaccatccgctgagatcgacccacgtggcgtccgccgccgtctcggtgcagccgtacaggttgagcaggcgggccggggcggggaggagggcgcgcatggcgcgcagcgctggccccgtcagtggctcgccgctgctgacgccgacccgggcggggggcagtgggccgccgggggcggcagctgccgcccagctgcgccacacgcgtggcagcgctgcgacaatgctggcctcgcccagccgcagcgcctcaatgcactgcagtgggaccacgatcatgggagcggtagcaagggctttgtaggtgtggatgaagcggcgcaaggtgtgcacccatgctggcctgcatgcgtggaagcctgaggagagccctctatgtccacaaggacttgagcgttgccttgcagatgcgcaccttggccggatccttcaggagggcgcggggtatggcgagtatgcgggcgccgccaagcaaagaccccaggcattccatcaggctgtccacaaagacgggggccgtcttgaacgcatatgtgtcactgggattgaggaagccctgagactgcgcccatttgacgcgattgagaagacctggcgaggaagagtggtggagagggggtgcgacttcgctgtgtgcaaggggtctgtgtctggaggagagggacattacaggcccgggccgtccactcgcagggctggacacctgagtgagatgcannnnnnnnnncggaggagagggacatctcaggccagggccgtccattcgcagggctggacacctgagtgagatgcacaatttctctgatcccgtcgactcgcctgtctctgtcccgagcacgccgaccggcgagccagtgctcccagatgtgaacaagacgtagatgtgaggcatgggggttgacgctccagggccagagttgccactatcgccatgacataggtgctgtgcgggttctggcgccgctgcggcgtctggtggaggtccgatgtgcaccgtggggagcctgatgccggttgggggttgtgtgccaagcctcagggccaacaccctggccccggaccccgatatcgcnnnnnnnnnnacacggtggggagcctgatgccgagtggggcttgtgtgccatgcctcaggggcaacaccctggccccggaccccgatatcgccgtctcgatccgagaggcaggccattcaatgtcaatgggcataaaagcacacctgcgggtgagggcggaacagactgtcaccgagaagacagtgtgccaggtgatgatgttcatgcggcactttgcggcctgggcttggcttatgtgttaggtccctcgccgaggtgctgtgaaagcctagccttcaacacccagctcccatcccatcagctcaccctatggcgaggcacgcaagggcggccacgacatattcacaggagttatcgaggtatagagctatcgcgggcggttcgctcagttccttgcccgcagagacatcggcatggtgggaaaatgtatcctgcaccttctccacctaaatgaatggacgactcggtcgcggtgaggccgcagcggcccatgacgtatccagtgtagacaatgaatcagaatatgtggatatgtacgtacccatgtgagtaattgtgcgcatttgtactcgattgcttgaagggtgccactcttgtactccctcacagcaatcctgccaggctcggtcacgaggcggtcatgaatgatttgccatacttctgagtgatactgccgcatgtttaaaactacattgtttcaggtgttcggggtttgtgtgtcagaattatcgtactttcacatcattgcatcgctccatggtgcatggccatttgcagtccgcgcggatctgccaagatttgaattgttgcaaccccaggtcaccacggtgcgggcgagtgatccggcgagtcacatggcagaatacctcttcagcgggtacggacatgttcagataacaacctgcaacaatccaagattggcctggagatgctgcatctcagcacctgcgcccggttggggctcggcccacggggctcccttcatccgcgccatgtgcagcctcgcgcacagccccggccagcccgctcccggtcggcgccagcccagactcggagccaggtgcagctcctcgccgcccgggatgacgtcggcacactgcgcttgcccctggatttcatcgccattctgaccaccgtcagcgagcagaagggccccaatgaacggtgaggatacctgtccgtccatgctgggtgctccttcactgaaaccatgccatgtaatgagcctgcgcctgaaatgattcgcgtcctgtggtgctcgtagggacatccagtgtgcccagctcgtcccccccccccccccccccccccctctcccnnnnnnnnnnagtcctgtggtgctcgtagggacatcctgtgtgcccagctcgcgcccccccccccccccccccccccccnnnnnnnnnnnnnnnnnnnnnnnnnnnnnnnnnnnnnnntgcaggcacgccaacttcagccccagcgccctgacggcgcgctccgagatcctggaaggcgcccgggccacgctacgcgaccccggcagccaggcccgctacgcgcagcgcgtgcagcgtggggaggtggaagagcgggtgccctcccgcctcgtccccggcgcgctcctgctgctgctggaggcgggtcgcgcccgggatgcggcagaggcgggccagcgctggctgtcccaggcgcgcaggggggtgcgggaaacccaggacgtggcgctcgcgacggggctgggcctctgcgacgccgccgccgaccacctggcccagacggggcgcgtggcagaggtgggagagactgggaggatgcatgtggctgggcagggtgcggtgtacatggtgctaccgagatgaactagtgttgtgtcaccaagtttgagagggtggtgggcacagggatggagcctggcaatgcgcagccccagtaaccacccaaaccctcatccgccgcgcatcaccccgccagaccgtccacctgctggaggaggccgcgggtgtgctgcacaagcacagggcggggtccagcctgcaggcagacatccagacggcggtgcaggagctggagactgcggtggtgatggagctgctgggcgccgggaaggagggcagggtggagggcctgcgccgcgcccgccaaatcctgctgtcgtccggcgggaggcacggcgaggcacccacctcgagcccctcggcgccgccggcccccagcctggagtggaggtccaagttcctggccgacctgacaccacaagagctggtaaaccggctaatttgttgaggctgtgtggccggcgaccttgatcaaggttgctccagaccagggtcccttgggagtactgtgcttggtgcaagtctctccannnnnnnnnnctcctgctgtcatccggcgggaggcgcggcaaggcacccgcctcgagcccctcggcgccgccggcccccannnnnnnnnngcttctcaggcatgcgatacctcggccccgcccccctgatgtgcagcattctttttaaatcaaccccaagcacagctccctctttccnnnnnnnnnnagctgatttgttgaggctgggtagccggcgaccttgatcaaggttgcttcagaccagggtccctttggagtactgtgcttggtgcaagtctctccacacttctcaggcatgcgatacctcgcccccacccccctgacgtgcagcactctttttgaatcaaccccaagcacagctccctctttccccaccccggccagatggcgttccacgagggcgtggggcacagcgcggcgggcacctccatggacctgtaccgcatcagtaccgcctacatcggcttcgcaaccctgaccaggaggcccgccttgctgattgccgcgctttcctgcctggatgcggccgacgcgatggaggacgcggcgcccggcacggcacccggccaggcgccgcaggacgcgcgccgggcggtggaggagcgccagcggcgtagtgtggcccgggcggccgcgcggctcctgctgggcgacaccgaggccgccaaggcggccctgggctggcagcagggcaggcctgccgaccgccaggtggccgcctttgtcaaggtgggcgaggcgaagggctgcgggggggttggggaaggccgtacgggtgcacgcgggcgcaggctgcctggcagacggcctctgctcacacacaccgcgcgcggtcgacatccgcaaaacccatactcccgccctttcctctgcaggccaacagcccggacccctccgacccactgccgggcctctgcgctctggtggagcgctgggtgagcggtgtcgcctggccatacgcgacatctgtcgggtggggccctggggggggtgtggaagggggtggttgagcaagagggcatgctatcctgtggtgctgacgaggaccagtctgtgcagggtgtgcgcggatgttcccaggggagtggacgcctttgaaacccgcctcgaccccgagccccttccccctggaactcctctgctcacaggcaggagcctggccaggcggagggggcgttcagcatcaatgcctggttcggggatgcggtagtccaggcctacctctcctcgccccggccccacggtgacagccagccgagcctggccgagaggctggcgggggggaccgaggcggtgctggcctggctcggatcgctcgtcggagggcgcagggagccgaccggcgaagtggcgctgggaggacgtggggcccgggaagctggagaagagcccgcggcgcccctggccgtcgaggcagagctggaaagcagggaggcaggatcgacgactgcagcgaggcagccggccgcaggcggtccatccgtgatgcggagcagccagacctggcctgagccgacagagtccggcgccgagcctccttcgcaagctccggctccacatgaagcggcctcctcgcctctccatgcaccgacaccggccgccgatcccacggcgaggcgtgcgcctcctcgggacggggccggcggtgtgcctgaggttcgtgctgccgcctcccggcagcccggcgaggatggcgccgccccggccggagtgccgcgcgtccggcgccggaccccgccccccctccccccccgaagcaggccctccctgggcctggcccggcttgagggtgaggagctgatgtgggacgcgggcaagcggcgacggccgcgctggggacgcttcctggcggcgggggcctccatcctggtgaggtcgtggggaggagggggtggttttcaatatgttgagaggcatgggcgggtctttgccatccaataggtcggggttgtggcagatgcccacagagttttgaggtcgagacatgcgtgtgcagggtcacgccaacactcctgtcagtgcactcaaggcacgcccgcgctcctacccatgcnnnnnnnnnngataggttggggttgcggcagatgcccactgagttttgaggtcgggatatgcgtgttcagggtcacgccagcactcctgtcagtgcgctcaaggcacgcccgcgctcctacccatgctccccctctgtacgccaggctggcgtcgcgctggcatcgcgcctgcccggactgacgcagggcccgcggcagcctgtgagcccggcggcggagactgcgcacccggcagactcgacgctcagcggcacgcaggctctgcagctcatcaagcgctggcagctggtccgggtgagggggtgaggaatcaaagagcccaaatggtcaggatgccgacccagtgagtgacccgtgcggcccggtgttggcttcgcccannnnnnnnnnttgaggaatcaaagggcccaaacggtcaggatgccgacccagtgggtaacccgtgcggcccggtgttggcttcgcccattttctgccccaagatcctgccttaccgagcccctcctccccccctgcgcaccggcaggcggcggcactgggcgtgaagcatgacgcccgctccctccccaccatcctcgggggggaactgctggccacctggcaggaaaggacgaagcagctcgccgcgcagaactggtgtgctgagcgggagggggtgagggacggccctgatggccttgtttcgcaccggatgctgccatgtggatcgcatcggtgcactcccaccacaggcactacgaccaggccctggacgcggtgaagctgctctctgtcaagcctgggagttccccttacacggcagtggtgagggcacgcctgtccgagagcctggtggcgcaccaggggagggatgcggcgccggtggcgcagcggtgagtgctggtggcctcgtggggtagggtgcggtttgcaaggggaagtgctttgcactcctgaattacctatgcggcagaagaagaggagagatcgcactgctccctcccactgcttccagccctcagaacccaccaacatttaaatacccaccaccacagcaaggagtacacggtgaggtatgtcgtcgagaagcggggctccggctggatcatcctggaggccgacatcgagggatgattacctatgcagccgggcaatgaagccctgacaagcctgggagggcacctgcaagtgcctcctggctcgagtgcatgccgcggctttgagcaaccggcgttctatgcctcggtggaccatgcttgtagatgcttcctcacagcttctcatctgcacctgctgtaccaaatcatccctggcgcagccccttgatcatccagggcgatgggatggagcacatactgggtaaaatgcacttcaactcttgcaagcgctggcgaggggttgtggggatgctgcgatgaaacctcatgttcaggtcggcttccctgccggcatcacgtgtccggatgcgctctccggagccgctcacggcaggggtttcccgcactctcccttaggcatgaagctgcgctgcgtctgccgaagagctccccgtctcctgaattctgcaggtactttatgtttgccaaatagttccccagtttcgcattcctagatgctttgattggccaccgtcacgacattgtggtatctccatcctcgtgttcttgccgaaagtgcgnnnnnnnnnntcccagtttcgcaatcctagatgctttgattggccaccgccacgacattgtggtacctccatcctcgtgttcttgccgaaagtgcgctcgggccctacctcgatgaccggtgcaggcctcacaacctttgtcgccttgttgggctcgcttggactggtgctggcaagcacaccttcttcatactcatgggtctacacctaccccactgggnnnnnnnnnngcggtgcagtcctcacaacctttgtcgtcttgttgggctcgcttggactggcgctggcaagcacaccttcttcttactcatgggtctacacctaccccactgggtttagctgcgacccggtacggaggtgctactcgttgccggcagcgctgacatgctctattagcccctgattacgctttaaccgtgcccattcaaggtcttgaacccccacttgatgtgcagctctccataaaacaattcggggccgacccaaccggagccaaggacgtgagtggcgtgctcacttccgtgaacagcatttccaacttcgacgcttccggcatcatacacatcaccgccggcacatacctggtcgcaaaatccatcgccctcagcaagccggtgtctctgtcggcgggagcggtcctgaagatcgctnnnnnnnnnncccggcatcatatacatcaccgccggcacatacctggtcgtaaaatccatcgccctcagcaagccggtgtccctgtcggcgggagcggtcctgaagatcgcttcaggcgtcacggtcaccttcaactctccggtggcggccccgtcctcgtcccagatcttttccggcccaggagccgtcaagtttgggttcggcgtccaggcttcggtgtatgtggagtggtttggtgccaaggggaacggcgcaaccgatgacacagcggccatcaacgctgtgctggcagccggagacagttccctcaacgtcatgttccaagccaagacgtacctgacatctggcccgctgatggtcccatccaacgctgtcgtccaagctgccccaggtgcgtgcctctctgactctgtgactgaatacctgctcagctggctatggtctagactcactgggaaggttgtgagacagccatgtgagccttggatactgtctctctcccaggccttgacctcaagacctgacaatgcttaccaccttcaccactgcttgcacgaacgcgcattcaagccctacatgagatgggcttctctttgtctccaaccaccattgcctgcagcctcaccctctgctgcaatctgctgagtctggtggacgtacttctcatgcacggaattctctcatgtcccccttggcacctccccccacccctaaaaccctcctccaggcgctatggtgaagggcaagtcgcggctggctgacgcgtttgtgttccagctgcccattgccgggggcatttacatcggacgccagagcctcccggccctgcagaaccacnnnnnnnnnntgccctacatgagatgggcttctctatgtctccaatcacgatcgcctgcagcctcaccctctgctgcaatctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccgccgggggcatatacatcgggcgccagagcctcccggccctgcagaaccaccgccgtgccatcaccttttcggacgccggcattgtgaggcgggcagcttgagggggagcacgttgcacatgcctctctctccctgcacccccctctgatgtgtgatgcaccttgattgtaccaggctctccaaagaccagctgctgtcatgcctccaatctcacatcctctctaagacgcacacacctcaaccccgctcccctgtcctacagatcnnnnnnnnnntccctctgatgcgtgatgcatcttgattgtagtaggctctccgaagaccagctgcctgtcatgcctccaatctcacatactctctaagacgcacacgcctcaaccccgctcccctgtcctacagatcgacgtctattccccatctgtcagcggctgcgatgaggccgtgcgcgtgcagagcacccgggccaagggcgcggggcgccagatctcccaagtccgtgtggaagtccccaagctggacaacgtcatcaaggtggtgaacttatttgacaagaacggcggcgccgtcatgtgagccgcgccatggagggggggtgcagcgcatgccgtgcttatttcctgggccgagatgggagcggtggggactggttgtgtgtcatgaattcgccatggaagcatgcatgcagccacannnnnnnnnntatagagggggggtacagcacatgctgtgcttatttcctgggccgagatcggagcggtgggggctgattgtgcgtcatggattcgccatggaagcatgcatgcagccacaatgcgtacacttacaccaccgccccaagggagtgttgcacccttgtcccaggcctatgcaccttgtccctgaacctcagtgtccactcactcccgnnnnnnnnnntccaagcgagtgttgcacccttgtcccagtcctatgcaccttctccctgaacctcagtgtccactcactcccgcaactccccgccaggcaagggagcaacttcaggtttgggacatacaccgactctggctcggggacggcgctcatctccttccaggccagcggcgggggctgggcatactgggactccaacgacttccacttcgaccgaggtgggcagggtgatgggaagagtgtcattctggcggctgacacgacctttcaacctgcgacctgctctgcacattgaacattcgggagcctcctaccggctgtgtcccgggcccaatcggtactcttgtctggcagaggtccttgctccttgactgatgctccaagatgggcccgggtctggctgcactctcgagcatggctacactgctttgcaccctctgccgtgactgtcctggaccggcacggcatcttagtgccacccccccacccttccctcccccccaactcctgcagtcacccctgccgcctcgtcctcggccaacaagctggtcctcctcgcctgcgatgtgagcaccacgctgtaccgccagaatctgtacatcacccgcctggaccccctgcccgccggcggccgcctgaccaacgccaacatccaggactgcatgatggtggtgagcgccagcgcggcgctgagtgccgcgcagatggcgctgcccgtgttccggtctggcacggtcaagtccaacaacttcaacaacttcatgctgaccgcgccagccatcgccggcctgacggcctccccctcgcccaacacgcgcgcctccttcaaccgcggcctgcccctgacctcctccctcttcaccctggccctgcgggccaacaagcccagcagggatccgcgcacaggcaagacgccggcggacggcaagacctggcccgcgggcgaggcgcgccgcttctacttctaccatggcctggcccagaaccagcagctggtctacgtcaccgtgcccaagatcggggccgcctgccagcccagcggcgtcgccatcacggggatcttcgacaactcgggtgcgggggaagggtcggtcggtctgtgttctcaaaggctgcagattggtgcatggggcgtggtggtatcatgcatgaccaaccgatggcacgagcgtgtgcgaggcaggatcaagggcacggtcagtattaccaaggccggcccgagtagtccagttcactctccaccacaccccctcccgctgcagccaccgtcccgtatgaggtggagatcgtggcggtggcctgcaagccgctcgtggtcgcagacgtaaagtcgggcaaggtcaacatcagcttcccggtgctggtcggcactgtgggcacagactgagcgccgagagtctggccaggcctggtgagcgggcagcctcagtgctcacgcgacctggccactctgtggtgtggcctcagcagggctggacaacaactcctccgcagtacaatagaccctcgagtccaccaaacgacatgttcggaccgagaggtcctgatacatgacgtgtttttgagtttgcatgccgatgacatacctttaagttcagtgcatgcacctttagaggctgcatgaaggccggatcccacgtgcaccttcctctccaccatcgaccccgggcgtccgagctttcattcaccgctcgaatacatcgctgtacataatcaagccagccaatgcacctgcatttgagatgctcaagctgcttcaagaaacatttacatgctggcgacactaagtatcacatttgctgaacttgcacaccagggccacatgttgtagtcgctcgagtctcgcatgtacgcaaaccctgccatgcttcatgggctaacccatcccggcatcaatcgtgcccatgcaccacaccatgaaaatccacgttctagatgtcggctgaccctccgccgcatgtttgccgtcaccaacgggtctcctgtggtcacaggtgcattgagaggttgtggaccagagatgtgaaacatgtagtgcatggcgaagcctggtctcaagcatcacatctgatctatcttccctcacatctcgctcctcacacccatcagcaccgagcatgagctcgaggtcggagcagctgggaatcgacaaggcctacctgctgagacggattgcctctcttgagaggggggcctctgcatcccctcgagacaggagggaggtggacgaagcccaggtgggcttgcgcggcaggagccgaggtgcccagcccatggccctctgccattggtcccgtgataccctgtctaagcccccctgcaaatatcgtgccgtcccgccggcttgccttcagggagccccctcccccatctctcaaccggcccgcaggtcctggtggagtcccacgccgcccccacccnnnnnnnnnngccctgtctaagcccccctgcaaataccgtgccgtcccgctggcttgttttcagggagccccctcccccatcactcaaccggcccgcagatcctggtggagtcccacgccgcccccaccctggacctgcaccagctctctggaaagtggcgcatgctgtacaccaccgcccgtgacgtcatccccctggtgcgcgccaacacgctgccctccttcctgccccagcccctgcgcgtgggccccatctttcaggagtttgatgatcagggcggtgtgcgcaacgtcatagaggccgaggccctgctgccgcccggcaggggcacgcgcctgaccttccaggtggaggcccgctaccagcgccgcggaccacgctccctgggcctgcgcttcgtggccgccggggtcccgcacctggagcccagcgcctccctgcgcgccttcctggccccggcgctggcgccgcgcggctggtggacccaccgcctcctcctcgcagcgcagcaggtgggaggaaaggtagcacgcgtgtttgtgttggggctcggctcaagcaggcgaggtggtgcagctgcaggccgggcaggtgggcaccagcaccggcaccaagaccccctccctaccctgcccctcgctgtctgcctacacaggcacacatnnnnnnnnnnctgcgcgcgtgtgtgtgttgaggctcggctcaggcagacgaagtggtgcacctgcaggccgggcaggtgggcgccagcaccggcaccaagaacccctgcctaccctgaccctcgctgtctgcctacacaggcacacatcagggtgccgctcgtgccgccgccgatcctggatgccttttcagcgcagcagggcgagtacctgctgagctacctggacgacaccatgctcatcgggcgcaccaaagcaggaggcggcaccttcatcttctcccgcgagcctgatatcggcgaccgcctgctggagcaggagagcaggagcctgggacccatcagccagcgatgaggcggggagggaggggtgtgccgcggtgggcagaccctctgacgctcgacggccactcgccggctcactcgcaagccaaagatcctttggagcggcgtccctggcaggcgggtgccagcctcgttgccccagcgcactgtgtgaaacctgaccagcctcctgcattgattctgtcgctctcttacaannnnnnnnnntagcctcatccccccaccgcactgtgtgaaacctgaccagcttcctgcattgattctgtcgctctcttacaatgaggctccagggcctggggtggtgccgaggggaagcaatgatcgggtcacactcgggcaggctcgtgaaacgtgccacagctcatcgccgcccgccgcccctgccggcgccccggcccctgcccccaccgccgc

SEQ ID NO: 42984 - DNA, 61 bp, Chlorella protothecoides
aatgcgagctgatgtcagcttctcggcggggcccatgggacacctgtccaatcccccaaat

SEQ ID NO: 42985 - DNA, 9908 bp, Chlorella protothecoides
  modified_base (672)..(681): a, c, t, g, unknown or other
  modified_base (778)..(905): a, c, t, g, unknown or other
  modified_base (1244)..(1253): a, c, t, g, unknown or other
  modified_base (1396)..(1405): a, c, t, g, unknown or other
  modified_base (1674)..(1683): a, c, t, g, unknown or other
  modified_base (3198)..(3207): a, c, t, g, unknown or other
  modified_base (4489)..(4498): a, c, t, g, unknown or other
  modified_base (5334)..(5343): a, c, t, g, unknown or other
  modified_base (5700)..(5709): a, c, t, g, unknown or other
  modified_base (6612)..(6621): a, c, t, g, unknown or other
  modified_base (6693)..(6702): a, c, t, g, unknown or other
  modified_base (7064)..(7073): a, c, t, g, unknown or other
  modified_base (8102)..(8111): a, c, t, g, unknown or other
  modified_base (8730)..(8739): a, c, t, g, unknown or other
tctcccctccccttccaccccacccccccacaccctcccctcccctcaatgccaacgcctgcagcacctggagctcggtcagtttgtccaccgcctcctcctggtcctggccgaccctgaagatggcccggagcggggccgaggccgcactcagcttcttccgcagccggaccagcttgcccagcgtagcgtccacgaaatcaggagctgagcagcatgggggattccggggtcagaggagaaggttgggacgagctttggggcgtgagttctatgagaagcatgtccatcaaggcccttgcaagcggtttgcatcatgacatcgaaccagggcacgtgccaaccagaagaagcgtcgtgaagcagtaggcctcaacgcggccagccttgggccagtctctcaatctttcttttcccctcacaaaaccgcactcgtcagcaggcgcagggtgtggcctgtcggcgcggtgtcaaatacgatgcgggtgaagcgcgcaaactcctccctcttcacgaattgctggacctgcgggggccagggcatgcaggaccaggggttgagcttggtctggcacgagccggcgcagaattcagcttgaagaggaccggtcgccgtgcggatccattcctccccatggtgcccaccttggcgatggcgaccgcctcatcaannnnnnnnnngcgagcgtcatgaagcagcaggccttaacgcgcccagccttgggccagtctttctatctttcttttccctcacaaaaccgcactcgtcagcaggcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcgagggcatgcaggaccaggggttgagtttggtctggcacgagccggcgcagaatccagcttggagaagaccggtcgtcgtgcggatccattcctccccctggtggccaccttggcgatggcgaccgcctcatcaaagcccggagggggggtgtccagcaactcccccagcttcaggtctgtgaattgctccagcaggcctcccaggccaaagccccccatgaagtccttgacctcctgcttcccatcgcctggcggcgggggaagatgggcacaggagaggatgcttggccctgacgaaatatgtgtgctcaggcagcactgggaagcacgctgtgnnnnnnnnnnattgccctgacaaaatatgaatgctcaggcagcactgggaagcacgctgtgctttcgagctggatgcgccagtgcctgctcggacgatgggttcaagcccccctgagcctcagatcacgggcctgacctctccaccccacccnnnnnnnnnncgcctgctcaaacgatgggttcaagcctcggatcacgggcctgacctctccaccccaccccacctgcggtataggccttgaacttggccttttccctttctgggtcgatctccagcgcccagagcgggagctctgtgccctccagcatcacaggcatgccgccgctcacatcctggtgattgggaggggtccaaagggtgagcgggttatggaaaatacacatctggattgatcctcacacatgcgcatgggagagtacaagccacagnnnnnnnnnncatggaagacacacatctggattgatcctcccacatgcgcatgggagagtacaagccacagggcaacctctgtcccttgcgcagtggagcagcaagcacagccgcacaccggagccatccaagaagcaaacagcgctccgcccacctgggccagggaatcactgagcgagtgcgcgggatccgtggacaccacgagcgtggtgtgaccctcctcagcaaagcgcaccgccagggaggcagccaggctggtcttgccgacgccccccttgccactgaccatgatgtacttgcgccccgtgcccgcagagagctgggtgaaggcgctggccaccggttccacctccgtgctggagacggccttcacggcgagtcggatcccggtggaaggtctgagtcgacagcttgactgtgtgatggaggcttgaagcgccttctgcgcggcaaatgggcggcatgcggatgggtgggctggctggcgctgtgccgcatgcccggtccttgaccaagcgcatcctaggtgtcacaaagtacctggtaccatcgtggtgtagaaatgtgcttcacagcgtgcgcctggaagcattttgatggtggaagggcccggaagccggtgtgcatcgcggtgctcatgtgatccacggaatatgcacgcaagcctacaggcttttcagggcaattacttattcatagctgaatttgcttaccgtttcaaccagcgagcacactgggaagggcactcttgttgcatctagatggctcgattaactctccgacacgatccgataggcagccgagcttccactcattcctggccttccctatgccaccgacgatactgccagcctgggattgagcaccatcaatcttctaagatgtcactcgcatgaacactctatgtcagatccggtatagtgtggatgaatgctctgtactcggcgtgtcgcatgcttaagaggtcgtctctccgcatacgcttcctacccatgcttcggcccaaacagcaatgttgctgagtagtaggaggcaggtactgtcagattctcctacccctccttccacaactgtccgattgggaagatagcatgccacactcggcgtgcatcgatgtaggccccttggccgccgtcggactctcagggaccactgttgtacacttgctggcgccatttatcccggggcaagcgtgctacctaccgcaaggctctgaagaccaaggaccggaaaggcccactggcctgcaccctcttagccagtaacgagacacagctgccacatctgagcccctcagatatcccagtcttgctacccaagagcgacccagaggtggaagaggaccgcaagagttgggcggcaaggtctccctaacagtgcagggaggaacttgaggggaagcgcagcgcaatctgcaagggctgaatcagagctctgttgctgatgcgattggacgggttacatggaccatttcccacctcgggggcagagcacgctgcattcgttcccttcttgagagagggnnnnnnnnnncacacggaccatttcccaccttgggggcagagcgcgctgcattcgttcccttcttgagagaggggatggcaagaggcgacggacgtattgagggactacaattttcatcaccacctttacatgctgcagaatttgcgttctaggataccaagaccagcacagcgtgtaatggtcatctgggttatgaggggtcccgccaacttgatgagtccctatagcctcaagagccaaacagggcacctcccgatatgtgtcgacaatataatgatatccttgcactcgataattttctactttctatttctacagtctataacccgccttgtgcattgtgctcgtgaagtaaattatccattgaagaggccaagcgaattcagagacccagggccatgcctagcggccgaaaattcaagcacagtgaagcgatggatggtcagaaatagcataagtcgcacacgattcagctcgggtggccatatgctggggatggttgcttctcctcatctcgcacatagacaccgtccggagcaccgcccgggggcgggatttcgcgtcaataattgcatgtccggtcacaccgttgccagaaggggcaaggccgcctcgggtacgcaaatatacgaggcaacgcctcccgatgccccctacatgagccaagatacttataggagtagatttcccggcctctcagctctcttcggcctcttctggtaacacagcaaagccgtgcgtcgttcgttaacccccccgcggtacttaaatgcgggacctgcgggctagtgccctgctgggcatagccgtctgtcttctgagcctcacggtggcaattaaggtatgcaaaggttcatttgcaagtatcctcacttggcaaggacggtcacatgcacgtccgcgaggcccatccttcaccgaccagaaccccacctcacacatgccagggagcatgcacgtccaagttctactccctgccatctgccatgtgagtattcctactagtttgtattacaattagggtcaaaggccccgccatgatgtaatgccccttccggaagacgtggggagctccacaaacagctctcacttcgaatcgacttgctccccgctccccggtttccggtgctaacattgcagatacggaccccatgtaaccgtccctcactgccaagagcgcgggggcgttttgcaggttcgaagacatgcggcgtgagaatgtggcatgcgactctgggcagggggacttgcagaccaagagggggttcagctcgcactcccctgtggtgtnnnnnnnnnngcgaagacatgcggcgtgagagtgtggcatgcgatcctgggcaggggaacttgcagaccaagaggggggttcagctcgcactcccctgtggtgttacctatctcccctcctcacatcacagggagcaaggctacagcaagcagggttccgtcaggacgactaccctcaaagctctcggattgcctgtccacgccatcagcctgagctcgctaacactggtcaagggtggatccactgagattctggttggtgtggagtgcctaaaggcatggcagtcggcgtgcacagcagattcgagaggcaacatcggcacgggcaacaagggcaaggacaatttcggcgacaacaatgtgggcgactacaacattggtatgctagagggtgggataggacgacggggcgagcatgggctgatgacctctactcgatggactacttaccagccttcctcagtcgtctcaacggtcctgcacttccacaggaaactccaacaagggcaactacaactggggtgacaacaacgcggggtccagactccgctgcaacaatgcagtgggtatccggatggtactgaacttctgcagcctgtcagaactcaggaagtatgcgttcaagacctacaatcctccatcacctccacccaggcgcatctcgccaccacccaccaagaaaatgtcgccgccgcctccctcgcctggaagaaagtcgcatttccaaccctcaaggaagtcgcctcccccatccatgaagcagtcgccacctcctaccaccttccagtcgccaccttcaccaagcacaggggtcgctcccagcccgccaccgtcctctcctcctcnnnnnnnnnnctcccaccctcaaggaagtcgcctcccccacccatgaagcagtcgccacctcttaccaccttccagtcgccacctccaccaagcacaggggtccctcccagcccgccaccgtcctctcctcctcccagcctgccgccgtcctctccacctcccagcctgccgccgtcttctcctcccaccgtcccgccgccatcttctcctcccacccgcccgccgccgtctaatcctcccacccgctctccgccatcttctccacctcccagcctgccgccgtcctctcctcccaccgggccgccgccgtcttctcctcccaccgggctccctcttagcccaccatcacctcctcctatcagcccnnnnnnnnnnccgggccgctgccgtcttctcctcccaccgggctccctcctagcccaccatcacctcctcctatcagcccgccaccacctccttcccctcccagccgaccactgtctccgccgccgcccagcccaccatcacctctccctcccagcccgccaccgcccgctttgccggaagtaccttccagtggtcctactccaccgggaaggtgacaatcaccatcaccatcgtgacctacacgtctggcaaagtcaccgtatacttgatcgacaatgagtatgccacatggacatggaacgattcccacaccactagatacaccaccacaaattcctgaccaagcggcacagatcagatctggaagttcacggtgctccccgcaggcacagacattaccctcgcaacagatgctatcccacacgcgccagaagaagatgaggcacagaattgcggccaagtcgcggtggcgtatgaggctccatgcccctgaatgctctttcagactggagtgtggctttgatgtgatcagcaagcccagtctcttggagtgggcgagggcaaggtgttgcggtggaactcagtgtgcatgtaacacatctagccaggacaggaagttcctcagcgtgtgggagacaaatgccctcaacggacaccaaggccgagccgcgagtgaccacaatgcagatggggaatctgctgcggcagctggaagcaatacagtcagagcataggagaagtcaagcctgggagcacgtgctatgcatgacacgtagtgtcccattgcaagaatgtggtgtctctcatgcaacaacaccatgtttgcagctgtgagtcccgcaaagcagggtcttgccagtagcacccgtcctgtgcctcattcaaggtaccagcacaccaccgccgccgctnnnnnnnnnngagagaactaagggcggaatcggcaccatgcaccgcaaatcgtcttgacagggcctgtgctgcccatggtgnnnnnnnnnnaccttgtcactttgagcaggatgccgcgatcggcgaggtgcatccactggctggccgtggggcgtgtgcatctaagagaacttaaggcggaatcggcatcatgcaccgcaaatggtcttgacagggcctgtgctgcccatggtgccagctgggaaggtggaaggaaacagtccctgggagtggcagatggtggacagattgcgcaatcttggattccttaacgaaagtggagacaccatgaggaggtgaaatgctttgcggggcctgaactccaacacagtggaaaatgggttgcaattatcggttgaccatctaagatgcaggcgaaaggggtttgtgtccattgcgccaacattctgccnnnnnnnnnncttgcggggcctgaactccaacacagtggaggaagggttgcaattatcgtttggacatttaagaagcaggcgaaagaggtttgtgtccattgcgccaacattctgcccttgaaaatcagagacttgggtgttctgatcaatcagggtttgggtgggccagatcagtggggatctgtccgtgattttcacgtcctgggttcgatggaggaggaaaggatgcccacatgaacctcaccgcccctccccaccttatcggctctccctgaccattattaagcatactgcacactttcagccccagttctccacgccgaatcccctttgaacctattctctgactgtcgagccaccatgacgactctcgtgcaagcattcctcaacagcgccattgccggcaaggtgggtacccgcacgcactcgccgcccaagctcgaggacactatgcattgccaatcggctgcttgacacagatttattactttgccccgacgactgcagcgctccatggatgctcggaggtccacaaccacctgctccgctcataacaccgaggacaccaaccgtcggaaggtgctggccgctatcccccttgtcggtacgtctggaaccattctatcttggcatatgcactgtgcggtggcggaatgcgcgccatgcggtcaacctgctccgattccgacagtccttgtcgccatacccccccgatttgcggagggtccatcctccatcctcattgtggaggccgtgacgtccctcccgccccgccgctctgcaggccttgccttcggcagcgtacagagtgccagtgccaacatcaccgccggcaagagctccacgaaggcctcggctgacggttacaacatgactgggatcaagcgtcaaggcctcaccaaggcccagaagagggagatcctggaccgcaagcgcgcgagcgcccaggagtaggccccgcacgaggacgttgtagggattggtctgtgtggaaggactgctgcgcagactggacccatcacagagtcctgtcgagannnnnnnnnntggagtaggcccgcacgaggacgtcgtatggattggtctgtgcggaaggactgctgcgcggactggacccatcacagagtcctgtcgagaccctgcacctgggactgttgtgccgcgatccaggcttcttagcgggagagcgtgagtgtgcctattgtttgcaattttctggcgtagaaggggcagattgagctccatgcggcgagtttccgccgtgcctccaaaccattcgacctgtcttttcctcccacggtcccatcctatgcggtgccacatctagatgtttgttcgagtggcatggggccgagcccctgggcaattttgtgctgtgccgtcactcgcggcggggtgcagtcacgaatgactgcacaacgaccttttgtcccattgtttaatgttcctactatccacttgtcatggagcccagcacatcgatgtgtttggtatgctgcacacagattgggaaggggactctgggcgtgtgggagagcctcaggtgcgggcctgcacctcgcaaaccttcccttggatgggatggcaccccccgtcgccacgcagtgggtgcccacacgggcgcaagtccccccttctggctcaggcatgtgccgcgacggcaggnnnnnnnnnnccgggcctgtacctcgcacaccttcccttgcatgggatggcagcccccgtcgccacgcagtgggtgcccacgcgggcgcaagtccccccctctggctcaggcatgtgccgcgacggcaggctcctcctcggcctcagccccggcggcgcctggagcgccctcccctggctccgagaggtgcgcgcggttgcgtggcgtcgcttcgtactcctcgatgtcctcccgcatgccccgaagcaccccctccagcagctcgccgcggtaccgcgtcgcggcccagtccgccagctccgcctgcagcccgcgccggaggtcgtggtaggagccgacgctggccccggccagtgcacacaccctgcacaggtggtgcgcgggctgcatgtcaggatttgctgatgtgtgtgtggggggtgggtccgttcggcacgcaccctgatttttgtaacgtgcaatggctgctgcgggtggcacaccgagcgctgccagggcaggcacacaggacactctcccccgaaacacccagaaaccaagcactcacgcccgcatgggcttcaggtagagcgcgtccaggaacacctcgtccttcctcttgggcttgccgccagggacctttgtgagtcgcggcccgagcactgggagggaggattgaggtggggggcagggaggagtgagtattgagcgagacgtctgcctcgcactcgtgccgctgcgggaagaggcgcggcgagcgccaagggtgtcaccaggcgctccagggggagcgatgggatgcagacccccccagcagccccttgtccacgctcctgggcaggaattctggcgatgcaccccccccagcaataggaaggagggcctggatcgctcacctttgaagcccgcgcgctggaggaggcggacaccgggcgccaggcgcgtagccagcggcttggccatgagctgcggcatggccgcccagccctcgggcggcacgcccacctcctgcgacagccagtcgtaggtggggtgcaggacggcgggcgcctgcaccgcgcccttgctgcccagcaggcccagcagggcctccccccgcaccccgcgcgcggcccagaagtcggcggcgggggccaggtgcggcccgcccgcggcctccgccaggcgcggcgcgcgctccagcgcggcgcccagcgctg

SEQ ID NO: 42986 - DNA, 76 bp, Chlorella protothecoides
agaggttgagggggagggcagggagccattgggacgcctctagtaagtgatgcagggccctgcgctcaaaaaggac

SEQ ID NO: 42987 - DNA, 114 bp, Chlorella protothecoides
gcgcgtccgccgccgcgcgccgcgcaggcgcaggcgccgaggcggcggccaagccgggcagcgcctcccccagcacctcccccggcgccggcggcctgtccgccgacccggagt

SEQ ID NO: 42988 - DNA, 61 bp, Chlorella protothecoides
ctgggtgagacaatggcttatggttaggggggaaaggacttccatcatactgttgagagtg

SEQ ID NO: 42989 - DNA, 68 bp, Chlorella protothecoides
ctctttatcaccagcatctttcaccccctcacacccctccccccccccccaaccaactaaccccgtag

SEQ ID NO: 42990 - DNA, 459 bp, Chlorella protothecoides
  modified_base (171)..(266): a, c, t, g, unknown or other
cgccggcgccggcgcccgcgccgcgctcggcggcgccggtgctgtcggtgcgctgcaggtcgtgcgcccccggcagcgcctgcaggcccctgccctccagcaggctgctgatgtagcgcccgtgcgcctccaggctgcgctgcagctggcgctggttctccagctgctccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcctcctgcagcgcacgctgcgcctcgctctcgcccgtcgtggcggggcccagctccgccggcagcagcgaccgcgccgcgctgatgggggagccgccgcgcagcgccgactcggaggcggtgcgcgccaggctggccgtggaggcggagcgtgggggcatggagccggggcgggcgcgcgcagagcgcgcgc

SEQ ID NO: 42991 - DNA, 61 bp, Chlorella protothecoides
ggtgcgagacacccgctccgccacggcggcggggggcacccggagccgggccaggccctcc

SEQ ID NO: 42992 - DNA, 61 bp, Chlorella protothecoides
ggtggactgcacggtcaccacccagtctggaaagcaggtgcccgcgcagtgggcgcgcctg

SEQ ID NO: 42993 - DNA, 61 bp, Chlorella protothecoides
cacaatcacctggccagcggatgcaagaggcctcgaagtcgagggggcatcatccgccgcc

SEQ ID NO: 42994 - DNA, 70 bp, Chlorella protothecoides
catcgtcggcatgccctccggccccttcctcttcgccgatcagtggctgtccgtcatcaagtctcgctcc

SEQ ID NO: 42995 - DNA, 82 bp, Chlorella protothecoides
gcccgtctccaagcccgtctcccagccccaacccgtctcccagccccagcccgtctcctagcccgtctcccagccccagccc

SEQ ID NO: 42996 - DNA, 61 bp, Chlorella protothecoides
ggcgacgtattggctgcacataggatgggggggggacagtgtttgcaggtgggcagagccg

SEQ ID NO: 42997 - DNA, 61 bp, Chlorella protothecoides
taaagaggcaggtcccgaattcggaggaggggagcgactcgcggactctcatagttgggaa

SEQ ID NO: 42998 - DNA, 61 bp, Chlorella protothecoides
tttggtatgtagtcaatgcgtgtggcaggggatgggggtccggcctggggttccggggcct

SEQ ID NO: 42999 - DNA, 12498 bp, Chlorella protothecoides
  modified_base (3178)..(3187): a, c, t, g, unknown or other
  modified_base (3604)..(3613): a, c, t, g, unknown or other
  modified_base (3691)..(3700): a, c, t, g, unknown or other
  modified_base (3880)..(3889): a, c, t, g, unknown or other
  modified_base (4117)..(4126): a, c, t, g, unknown or other
  modified_base (4319)..(4328): a, c, t, g, unknown or other
  modified_base (6099)..(6108): a, c, t, g, unknown or other
  modified_base (6188)..(6197): a, c, t, g, unknown or other
  modified_base (6424)..(6433): a, c, t, g, unknown or other
  modified_base (6746)..(6755): a, c, t, g, unknown or other
  modified_base (8556)..(8565): a, c, t, g, unknown or other
  modified_base (9197)..(9206): a, c, t, g, unknown or other
  modified_base (9265)..(9390): a, c, t, g, unknown or other
  modified_base (9507)..(9516): a, c, t, g, unknown or other
  modified_base (11885)..(11894): a, c, t, g, unknown or other
gcgggactgggcgccgccggcgccgcggccgccacggcgccggcgtccacctcggcggccgccgcggcgctgggctcgtcggccaacccgctgtacatgatgcaggcggagccgtctttctgggcccagatctggcgcacggtccgcgtgctgggcctggctttcctgctcatggccggggcgggcgcgctgatggacgagcgcggcctgtcacgcggcgtgctcaactcccccgacctgaagccgcaggtggagacggggaccaagttctccgacgtcaagggcgtggacgaggccaagggcgagctggaggagatggtggagtatctgcgcgaccctgcgcgcttcaccgccctgggcggcaagctgcccaagggcgtgctgctggtgggcccccccgggacggggaagaccatgctggcgcgcgcgatcgcgggggaggcgggcgtccccttcttctacacctccggctcggagttcgaggagatgttcgtgggcgtgggcgcgcggcgcgtgcgcgacctgttcgctgcggcgcgcaaggcggcgccctgcatcgtgttcatcgacgagatcgacgccattgggggcaagcgcaaccccaaggaccagcagtacatgaagatgacgctgaaccagctgctggtggagctggacggcttcaagcccagcgagggcgtgatcgtcgtcggcgccaccaacttcccccagtcgctggacaaggcgctgatcaggcccggccgcttcgaccgccacgtgaccgtgcccaaccccgacgtgcgcgggcggcgccagatcctggaggcccacgcgcggcgcgtgccgctggccgccgactgcgacctggacgtcgtggcgcgcgacacgcccggcttctccggcgccgacctggccaacctggtgaacgtggcggccctccgcgccgcccgcgacgccaaggccgccgtgggccaggccgacctggagtttgcgcgcgaccgcatcctgatgggcgccgagcgccgctccgcgctggtcagcgacaagatccggcgcctgaccgcgtaccacgagggcgggcacgcgctggtggcgctctacacccccggcgccgccgcggtgcacaaggcgacggtggtgccgcgcggcggcgccctgggcatggtcagccagctgccggacgccgacgcggagctgagcgtgacgcggcgccagctcctggcgcgcctggacgtcgccatgggcgggcgctgcgcggaggagctcatcttcggcgagggcgacgtgaccacgggcgccagcagcgacctggtcgcggccacgggcctggcgcgggccatggtcaccgactacggcttctccgcgcgcctgggcgccatgagcatcccctttgcggaggccagcgccgaggcgcaggccgccatcgaggccgaggtgcgcgcgctggtcaccgccgcgcacgcgcgggcgcgggacctgctggcggcgcacgagaaggagctgcacgcgctggccgccgcgctgctcaaggaggagacgctgtcggggcagcagatcaaggacctgctggccgcggcggggggcgggccggagctggcgcgcgccgcggagcagtaggtttgttcgcgttgcttggtcaccaggaggcggcgggtgcaggtgtgggcatgatgcttctgatgtccagaccccacgctgctggcctgggaggtctgtgaaaggggcggccgcgacggcgggctggacacacccgcgcatgtatacacacagcgatgacagggacctggtcctccaggggcggagggaggcaggagcaaaggggaaagtgctgtggctcatctgcagtgttaggagacaacaacgtgccatccagtgtaaagtgcaggggaccacaagctgggagcaggtctgggtgtggctggcagcgcgcgcgcgaacccctcccgaaatcttgtgagatcgggagcatgatccaggcgcgacacctctcgtacacggagcacagggagaggcgcaggtggaggttaaaaagcagtatccagacagttatcatactgaaaatccagatccatcgcaaacgccatggcggaaggcctgtcggtgaaccacgctgccgagccagacctgagcccgggacctgcaggaaccccaaagtacctgcgcacgaaggaccatgtgctcagcatcgaggatgccctgggcaacgtgggacgacatctgagcagactgcagagggagcgtctggagtacgagcccctggtgcccgaggtcctgcaaggcaagccggcgaggtgtcgagttccgacatgcatgccggagttttctggttgagcagttcgccccgagcgatgctgcatgcatgtgacattagattgcatgtacacctgcaggacctcatgagattgtggagcaggaaacacggcaggcggcggcaaatcacgaggccatcgccaagctgttcccccagctctgccgctcccccctccacctcctgcgcctggtgcccggagagcatgccccgcatgccgagggccaccgccctctccgcatcggggtggtgctgtccggtggccaagctcctgggggccacaatgtcatcacaggcatctttgactacctggccaagcagcacccctgcagtgtgttgatagggttcaaggatgggccacgcggcattatcaacaacgaccacaagctcctcaccgcaagagaactggtgcgtggaggagttgaggtattgtcgggcggcttggttgatggagcatgcagtgcatgttctgtgacgtgcgtagcccaccttgatgctcatttgaatcgtaactgaggatgcctgccggtaacctccactggacgtgcaggagttctaccgtaatcaaggcggattccacctgatctgctctggtcgtgataagattgagaagccagagcaattgaaagcaggtgtgtgacggcggggggcaagattgttgacttggggaacatggaaggtggaaccggctagcgaatgcctcactgtcaccagttcatcttcgctgtgcaactgcgtttcgtcagtggcgttgtctataaacaagcagcatgcgaggctgcctgtccatgggacctccctccgatcgtttccacttctcccagcctacctcccaccctggcctgacagccaagcagacctgcaaggagctgggcttggatggcttggtannnnnnnnnnatccatgggacctccctccgatcgtctccacttctcccagcctacctcccacccttgcctgacagccaagcagacgtgcaaggagctgggcttggatggcttggtagtgatcggcggcgacgactccaacaccaacgcggcagtgttggcagagtacttcctcagccaaggtggagactctggtgggaggtgctgctaccgctgaaggcaatccgcctttgtgacgtactttccatgtccaccagacctcatcctggccccaaccccccttgcagacgtccagacctgtgtggtgggcgtgcccaagacaatcgatggtgaccttaagacagtagatgttcccatctcctttggctttgacacggccagcaaggtctattcagagctgatcggcaatgtgatggtgaggctgggggnnnnnnnnnntgtggggagtacaatatgaagcacatcatggcaatgctgtcgtgaggtaggggaaagtgtgagagcggctgaagagcnnnnnnnnnncgaagcacatcatggcaatgctgtcatgagataggggaaagtgtgagagcggctgaagagcaagctgtgtggacccgggtgtcaggttccaccttgacatcaatgtttgctttgggagtcgtgcctgcttaagtcccacttgttgaaagactgcacaacacgctgcaatccaacagctgnnnnnnnnnngtttgggagtcgtgcctgcttcaagtcctagttgttgaaaaactgcacaacacgctgcaatccaacagctggaacctcttgaatccacagacggacgcctcgtctgcgaagaagtactaccactttgtgaggtgtgcagcggacttgcctgctatgtgctcgcaagcacctggatgaccgcgcactgctgtcgccctgggtggccctctcttctttggtgtgcctgcnnnnnnnnnnagtttggggtgatgaagatgggggtggatgtaattgcggcctctacaagcgtggactgctacctgctgacggcggagtgtcaagtcaccccacctgaggaacgcccccaaccccttctttgtaatgagcctaaattatacatgcaccgtcctgcagatcgcggatgtggtggtggcgagggccgaggctgggnnnnnnnnnngtgaccgcgcagtgctgttgctcggggtggccctctcttctttggtgtgcctgccagcagtacagcagccttgtgcccattgatgacgacaaacacaggttaatggggcgggcggcatcgcacgtgaccctggagtgtgcgctgcagactcatccccaggtggccctcatctccgaggaggtggacacgcacagctggtcgctgcatgacattgccagcagggtgagattgggctgtggggacgaggtgccctgctggggaggaaggtatgtttggggtgatgaagatgggggtgggtgtaattgcagcctcgacaagcgtgggctgccacctgctgacggcggcgtgtcaagtcaccccgcctgaggaacaccccaaacccttctttgtaatgagcctaaattacacatgcaccgtcctgcagatcgccgatgtggtggtggcgagggccgaggctgggaagaactacggcgtggtgctggtgccggaagggctcgtagagtgagtgctgcccggatgcgattggggagtcggctctgcaagggacatgtggctggctatcaggttgtacagaacgctgcaaattggtctgtactgtagagtttgccgaggaccggtctcggcatcaggggaacagcccctgccggtctcattcctctgaccatctcctgcctcacatgcatccagaccccccctcccccccttcactgggcccctctttccaaaacaacaacctcgtgaaggtacgttcatgacgtctctgccctgattgtggagctgaacgagctgctggccaaggacagcgccgacccgcatgacctccctgccgtggccgcgagcctgaccccgccctcccgcgccgtgttcgagtcgctgcccgccggcttcaagaccatgctgctggaggagcgagacccgcacggcaacgtccaggtgtcgcacatcgagaccgagaagctgctcatccggctggtggagggggagctggcggcgcgccgcgcatccgggcgctatgccggcaagtttgctgccatcccccactttttcggctacgagggccgctgctccctgcccaccaacttcgacgcctcctactgctatgcgctgggccacgccgccgcgtccctggtgggcggccgccgcactggggtcatggccaccgtgtccgatctccagctgccggcggcgcggtggcgggtgggcggcacccccctagtggccatgatgtgcctggagcggcgcaagggggcagtcaagcccgtcatccgcaaggcactggtggacctgaatgggcccgccttcagggcctttgccgccgtgcggcgcaagtgggggcttaccgactgcttccgttccccggggcccatccaggttggaactgtaatctcaagttggccgaaacgggagaggtgacctggttgcgcactcccggggccccaaaccgtgttgacttcgcccggcagcatcatttggaggggcagacgccactgtcgcaggagtgagatggcccattttccgcaagttctccgacccagccaccccttgaaggtggccccaccaatggctccaatccctcctctgcccccgccgcagttttctgggacccagtacgcggatgtggcgacgatgacgctgggactggagatcaacgacggtgacccggtgctcctcctggcgcacggcctcaccaactactgaggacctacagcagttgctgtggactcgtgagccgaccctgggaccatcagctcccagcaagcttgcagggtcnnnnnnnnnngcccaaaccgtgttgaccccgcccggcagcatcatttggaggggcagaggccactgtcgcaggagtgagatggcccattnnnnnnnnnncagaggcttctctgaggcattggagtcctgtcctgcagtgttgccactgactgtgctgttgtgttatagctgatgatgtaccttttcctccctcggcagccctgcacgggacccctgagtccgaccagcccttccctgcctagcagcaacgcttactgctgtttttgagtgtgtctttcctgtccgttcctagagttgctcccacgaatccacccctcccgtctgcnnnnnnnnnncgagagtgtctttcctgtccgttcctagaaatgctcccacgaatccacccctcccgtctgctccgatcctcacctgccgtgcatgctgccaaggacagtctctccccacctcaacccagatgctgtgcgcacagcatcccgcacctccgaccatgggagctctgctcgctctcattccactcagcctcctttgtgtacaagcctttgaggcagtgctgtggtgcagggagctgcgagcagactagaaattggaaagcttctgcctattgaaccagcggctatgggaggggatagagaggatcacaggtacgtnnnnnnnnnngtggaaagcttttgcctattgaaccagcggcttggggaggggatagagaggatcacaggtacgcctatccaccccccctctctcaagccggcacggggactggttgccgccccagctgctcggcggcttcctgggcacccagcccttgcggcagggggctcggcgcgggcgcctccatcagcctctgcatcacggagtcgttcctgatttccagcacggcgggtagcccgtccccgcacccacgagacagcccaacgtccaccctgaagactcggcccccgcacgcgctgttgatgccctggatgttgtatttttggggggaaaagggtgctatggtcgagtatgaaaggcttggccgccgccgccccttttagccatgctgaaccccaatctcattccacccccctaaacccccctcggccggcccggtctctacccacctcttgctggatggtgtggcccaccaccatgcgcgccgcgccagggatcctggccagcgactctgcaagcccggcgcagtcgcaggcctcggcgtcctccgcggagtagtcgcgcgcccagaccacggcgctgcggccggtgaggatgcgcggcgggcgctcccccgccgcgccctgcagccaggcccgtgcggccgcgttgagcgcgggcaggccctgcgccgcatgcacggggagcacgccgccatgcgcaaagacggtggcgcccacctgcaggaccagcgggtgcggcgccaggaagcggcgggccaggggacccgtcccgggccgcagcgcggcgtagcgtgcgtcggcgccctccgcgcgccggaactcgcgcatctcgccgcgccaggcggcggctgcggcggccgtgttgccgtccgcgccgaagcagccacaccgcgccttgagggccagctccagcgcgtgcgcgcgcgcgaagcgcgagaactcatccagcccaccggcggtggcgaagcggaagtcgcgcgcggccgacatggtctcgtggttgccgttgagcacgtgcagggcgccgccggctgcggcggcctggcgctgcagccgctccagccagaagaagagctggatctcggcgtcgccgcggtccaggatgtcgcccacctggacggcggtggcggcgccgccggcccagcggtcgcggtcgtccactagtcccgcgagccggaaagcacggcgcgccttgtccaggtcgccgtgcaggtcgccgatggccagcaggcgctccacgccgggcagcaccgtggctaggctgggcgcctgaggcaggaaacgggacagcgcaaaggggttgtttaagagggcagggggcgcagggacatctaggaggggcatcgtctgacgcagatcaatgaaccagggccagcgcatgaaggagaaacaccctcaacaagcaagcatcacccacctcttcagggtcacgccgtggagccgcggggccgttggcatgagccgtgtcaaccaccgcctcgacaaaggaggcccacacctaaaccgtgggtgggggagtggacgtgggtggcgcattctcaaccgggccacctggatgcgttttctgcataccattcctctatacatcttctttcacctttgggaaccctggagggcagcgcctcggagggcctgagccgtcgtgccctgtcatcgcacgtgagcctcagggagtttccctccgaaccaccacaagcagctcctatgctcgcgttattctgtcctcaaactcctggtggaggaagacgcatgccgaggcgtctgtcaggccgctgtgcacatcgactgccgcttgcagcgagcaatgnnnnnnnnnngattcctggtggatgaagacgcatgccgaggcgtctgtcaggcctctgtacacatcgactgccgcttgcagcgagcaatgagaggtctgaaccccaacagccctagcacgcaccgcatgagcctgtctcagggtgtttcggtgcattggtggacgagcagatgccatctcatgccctggtcgtgtgactgggcaccaaacttgatcgcccggagcgccaagctccaaggccgattgctgatttctgttcgggcacggcacaggtgttgcccacgacgaggatcgactcggccgctgcccggcctgcagcctagttctggatgtggatccaggtgtcaactctagtcgtgtatgcaggtgagaggagttgagtccctacaattccccgatcctccatgtgggcagcagcagtggcaaggttgggaagcttcccccacagctcctccaccccaaatccctcgtcccctgcaggtttctacctagtcatagtcttcctcaccctgggcatagcgtgcgccctcttctacctggcggagatcattgaggagcacacatccaccacgaaaaggctgctcagtcatgtcatcaaggtgcctggactgttcaggcaaaggggcgatggcaggggctggnnnnnnnnnncccctcgtcccctgcaggtttctaccttgtcatagtcttcctcaccctgggcatagcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgacccctctatcctccttgcggccactgatcctactcacctccaccctgacatcgctttttgctcaaccatgaccgaccctccccccccctcgctcgcagatcgagttggcgctnnnnnnnnnntgactctgccagtgcacttcatgtgcctgtcatgcatgtcctgcgctgagttcctgacaaatcggcctgccaaccaggattatgacccctctatcctccttgcggccacggatcctactcacctccaccctgacatatcgctttttgctcaaccatgaccaaccctccaacccccctcgctcgcagatcgagttggcgctgcacgccctgctgctgctggaccgcctgcccatcctctgccttctggtcggcgcggcggcccaggtatcccaccacaccctcctgaagcgcttcccctacaacagcgccctggcaccctccagcctggccagcgcgggcctgacgctggcggccacgggcgcctggctgcaccacttctggacctcccgctactcgggcgagtacatggtggccttctgcctggtcaccacctggctcaccccctttgcgctgctgctgggcgtgacgggggagcaggcggtgctgccgggggcggggggcttcccctattcgtcccccgggccggcgcagcatgggggcgccgcgccgcccaagaaggcgtccaggagggggctggcgctcaggatgtttgacgtgctgcggcggaaacgggacgacgtcgtcccggggctggtctcgcacctgccgggcgtcaccaaggagaagatctgagatcctgttgtggtgccaggagagtggggtaacgcctcccggtcgaatcaagctccgccctcacacaaggcagaccatgaactggtgtgagtgccagtgtgcacagtcgcgcccgccccagctcttgcagcgaggtgcacgccgtgtccaggggctgcgatgcgaggcccagggctggatctgaccatcggtggtgtgcgctgcacgtgtccatctgcccgggacgcgcggatgagggacctgtccagctgccctgcaccccggctgcccctctctgcggtcctgtccaccatacgcggggcgacacgcacaacagagggaggggggggcagcagcgttaaggagcagggcatagaaaggcctttggaatcaaggtagtatacagcaaaagcacggtatgggtcggggggacaatggcgggggatgttgctgcaggtccgccccgctaaactgttctttctttctttctgccgttgcgatggaggatccgtaatgcagacacgccctagcgaggaggtggaccggcctcggcccagcccccgtcaggccgcggtgcgggctgcggggctcacgcgcgaaagcccgttggcggccggccgcctggctgcctgcgagcccccggccccgatgggccgcgcgggcttcgccccggcctcgaagctgccggcggcggaggaggtgtggggcttatactggctggccttgctccggaagtcctggatgctcctgaagtcggtgtccagcagctccttaagctgcaagggagcagtgaaaaggagggtgtcaaggggctgagaggtccgggggcgcagaagcaggggggttcccatgttgggcacttgatcagccaacccattccaatggagagtgcaactcgacgcatgcaggctgagcattgtggtggggcggtgcaggttccccccagggcgggcctcagttttgattgattgagaattgtattccacaccagccctcccgaggggggactatcggaattagcatggagatttgacatcccaggccgctgcccttgatacttcacatgccagacagaacatgatctccccagtgaaaggtgagcatgctgtgcggcaagcggcccctccctcaccctctcccagccgaggggcgctgacagcccctacaccctgcttccggctctgtaccttgggctggatctcgagctccttgtccttggggaagccgtggtagttgtggaaggcccacaacttctccagaccatacaggaatccgttggcatagtcctgggcaagcggtgaaggtgaaggatgtgcgcaatgcccgacacaggtttggcggatgggcaccctgcacttcaagcatgcctgacaggtgctctgatgatcttctcgagcacaccaccgctgagtgctctgggctgggtatccactctggcaccgctggccccatcaagcgcagccagcatcccatgccccggagtccatcgctccgtccctcccttcccaccaatcctctgcacctgcagcacgtgctcctcgaactcgcggtacaactgcaggttgaaggccttctccaggccgtaggagtagaagcggaagaggcactccagcccgtactggtagtcgctggcagcgtcctccagggcatatctggattgtagatagggtggggggaggtggggggcatgcgtgagttggtgagcggtgcctgggcannnnnnnnnncctggatcgtagaaagggtggggggaggtggggggcaatgcgtgagttggtgagcggtgcctgggcatggatctctgaggccatgcacttccgctgcacgccaggcgtggcatatactcgactccgcccctgccccagcgatgcctcgtcccaatcacccccctccccctcacgagtccccattccaacgtacttcctgaagtcgtcgtacatggtcttgttgaagtggtccctcaggaagtagcaccagaagcggaagagggtgttcatctcctcgctgtgccccacgcccttttcggcgcgctcggccaggcagcgcgcctggaacttctcgtacttcatctgcgtgaagttggcctcctccagcagcgcgtggctggggtgctggaacttggcgatgggcgcggaggagccgaggacggaggacccgaagcgcgggctgccgccggccgacacgccgcccaggcggctgcgcgtggcgggggacacacccagcaggtgccccgacccgtgctccggcggcgtcgagcccagcagccagcccacggcgaccgagggcggcgactcggcgtggcgggggccgccgcggtgcgcgcggccgccg

SEQ ID NO: 43000 - DNA, 127 bp, Chlorella protothecoides
cccagcatgggtgagaggcggggtcctcagtgccacgcccgcccgtcatgcaagcctcgcccgcagccccaagcaccccccccaccaaccccgcacctcgatctcagcgatggcctcttcgctgaat

SEQ ID NO: 43001 - DNA, 83 bp, Chlorella protothecoides
tccccctgaaataccacaaaggtacttcggtctttgcgttactaaattgttttttaataaatatttttgtttaaaatatttat

SEQ ID NO: 43002 - DNA, 61 bp, Chlorella protothecoides
taggagaacccagacctgttcaagtggctggcgaaccaactccccacgcctgagcatctac

SEQ ID NO: 43003 - DNA, 63 bp, Chlorella protothecoides
acccaggcccctgtgatggatgggtggattggggggggggtgaggggggaagggcgaggtggt

SEQ ID NO: 43004 - DNA, 11265 bp, Chlorella protothecoides
  modified_base (512)..(617): a, c, t, g, unknown or other
  modified_base (2856)..(2865): a, c, t, g, unknown or other
  modified_base (2979)..(2988): a, c, t, g, unknown or other
  modified_base (3597)..(3688): a, c, t, g, unknown or other
  modified_base (5217)..(5226): a, c, t, g, unknown or other
  modified_base (6449)..(6458): a, c, t, g, unknown or other
  modified_base (7478)..(7487): a, c, t, g, unknown or other
  modified_base (8314)..(8323): a, c, t, g, unknown or other
  modified_base (9379)..(9388): a, c, t, g, unknown or other
  modified_base (9953)..(9962): a, c, t, g, unknown or other
  modified_base (10339)..(10570): a, c, t, g, unknown or other
  modified_base (11059)..(11206): a, c, t, g, unknown or other
cggaaaggggagctgacccggcgcgttgatggccgcacgcaccgcatgcgaggcatccttctgctggtttgtacagctcgacggtggaaccacgcacatctggacgcgtgccgtctcccatttgaaaatttgatcctgctcactgcctgtctcatccgtcgtgcaccccacgaccccctggtcactcggccgacagctggcgacggccatggcccgcaccaagtgcccggcctagatctacagtgtccgggggagtagactggtgcagatcttcgacgccatgatgcccagggaaggcatgtcgatcgccggcttcgtggcattggtgaccgtgtacctcgggctgaacagctcgctcaacctcctgaacaaggtgagtgcgcgaggggtcctgggatcccggtggcgaggcctggcagtgcgcgatgggatgccattcaccaacctccgtggagctgcgtgtgtcattctgcccccgcccaccccctgcacctctcacccctgtcccgtcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccgcatctcagaccccttcccctccacgacgcagtgggcgctgggcatctatggcttccgcttccccttcctgctcaccaccgcgcacatgagcttctccttcctcgtgctggccccctttgcattgcgcacgccttgggaggcccaccgcgccacgctgcgccgctcctggcgcggcgtggtctacatcggcgccttcatggccctgaacatcgcgctgaacaacgtcagcctgcaggacatcagcctgaccctgaaccaggtcatccgctccgccatccccgccgtcacctgcctcctggccgtattcgtggagggccacgtgccctcccgccgcgaggccgcgggcgtgctcacgctcaccctgggcgtcatggcggtggtgtggcagggccgcgccacgggccgcgcctacgccgtcctcttctgcatggccgccaccgtctgcaacggcgcgatgatgaccttctcgggcaaggtcatgtcggagaagctggatgtggtcagcctcaccttctacaccgcccccgtcagcctcttctgcctcctcccattcttcctgaagttcgaggtgaggcgaaagctcccatgggcgcttgggctgtgctcccctcatgccccctcccctaacaatgatgatcctcaacctccccccccccaaccccactacccagctggccaagctgatggcatacctgcccgagaacccgcagggtgcagcctacgtcctgctcctcacctcgatcaacgcgctggcctacaacctggtgcacacgctgatgatcaagcgcacctccgcggtcaccaccacggtgctgggcatgatcaagatcgtgggcctgctcctgctctccaccttcctgctgggggaagggagggagctgacccccagcatgaccgcgggctgcatcatggccgtcacggggttcgccgtctattcccacacccgcctgacggagacgcgggccaccacgggggtccgcgtcatctccctcgaaggcgacgaggaggcggggcggccagtcaaggggctgggcgccagcgccgcagtcttcaggcagccctccaccccaaagtccagcgagtgagggaaggcggaatctgggaggggccggtctgggcggcgggccctaagtccgacaaggtcgcggtcgcaggagccggccggagcgctggcagggctgttgctgctcggagggagcacaagacacgccatgacaagacaccagcctcatcagcgccgccttgtatgtcaagctgtagtccatgaaaccctaagaccgcctggtgtaggactctgtactcctgatgggctgctgccttctgaaattccccttgattactgccttgcagctcaggacagggagcgcaaagtcttgcagctgcctcccatacacagggcgatcctgatgccctgactgcccacgaggccctcgctcctgtactgcacgctctgaagaactgcacacctgtctcgaagtcggtcatgtcaagggagtcacagcagcagtcggcgacgtgggggtgcagagagcggaggggacagctgacatgccaggcgcgccccccctcagcccaggcgcgccccccctcagcccaggctgttgatggccgcgcccagcggccacgccgcctccacctgctccttcttgtactggacctgcagaggtgttggattgaagggggggttgagaagtgcacagagagatgtgaagacttgggacatgctcgtgcatcctcatactcggcagacagagccaggacctcaccaacaaacccaaactctgcaacacctgccggccagccccaccccctcaccttccccaccgccacccaccttctttacgatggtcacctccgtctcctccggcacgcggaagccctccagcagcaaggtgtgcacgtagcacaggtccatgcagaagaaagggcgggccgcctcttgcacgttggggaagagggtgcccaggtctgccagcttggcggagcaggccttgtccgccagcttcttgaactcggccggcttgaccctggcctcgattgcggcggtttcggggaccaggcctggggtggcggggtgggcatgggagggctcagggtattcggtgggattgtccaacacgacgcgggaggtgggtcagaggcagggcgcaggattgtggtggggagcagggcgcgtccatccagcggcagcgctcgccacagccaccccgtgccatgcatcaccccgcactcgacnnnnnnnnnncggggagcagggcgcgcccatccagcggctgcgctcgccacagccacccccgtcccatgcgtcaccccgcactcaacagcctcccccgtgccatgcatcaccccgcactcgacnnnnnnnnnncgcccacctgcgtccacggccctgtcccagaagtaggaggatatgtagaagacggagggcacgcggcccccgccccaggccccattgaagctgcactgcagctggggcgcggcgcactccagcgccgcattgaggctgctggccgccacggcggcgcaggcggcggccgaccccgcctcgccgccgcgcatcgggtgcttgaccccggcgtactcgtactcgcccgcgtagcccacggggacgcaggggtggggcgcggccgggtcggcgggcgcggccagaacccccgcccgccccgccatcaggccgtagcccaggtagctgtagacgtacacgctgtaccgccgcccgccgccgctgagcgtggtggtgtagttggcgtgcggcgcgcccgccgcctccttcgccgtcatggcaaaggcctcctgcacgctccccccgcccaggtcgatggccgccacggtgcggtcctcgtgctcacccagccggcccagcaggtagttgagggtcagccaggcgaaggcgccctcgttgaccccggtcaggatggacacgtccgacgctgctgactgtgggaggcggttgcggcgggggggggggggggggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgcggtcttcaagatgcattctcatcatgaagtgtgtgcaggcacccctcatacaggaccaggtgcatggcacatgtccatccagcccccaatgaagagcaccaggcctgcagcccaggcctcggccccatcccaccgtcaggcagtccccatcatccctcctcaccaccaccacccaccccgcctcctctcagcactctgcccacgcaacccctgccaccccctgaaccaacccacctggaaggggtaggtcttgagcagggcccgcacctcggccaggatgtcgtcggccttggtccccggcagcatcctgagccccgcggtggcccccacgctgacgtgggtttgggcgtgcagcgcctctgggatggtctccagggccagggccaggagaggcttgagcgaggctgccgcagccttggggtccgcggcgtaggagctgagtcccggcttcagctgctcgaacttgtcgaactgcaggtcctgcgcccccgcggcggaggtcagaaacttgaagatgtgcacgcggctacccgtggacccggcatcgatgaccaccgagaacttggcttgctgcgtcgaggcgtccgccgccttggacgccccataccgggggtccaggggagaggcgcggggcatgatgcccaggaccagcaggaccagtaccacgggaatggacaggacggtgagcaggacgcggtgcctgtgggggcaaggggggttggggaacgttgaacgaggcaagccgctctccgataccgggcaacccatgtgatctgccgctcgccgagggatcacatttgtcaggcgcataccttctcacgaggtcccagcgaccctcccgtccctttcccatcctgggaaaggaggggcgtagggcggacgtggtgctggagctgtccgcgatctggcccgccagggagcgcctgcgagaggcaaccgtccttctggcgatagatatgattacaagtacaactgccaatgcattcggggtctcgctgtgcaggtcccttggcactgcacctccctcagctctttgccctcttgctgcgagtcccggccggagcgagggcgcgggcgcgccaggccggtgtccgcattcacacccagaccttgatcaggccatccaccgagctggtgcacaaggtactgccctccgggtgcagggccatgctacacacgctgtcgctgtgggcctggtggctctccaccatctcgccagacgccaggtcccagatgcacacgcgcccatcctcggacgcgccaaacacatgggcgtcggtgggactgaggcagcactcgatgcgcgtggacgcatgcttgtgtcctgctcaccatttgagcggtcggggtggggtgtcaagtgggagtgcctgggtcacctcgatccaacatggcactgcaggtcgggcgacgcaaaggccccgcacggttcatccttggtgttgcccatgtttcccatgcttcatcgtgtctcccctccccctcccccctccaaccatcacctctgaactccatgagcaagtcnnnnnnnnnntgcaacgcaaaggccccgcacatttcatccttggtgttgcccttgtttcccatgcttcatcgtgtctcccttcccccttccccctccgaccatcacctctgaactccatgagcaagtcgccctcagcacgatccaggagcctgatgcaggagtccatgcaggcggccaggagcatggcgccgtcgcgggaaactgccaggtgggtcaccggcacgtgcagcgcgtcggtgaagaggcggcccatcctgatgtcgtaccgccgcacgccgccgtccacgctcgccgccgccacctcggcgcggccgccagccgtattagtcgtcacgctggtgacgctgtccgacgcgtcggtcatcacctgcacggggtcaaacgagcgggagcgacagtcccagaccttgaccgcctggtcgtaggaccccgtcaccagcacctcgtcgccggcgccctgcgtgatctgcagtggggtgaggatgggccgtttgaaggtactctttcgccggtctcaccaccaccttcatccacatgagcgcatgcccgcaggcactcatgactccagacagcacataccgcattgatgggcgcatcgtggcctcgcagcttccggattatttttccggacccgacgtcccagacaaagacctgcttgtctccgccgcaggacgcaaacctggccaggagggagatatgggtggtgtgtgaggttgagagggaaaatagtagggatgcctggcgggaggagaagtaggtggaggcgcacgctggcagcttggccgaggagggcacatggaggctgaggatggcagctaaaatccgcaaacataatagaattatgaccacagctctatcaagcaagactatcaaatcaaggccaaggcatgctccacccctggccgtcaacggctgccctgtcctacttgctattgtccttggtaacagtcacatcccggacatcatatccatgcccagtgtacgtcttcacgagtctgccggtgtgtgggttccacagacgaagcgtacgatcctgcaatcgccccgggaaatgggagagggtgaaggtctagtcgcaccttttccttgagatcagcggtcgccatcaattacacagaccgccctccgatcgaccccaagcaccttgccacaggacaagcagtaggtgccttgactgttgaagcgcacagcgtacacggggccttcatgacccttcagctcgtagcttgccnnnnnnnnnngcctggagatcagcggtcgacatcaatcacacagaccgccctccgatcgaccccaaccaccttgccacaggacatgcagtaggtgccttgactgttgaagcgcacggcgtacacgggtccttcatgacccttcagctcgtagcttgccgatgtgggaaagtgctcggagggctccgcggcgaggtgcgggggcagggcaggccccagcggggtgggaggcatggtccacacccctcgagtgatccctcacattccccgctgctggatctatcagttgcagagtctcaatgtatgtagtattttggatgcattggatgcacaatctggtgctgttaccacttcagtcatgcagaatcattcccggtctggcgcgcgctctgcgaaatcgtgcctataggaagttcacacgggcaatctacgcacgagagtctcgacggtatacacaccgtagaccccgctaatccatgtaaaatgcccacatgccaaacttgatgctgcgggaaagcatgtgactcgtcgtgcgtggtgtcggtctcggattcgggggccccatgcctgacctgagccagatcttattgaggccacatgcacaatgtagaacccttatcgtagctattgctttgatattgctcgttgaaggcgcgcttgcgctgcagatctctcctgtgcagcgtgcactggctcagtatctgaccaatgaggagctgagcacctacctccaggattatcagagacgctgccgggacatcgcaaaactgcacgtcatcgggaccagcgttcagggcaggtttgtcttggatctcaagctggtgggccagatgtgcagggaaagtgtgggctgagctggtgccggaggcggtcaaggcagctacgactggatgcaaactccatcaatggggcgatctacgcgcaatggggacatgccgcagtgctgaaaaaccctggcagtcatcatgtaacgacaggaggtccacattgacacggtcccaaaacacaggcagctgctggcactggagctgnnnnnnnnnnacaaactccatcaatggggcgatctacgtttaatggggacatgccgtagtgctgaaacaccctggcagtaatcatgtaacgacaggaagaccacattcacacagtccccaaacacaggcagctgctggcactggagctggctgcatcgcccgggtcaacgaatgcgctgcctcacttcagatacgtgggcaacctccacggcaacgagcccaccggccgcgtgctgactctggctctggccgagtacatctgtgaggcccgaggggaggacccccaggtagcccagatcctggctgggatgcacctgtggctgatgcccagcgccaaccccgacgggttcgaccagcggacccgggaaaacatgtgcgtgtctttaccataaccagtgactgggaggcaaatgcctgggaggatgagtttggtgcctgcgcgaagatcgaccccgtccgagtcgggtgcctagagatgtgggagcagggtgattgggatagctcttcccaccaacacagccattcctggccgagatccactcctgaggggtctccgtcccttccctcgtgaccagaaacaatgtggacctgaatcgcgacttcccagataggttctcaaagccgccgagcttgatgccaactggcagcgagcaagcagaggtccgggctctgatggactggagccgccgcattggcttcactgcctcggctgcgatgcatgaggtgggcatgcaggggctgatggacggagggttagaggaacaagggtgggtataggcactgacatgctggcattcaagtctcgtgagggaggcggccgggattgaatccaccagnnnnnnnnnnatttgagcaacaagggtgggtatatgcactgacatgctggcattcaggtctcgcgagggaggcggccgggattgaatccaccagcacctcccaactgtcgagtcagaccaggtccctcgggcctgaccagatgaactgtaaagggagcatgtacacgtacaatgaagaggtgctgcttacgcacatacgctctcacacatccacatgtatcacacacccactgcagggggcgctggtggccaactaccccatggatggcacgccagacaggtcgacccagtacgccgccagccccgacgacggcacgttccgccacctggcgaccaagtacgcgcaggcgcacacgaggatggccttgcccacgaacaaggtgggcgcgtgggtgcacgcatgcggcgctgcatcagtcgtcctgcccttcccagccccaggaatcgacagagtgcacggtcaccatcccatcacaggagtttccgaatggcggcatcaccaatggcgcggcgtggtatcccatctacggcagcatgcaggactgggtctacctcgcgacaggctgcttcgagctgacgctggaggtgtcggagtccaagtggccacccgtggccagcctgggggcgttgtggaaggagaacaaggcatccctcctgggtctgcccctgctggctgtgctgggagggtgcgtacgatttgggggggttggtcagaggggctggcatgcaccagggtgtggagcaggggatgtcatcctggagcagcagccgcggctcaattcggcattgtggctgcagctagtgcacaagaacagagagtcaccgcatcgatgcttgtggtcttcctggatctcgccctcaagacttcctagcctgatctgcattcccacagggtgcggggtgtggtgaaggcctccaacccactacgccagggcgggattgacacccctctccgcgccaacgtcacgggtgcgaggatgggttggggctgcctgcctgggaagcatgaggagaagcttgtcggtggtttaatgtaagctcagcgcgtccatcaaaccccgcatcnnnnnnnnnnaccactacgccagggcgggatcgacacccctctccgcgcaaacgtcacgggtgcgaggatgggtcggggttgactccctgggaagcatgaggaagcttgtcggtggtttaatacaagctcagcgcgtccatcaaaccccgcatccactttcgctgcacggcgtgtgtatgacatgaaccaaccccccccttctcccacatcgcgctgcagtggcgggcatcgagaccgtggtgcagagccgggagggcaccggcgtgtttgcacggcccctggcaccggggacttacgagctgcaggcgagggcacatggctacaccactgctacccagcagaccacggtgcccgacgacgggacgggcgtggaggtgctctttgagctcaagcgggtggcatccagcggcagggccaggcgggcgggcggcgaggaagccgccgacggcgccgcggcgctcgactccgtggcagcctggggtgtaaaccccggcggcgctctcaggttggaacccctgcgtcacaacgtgctcctcgtctctgccggcatcgtcttgctcctcgtggtgtggtnnnnnnnnnnacgactccgtggcagcttggggtgtgaacccgggcggcgccctcaggttggagcccctgcgtcgcaacgtgctcctcgtctcttccggcatcgtcttgctcctcgtggtgtggtttggtggatggcggctggcggccacccggagggggaggagtctccagccccgcacagtcatctccatccccctgagcagagttgcgggttaggggccatgacctttgcccggccaaaccccttgcctttcaaccagttttggacttgagcgttgttgaactggattgaaaacagcgagtccaaacaagccggtcgtctgctgccccagaaggcggtctgtcttgggccaaggtaggcaagggaggggccttcccatcacgctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcctgaaggggtcggccacgtgctgccatgatcctctttgttcccctccaccggagtcttaacccatactgcacagcagttccaagggaaatgccggcgatggaactggctgcatctatgcttcatggccgccagccatctttcgatcatagatatgcactgttcaccccactagtggaactaggaagtggcgggagacttccagcatagagaaagggaaggtgttaagtctgctgctgaggcattggcgcatctgtgcgatgggaagcttataaaggagtcctgcatagcggataatcacgcccgcatgacacaccgcccatccccttggacagaatcacaccacggaccaccaccggcctcctcgccaatcaacaccccgcagtatgctgggcaacttaccctatcactgccgctaaatggcagggtgtcgccccctggtctccactgtcgaaaacagctcccgcacgtggcaaagcacgccgcatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtatgagatccaggtctgtaagcgaccggcttagcaatccggcagggagagcgtctgc

SEQ ID NO: 43005 - DNA, 77 bp, Chlorella protothecoides
ctcctcagcacctccatttcagctctaattttgcagcaaggcagggcgcatcagatcgcaggagctcaagcagcttg

SEQ ID NO: 43006 - DNA, 61 bp, Chlorella protothecoides
gtgccttggcctggatgcgctggctcgccggcgtcactggggtgccgaggtttggtgtgag

SEQ ID NO: 43007 - DNA, 103 bp, Chlorella protothecoides
catcgggcagcccatgctgcccctggacacgaagctcttcaactttggcgcttggatgggcggtgaccgcgatggcaaccccttcgtcaccgccgccaccaca

SEQ ID NO: 43008 - DNA, 99 bp, Chlorella protothecoides
gggggcacgcccgcgccggtctcgccgcgcgaggcggcctccaggtcggcgatgccctgcgccacgctgtccagcagcgcggcgtccagacccacgcgg

SEQ ID NO: 43009 - DNA, 61 bp, Chlorella protothecoides
ggctctgtcgcatcaagggaggcaggggggggggtgcaggcaggacataccagggcagggc

SEQ ID NO: 43010 - DNA, 96 bp, Chlorella protothecoides
cccaccaccatcacaacctgggagggcgaggcaggcatgtgcgtcaatctgtgcactcgaagctatgccctcagcggccgggctcgccaggctgaa

SEQ ID NO: 43011 - DNA, 61 bp, Chlorella protothecoides
ctccattcccgggcgccagctgctggcaggggcgctagacatttcctcatgccctacctac

SEQ ID NO: 43012 - DNA, 87 bp, Chlorella protothecoides
ttcgtaatccggcggccctggtcctgcgtcgccccatctcgcccgcgctcttgcccgcgcttcgcctttggcgcagggggcggaggg

SEQ ID NO: 43013 - DNA, 94 bp, Chlorella protothecoides
gagggtgcagtgtattggttccaacaggataattgaaatcgattcgatccaacgaatattggatacgccagctcctcatgtcacgcctcccctc

SEQ ID NO: 43014 - DNA, 61 bp, Chlorella protothecoides
cgggcatatgaatacaggctgctgcttggggacacggccgcggttgggcagtcttgttatg

SEQ ID NO: 43015 - DNA, 71 bp, Chlorella protothecoides
cctcaactcctacttcacccagtactttgccggtgagtggcggctgcctgcctgagctgcctgcctgaggc

SEQ ID NO: 43016 - DNA, 105 bp, Chlorella protothecoides
caggtggggagggaggccccggtgatacatcgccgaggctgttgcggcaggtggatcgccggccccgctcaaccccccacgagcctgcgtggccacaggcgctgc

SEQ ID NO: 43017 - DNA, 85 bp, Chlorella protothecoides
gtcagtccttgctgccactccttgcctctgaccatatccatcctctccatcaaatcacagcttgcagcacccacgttttcctcag

SEQ ID NO: 43018 - DNA, 61 bp, Chlorella protothecoides
cgtctggcgcagctccgccacgctcgccaggccctgctcgaggacgggggtcaggcgagca

SEQ ID NO: 43019 - DNA, 72 bp, Chlorella protothecoides
cgccgctttggaaggggggggaggctgggtcaggaaggtagacggcgaggcgccccggcgccggcgggggca

SEQ ID NO: 43020 - DNA, 83 bp, Chlorella protothecoides
gggaccccaagtccagccctctccccctggctccactccctgccgaacatcctgctcaacgctcccttgcctgcgtcctcccc

SEQ ID NO: 43021 - DNA, 102 bp, Chlorella protothecoides
gcgcagcgtggccgccagcgccaggaggatccccgggacgaggaagcctgcctcgcacgcgtcggtccccatgcccgccaggcgggtctcggcccaggtcac

SEQ ID NO: 43022 - DNA, 450 bp, Chlorella protothecoides
  modified_base (158)..(291): a, c, t, g, unknown or other
cagctcggcggcgaggtcggcgtcctcggccgcgcgcgcagcccaggcgcgctccagcagcggggcctcctcctcgcgccgcgcgcgctccgcgtggtccagcgacttagccaggcgcgccaggcggcgcgccagctccgccgccgccttggcagccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgcgccccttggacgccaggaaggtcttcagctcctcctgctcccgctcctccatctcgcgctggatgcgctcggtctcgcgccgcgcgcgctcctgcgccttgcgccgctcctcggcctcgcgcgccgcggcctccgcggcggcgcgcacctcctcc

SEQ ID NO: 43023 - DNA, 61 bp, Chlorella protothecoides
aaaccgggaacgtccatgtgcggcgggagggggaataggagctgccagggagcctgcaggg

SEQ ID NO: 43024 - DNA, 61 bp, Chlorella protothecoides
tgggacccatggagcctggagttggggagggggggcctgttgctccacctccctgcaattc

SEQ ID NO: 43025 - DNA, 61 bp, Chlorella protothecoides
ggcatgcccaccaggcccggcgcggcggcgtgcggcggcgagcctgcctctgctccagtgg

SEQ ID NO: 43026 - DNA, 120 bp, Chlorella protothecoides
agaaaccctgggtgcgcccaggcatggtaacaggacaccatcccgcccttcgatccaaatcccaaatcccaaatcccccccccccctaacctcccggaccccaggctccagcggcgatct

SEQ ID NO: 43027 - DNA, 155 bp, Chlorella protothecoides
tcgggccctgcatggggaatgcatgtgcgttttggtagagaatactatgccaggaaggagtccatgcatggcggttctgagatgaaggatccggggggtgtcaaacttctgcctctccacgctctctcactctggcaagggcaggactctgagct

SEQ ID NO: 43028 - DNA, 80 bp, Chlorella protothecoides
agccagtatggtgcccgggatgaggggaaaccggtcttgaagggcacagtatgcatcttctcggcaccaaaccacgcaca

SEQ ID NO: 43029 - DNA, 853 bp, Chlorella protothecoides
  modified_base (123)..(199): a, c, t, g, unknown or other
  modified_base (592)..(654): a, c, t, g, unknown or other
ggcggcgcgccgaccggcccgtcgccgttggggacgctgggttctggcgcccccgacggccacgcgccgccggcaggcgggcagctgccgggcctgcaggacgtggcggggggggggcgcggnnnnnnnnnnnnnnnnnnnnnnnnnnnnnnnnnnnnnnnnnnnnnnnnnnnnnnnnnnnnnnnnnnnnnnnnnnnnngcttcgcgccgagttcgacgtgcgcggcgacggctggcgctgggggccctgggccctggactcggccaccgcggtgggcagctaccactccgaggagggcctgcacctgcaggaggtgggctgcttgggcgaaggagcgaggggagggggggaggggggtggagtaacggggaggtggaggttggtgatgggattggagagtggtagtgatgttgggggaggtcgcatcagtgagggcgggaatgagtgggcgatgcctgggtgggcgggcggccagagcaggaagaggaacaacgacgatgctaacccgccgcgtgcctcccacgggcgggcctgtggacgtctcgagcgtcgggatctcccagcaccatcgtccaaactcacccccccccnnnnnnnnnnnnnnnnnnnnnnnnnnnnnnnnnnnnnnnnnnnnnnnnnnnnnnnnnnnnnnntccccgactccaaaaccacgcgaccggcacagttcgcgctggcgctgggcgacgccaagctgctggtgcggggcgggctgcttggcgcggcgcaggacgcgagcctgctgctcaccgacttccccgtggccacgctgcgcccgctgttccgcggcgtgccggcgctgcgccacgccgtccccgccgcgccgcccgcacc

SEQ ID NO: 43030 - DNA, 67 bp, Chlorella protothecoides
atgctggattgtgatcaggctgggcatggcgttgggcatggaccacggtggccctgtgaagtgaagg

SEQ ID NO: 43031 - DNA, 104 bp, Chlorella protothecoides
gctggactgggaggtaggcaggggcgggaaggggcgccaggcaccccctgggcctcaccggtgccgtggggctatccccgagcaccatccagtccgccctgcac

SEQ ID NO: 43032 - DNA, 79 bp, Chlorella protothecoides
atgtggaaggttggagaatatgcacggggggatccgacgtgtgtgggatgcctggtacaggatgctcaagctcttgtgc

SEQ ID NO: 43033 - DNA, 61 bp, Chlorella protothecoides
gcgaggcccagcgcctgcgcattggcggggggttgatgggggacggaaaaggcgtggatct

SEQ ID NO: 43034 - DNA, 6835 bp, Chlorella protothecoides
  modified_base (320)..(329): a, c, t, g, unknown or other
  modified_base (638)..(647): a, c, t, g, unknown or other
  modified_base (2129)..(2138): a, c, t, g, unknown or other
  modified_base (2242)..(2251): a, c, t, g, unknown or other
  modified_base (2322)..(2331): a, c, t, g, unknown or other
  modified_base (2946)..(2955): a, c, t, g, unknown or other
  modified_base (3317)..(3326): a, c, t, g, unknown or other
  modified_base (3571)..(3580): a, c, t, g, unknown or other
  modified_base (3831)..(3983): a, c, t, g, unknown or other
  modified_base (4049)..(4058): a, c, t, g, unknown or other
  modified_base (4317)..(4326): a, c, t, g, unknown or other
  modified_base (4471)..(4480): a, c, t, g, unknown or other
  modified_base (4680)..(4689): a, c, t, g, unknown or other
  modified_base (4791)..(4800): a, c, t, g, unknown or other
  modified_base (5287)..(5296): a, c, t, g, unknown or other
  modified_base (5794)..(5803): a, c, t, g, unknown or other
cgcccccgcccccgcccccgccgacgtcttctcgggcctggccgccggagcacgcccagccttcccgcaggcgccgccgccagccaaggcgctgcccccacgcccctccagccggaacagcgactcggcggcgcacacgctgttcggccgctcctcctccctgtacgacctggacgcgccccaggccccccagcctgcgcccagcggcaacccctttgcttagcgcgcccagcgggcaacccttttgcttagcgcgccgaccttgtgagtgggcccatcgaaccctgtgtgacgtcctccctccccctgatccctgcccnnnnnnnnnncaatccctttgcttagtgcgccgaccttgtgaatagggctcgtcgagccccgtatgacgtcctccctccccctgatccctgccctgcgtggaatgcccgaggcccctccatcgaccctcaggtcccccatcgatgctgccggtaatgttcatcacttgcgtgtgggcagttgcgagcatcgcaagcgcctggccctcaccagttctcttcttctggtatcgtgccggggtggcaggcaggggcaggtcgcgggggcgattgggctcgggcagtcgatgagcttgcaggtttgtgtgcacaggggttgcnnnnnnnnnnagcagttgcgagcatcgtaagcacctggcgctcaccagttctcttcttctggaatcgtgccggggtggcaggcaggggcaggtcgcgggggaaattgggctcgggcagcccataagcttgcaggtttgtgtgcacaggggttgcttgatcttaaaaccatagtggcacccggccattgagtgaggggcccgtgccgtgcctgccctgccgtcaccggagttggaggagcgcctcgggcctcaccacaggttgccacgcctctgcctctaccaggcttaggcctgcatgtgtgggtgtaagggggtctgagcagggctttggtgggcatgcagggggtggggtggtggacgcaaagggatcgccgtgccgtcgaggctaccagttcccctctaccctggcagctccaccacggctgtgggctggcacctgggtcgtggtttgcttcaccctgcgcggcagtgaggcgctggccgaagccggacgtcagcagcgagtgccgcatggctgcgccaaggtctgacgcagtggctccattccggctcgggccgcctggcccggttcgagccgcctgcagggacagagtatgcccgtgccttcgtgaagcgaccagagaatgtcgctgcgtctcagccagtggagcgcggaatgctgctggcacccctggcacaagccacactctcatcgatgccctcccctctgagccacctgccaccccacctgcagcacttccagggcaaggggcaggctctcgcccacgtcgccctgacccagggtggccaggagggagccgcgggcccatgccgcccattcaccctttcctttcgggtccctgggcgccagccaggcggccacccagtcctcggcgccctcgtcgtcgcacagctcggcggcaaaggcggcgacccagggcagctccccgtaccgccgcgcgaggtcggcgaggcggcgcggtgcggcgcgcccagccccgcccctccccgcccgcgccagcagcgagcgcaccccgcccgggtcgtccgcgtagggcagcgcgcagcccgtgccctgcacccacacgtaccgccggcggtacagcgcgcgtagcgcggcgccggccagtctctgccggtggtaccgcgggccgtccacgcgcagctcggccacccgggagcccgccggcagcaggcccggggcaacgagggcgtgccgaggcggcgagatgcgccccccggcgccgccctttccacccagctgcgcgtccaggagctggagggtgggggtgcccagcgccgtggcgccggtgcccttctcttctccggccagcgtgagggtcaggggcacatagaccgggaccccagagcgcacgtccagcgcattcaggcagcgtggctcggcggccagcgcgtacaggtgccgcaacgcctgggatgagaagggattggaggggggagcaaaggactagtggatgcagagccgggggggggggggggggggggggggggnnnnnnnnnnaccggccagcgtgagggtcaggggcacgtagaccgggaccccggagcgcacgtccaacgcattcaggcagcgcggctcggcggccagcgcgtacaggtgccgcnnnnnnnnnngagcacgggcatcatgcccgccagccttcctcctgacagtccacacccggtgcccgagcaagcaaccaacnnnnnnnnnnaagcacgagcatcatgcccgccggccttcctcctgacagcccacacccggtgcccgagcaagcaaccaacacccccctcccctccaaacccctccaagacctggtgggaggcgcgctggtcctgactcgagagggggaatggcggcagcacagcgcagagcagagaggccacggccagcggtcgcgtgccaaaggtcagccgcccctggcccaggaaaaggaagcccagggccatgccgacggcggtgtgcgccccgtaggtcaggctggagctcggcgcgcgggtggggccggggggaagggcgttcgaaggggagtggggggcagagcgcagcgacagacctgcaatgtgcttgtggcggtggtggtgggtgcatgccaggtgaggcatggaggtgcatgcaggggtcagctaccccaggctgcaggcatgagtcttgtcagggtgatgcagcaggaggatgcatcattgatgtggagcgttagagtccctgcacctccgcttggctgcttggctggtgcggcgacgagtctcttgatgatacatgcacggggctcgcagggtagacccacccatttgctcttgagcacccaggagtccttggatctcatccnnnnnnnnnnggggtacatgcacggggctcgcagggtggacccacccattggctcctgagcacccaggagtccttggatctcatcccgccacacccctcacccctgaggaggcccagggtggccgagtgcccgctcccagccatgacgatagccaaagaaagcgcgagcacatccacggcctcctccacgtgcacgcgcccgagcgcccagccctggcgatcgggtttcagctccgggatggcggccttgaggcgcagcaggccctccagcctggagcgcaggaggcctgcggcagccgcgctgcagctgccggcgtggcgcaggccgacggcgaggcacgcgcccgcgatgcaggagatgtgtgcctgtcnnnnnnnnnnaaactcggttgaatgtgcgcgggagaatggtgggtgcgcgaatgggtgcagtagaacagttcaagccatgctggagtgctcgaagagtggctggacatattgctggatcatgtcacgagggccagttcctctcacacaaaagtggatgctgtgctcatgttctgtgaagagccatcgcacctctgcctgtcacccccccgcacccatcacgcatgacaggcacacatctcctgcatcgcgggcgnnnnnnnnnngtgcgtgatgggtgcggggggggggggtgacaggcagaggagcgatggctcttcacagtgcatgagcacagcatccacgtttgtgtgagaggaactggccctggtgacaggatgcagcaacatgtccagccactcttcgagcactccagcatggcttcaactgttccactgcacccattcgcgcacccagcattctcccgcgcacattcaccctaagttctgcgattccctcgtccaacacacctgacacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgtcgcactcaccacgatcaaagtccagcgcatgcctgcttgcaggcattcgcaacctccccagcnnnnnnnnnnacagcctccgcatcctccttcctgcgtcgggcggcccgccccacccccagcatcttgctggtgtcaaactgatggttgggaggcgcgagggtttgttgcaaggaatgcatacgacatgtcgcactcaccaccatcaaagtccagcgcatgactgcttgcaggcattcgcaatctccccagccacacctgcaagatgcgcggcaactgctgcatcacccagtcctcggcaggagtgatgccggaccacatgaccagggcnnnnnnnnnngtaagccagggccatgccatacaccatgagtagatcaccttgtgatgcttgcaatgcgccatgatctccccccctggctcgtgcaagcattccacttgcagctgaccagattccggatccactgacacaatgcgtcaccaatctnnnnnnnnnnggccacccgcagcaagaggtgctgcggtctcacaaagtccagctcgaacagcgactctgtggtgaggtttgggcgagtggatcagcgtcacccaagggtaagcattgaataggccagggccatgctatacaacatgagtagatcaccttgtgaagcttgcaatgcgtcttgatctccccccctggctcgtgcaagcattnnnnnnnnnntcaccgtcagcggcgaggcctgagccgcggcgatgtcggcggccacgcttccccccgcctggcgctgcgcgccgcctgcccggccctgcgccgccggcgccnnnnnnnnnngcggcgtcgtcggtctgcaggtgggccagtcccagcgccagggttgccgccgggcagctggtgcccagatccagcagacccccttccaccaccgtcagcggcgaggcctgcgccgcggcgatgtcggcggccacgctcccccccgcctggcgctgcgcaccgcctgcccggccctgcgccgccggcgccgagacttgggcctggaagaggtcgggggcgacgccgagctctgcgccgggcgcctggggcttgccaggcctgcgccggcccacggtgccttccctcatccccccaagcatcagccgactggcgtgaagggggaggtggatgggaaaggggtggaacggggggtgggcgcgggcggatgtgcatcgtctcgcacgcgaggctgcgctgcctgagagggcagcgaagcccattccgtcaaggacagacactcaccccccagctccacctcacgcacgcaagcatgcatgcgcaccagagnnnnnnnnnnaaggtggatgggaaaggggtggagctggggggcgggcggatgtgcatcatgtggcacgcgaggctgcgctgcctgagagggcagtgaagcccactccggcaagaacagacactcaccccccagctccaccccacgcacgcaagcatgcatgcgcaccagaggcgggtgtccaggtccagctcagcgtgaccaagcgcctgcgtgcccttgctcaggtggatgagtcccagggccaggccggccgccaggctgtatgcctctcggtcctgcggtcgaaagaaaggggggaaggggtttgtgggggatgaaacatcggagacgccctgcacacatgctagagcaggcctgactgcagagtgagccgcagacgctgttgcctcgagcagcgaacagacattaactcgtggtaggaatgattaagagctggatctcagaatcgacggtgatggcagacggcattgccgatgctcaaaggcagccacccagctccccggctcnnnnnnnnnntaaagggggaaagggggttgtgggggatgaaacatcggagacgccatgcacacatgctagagcaggcctgactgcaaagtgagccgcagacgctgttgccccgaacagcgaacggacattaacttgtggtaggaatgattgagaactggatctcagaatcgacagtgatggcagacggcattgtcgatactcaaaggcagccacccagctccccggctcacttgacacaggcaccagagcacccattcaccccctcacctcgctcctgcgctgggtgcgggggcgctcggcgccctctggctgggggccggccgcatccaccgcgcccatgggccgctccagctccgccatcaccacctctgacatcaccctgtcaggtcggggagggacggggagttgcagagcgatgcgctggggaaactgatgcagccactcgtggggcctgcgctcccagggcggtgcctcggctgctcatgccccgaccagctggccgttgccctcgcgatcgcaatccctcggctggtatggtatggaggcacaccccacccaccccacagcggcccccggcaccgcctgccacaccctgccacgcgcctgtggcaggagccaaggtgcaccaggcccaggccgatgagcgctgcgccctgcaccgaggccgggatctccaggtccgggtaggtgctggggtggcggctggggaggtggagcaggagcatcttggacaccgcagcgtcgcgcaggccgcgcctggaggcggccatgcccaggagcactgccaggatggtggcttcgtgcccctgggccaggtagcggtacaggtcggtggctgccaggcagcccaggtgccccgcgatgcccaggcccagcagcaggccggcatgggagtaggagggcgcgggcgggttgtggtaggccacccaggtgcggcccagggccccagccgggcccgcggcgggcacgaggctcagccccgccgccgcgccggcgtggaactcgggccacgccgtctccgcggccgcggcgccgcccccg

SEQ ID NO: 43035 - DNA, 64 bp, Chlorella protothecoides
ggaagtggaacgccaccggcccctgcgccacgccgccgccgctcgctcgtgcgccccgccctgc

SEQ ID NO: 43036 - DNA, 98 bp, Chlorella protothecoides
tgaaggccggcggcgcctgcatggacggcaccgcgtacgaccccgggtacatgccctggtactgctggaccgcggcgtggtacccgtcctcctgcttg

SEQ ID NO: 43037 - DNA, 69 bp, Chlorella protothecoides
gccagcttgggcgaggaagggtgggctcccggggcccagcggcggaccccaatccgcggctgctctgca

SEQ ID NO: 43038 - DNA, 70 bp, Chlorella protothecoides
gacgcgcagtcggtgtgatgcgagcgcaggagatgtgcggctgtttcctgctgagacgcaggggaggcgg

SEQ ID NO: 43039 - DNA, 71 bp, Chlorella protothecoides
ggagcgggggagcatgtcgcggccggtagtcgcccccccccaccgccccatgctcatgcactgactgcatg

SEQ ID NO: 43040 - DNA, 62 bp, Chlorella protothecoides
tcccctcaaccccactgctccactctccaaacccaatcagcgcccccccacccgccgcccac

SEQ ID NO: 43041 - DNA, 61 bp, Chlorella protothecoides
gcacgattttgtgccagagggcctggcaggggcagcgcccgtggaccccagcgtccaccta

SEQ ID NO: 43042 - DNA, 110 bp, Chlorella protothecoides
gtgctcagccccccgggtctggtgcgggcttcatccctccaagctggggcaaccaggatgacggcccgcggccactccccccgccacctcccccccaccccccccacctt

SEQ ID NO: 43043 - DNA, 61 bp, Chlorella protothecoides
agacagcccggtcaatcctgtcgaatggagggaaaaggggtgtggatggtcttcaacgagg

SEQ ID NO: 43044 - DNA, 61 bp, Chlorella protothecoides
caggaggaaccgccaccgggcccgccgccgacgccgccgccgccgcgctcatggtgggagc

SEQ ID NO: 43045 - DNA, 443 bp, Chlorella protothecoides
  modified_base (95)..(139): a, c, t, g, unknown or other
cggcgacgcctggtgcccaggctcacaagggtgcagcagggcgggcgtgggggaccgccaggtgctcgtcccgggtcgtacttgaggggccttcnnnnnnnnnnnnnnnnnnnnnnnnnnnnnnnnnnnnnnnnnnnnncccgtcccgggtcgtacttgaggggccttcggagccgcctctcccccacacatgcacggaaaagaaaggaaagaaagacaagcaaagctcacccgtggtcaggggtgcggtccatgtcatggagggcaggtccaggacgaggaggtcggccagcgcgcggcggtgtgcgtcctctccgccaaacacgtacaggccggtgcccagcaggctggcggagtggccgccgcgcggcgcgtgcagcgcgcgcgccggcgcctccggcgcggcctcggcctcggagtcagagcccgaggcggccgcgccg

SEQ ID NO: 43046 - DNA, 61 bp, Chlorella protothecoides
agcatggcatggccggaggagggcgcagggggttcacaaggtcccgatctgatgacaagtg

SEQ ID NO: 43047 - DNA, 61 bp, Chlorella protothecoides
attgcagggccatgctggtcaagggcgggggggctccatcggacactccttgtgagccacc

SEQ ID NO: 43048 - DNA, 78 bp, Chlorella protothecoides
cctctccatcccctccaccccccctccctcacccaataataaaacaacactgtgaaggtctcaccgcatcgggcagaa

SEQ ID NO: 43049 - DNA, 61 bp, Chlorella protothecoides
ggtgggagacagaagaggcggccaggcatgcgggcagggagggcacaagcggacgcaaagt

SEQ ID NO: 43050 - DNA, 72 bp, Chlorella protothecoides
aggtgggtcgtccgtgtgccgagcgggtgcttatccgccccacgtcgccactccctccctcgaccaggccag

SEQ ID NO: 43051 - DNA, 13719 bp, Chlorella protothecoides
  modified_base (1173)..(1182): a, c, t, g, unknown or other
  modified_base (1479)..(1488): a, c, t, g, unknown or other
  modified_base (1627)..(1636): a, c, t, g, unknown or other
  modified_base (2125)..(2134): a, c, t, g, unknown or other
  modified_base (2383)..(2392): a, c, t, g, unknown or other
  modified_base (3029)..(3038): a, c, t, g, unknown or other
  modified_base (3809)..(3818): a, c, t, g, unknown or other
  modified_base (3892)..(4008): a, c, t, g, unknown or other
  modified_base (4091)..(4236): a, c, t, g, unknown or other
  modified_base (4338)..(4347): a, c, t, g, unknown or other
  modified_base (4449)..(4458): a, c, t, g, unknown or other
  modified_base (4728)..(4786): a, c, t, g, unknown or other
  modified_base (6395)..(6444): a, c, t, g, unknown or other
  modified_base (6606)..(6615): a, c, t, g, unknown or other
  modified_base (6682)..(6691): a, c, t, g, unknown or other
  modified_base (6758)..(6767): a, c, t, g, unknown or other
  modified_base (7061)..(7070): a, c, t, g, unknown or other
  modified_base (7630)..(7639): a, c, t, g, unknown or other
  modified_base (8348)..(8357): a, c, t, g, unknown or other
  modified_base (9039)..(9048): a, c, t, g, unknown or other
  modified_base (9262)..(9271): a, c, t, g, unknown or other
  modified_base (9899)..(9908): a, c, t, g, unknown or other
  modified_base (11043)..(11107): a, c, t, g, unknown or other
  modified_base (11565)..(11574): a, c, t, g, unknown or other
  modified_base (12190)..(12199): a, c, t, g, unknown or other
  modified_base (12412)..(12421): a, c, t, g, unknown or other
  modified_base (12604)..(12613): a, c, t, g, unknown or other
  modified_base (12866)..(13016): a, c, t, g, unknown or other
gccggcgccgtccggccccgaggcggcgagcccgccggggtcgtcctgcgccagcccccgcggccccgacccccgacccacggcggcggaggagggctgctcggaggccggcaagtccgcctccagcagcctgtgcacccaggagacggaggtggcgccgcgggccagtgcgctggacggcctggtggcggcgctgatggggcccatccctgtggcggccccgtgctgagtctgtgcgtcacggagcagcccgaggcaggcgggcttgcactctgccctgccgctccgaggcagtcgcatgctaggtatcgtaatcacaggaggggcctagcagtgcgaggccttcttccccagcaaaccccattcctcatcaagcacctgcaccccattgcccgccgctatttttgggctccccctcttgaccagcccgcaaggtctggacctgggcgctttgttgcagcttggtacagcccctactactcacccatcacccctggagtggagcacgcgccttcctatccctcctttttgagatcatgccccccgccccttttcctgatgaagaatcctgatttgcacggctgtctgcatcaatatgtacgcttccatactcctccttcaacagttttgttacagctccacacagcctgccagggtacagcgtggggtccagggggttgcggcgctgctggagaggtgcagagaggtgcaggtgggaagcacggaccttggagcagggtgcaggggagcagtggtcaagcacagcgcggtggtcatcgggcccgagacccccctgtcctggacagggcgatggcggccttgtaggccggggcggtgggcggctggaccggctgcagtggggtgtaccccgctgccccctggctggggaggtcgtaggaccggtcggcgtcccagccagacaggtccccgcacgccatgaagggcaccagctgccgtaccgccaagctgcgcatggcgggtgtgatatgggaggatgtgatatggtgaggggttccagggagtgggcccgagcatggtttgagctgcggtcgtccagaacacactttgttgagtggagcctgcaatggcggatctccctgagaccgccgttccccctgcctcacctgtccccggccgcctcatactcggccgctcccgcctccagcagcgccnnnnnnnnnntcatcaatggcgcacctccctgagaccgccgttcccccggcctcacctgtccccggccgcctcgtactcggccgctcccgcctccagcagcgcctggaggcaggtggggtcaaaccccgggggcggcgcgaagtcgcggcacaccacaaacgcctctgttgtgtgcgaacgaatcaattgggggtggatgcaggggtgttaagaatggtctgcgcacacaggcagggctgggccgccagggtgtgcagtccaccatgccgtgctttccttcagggcgtgggcgcacccacccggccnnnnnnnnnncagtgtgcggatgaatcaatggggggtgggtgcaggggtgtcaagaatggtctgcgcacacaggcagggctgggccgcgagggtgtgcagtccaccatgtcatgctccccttcagggcgtgggcgcacccacccggccnnnnnnnnnncccaaccccatcccccccccgacaccaccagcccgcgccacccaccgatgctggagtttcgggagctgcgcggcttggccacctccacgccccggaacaggcagcgcagctgcgcggtgagcagggctgcgtcccgcccgcggaagatcttggccacgaagccgccgccgggctgcagcaccgcggcggcgatggccagcgcggccagcagcagctgcccctgcacgtactcgtccaggtcgtgcaggcccgtgacgtcgggcgcgccgtcgcagaccaccagctgtgctggtcggccctcgaaggcggccaccacgccggccgccgtggccgccgaggtgatgtcgccctggagctgtgtgaccccggcaatgggggccatgggctgcaggtcgatggccacgatcacgggggggggtgtggagccggccctggtgggtgcatggggtgtgggggtgagggtaagggtggaggggtcgaggtgtagannnnnnnnnnggtggagccggccctggcgggtgcatgggggtgtggagtaaagggtaagggtggaggggtcgaggtgtagagaggggggtggtttggaacgctgtcgggttgaggactcagttctgaggggagcggccataaagattgctccgtctgcacaggaaggcatccctagggggccagggccctcagtttgagcatggtctgcaggtcgttctcatcaaataagaccaaggactcacttgacggcggggaggnnnnnnnnnnaccctcagtttgagcatggtctgcaggtcattctcattaaatgagaccaaggactcacttgacggcggggaggtagagcctccggctcagcacctgactccagctccccggggccgcacagagatcaaccacgcggtccacgcctgtggattgcagcaatggtgacacattgtaggttcagccaccagggatgggaggcgcccccagatcttccctgggaatgcagcgcaggcccttcccagtagtgccggccactacttgagaacgcctgccgcaccatccagaaagtggtagacgtcgtccagctgcaggagcttgtaggcgctacgtgctcgccacccctcctccttggccttgcggtagtagatgtcgcgcttgtccttggacgccttgcccatggtcagggcgcgcagagcaagggggagacctgatagatgctccaagccgaggtgcacctatattccaaccattaagtacgactcttttagtttcaaataatccacttcatcaaaattccagcgtgcaaccattgcatgctggacattttgcactccgggctcggtagggtacatttgggcgcgaggtcgacatcagcaacatgagttggggcatggggcaccgagcgatggtgaagctnnnnnnnnnncagcgtacatttgggcgcgaggtggacattcgcaacatgagttagggcatggggcaccgagcgatggtgaagctcacatgcgcaagaatttgggaatttatcggtagctatattctttctagtccttaccccataggcttgcattcgtttgtacctccctgagcccttacttacctggggcgtccggctggtggaccgtgtatttgcgagctctgtagaacgtgcgactgacacattcccgcgacccatcggaggtcaaggggagatcgtctacttgtggtcgaaggcacaatggctccaatggaggagctctccttcgaggactttcctggcacgacactcagggtctggctgttcaccaatgtcacaaacagcaagtgagatgctgacaggaggtgacgtgaaggcacgcactgccaaaatccaatccaacacctgcatgccacccatgcacggctcagggacgtccaggcggccatggtggaaggcacactcgagtacgaagccgccatcatgaatgcagccgtcgtgccttccctgtttgcggtgcacctcgccgcgcatcacgccttgctttctaagcagcgggggagtcttcggaccaggtccttgcactctgagctggtgtgcaacctgtcaggctccaagcacgtgagtcctgcactgggggaggggagggttgggttctcagtgcgtgtctgcatgtgtaattcgcttgcagggctgatgggggagcgtgcaaccgcagcgctcacggctgtgttggggctnnnnnnnnnnatgcatatgtaattcgctttcagggctgatgggggagcgtgcaaaccgcagcgctcacggctgtgttggggctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgaggcctcccagcatctcctggttgccagtttcgatgccaggatcggcatagaggaccaactcatgtcgctggtacaaggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgtcggattgctgtttgtcaaacttatgccacatttccctcttgctgccacctctcctggctgtgtcacgtcaaggtctggactggcattcccagacacannnnnnnnnngtgtgggattgctgtttgtcagacttacgccacatttcctgcttgctgccacctctcctggctgtgtcacatcaaggtctggactggcattcccagacacannnnnnnnnngcagcgtcagacagcagctcatatcggcattatgcatgccccatccccagattgcagagtctctccagcggtttggtgtgacggaggcctcccagcatctcctggttgccattttcgatgctaggatcggcattgaggaccaactcatgtcgctggtacaaggagaatgccagcacagcaaggaggctcttggtagcataacagacatgggcctgctcaaaaaggtgcggcggtatttgccaatcagtgactgggctcggttgagaaatnnnnnnnnnnnnnnnnnnnnnnnnnnnnnnnnnnnnnnnnnnnnnnnnnnnnnnnnnnnaacctcctcctaccctcctgtagtatttcaagtgttcagatgccgagttggcaatgagtagcctggaagacatcatcacctgccagatggctgccagggatctctgatggtctgcaaactgagcagtggcccagccggcccacttgctctcatttcacattcacccatttcctttgactgcttgtgcctcacggaactgcaacaaagtcttgaaacaggctcacagtacatctcaagggtgattggatgaggcaacttggacgttacttgtcgtccaagtctgcgaggtgtgtttggtggaagctttttcgtactgaaggctcactgaagggtttccgcagcgcagcgacgtcgtgcttggccagtcaagaggcaggaacgcgagaatttcggagcatagattattgctcctccaaatgtcctagattataacggcttcacaggtcactcgtgattgggaatcacaggtcgtccaggcaggagggaccgcgaccaaaacatgcgtggcttgctacaggccgtgcgacgatgcctgcagcgcggcgcattgggagaatcacagcccttgaactctttgaaagaagctcagggtgtctttcagtggccacgaaggttagatgcagttcagggctccggtccctggcggcagaggcccaggtccggtgatcgcgggtttgcctccttcctgcagttccctgcccggccaggccgccgggatctggacccagatcgagtaatgtacggcctcctcgccgcaaatgtggggggatgggtgctgtggcgcaccaacccagcattcatgaggtgcgtcgggcgctgtgggcccccggtgagaaccctgaatgttgtgggctggcccacaggggagcaccgtgagctgctcaggacacccatgccgctcacctggctccacctcctctcttctcacgcgccgcagcaagaatgcgatggtgtccattccacacctgaagcgcgggagggtttggaccctgctgacccacagcttcagccacagggacacctggcacctggcctccaacggcctgggactctatggctttgggctggtgagtcctcgcgcagtgcctgtgtgccaagtgtgctggccagatctcctgctgatggctgcctcctctcatgaccacctttgggtcacatggtcccacatggccccctctcccaacagaccctcggccgcctctttggaggcaggaaggtgcgggggcctttgttgagtcgcaacagctcctggctccatgcgtagggacaccaggcttcccagatgtacattgctcgactcttgcctgccctgtccagctcccataagctctgctgctcgctgcacacagcgtccaccctacaccacccaccccctcccccggacccagttggccatgatctacgccggctgcgccctgggcggaggcctgggacactgcctgtcccaggccgccgggcctctgtgggcgcggcgggatgcctggggccggctgccgctgggcacggggcaggttcccgccctgggcgccagcggtgtggtggcgggcatgctggccatgaccgtgtacctggcgccctcgcagaaggtcctgctgtacggtgaggaggnnnnnnnnnnnnnnnnnnnnnnnnnnnnnnnnnnnnnnnnnnnnnnnnnnctcggccatgtccggctctgagaatgattggagcagcagggcaccagcttgcacctatgccctgaacctcaggcttgcaggcatgcccgcactccaccaatccacaccctctctgagtataccctcccctttcaggcatcatccctctgccaatgtacgccnnnnnnnnnngggggtgtggcatgttgtcgaccagcaaggactgcatgttgccaggcatttggaggagccgtctgcnnnnnnnnnnaggggtgtggcatgtcgttgaccagcaaggactgcgtgttgccaggcatttggaggagccgtctgcnnnnnnnnnntttggcctgctctgggccggactggacctgctgacgctgcggaatccgggcagcaacgtgtcggtaggaggccatgcaggcggcgctctggcggggctggccttcctcctggcctaccgacgcggcaggttccccatgcgctggggctggtgagcaggcgcccgggctgcgctctggccttgtttgcccgatgaattgtaaccaacaatgactgaatagcggcgaagaagccatcaaggcattctgccccaagtacagcaggtcatgcatgagaatcgcatggcatgacctgcnnnnnnnnnnagcgaagaagccatcaaagcattctgctccaagtacagcaggtcatgcatgacaatcgcatggcatgacctgccaggtggcatgtatgagaatcgcatggcatgacctgccaggtggcatgtaaggccacgagatgggccctggcggcagagcccttggtgcccatgctcccgtgcatggtatagcatcacgcttgcactccagcatctgtgagcagcatgcatggggcgccagcatgggagggagcctgcatcgagcctgctggcgagatcagtggaaccgccggccgcctggccccaggatgtcaggaggggtcctgatgcacccctctccccaagggtcttgcggctgtccaggttggaaggagtctcacatcctcctgcctgcaggaacccacgttgtcgctgcgccgctgctgtcttccctgtgacgcgccctcactgccattcctgcctgccgcagagggtgagctgctacaggaccggcaggcaccctggcttcgtatcgctcgagccccctgccccattgatcatccaccgtctggacctcctgcagccgcnnnnnnnnnncgtcgctgcgccactgctgtcttccctgtgacgcgccctccctgccgttcctgcctgccgccgagggtgagctgccacaggaccggcgggcaccctggcttcctatcgctcgagccccctgccccatcggtcatccaccgtctggacctcctgcagccgccagcctcagcgccatgcaaacctcctgcagccgccagcctcaccgccagcctcaccgccgcctggccctcccgccgccggcctgggggaggttccctgtcttggaggtgacgactggccctggtcccccccgctccaggcaggcgagcgcaaagtcggacaccgccgcggcgtattcgtccgggaagcggcggtagtgctgcacgtgaccggacccatggaacttgaccacccgcgtgaggatgtcggagtgtgcgacgtccctcaggatctgcgtctccacgtcctcggccgggatgatgtcgtcctcctcgctgtacgcatacatgcgccccacccggtccgggatggtgcgccaaccgccgagcgcctgcacgagggttcaggcgcggacgagggttcatcggcaggcatcgcggcaccgcagctgggggaggctcggtggcgcagatgagcttcactggcagagctggggaggtgccagcggtgggggagggggcgtgtgaggttcatccactgagcctccatgatccccgagtcccacctctgnnnnnnnnnncgaggtgccagcggtgggggagggggggtgtgaggttcatctactaagcctccatgatccccgagtcccacctctgcaaggaagtcgtggtagggtcccgaggccaactgctccaccatcctccgcctgtaaaaggcacggaagatcgccaggctcaccgagctcagcgggttgccgcgcagtgctgcctccacgcccctgggatggattgtggcggccatgcacgggctcttgtgggtacaccagcctgccaggctgagtggccaggcactagaaagctctctgtcagcaggagttgccctccctgcactcacatcagccgtctcccttgccctggggctcgggtcaccctccaggcgccgtcgagaaacatgtgtggattcccgcatcgccgcccctcccactcgcccacactcggcaagcagaccccatccacacccacctgatccacacgtctggggtgagagccgagggcgccgagtccacgatgatcccccttgtgggtgacatgatgcgctggaatgcggccaggccctggagctggcgctgggagaagcggtcgcgcgggtgggtgacgtgcgtgacggggaagccggcggcccaggccaggcggcccaccatgccgccgtaggcaaggtaccccgcgttggacagcgtgtgcacgaagacggggggccgtccnnnnnnnnnncgctcgtggaaaggggggatcacatcccaggtgttgacccggatcatgtggggctccgcgcccaacacccgccacatgttggcgtacttgctgcgcgtttgtgggggaaaggagcggcgctcggcggcgcagagagaccagggactggcgggggttgccgcacccctcagggaggccaggtcatcaatgggggagggcatggacgtgccaatgnnnnnnnnnncgccccaccctcagggaggccaggtcgtcaatgggggagggcatggacgtgccaatgagtgatgacaccagacaaagacgaatgaaccgcgctccccagctcacttgaggtgcgcctcccggcatcccagccagccatacaggaggacaaagggcttcaggcctgggaagggccccttggtgaggacctgtgcctgcgccattgcccaccgccgacgcaggcctcgagggtgagatggggcaacattcgaggttgagtgatcacgaatctgcagcgctgggtcacggatgcgtcatcccatatggtcttcatcggggcagaggccgggagtcgtgctgtgggccgagggcagcatgccgaaattacgaaccgcatttcggggcagatggggacaaacgcgcccaacccgtcctgtaccggcgggttcaaggacagcggatgcgatctcgacagctgagcgtacatctcatgcacggctcttgcaccgagacacccgcctgcactggtggctggcggtagccggacccccgcgaggtcgatccctctgggcccacgggggtgggacatgacagccgcggtgccgatccctggagcacatcgaatgtcgatgcatgtgtttcccggcgtnnnnnnnnnngcgagggtgggacatgacagccgcgatgccgatccctggagcacctcgaatgtcgatgcatgtgtttcccggcgtttggaggctctgggcctccctccctgcgacagcacgcgccttcctcctgctcaccgcggtacaggccttcctggccggcatcttcgccgcgacgcaggtcgggtttcactggcgggcctgcgtcatgccatgcgactttaaccctagtacgacggccaaacgcccggaccatgcaccgtccggggccacccaggcccgcccttcacccatgccctcaaccacccctgccccccgcagatcggcacctccctgcaggacaccctgctcatcctcgccacctccctgtccctgtggtggctcagcctcgactccctgctgcgcgcctgcgcgcaccagctccccgcctgcgccgtgctgggcacgctgggcgtcgccgagatggtggcttttgccgtcgctcacggagccgacagcccgggccccaccgccgtcgccgcgctgtgtgccgcgctgcagcttgccgccctggccctgtgccgcaccgcctaccgccaagtgggctggcgctgggcgggcaggatgccgggcgacggccgcctgcgcggcacggagctgaggaagcgggcggcactgtgcaggtcgcgcctgggcgcggccgcccgcttcgacgccgtggtgaggggctgggtggtggtgttggaattgcgcacgtggcagccagccgccgggttgtttggtgcgggtgcacagggcgctcgagggcagggccggttcacggcactgaggtggctggaacccatcccagagaccacctccccataagagtgtccaacccacccatgaccccctccaccccctccacccatccctcgccaaggtcctggccatcctgagcgttgtgatggtgaccgagggcgcgcccctggccggctcgggcgccggggtcgcgctgctggtgggcggcgcgctgggcggcgccctgctggcgacctggaatgcggcggccacgctgggcgcgctgcgccgccacgcacgcctcgccctggccgccgactttgccttcccgctttcctacggcccgcccgtgatcggactgggcgtggtggtggcggggggggcnnnnnnnnnnnnnnnnnnnnnnnnnnnnnnnnnnnnnnnnnnnnnnnnnnnnnnnnnnnnnnnnngcctggcggtggcctgcgtggtcttcctggccgcgcgcgcgacgctctggtgggccgtcaggctgacatggcgctcgacgcgtgcgctgcgcgccgagggggttgaggacgccccgcgcgcgccgcacccgcctccggccctgcttccgctgatggacggcgagtggatggtgcgttgagagggtgtgaggtgtgaggtggggtgggggccgggaaggggacgaggtggcctcaagggccaggagaatcttttccttgggtatgggggatgcgccagtctgtgggcaaagacccaccacagtggtcggcatcgccaccagaggccgttggggcctggcaccagtacacccaagcggccactgcatctccctttggaggttgtcggtccagcctcatccgtttcgttcccccttttcccctgaaactgaaatccattgcaggagaaggagtcgcggcgnnnnnnnnnntggtatgggggatgcgccagtctatgggcaaagacccaccacagtgctcggcatcgccacaagaggccgtcggagcctggcaccagtacatacaagcggccattgcatctccctttcgaggttgtcggtccagcctaatccgctccattcccccctttcccctaaaactaaaatccattgcaggagaaggagtcgcggcgcaggcccggcctcaccacctccgtcttcatgcagctgtcggaggacggatcgacgctgcgctggggctggagcagcagcgtgctgctgtaccacgtggagagcgtgcgcgccgacgacccggcgcgcagcctcaccctgacctttgcgctgggcgccccgctgacgctgcgcctgggcggcgcggccgcctacgtggcctggcggaccggtctggcggagctcctgccccgcctggccgcgcacgccgacctgctcactggggacgacgccgaggcgggcggcacgggtgcggcgggaggggtcaggggaaggggtcggggggatgccacgaggcgttttgggggcggtatgaggggcgcgtcgcagaggaacggggcagagtcgtggggcgagggctggacgaggcagcggtggnnnnnnnnnntgggggggatgccacgaggcgcttggggggcggtatgaggggcgcgtcgcaaaggaacggggcagagtcatggggcgagggctggacgaggcagcggtggcctgtcccggccccacccgcagctgaccgtggcaccgcccttgcccagcgcagggccccatttgccagctcagacgccgccacccttcctcccctcgaccagagtctgccggnnnnnnnnnnggcacacggccccgtttgccagctcagacgccgccgcccttcctcccctcgaccagagtctgccggcgtgcagaagcacaggctgtccatcaaacgcgaatcctccgagctggtaggctggtggatggaatgaccgaggttgtcgtgtgtcggacgtgatgtgccaccacgctgcacctgccnnnnnnnnnncgtcgatcaaacccgaatcctccgagctggtaggctggtagatggaatgaccgaggttgtcgtgtgtcagacgtgatgtgccaccacgctgcacctgccggtgggtgcatcgtgggccaccccccgctcggccacgggaacactcctggtcgccgccgctcgacgctcgggccagggcccgtcccggccatcccactcgggccccccctcaccctccctgcgcattgtcacaggagggctgcatcaacatccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtggtggccttcgaggggcggtgggtggctggggcaggggcaggggggggcattccgctggcgtcacatggtggaagcctgggagcgggcatgggcctggcggggaaggaacatgaggggggctggcgtcggtgccgagcctggccacctcagtgcctgccgaggccgggcgggggtgcacgctcggtgccacacgggagccaaggtcgtacgccaggcctcgggctcgacgctgtgcggcgctctcgacggctggcaaccctcgcatgatcgcccctccccgctcccgcaaccccatctcacatgcgctctgggccccagccctgaccctccccctgtgttccccacccacccaggaggcgcggggctgggcgctgccggcgtggatgcgcggcgtgggctacctggcctcggggacggtgcccgggggcggggccaagcgtcggtccagccccaccaagcagccgctggtgggcggcacctccctcagctcgcagagcagtgtggggccgcgggacgaccccgagctgggcgccggcgcctgggagggcggccgcgggcgaggcctggaggcggtcctgggccaccccggcctgcaccggcgggggggggcgtccagcgcggccggcagcacccccacctcggaggtgggggcgccctccctggccgccgcttgggccgtggcgtcggggggcggcggcg

SEQ ID NO: 43052 - DNA, 61 bp, Chlorella protothecoides
agaccctccctccacccgctgcccgcgcctccctcgcacccaacaaaccaaagcccacctc

SEQ ID NO: 43053 - DNA, 70 bp, Chlorella protothecoides
ttttcggggatacatccttcccaacattaactggcccccgccccgtccacaccaacaccacccactcgcc

SEQ ID NO: 43054 - DNA, 71 bp, Chlorella protothecoides
aggtctgcccgccatgccattgaacctccagcctccgcccagcagatgcatggtgtgcatctgcagtgaga

SEQ ID NO: 43055 - DNA, 67 bp, Chlorella protothecoides
acagccccatggcatcaagggtggaggtgcagatggacccgccttgctgaagcccttgtgcctttaa

SEQ ID NO: 43056 - DNA, 75 bp, Chlorella protothecoides
ctgtggggtcctgggcaacagaccagtcagtcaggggggggaggagggggggggtcagccgctcagtcactcgtc

SEQ ID NO: 43057 - DNA, 171 bp, Chlorella protothecoides
gggtgcgtcaccattgcaacaggcgtcgctgagcggtggcgggagtggaccccaaagcaagcatgctcctgttccgaatctgcgaccaagatcggtccaggccccgagccacacacaactcctcccacgcccccctcccaccctcccgtgcatcaccgtgcgatctgggag

SEQ ID NO: 43058 - DNA, 61 bp, Chlorella protothecoides
aggtatcggtgcacggatactctgcggggggggcaaccccatcattgtagagtgatcccgc

SEQ ID NO: 43059 - DNA, 200 bp, Chlorella protothecoides
gccgtcgcagtacacccaggctgccatgggtgcagggagggcgagggcttgacagccagggcggcaatggttggacagtgcacctccaggatggggctgccccgcccgatcccatgctgccacgcccctcctcccgctcaccattgcacacggtctcctggtgatccccgctgggctggtactgcaggcatgctgagcaa

SEQ ID NO: 43060 - DNA, 61 bp, Chlorella protothecoides
cagctgcttggccaccgtgcagctgggcccgtactggcactcgcgctccggcacctggcac

SEQ ID NO: 43061 - DNA, 67 bp, Chlorella protothecoides
ctgccctgtacatttcccactcaaccctcagccagcgaccccccctttctccctcccccgcagagct

SEQ ID NO: 43062 - DNA, 2486 bp, Chlorella protothecoides
  modified_base (1837)..(1846): a, c, t, g, unknown or other
cacccccccacccccccaaaaagccctccaccccctttcccacacacgcaaacacaggggccacgcgtcggagatgccggagctgcctgacgcactggacgcgactccgacctgcatccgcttcatcggcccgccctccggcccgatggcggcgctgggggacaaggtggggtccaccatcctggcccaggcggcgggcgtgcccaccctggcctggtccgggtccggggtcagcatcgcctaccgcgactgccccggcggcgagatcccggcggccacctacgcggcggcctgcgtgtccgggttggacgccgcgctggcctcctgcgaggccatcggctaccccgccatgctcaaggcgtcgtggggcgggggcggcaagggcatccgccgcgtgctgaacgcggaggacgtgcgcgccgccttcccccaggtgcagggcgaggtgcctgggtcgccggtgttcgccatgcgcctggcgccccagagccggcacctggaggtgcagctgctggcggaccggcacggggctgtggcctccctcttctcccgcgactgctccgtccagcgccggcaccagaagatcgtggaggagggccccgtcaccgccgccccggccgccgtgctggaggacatggaggcgcgggcgcgcgcgctggcgcgcgccgtgggctacgtcggcgcggccaccgtggagtacctgtacctggtggagagcggggagtacgccttcctggagctgaacccgcggctgcaggttgagcaccccgtgacggagtggatcgccggggtcaacatccccgccgcccagctgctcatcgcggcgggggtgcccctgcaccgcctccccgacctgcgcacgctgtacggcgccgaccccgcgggggactcgcccatcgacttcgagggccccggccgccgcccgcccgcgggccacgtcgtggcggtccgcatcacggccgagaacgcgcacgacggcttcaagcccaccgcgggcgcgatcgacgaggtgtccttccgctccacgcccgacgtctggggctacttctcggtcaaggccgggtcggcggtgcacgagtttgccgactcccagttcggccacctgttcgcgcgcggggattgccgggaggccgccatccgcgccatggtggtggcgctgaaggaggtcaagatccggggcgagatccacacccccgtggactacgtggccgacatgatccagagccccgacttcctaggcaacatgcaccacacgggctggctggacgcccgcatcgcggcccaggtccgcgcccagcgcccgccctggcacctggtggtggcggcgggggcggtgctgcgcgccacgcagcgcgtcgccgcgcgcgccgccgagttcctggccttcctgcagaaaggccagctgccgccggaccgcgtttccctcatccacctgacggaggagtttgtggtggacggcgtcaagtacgcggtggacgtgcggcggcgcgggccgcaggcctaccgcctgacgctgggcggcgtgggcgtggacgccaccgcgcgcacgctcaaggacggcggcctgctgctgcagctggacgggcaggcccacgtgctgcacgcggaggaggaggccctgggcacacgcatcaccgtagggtcccagacctgcctgctcagcaacgagcacgaccccagccaggtgggtaggtggggggggggacaggagggggggtgcggtgggcaaacccaaccgccctggaccaaggcactgaaagcctgtctaccgcttggtgacgcaagcctccccccaccctccccacaacgtcccgacagctgatggcggtgagcacgnnnnnnnnnnctgtctgccgcttggtgacgcaagcctccccccctcccctccccacgacgtcccgacagctgatggcggtgagcacggggaagctggtgcggcacctggtggaggacgggcagcacgtggcgtcggacgcaccgtacgcggaggtggaggtgatgaagatgatgatgacgctgctggcccccgcggcggggttggtggcctgggaggcgcccgagggcgccaccctggccccgggcctcctgctcgcgcgcctgacgctggacgacccgggcgcggtgcggcgcgcggtgccctgcgcgctgcccttccccgagctgggcccgcccagccccgactacgacggcctggtggcgcgctgcgcggcggcgttggaggccgccgagaacgtgctggcagggtacgacgccgacgtgcccgccgtggtgtcggcgctcctggccgcgctggacgaccccgcgctggccctggtgcagtgggaggcggcctacggcgtggtggccccgcgcctgccggccccgcttgcggcccgcctggacgcgctgctggccgagggtctggccgagctggcgggggcctcgccgcgcgtgggcgtcgcggctgagcagatggtggtggtgcccggggtcggcgccggggtcgg

SEQ ID NO: 43063 - DNA, 80 bp, Chlorella protothecoides
gcagggtcccagactcggcaccctcccgcgggccaccctcctcctccgacctccgccagctccggggcgtgggtcgcacc

SEQ ID NO: 43064 - DNA, 89 bp, Chlorella protothecoides
ggcaggggaggatgcaggaaggactgcgccaccgcccttggtgctgcgcgccgcatccgccgcagtgacatgtgcgtcgtgggctcccg

SEQ ID NO: 43065 - DNA, 76 bp, Chlorella protothecoides
gcctgcctggcaccgcgagagctggcgctcgggccatcgagcttcgtgcaagactcctcaccgcaactcacctttt

SEQ ID NO: 43066 - DNA, 76 bp, Chlorella protothecoides
ccggcagcagtactgcggaattgttcgtgctggaggcatgctatgtggaggttgtgccaagctcggcggctgcctc

SEQ ID NO: 43067 - DNA, 61 bp, Chlorella protothecoides
aatgcgcgcatgcgctgagacgttgagaggggcgacgccaatcccgtgcatgaagttcgcg

SEQ ID NO: 43068 - DNA, 61 bp, Chlorella protothecoides
gccgatgacgacccctgtgccgtggtccagtagcacccccgccccgatgcgcgcggcgggg

SEQ ID NO: 43069 - DNA, 76 bp, Chlorella protothecoides
gacgccacggtgaacgagtggcggaaggcgatcggcgaggcgggctcgctaggccgattcgggaaggtgtgtgagg

SEQ ID NO: 43070 - DNA, 4057 bp, Chlorella protothecoides
  modified_base (3713)..(3745): a, c, t, g, unknown or other
cccccccccggggcgaccaaccaaggaaagcccacctgcacgtcctggttcagcgccaggtaatagcggtccacacccatggtgttctgccagaccaggttggcggcggcgcagaagatgaccagcaccagctggaaggcgatgaccagcccgatctggaggttgaggaagcggtcgaaggagccgaccttgttgggcgtgcgcgccgcgttcatctggattcgcgactcccgccccgtgtacaccaccaggcccaggatggagccggagttcttcagcatgcagccgcgcagcagcatctcgttcatggtcacggggacgttcacgtgcggctcctcccctgttgcgcgttggtgtgtgggtggggtaaaagggggcaggcgagtggactcccgtgcaggcaggacatccatgctgcgaccaacgctcacaacacccctgctggcaaagagctggctcgacatccaagccgcacgagcttgccagtctggcgcagcgactgcatggaagagcctgtgcaacatccccctcccaacagggcgcacgatgactagaccctgaagctcccaacccatgcacagaccacactgtcacccaccagcggccgtgccgttcccgctccacaccatcttgtccgagccggggctcaggggggtacgtgcaaactgctcgctcaggattgtggcctgtcccttgaagcggtgcaggttgcggttgggggcctcggcagacagcctgatgcgcaggcgcatggcctcctgcaccgagctggcctgtgacaggggttgtgcattgtggaatggggtgagtgtcttgccgcagggctcacccagaaggaagcttgagtgccgcttcgctgggaagagcaccagacaggtcccagctgcacccatcatgcacccctggagaatgccccagacgcttcatccctcccgctcggaatcagccgcaacttcccgaccaggcaggccacgtccagacccgagggaaccacatcctccgcaacgagacacccgcccacctggatgcccttgaggtcgatgggctttcggatcttcaggttggtctccccgtccaggttggtggtccggatgaagcagacgcggtcggggagctgggactgcaggcacaccatatcggcggggaagagctcgtcgtcccgcaccaccagcgcatcccccaccttgacctcggtccaggagatgtcggtgatgctccctgaggtggtgggaggggtgtgagggtgaaagggaggacaacattcatgttgacagacagcaggcacacaccacaatgccagacccatgaccagggcaccgctctgatgctcgacggccggctgcatcccacggcagaaccttgcaccgacacagatcccccctcccccccagccacaccacgccgaccacaccgtcggggttggcgcggtgggtggtggaggcgttcatggtcttgtcctcctgatgccgcttcacgtcctcccacaccgctttgatcccggcgacaagcagcacgaagacgagggcagcggtggcccccacaccgccaaaaggggacaccacgctccaccaggacaggcaggcctggcagggagggagggggtaggtccagtgtcagccagaggaatggccggtggtgcgtcccacacctgccctgcatggggggcgcgccggcgccgcacctggagcaggaagtagaggtaggcgacgcgggagaacatctcgaacaggaagatggggaggaaggtgatagggttgtacttgctggtcaccacacggttggagggcgtcttgccgtccaccgtggtcccgccctgggggtcaaagtggattacacgcagctgttgggccgccgcgccgttcctgctgtcgcccttggtgacctttgggggaaagcacagggggaaagcggtgggttctgcgcgccatgcctcgtgtgcatagcttcatggtgcattgcagctggaggggcattgcccagcgcgcttggcacaggggcaactcaaaacccgcactgtcagacagctggcaagggccaccgtcctgaccagggcagggctcctggatcccggggctcctctgcaatccatgccccgacacgcctccacaccgccccaccttgggggtgtcggtgcgttccagattgctctgcagctccgcacgcagggctgcttgtttccgagggtccaccgaggagcgcagccgggcgacggcagaggaggtcaccctcgtcagctgacggggcatcatcttgttcagcacagccccaggactgaacttgttcctggagctgctgctcgagagctccgccgggccagaggtctccccgctgggggcctcgctggccacctcggcatcctctgggatggcgactgtcaagccatcgttacgcggtttaggcatcctacaaagccctgctcatgtcagatctgggcgatggtggaggtgatcgcgaggtcgactggcccgtggacccaactcaaacaccacgacgccactcgacgcagtcaagggctgcccactcgacaaccacgtatgtctgcacccagcgacaattgcattccgtcccgtgcctgctcggaggctgtgctgatcgaggtcgaggtgtccctctcagggcacccatgacgttggtttgtcgtcaacacgagattctagttcgatcgcccggtccacgcgccttgaaattgtttgcctgatcgaggtgcaattctgagcacaatgtaccttaatattgacaacaatcgattttaaaccatccatcaaagcccaactgcgtacatgcgtttgtagtgggagcatgacggtggccgctgggcccagcgaggctgtccccgctccccccgcagaggctgcacccagcacgcccaccagtcatgtggagattatccccctgggagcagcgcaggaggtggggcggtcctgcgtcatcgtgcgctttgcggggaagacggtgatgttggactgcggggtgcaccccggcttctccggcctggcctccctccccttcttcgacgtcatagacatgtccagcgtggacgtaatgctggtgacccacttccacctggaccactccgcggccgtgccttacgtggtcgggcacaccaacttccgggggaccatcctcatgacgcatgccaccaaagccatcaccagcaccctgctccgagattttgtaaaagtcagcaagggaggcgcaggcgagtcaggggtacagggatccaggggcttgggagggttggggaggggaggtggaggggccagggcaagggctggcgggcgaagccggtgaactccacttcgtggaggcggtgtgggtcggcctggacgctaggaccccgctggcgatactcgctgtgcgccatgaaattgagtcacccaaccagcctgtagggagagagtccgcgtcggatcttctgtcaccctttgcctcccatcaacaacccctgccctgtccaccgccagatgccgggctgtacacggaggccgacctggatgcctcgctggagcgcacgcatgtcatcaatttccagcagaccctgtgtgtcaacggcatcagcatcacggcctaccgcgctggccacgtgctgggcgccgccatgttcatggtggagatcgccggccagcgcattctgtacaccggtgaggagctgtggcggcgttgggtttcgcttcttttggggggggaagggggggggatgaaaagggaagggnnnnnnnnnnnnnnnnnnnnnnnnnnnnnnnnngggaaggggggctgtgtgggggaataggtcggaaagcctggaggtgtggagggtcttccttgtcagcagtgtggtcgggttcccaggtggcaagggtgggttgcctcgggcctggctcagcccttggcaacactcgtcatggcgttcgcaagacgcttgaatcttgatgcgcaccagcgtgcaccccctcgctgctccattgggtgccctttacgccctgccatctctggatcaggttggccagcagcactgcccatgcatcgctggcagaacctccccccaccccccacccactgcccacctaacagccca

SEQ ID NO: 43071 - DNA, 61 bp, Chlorella protothecoides
gcgctgcgtgctggtgtcggccacggtcacacgcggcgtgcgcgcgctgatggaggccgag

SEQ ID NO: 43072 - DNA, 102 bp, Chlorella protothecoides
ggtagggatgctggagtggtgactgcctgtggccctggagagccatcgatgccatacaagactgcttggcgccacgcccccccccccccccccccaccccca

SEQ ID NO: 43073 - DNA, 71 bp, Chlorella protothecoides
agggggttgagaagagcagggggttgagaatggggagttgattgcgtgggcgcgtaactcgcctgcccctc

SEQ ID NO: 43074 - DNA, 13008 bp, Chlorella protothecoides
  modified_base (794)..(803): a, c, t, g, unknown or other
  modified_base (2141)..(2150): a, c, t, g, unknown or other
  modified_base (4111)..(4120): a, c, t, g, unknown or other
  modified_base (4202)..(4211): a, c, t, g, unknown or other
  modified_base (5410)..(5419): a, c, t, g, unknown or other
  modified_base (6232)..(6241): a, c, t, g, unknown or other
  modified_base (6765)..(6774): a, c, t, g, unknown or other
  modified_base (6936)..(6945): a, c, t, g, unknown or other
  modified_base (7009)..(7018): a, c, t, g, unknown or other
  modified_base (7080)..(7089): a, c, t, g, unknown or other
  modified_base (7630)..(7639): a, c, t, g, unknown or other
  modified_base (8181)..(8190): a, c, t, g, unknown or other
  modified_base (8393)..(8402): a, c, t, g, unknown or other
  modified_base (8727)..(8736): a, c, t, g, unknown or other
  modified_base (9811)..(9820): a, c, t, g, unknown or other
  modified_base (10740)..(10963): a, c, t, g, unknown or other
  modified_base (11061)..(11070): a, c, t, g, unknown or other
  modified_base (11296)..(11305): a, c, t, g, unknown or other
  modified_base (11391)..(11400): a, c, t, g, unknown or other
  modified_base (11599)..(11608): a, c, t, g, unknown or other
  modified_base (11944)..(11953): a, c, t, g, unknown or other
  modified_base (12022)..(12031): a, c, t, g, unknown or other
  modified_base (12132)..(12141): a, c, t, g, unknown or other
  modified_base (12926)..(12935): a, c, t, g, unknown or other
gggggggggggaggaggccgccttgccttgcatgggccctgggcagccagaccccttctctgcacctccctggcaaaccccagcagaacctacccccttgttcccaaccccacccacttccacaccgaaacccaggaccgcatcatcggcgcgcacttcttctcccccgcccacatcatgccgctgctggagatcgtgcgctccgacgtcacctccccccaggtgatcctggacacgctggactacggatcgcgcatccagaagacgcccgtggtggtgggcaactgcacagggtttgcggtcaaccgcgtcttcttcccatactccatggccgcggccatgctggtggactcggggctggacccgtaccgcgtggatgccgccgtcgccgcctttggcatgcccatggggcccttccgcctcggcgacctcgtcggcttggacgtcagcctgttcgtgggcaagtcctacctggaggccttcccggagcgcatctaccgctccgccctggtcccgctgctcaacgaggcggggcgcctgggcgagaaggccaagaaggggtggtacgtgtttgacgacaagcgcaaggcgcgccccgaccctgccctggcagagatcgtcctcgagtcgcgcaaggtgcggggttgtttggggggcgctggaggggggggtccccaggatttggggctatgaatcgtggtggggtggaagagggagcctaggagggagcgggtttgctggaccctttgcacgatgcgatcctcgccctcaccaccacaaccctgccaaacacnnnnnnnnnnaagtcgcgcaaggtgcgggggttgtttggggggcgctggagtgggggggaggcaggagttgggactatggatcttggtggggtgaaagagggagcctaggagggagcgggtatgctggaccctttgcacgatccgatccccgccctcaccaccacaaccctgccaaacacacacacaatcacacacacgcgcacagaggtcggggctgtctgggaatgccgcttttgcggccaagctgagcgaccaggacatcgccgagttcgtcttcttcccggtcatcaatgaagcatgccgtgtcgtcgcagaaggtgcggggctggagtgtgtaaactgggggtcggtcgtcagagaggggcaagcgacggaatattcagggcgaggacctttgttctgagaatatggaaggcaagcatgtgacgtgtgcagtcccaccctgactcaccccctggatgttcccttctccatttcgcccacctcaaccccacacttgtctgcaggcatcgtggacaagcccgcggatctggacgtcgccaccgtcatgtccatgggcttcccagcctaccggggcggagttgtcttttacggcgacatcgtcggcgcaggtttgtacgggacgatggaggggaaagagtgtttgggagtgtgctggtggtattgtacagggatggcctctctgtctttagatgctccatgactagtgttctagcataccttccccatctgccccttgcccaccttcacctcacccactcttgaacctcgcagactacgtcgtgcgtcgcctgaagcagtgggcaacgcagtacaaggcacaggccggcttctttgagccgtgcgagtacctgctggcggctgccaagtcgggccgcaagctgtcggcgggcaacgccacgcagtccaagatctgagcggagttcttcacgcactgcctgccgcccagatgcaggcacccctgccaaatgttcccactccagtagctgtgaccaccaacacccctcacaaccatcctcttttgcgccctttttccagccttgcgctcggatgctcgcagtggtcgggatgcccctgccaggcatggccctgagctctgctgccactgcccaccctgccaggcatggccctgagctctgctgccactgcccaccctggccgcatggtccggagttttgtagttcgtattgatgcagatccagcgcagacaaggggggttcagcagtaaagatatggcaacagttcaggcttgacagtgtcggtgatcagaagggagcttcagactcgaccacccacgaggatgctctccgactgcccgccgcctcctgactgctcgccgcctcctgnnnnnnnnnntgaggatgctctccgactgctcgccgcgtcctgactgctcgccgcctcctgaccgctcgccgcctcctgacttatcaccaaccccgcgccattcgccgtaccaaaggaagggttctgccgcagacgagcatccgcagacgagaggaggggaaagtccgctgtgcgcagggcgtggatggtcgcggcctcgatggcccgggccgagctaccggccccttcgccccccctcacagtcatatacaccgcctcggcctgcggatctctgaccctggatgccccgctcctcctcctgtgtgtggctagccgctcctttattgaatccgtggaccctgcatggttaagggaggaggggtgttacattaggggtcgggcccggggggggagggcataagatcgtcgcaacgcatagccatcatggcggcccgatgcaggcatggttgcagagcataccgccagagactccgctcctcaccgacataaaaccagccgtcggtgcgcctgacgatgtagacgcaggacaggccgactgtcctcgggggcggggtctggcccgctctgacgacggcgagggggctgagcgtcggcgccggggtggggcccggggattcgggcggagacggagcgtcgatggctggcacgggggatcggccagcgctggccgcaccaggagcccccagctgctccagcaccctgctagcagtctgtgccagcagctccccggcctctgccagcgacctcagcttcagagtggcaggggcgctggcgggctcgagaccccgtgtttcagtcaggtctgtggcaatgccccgtcctgcggccaccgcagcgtcaccactccggcccgcggcctcgtcgtcgtcgtcgtccaatctccccctcccgccctccggcgcggcgtgcaaggcctggacgtcggcgtagagggcagccgccctttccagcacgcgcgcgggcaggcgctgcgccctggccacctccagcgccagcgactcggtgctcgaccccggcaccatgcgcagcgtgggccggcgcgccccgctggcatcagtgcacgtggccatgcgcatgcggcacgtggcgcgcaggcgcagcggcagctccagcagcgggtgcaggtgcgtggcaaacacgccgcggcagcccgtggcgtccaggctttccagcagcgcgccggccagggcggcgccggcgcgtgcctcggtgcccttccccagctcgtccacgaggacgagggagtggggcgaggcgtcctccagcacgtaccgcatctcggtcatctccacggcgaaggagctgcgcccctccagcggcgagtcggcgctgaagttgcgcagcatgaaggcgtccaggtagggcaggcgcgccgcgcgcgcggggacggccagcccgcaggcgcccagcagcgcgacggccgcggtggagcgcagcagcgtggacttgcccgccatgttggggccggtgagcaggaagagacccgccatgtcaaaggagttaaacaccgcggcggaggcgccggcgccgcgcggctgcagccagtagggccacatatcgcgcacgctcagcggggccggggggagggggttgggcgcgaggcccgcgtccccggcgcgggcgcgcaccgcggcgtcggggccgtaggcaagggtgggcagctgccagccgcggcgggaggcctcgcgcacgtggccctccagcgccgccgccatcatggacagcatggaggccgtgaccagcagcggcaggctgggctgcaaggagcaggagttaaggggggtaagggatgcggaatctgatagtgtggacaaagggaggggagatggagaagggaaggaggtacctgttgcagggccagccatcgatccactcccgtctcctcaatacatgctggacaatccttttctcccctcctctctgggattcgatgctgaactcccacaaagtaccaatgcaccagccacccnnnnnnnnnntagggggtgagggatgcggaaatctgatggtgtggacaaagggagggtaggtggagaagggaaggaggtacctgttgcaggnnnnnnnnnnctcccctcctctctggaattcagcgctgaattcccacaaagtaccaatgcaccagccaccctgtccacctggagcctggcagccaggtcgtccagctcacgacgcacagccctggaggcctcagagcatgctcgccggtagtcatccgtggcagagtcgacggccgggtgggagtgggcaccgggttccgactgtgtgatgtgagggggggaagggcaagggagacttgcctttcaggcccaggaagagaagaaggtgagaggaatctgatgaactggcaagtcacagcaagccgtgcaaccaagaaccaagctggcgcactatgcccctgtcatgcacaacgtgttaccacacccaaagtcaagactccaacaacttctgcacctttcccatgcgatccttggggtgccagagccccagctcgtctgccaggtggagtgcagagcaggcccgagggagcctcagccagacggcattgttgtgttcatccaggcgcagcatgggtcgcagttttactgggtcacccgcctgcacatgagtgcggcaacaggggtgattgggattggccatgtggaatctcagcagcgtagtcagagatttcgaggtcctgccttttccgaaatctaaagcccgcacaaagtcagtgaccatgtggcgcaacaaatgtgtcatctacatcgcgacaacacaccctgaccgaggcttccaggagtggctcgtagatggcccgcagctccttttccaccctcagtcctgcattcatgacctgccagatggaaggtggggcggtgagatcaatgcgtggtgcaagtgtagatctcagcaatccacccatgtgcccccatatgcacaggcacagccacctacacaccgctgtgtgcaccgctggcagcctgtcggccttgaccttgccccggaagtcctcgttcttgcggatgaaggcggccatcacctccaagcccccgctcgtgctgggggaggaccctgcatctgtaatgcgatacggactcgtcggacgaggtgcctgcaatcacgctgattaatgccaccggtgctcaaactaggtatatcaaggcactgcgtgtgaaccctagtgcacttgggaagtcatcaagactgataatcctgctccaagggcgagtgctgccttcctgtctgtggtatcgattgctgtaccaatctcaccttcgctgttgacnnnnnnnnnnggcgtgtggaccccagtgcagttgggaagtcatcaagactgatgaccctgctccaagggcgagtgctggcttcctgtctgtggtatcgagtgctgtaccaatctcaccttcgctgttgactggggaggggccagatccaggatgcggctctatcacctcatggatcagttgctgggtcgacctgagcaggcggatgaggtgagaggatgcattgctaggtactgcatgcctgagttggagcattgccttgcaacaactctcttcatgggatccagtatcctggtgtgaaacaaagagctgctgtgcacacagcattccccagaggaagtcaagttggcacagctggtccccctttcccaccaccctccctacctggttgcttcagccagctcctcacggccaaacaacagccccgtttccatctgggagacagtgagcagtgcatctgccagctcggcatgagctgggtctgagcacgtctgttccaccgcccaacaaagctccgctagctggagaaaggaggagtatgcattgggaggcaggaatggatgcatggttgtcaaggaggtgtgaacgggtgtattcataaaggtgtccaagcctcctgactcagtggggaactgagactgcagcacagcataccggtacagcatcctcagccatgcgccgagtcactcccacagcctgctgacccagctcatcccaggagccacacactttcaccgatacaagttatgagtgcaccaacctcacatagtcagccagcccccacctctcgataaaacacgtcgctggcctggcgctgctcaatcnnnnnnnnnngtttatgggtgcaccaccctcatacagtccgccagcccccacctctcgatagaacacgtcgctggcctggcgctgctcaatcttcagcaccaggttggcggccgcagtcaccgtgaactccggcagcgcagcgtgcgtgtcgcgcagggcggtacaagcccggtgcaccgccaggcccaccgccggcggcggcggcaggagcagcaggcgccggagccagcggcgggagggcagcggcgcgccggggcccagcacgcagtccagcagcgggggcacccccctgctcttgtgcaggcccaggttcaccgccgaggagaagtagagggggcgcgggcggtcgctagcgatggagcgcgtggtggtgaacggcaagctggggtccaggttcagctggcgacgcagcatggtcagcatgccctccaccgggtctgccgcctcgtacttgaccacggcccccacctgtgcgtgtcaggggtgtcagagcaggtggtgggtgatgttcgagggatcgcaaggattctgcnnnnnnnnnntaggggtgtcagagcaggtggtgggcgatgctgcgtgatgttcgagggatcgcaaggattctgcgacaagaattggaggttcaacctccttgcatgcacatggctcgggacgacaagcacggtcccccctccgtgtcaaacactccagtcacctggtgccgnnnnnnnnnnagtggctcgggtcgacaagcaaggtccccccttcgtgtcaaacactccagtcacctggtgccgnnnnnnnnnntgtgtgcaggaagaggggtggaactaggccgcctggcgcaggggttggtcgcggagatgcgnnnnnnnnnngaagagctcccggatgcgcagctcccactcagcctccgcccccgcctcccccaggcgagcgtcggaggggcccggcggcgtgtgcaggaacaggggtgggacgaggccacctggcgcaggggttggtcgcggagatgcgctggaacttccagacaacagattgacgagcacaggcctgactgatgtgggggcatgccacccttccatcagcaggaacagggggttccccatcattgcccagaaagatcttcaccaacgcaccacgtcagcatcaccacactgcatgccagcccagccccgcaccaagccagccacgtgtgccctttcaaggatcaacaaaagcctgccagaaccaccctcacaccttcgtacagccgggagtggatggcgtcctcggtgaggccctctgtgacgaccagccgccgcagctcaggctgcacctccatcagggtgtaccttcacgggtgggattgaggatggagtggggcatggcgaggttgttcatgcggcgaggctgggcacagtgcatcccagatgcctnnnnnnnnnntggggtggggttgaggatggagtggggcatggcaaggttgttcatgcggagaggctgggcacagtgcatcccagatgcctcgacctctcaaggtgtgtcaggccaccccccccccacacacacatccctgccctcaccctcccacgctgggcgacaggcccaggacggggggcacagactccagggtcacgtcggcgtcgcccccgcccagccccagcagcaagtggggcgcggcgggggtgaccacggcggccacgtagcgcgtcttctggcgcgcgcgcaccgagccgtagctgtacgcctccggctcctcctcgcacaccaccaccgacaggcccgcgccctcgaccaggtcgctgaccgtgcggcgcagattctgacgcgggcagccggcgcgcggcagggcgccggtggactccgggtcgccctgcacacggcgtggtgtgggtgacggcggcggtgagagcatggttccagagtgcagatgcggccgtggagcccaaccatagcagccaccatcacatacgatagcaggggtgccnnnnnnnnnnggagggcagatgcggccgtggagcccggccgtagcggccaccatcacatacgatagcaggggtgcctgtcctggcgggaatgcagcggtcggcagggcaggccctcgtgcggggtgcaacaggtacaatgagcggcaaccctaagtgtgatccttgagcaactcaggacagatgtccaggcaccactctgtaggcgcaccatnnnnnnnnnntgggcaggccctcgtgcgcggtgcaacaggtacaatgagcggcaaccccaagtgtgatccttgagcaagtcaggacaggtgtccaggcaccactctgtaggcgcaccatgggattgaggccggcgtgctgaaccagcaacaccgcatcgatgcccacagtctcaaaaaactctccaacctgatgagtgcggagaatggggcaggcatggttaggatggaggtgggtgtcagctgccgaggaggtcatcaggcgtactcaaacggctggctctcagcctctatctccggtgggcccgcgaagccccagccacctgcatagcctttnnnnnnnnnnaggttaggatggaggtgggtgtcagctgctgaggaggtcatcaggcgaactcaaaccgctggctctcagcctctatctccggcgggcacgcgaagccccagccacctgcatagcctttcccaaacacagagacctgcatttcaggaatggtccccctcacatgtcgctgatcccactggaacctccagccaaccctgctcctgcaaccccaccatccaatccaccactcccccgctgcacacacccgcacaaggagcacatgcatggggtacttggccttggtcgccaggaaaaacctgagcagggggactttccccggcccggagcgtttggcgttgctttcttccaccttgggcgccggcagtcccatgggctgcctggggtccagcagcttcaccagcttcctggcggccggcttctccacgccctccagtatggagctccagtactcctcaacctcctgtgcgatggatgcagggcaggggggtccttttaagcacaaacacgcgtgcagcaggggaccggcagcggggtaccaagtggctgcatgacatcattatctccaggcagtccgcatagcccccctttgcatcgtagtgctggcctcatgagtgcactctcagaccttggacactggctgtggggactttgggctggcttgcatggtgacatggtccctgcacgacgctcttccagccaccatggcgtctgagagcagcctggagcggtgccagtgtgccagggagcccagcgcccatctcctggtgcctgtctgggtaggcagctgtgcctctcccagccccacccctgatgccttggtgcacgcgaggcggcagcactgcccacttgggcgggccgtcatggctagtgacctcctcattagggagtggggcgtgccatggccgccgatcaaccctgcacgtcattcacatcggccctgcatgtgagccggctcagccaggcatgaacccactcccgaacgccggcccccggcctcattacagcctggatgccggccttgagaatgcaaagactctttatgcgtacctttgaaggaagccccgctggtcaagcnnnnnnnnnnttactcccgaacgccggcccccggcctcatcacagcctgggtgccggccttgagaaggcaaagactctttatgcatacctttgaaggaagccccgctggtcaagcccttgacgaagccaatcatccagcgaaaggcttgggtgtgcaacccacccaccccagggccctgttataccggcagaacgggtgccattgcggctcccaacctatcccacaccatttaacatgggattgagacctttcaaacgtattatacgatcggtgtccgtgtgttagaacacctgtcactcttctacaagtactggatcgggcgggccggcacccgaccgagattgcggtcgatttgccggactgcgcctctcaatctttcctccaggggcacattctccgcatgaggccgattacatgacatcctgctaataacatataaagatggcatcaacctgagtggatgcccattgtgcagggccacactgggcaggagtgggtgccccctcaaagaagtaccaagtgtggagggagggatcaaatcctgagtacatccctctactcgaaggggagaaagggggggtagcagaggacagcatcaatgagaacgctggtgttcgaaaagacaggataaaagaatggtgcattctggcgtgcgggcgcatgccaccgcacggtggtgcacagggggggcatgctcagaggtcggccagcatggcctccacacgcacgacaatgctgtcaaaactggggcgcgcactcggctcccgctgcaggcagtcccggatcaggctagccagggcaggggggcaggtgtccggaatggggggttggtagccctgcagacgagggatggcgggagggggtgtttgcagagggggcacgcatgttccgagggacggagctgcaggaggccgcctcagcccgtgctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacgcagagtgtgacaaggatttcacaggtgggcagtaagattgcctacgcaccagcgccctggaatgcagaacccatcgtggtgcgtgtcgaggatgnnnnnnnnnnccccaccacctttgtgcacccagcccatgggctcacgcaccaaacctcaacacataccccacctctgtgaggacgcagaagaagacctgggctgccgtcatccccgcaaatgcgatggtgctggtgatcagctcccaggccaggatgccggcagagtaaatgtcggtggccttggtcaggtgcccgtgcttcatggcctcggggggcatgtacctgcgcaggagtnnnnnnnnnntccctccatctttgtgcacccagcccatgggctcacgcgccaaacctcaacacacaccccacctctgtgaggacgcagaagaagannnnnnnnnngcgcagagtgtgacgaggatttcgcaggtgggcagcaagagtgcatatgcaacagcgcactggaattcagaacccatcgtggtgcgtgtcgaggatggtggcggcctttgctcacaaactcacaatcaccccaccccagcctcattacagccaacaccatcaaaactcaccccacgctgcccatggtgcgcatgagggnnnnnnnnnngatcaccctacccgagcctcattacagccaacaccatcaaaactaaccccacgctgcccatggtgcgcatgagggtgcgcgtctgccccggatccatcatctgggacaggccaaagtcggcgatcttggcgacatacccgttgctgctcccctctgcgctcttcagcagcacattggctgcggggacgagataggggtgggggtggatttggtaagggagcttaggggctgtgaagtgccacctgcatgagcgctgggcccctgcactttcctccactccccagcagccagcgagcgcgcgcgggcgcggcccccccccccccccccccccccccnnnnnnnnnngtaggggttggggtggatttggtaagggtgcttagggcctgtgaagtgccacctgcatgagcgctgggnnnnnnnnnngtctatgccagtccttcgccaaccacccctcctgttaacatccacagccctccacacttacccctcccctacacctcatacctgctttcaggtcgccatgnnnnnnnnnngcgtatataccgcgagctgttgccatctatgccagtcctgcgccaatcccccctcctgttaacatccatggccctccacacttagccccctcgacacctcatacctgctttcaggtcgccatgcacgatgttgtgggcgtggaggtaggccatgccgcgcgccatgtcgcgcaggctgtacagcacgggcttgagcatgacgcggcccgtggctgcggagacgaagcgccgcttgcggatgacagtctccagcgagccccggtcgcacagctccagcaccatccacgtctcgtagccgatggaggatgccggggaggggtgggaagcggtgtgggaggcgccggcgtcggaggccgcgcaggtctccagcccgccgcaggagagcgaggacctgagcggggccgggggcggcggcgcgcccggccccgcgccggccagtccccgcgagctggatgcgccggaggagaggcgctggatggaggaggcggcggagaggcgatttgcagaggaggcggcggagaggggatttgcggaggaggcggcggagaggcgatttgcggaggaggcggcggagaggcgatatgcagaggaggcggcggccgccgccgccgcctgcagcacggagctctccggcacggccgccagctccgcatcctccgaccccgccgcgcggaacagcgtggccagggaaagcgtgcgcgtcgtgggctcgtcgccccaggacgctggagtgggggcggcatgcgacggccctgccagcgctgcagggggcggggggtctgcannnnnnnnnnttcgtcccaggacgctggggtgggggcggcgcgcgccggcccggccagcgctgcagggggcggggggtctgca

SEQ ID NO: 43075 - DNA, 61 bp, Chlorella protothecoides
attttgtgtttctgtgtcgcggctgggggggtttatgcttgaaccctgcccccaaaacagt

SEQ ID NO: 43076 - DNA, 61 bp, Chlorella protothecoides
ttccaggagcttggtgtcgggaggggcggggtccgcggcagtcatggcgacagaagccgta

SEQ ID NO: 43077 - DNA, 61 bp, Chlorella protothecoides
tccgcccccacccaatgaacaaccaacaggttcctccacgtcgctctactccgacgcccag

SEQ ID NO: 43078 - DNA, 3394 bp, Chlorella protothecoides
  modified_base (323)..(332): a, c, t, g, unknown or other
  modified_base (2309)..(2318): a, c, t, g, unknown or other
  modified_base (2711)..(2922): a, c, t, g, unknown or other
  modified_base (2999)..(3057): a, c, t, g, unknown or other
  modified_base (3255)..(3323): a, c, t, g, unknown or other
agggcgcggcggtggcgagaccgcgacgcgcggcgccctgctctgcaaggcctgggagcgcctgctccagtgcgcgctggcggggctggaccggcatccgctggccttcgcagcgcacgtgccggcctgggccacgctgtgcgcctccaccgcgctgctgggcctggatgcggcggccgtgcaccacattaggtgcgcctgagggggggttggggtgagggccagggggagggccggctgaaggctatgacactcccaacgcagaggcccgtggatgtctgggcagcaacgcgccgacctcgccaaaccttgcccacgtctgnnnnnnnnnngaaggctacgacactcccaacgcagaggcccgcggatgtctgggcagcaacgtgccgacctcgccaaaccttgcccacgtctgagagcatcccctgcttcaacacccccccctcttcccccctcgcgcccgcgcccgcaggaccaagagcagggtgctgctcacgaggttcacggcgcgcgtgctcatccagcccatgtaccgacccgacttcatcaacctgcacgcgcaaggtggggacgctcgcttgcgtcgtgtgcgtgcaggggttaacaaatgatgggggagcgagggagggaggtttttgagcggggaggcagggtgcaggctggggatgctgccagcctgtgcggaggagtggagccgggcagtgtgcactgcgccatggaccctgcacagaaatctgggtctagcatgtctgattccagactccggccaggctcacacagcgccccccctcccttcttctaactcagggtttggagtgctgacatcagcctacgaccggtcgcagcggtacctgccctcgctcactgccgcccaggaggcactggatggcctgcttgcccccgggcagtgctcggccctggtccaggtaagctgtgcatgagtcagaaggggaatacaggtagaaggcaggtccttccaggcaacagctttccaagctgagcgctgcagttgcatgtcacatagtcacatttcccccccaagcattcccctggcctgcgttcaatctgtgcaggctgtggtgaccaagtacatcgccctctcctccgaggagctggaggagtggcaggcggatgccgaagggtgcggtgactgctgctgatgcagggatcatgtgagatgctggtgtacgctcgttcccggaccgtcgacaacatttcccctcctccccccctgtctccagcttcgcccgccaggtcgatgtggagacttctccggacgcagacacgcccaggccctgcggcgtggcgctgctggagtgcatgctggagcgcgagacggagtcggtttccagcgccctggtggaagctgcggggcagttgcaggtgagtgggtgtgggcaagtggtgtgctcgatggcggggccaggctgcaaggagggtgacggatctccatctcatgaagtcgatcagaggagacttcccaggcccagagctttggcgtgcctggagaaggcttggggaaggaagccttcaagtcacgcggtgcagaggagtctgcgccactgcccccgccgctccgcagtcctccaggacgccttgcctcttcacctcaccattgcccctgcccctcaatccccgcacccatgtccacagacggccccgctgaccagggaaactctgctgctgcgggaggccacctaccgcgcgctgggggagtgcttcagccacgtccggaccaaggtcgatttcccaaactggtacgagacggagctgcggggcatcctgcagccgacgccgaatgcaggtgagcgtatgcaaatcaaggtgctgctgccggatgtggttttgcaggtttcagtcgccagtgatctcagcgcatgtctcgggcttcggagagcacactgatgagtcggggggcccccctgccctcccccccaggcttggacgcccacatcctgcaggcgcgggccctctggctggtgggtgtgtgcggcgaggagctcggacacgagccctgggacgaggcctttggcctgtgcgccgcccacatctcctcgccggacctcgtggtgcgctgctgggcccctgagcccggctggtgggacccgggagtcgcatggggaggctgacgcggcgtgagggtgccgtgtgggctggggagtgctccctggttggccctgctgccggcgactccccctcagtgcacactgggctgcacgactgcatgcagggcggacatccatccacgcagcaccgatgccctctccccccccgccctcccaggtggcgctgatggcggtgtcggcgtnnnnnnnnnnaggggagtgctccctgattggccctgctgccggcgattccccctcagtgcacactgggctgcacgacggcatgcaggccggacatccattcacgcagcaccgatgccctctctcccccccccaggtggcgctgatggcggtgtcggcgtgcacggccatggttgcccaggccctggaggagtctgccttcctgagccaggccccggagagacaccgcatgcgcgagcgcctcttcctggacggcttcggagactttgacgagggtggggcgggggtgggtgggggtggccggaggcctgcctgctggagttcctgggttgtcattggggggggcaggctggcatcctggtgggcggaggtctgccaggcagggccgactcggcacagcagggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaccccctcaccctgcattgcactctgttcatcttgtaagcgcctggcaaacaggttcaaccccccccccccccccgnnnnnnnnnnnnnnnnnnnnnnnnnnnnnnnnnnnnnnnnnnnnnnnnnnnnnnnnnnnaggaggccacggagcaggtgtccgccgacttcacggcgcacacggcggccatcacgcggcgcgtggacggcctgatcggcgcctgcttctccatgctgcccgggctggaggagagcgagagcatggtgcgcgttctgcacgccgtgtccacggtggtggagctgctgggctcgcgcctggccccccacctcgccgccnnnnnnnnnnnnnnnnnnnnnnnnnnnnnnnnnnnnnnnnnnnnnnnnnnnnnnnnnnnnnnnnnnnnngctgccgggggtgtggggcgtggtggcggcgcggcgcggcgcgggccccggcgccgcggcccgcctgcacg

SEQ ID NO: 43079 - DNA, 61 bp, Chlorella protothecoides
gggaagtgaatgtcccttggcggggcgggggcctgggagtccaggctctgcagccccagtc

SEQ ID NO: 43080 - DNA, 71 bp, Chlorella protothecoides
tccagcggtccgggcgaccgagggcgccacgcaacgcggtgtggatctccctgcccatgtggccgccgggg

SEQ ID NO: 43081 - DNA, 92 bp, Chlorella protothecoides
tgcccccaatcagacacccctgaggtaggcgagtgtagacgctggggcccgcgctgcgctccaccatccttgccggtcagcccggtccaccc

SEQ ID NO: 43082 - DNA, 100 bp, Chlorella protothecoides
agagctgccaccgccctcaagtgcgccggccagcacacgccatccacgatatgaagagccccgccctttctcaccctgccccacctcgatgttccgcgcc

SEQ ID NO: 43083 - DNA, 79 bp, Chlorella protothecoides
ggcgcaggcctcccgttccttgtccagccaggcctcggcagccagcttatccgcctccagcgcctcgcgctcccgctcc

SEQ ID NO: 43084 - DNA, 11835 bp, Chlorella protothecoides
  modified_base (131)..(140): a, c, t, g, unknown or other
  modified_base (642)..(651): a, c, t, g, unknown or other
  modified_base (1567)..(1576): a, c, t, g, unknown or other
  modified_base (2292)..(2301): a, c, t, g, unknown or other
  modified_base (2650)..(2801): a, c, t, g, unknown or other
  modified_base (2933)..(2942): a, c, t, g, unknown or other
  modified_base (3370)..(3379): a, c, t, g, unknown or other
  modified_base (3638)..(3647): a, c, t, g, unknown or other
  modified_base (3776)..(3785): a, c, t, g, unknown or other
  modified_base (3918)..(3927): a, c, t, g, unknown or other
  modified_base (4559)..(4568): a, c, t, g, unknown or other
  modified_base (4950)..(4959): a, c, t, g, unknown or other
  modified_base (5039)..(5050): a, c, t, g, unknown or other
  modified_base (6172)..(6328): a, c, t, g, unknown or other
  modified_base (6492)..(6615): a, c, t, g, unknown or other
  modified_base (6774)..(6783): a, c, t, g, unknown or other
  modified_base (7803)..(7812): a, c, t, g, unknown or other
  modified_base (7999)..(8008): a, c, t, g, unknown or other
  modified_base (8429)..(8438): a, c, t, g, unknown or other
  modified_base (10064)..(10073): a, c, t, g, unknown or other
  modified_base (10705)..(10714): a, c, t, g, unknown or other
  modified_base (10769)..(10778): a, c, t, g, unknown or other
  modified_base (11296)..(11305): a, c, t, g, unknown or other
ggccgcgcccggggctgaagggaccctgggaccggcggggcccggaatccaaggggccggcgcgccgccggtgccgacgcagggcgttgcattggggccacccgcctggagcgagtgggaggcgggcctgnnnnnnnnnngggcaagcgacgacgggcagggagcgggcccggctcaggccgcgcccggggctgaagggaccctgggcgcggcggggcccgggatccaaggggccggcacgccgccggtgccgacgcagggcgtggcagtggggctgcccgcctggagcgagtgggaggcgggcctgctggccgagggcgtgagggtgtggggctgcggcaatccctgcgcgctggcctccatgatcggcacccgctcctgcgcagaggtggcggccgaggtggcgcggcgcttccccggcgccacgcacgggtcgcccaccaagcccccggcctaccaccgccgcaagccggcctggggcaagcgcatccgacctacggtcacccaggaccgcctcaggcggacagaccccgtgagtggccagagcttgcgtattttggggggggaggaagaggtcctgatgtgcacgaggggtggcttccagtcgggaagaggagggagcgcacaggtggctgtgtccannnnnnnnnnctttttgggggggcagaggtcctgttgtgcacgaggggtggcttccagtcgggaggaggagggagcgcacaggtggctgtgtccagatgagcgcccgccctcatcgagtcgagtggctagctggctctcaccctgccccctccaccacccaactcttcccccttcccccaaagaagtacatgccgtcctccccccccgccctctgcagctctgggcgccgtggcggccatgcagctgcgtgggtccctgcgtacgcggcacctgcccctgcgtggactcccagaacttctgcgagaagttctgcgcctgcgactgccgcgcctgcggcaaccgcttccccggctgcaagtgcagcgcgcgcgcgcgcggcggcgggcgctgccgcgtgcgcacctgctcctgcctggccgcgggtcgggagtgcgaccccgacctctgcgccggctgccaaccctccctggccgccggcagcgagggcggcgacggcgactgcgccaacttccggctgcgccgcgggaccaagaagcgggtgctcatggggctgagcgacgtgcagggctggggcgccttcctgcagggctccgcgcgtgcgggcgacttcctcggcgagtatgtgggggagctggtggacaccgcggaggcggaccgccgcggcatcagctacgaccgcgacgacaactcctacctgttcagcctgaacaaggcgtcggtcgtggatgcaaagaccaagggcaccaaactgcggttcgcaaaccattcctccgacgccaactgcgaggcctcgtgaggacggggaggaagtttttttgagggggggggggaccaggggaagaggggaaggggtgggggaagtaggaggaggagaatatatgttgaaggggagtgtggtctgaggatggcagggaagtacgtcttnnnnnnnnnnaaggagtaggagggggataatatatgttgaaggggagtctggtctgaggatggcagggaagtacgtcttcagatggaccccgcttacctgcccaggatcgctctggggaggatgagctgccttggcgctcacacatcacaggcgtgcagggccctccccgaccaggatcccccctttctcttgcaggattctgatggtggacggcgaccatcgggtcgccatcctggcgcgcaaaaacatccgggacggcgacgagctcttctacaactaccattacgagaagagggtgggtggtgcgggaaggcaaggactcggcgtggggaggggggagctgtgctctccaatgcctacgccgcatgttcaagtgggagccaaccctgcatgggtcgcgcacatggcccgccacctgaccttgcatccagcatggggccccaccgccgaccgcatctcacccccacatttgcaggcagcgccttcctggtggaacctgccctcagcccagggttccggactgggccagaggcgatccacacaggggcagagcgtgcagtgattttgccgtgcactcgagtgttcggtgcctggtttgatggcagcgatgcacccccgaccctgtgccgcgcccctggctgtaacaggaaaggctcacgtttgacttggacccccttggctggaccccagtcaccgaccccagcgaccttgcagcacgcggtcannnnnnnnnnacgtgcaatgattttgccgtggactcgagtgttcggtgcctggttcgatggcaacgatgcacccccgaccctgtgccgtgcccctggctgtaacaggaacggctgacgtctgtcttggaccccctgggctggactccagtcatcgaccccagcgaccttgcagcacgcggtcagcgcacgcgccctcgggccatttcctcaggctggggcgcagcgccgcacgaaggcctccaccagccccacgccgtcgccctcctgcgcgctggcgctggcggtgctgacctcgatgccggtggcggcctgcagcgcggccagcgtgaacgcctgggcgccgggcggaaggaggcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatggaggattggcagtgaaggagaggaaggggaaacagcatggcgtgtgcatagccagggagaggctgagcatggtggggaaggccctggttgcagcaagactgggtccacaatgattgccacgggtgacgnnnnnnnnnngtggtctgcagctgcaatagggggggaagggtggcggtgaggagaggatgggcggtggtgggagaggagggtgtgggacctcgaggtggaggatcggaagtgaaggagagaaaggggaaacagcatggcatgggcatagccacggactggctgagcatggtggggattgccctgcttgcagcaaggctgggtccacaatgattgccacgggtgacggaccagggaggcctgccccaccccgtggcctgagtcaggctgccacccagggctgctgcctcaaggtcccggcggcactcaaacttgccccccccccttgcccccccaaacccagaccccggcatgatcagcgcacaggcacccgctcaccaggtcgagttccttctccaggcgcttccgaatgaagtccacggagtgggccttcacccccnnnnnnnnnngtgcgcacaggtaccccgctcaccaggtcgagctccttctccaggcgtttccggatgaagtccacggagtgggccttcacccccatgtcagacttgttgcagaccaggaggatgggcagcctgcgcccgaccaccgacgggtgagtgagcacgtcgtacagctgcctgtgggtttaaaatggcgaggcggtgaggggagggccggagatcaagttcctctcgcatctcatgcgtgtggcaggatggtcgggatgcccannnnnnnnnncgccagagatcaagttcctctcacacctgatgcgtgtggcaggatggtcgggatgcccactgcacagtgcatgcgccaaaccaggtcgatgtcaccagatttccgacagcaaggctgggcaggggcacnnnnnnnnnnacacagtgcatgcgtcaagccaggtcgatatcaccaaatttccgacagcaaggctgggcaggggcacgccagagaggaccttgtgcaacccttccagcttgcaccaccgcacgcactctgcaatggccgactnnnnnnnnnngcagagaggaccctgtgcaacccttctagcttgaaccaccgcacgcactctgcaatggccgacttgtggggcaggaagtccacggcgtccaccaggaacacaatgccctgggcagacttctcccatgccagccaggtgtcacgcacgcgcgggtgccctgggatatccaccaggttgacgggtcgagcggcgggactctgcggggacagcagttccgcgggaggggggctggaggcgcgggctgggagaggccaggccagggcagtgcacagctccacacacacagctccacgcccaaactgtccacccatgggcctgtcaaaccacttgccttgtcggaggccaggttggtggtcacctcccgaggctccatggaggccaccgtcccattgagggtgctcccgtactgcaggcgatggaagagggtggtcttcccggatcctgtgggccccaggatcaggatgttgcgcccgttaggtctactccgcgccaccgagatgatgactgcgggccgagtcggcgacggtgggtgggacttggaaaggttgcggcaggcctccatccacctcgagatcaggaattgattgatccagtcccataaactcacatatcaagcctatgactgccaagannnnnnnnnnaccacctcgaaatcagaaattgattgatccagtcccatacactcacatatcaagcctatgactgccaagatggtgaatgcgatgtggaagggttgtactccagacccaaacagggagtgccaggcttcctccatgtcgggagacatactgcgaatggagcaagcgagattcaaggcgacgagatcatcagagctacatgcctgtacatgcgtggcaatgaagtcgtcaagagaacagcactctcccagctcgatttcccctggagctgtccagatgggttgaggagccctacgacatgtcctgctttccaggctttacaggagccagttggctgatgtgcaagcgccatgcagcccgaaacccacgctatcccggcacaagnnnnnnnnnncagctatatgcctgtacatgcgtggcaatgaagtagtcaagagaacattactctcccagctcgatttcccctggagctgnnnnnnnnnnnnagaacgcactccctcgaccaagaaggaggggttctgtgaaaccctcgggacgtgcacggggcctggtggcccgaaaaccaacgcaccccgtcagaatcgtcctgcaactcctccgggatctttgggcatggcgactgcattgcagaaggctaggaccgtagcactgtaccgggacagcctgaagacactgcttagctgggcagtagcgcgcgatattttctatgtgaaggtgaggctcgggtacactcgtctgcatgagcatcacgaggagtaggggcaggtatagttggtatatagatagcataaatcatccaatcatcgtggtcatgcaggcagcagagctccgtgctgagtttgatcaaaacgccacgctggtgagagaccggtgatgatggacaagtggctttggggtgtgctttgcaatgttccggcaccactaccctcgacataactcctccgactcctcctgcagaccggacacgaccagatagagcgtgccctggcccgtggcgaggagcgcctgcgctcgtatgcgcacccagacccttacattggtgagtaaggaaccggggctggcgtttttcggcagcagatatcgagatactgttgctcaaccctactccacccacgctacgcagtgccctaccggcctggaggctccctgtacgcgcggaacccacccttccccgatggggtgagtctggatgttgggacccattggcaacatccttgcatcatcctctggtcagtgagtccacgcttacgcatcctacatcacacccctccaaaacccttccgcgacgcagatcagcatgcacatggactttgggcgtgagggcgggcattgaatgcgttgtgtagctgggcaagacctgcccgacggaggttacctgcctgagaatgtacacatattgctgagtctcaggtgcagcggacagtagggtgcaagcattggtgagcaaaagatcgcagtctggagggaaaaacgaggtgaggcttcggccgggtgatgttgatgagtaaagacatttacggcgtgcctcccatttacaagcgctgctttcagatggcatgtcgccgaggctaccacgctgcgtcgtcctgcaagggaggcagctgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggggagggaccgcgcgccgtataatctcgctttacacctcaccagcgaggtgccctggagtttcatggggtcgcatcgcaccgtcacggcaccgacaagacccctccctccgatccctgctatccactcctcagaaccttgatgtttttttgtaggagctggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntagtgtggggagaggcaggtcatcgagttgggagtgacactttggccatgccagtttcacccaggtcaatacatggtttgctgttccttgcaactgcggtgcagctggagggtcctgcgctttgaaaatcatacccacatggcctgtcaccccacccannnnnnnnnnataaggacattgacggcgtgcctcccgttttcaagcgctgctttcagatggcatgccgccgcggctacgactctgcgtcgtcctgcaagggaggcagctgggctgcggtctccagctcctcctgccatcgccgagtctcggctgacccccaggtcgccgcattggccatgctcctgggagttccgtctggtcccttgagcaggggccggggccctagcaggtcttccaacatctgtaagggagggaccgcgcgccgtacaatctcgctttgcacctcaccagcgaggtgccatggagtttcatggggtcgcatcgcaccgtgacggcactgacaagacccctccctccgaaccctgctattcactcctcggaaccttgatgtttttttgtaggagctggcgccgtaagagctgcatgccctgcagcttggcctgcctgacactgggtggcagcgccaagactctcctcatggtcttgggcacatcagtttggggagaggcaggtcgtcgagttgggagtgacacttcggccatgccaggttcacccagttcaatacatgatttgctgttccttgcaactacggtgcagctgcagggtcctgcgctttgaaagtcatacccacatggcctgtcaccccacccacagccccgggctggttgggcaaggagcagcaggtttctggtcgtcgcctcacctccacgtatggcagggtggggtccaccaggaacaccgactccctagacaggaagctgggagggcgatggggagcgagatctgagccgtccaaaactccaggggcgtcaggtgagacgtcacactcccatgcgcaagcgtgcgtcacagcagccggccctggcacacctgtacacccgcagcatctccggggtggcgatgagcggggtggcggagatgagcgccgcccccatggtggaggaggcgcggtccgtgtagtactcgtcagagctgaaggcaggcaggatggccacgcagccatgcatgacctcgtagtattcctgcgcnnnnnnnnnnccctgctggtgagcaggggctgcagccgaggcctggacttttcatgcttgccggtgccccatcgtcccatgtgatcttgcctgtcctgccccaggcgcatgaccaccgccaatggcaggcctgccctgctgcgtcggtcctccctttcttcccccccacacaccactccctccccgcatccccgtgnnnnnnnnnncgatgcgtctcggtcctccctttcctcccccacacacaccactccctccccgcatccccgtgttctcacttggaaggggaggaaggagtagtgttcgacaatgcccctgtcgatgagatcctggggcacagtcacatctgcgcccttgccctgagggtatgggggagtgcacgagttgagtgaggatgggcaggccaaggttgctctcgctgcaggcgccggcggcctgtggcatgcacatcgacagcggccgggggccagggtgtcgcaagcttggtttccctcatgggttgccttgcgacacacaccccgatcccctcgccagaccctcgcgtcccccaccagtccactgtgatgcctgtgcccacctgcagcccaacccccactcctagcacctggatgacgagggtgaagttgctgnnnnnnnnnncccagaccctcgcgtcccccaccagtccacagtgatgcctgcgcccacccgcagcccaacccccactcccagcacctggatgacgagggtgaagttgctggccgccagctcctccgcctgctcctggagctgcgcaaagatgccggtgtagtcgcgccggctctggtccagcttgccctgcaggcagatgccggagcgtggccgcgccgcttctgccccaggctccgccgccggagacagccccgccagggtgtcgttgatgtacacagggcggcaggcggggagcacccgtctccagctcccctccacgcactcctcggggaagatgacggggaacatgggggccacccagcctgagtccacctgcgtcccaagagggacgagtttgggtttgggtttctgtgacaggaccctcgggggtcagaaatctccgaggggagaaggtttccccgagcgctcgacgggagcacagggccgtggagcgcatggcggatgcacgtcagtgcaccgggagccccccacctggactccctgggctgctgcccgccgctgcgccgccgcctggacatgcggcgctatggtaaggatcttggcgccgctggcgcggatggcgcggaccgccgcctcctgctccagggccaaagcattgtgcaccatcacgacataggtctggggcagctgtgtgtgtgtgtgtgtgatttgagggggaagggggtgtggggtgtgccgggcagctgcctgccatgccagcaggggggaggagattatggccaggcaagggctaagggcagagaaagggttggcagatgcccactggaagggcctcagtagtggcaccattgccaggccctcaaatcaaggaggtcgatggggcacacagtccgcaccacccatgcctcccccgtcgctccccacatgaccaccgtcctcatgacaagccctgacatctcctactaccccctgggacccccctcccctcctcgtcagtggctcgcctggagcgaggccagggcatggagcaagcccacgtggcaggtggggaaggtgatgagcaccacgcagtcgaactcgtggaaggcggcgaagaaggcctcataccgccggaagcccttccagaggaaggggcggaccacctcctccatccccagcgcggtggccttggtgaagacggtgacgttgtgtcgcagcttgaggaggtggtaccccaccgccgccacaacctcctcgtggtagctcaccatgttgacgatggctgtgcgtgggcggcggctcaaggggtcgcccagctcctcttcgaggcctccctccactgccgcctgtggcacggtgggatcgtggatggctgcatgcccagaaacgaagatcattgtgctgggcgggggagccgagctccctcgtgaccgcgatcgtgtggcgcaaaggcatcgtgtgatgggggggggggagtcgggaactgcacagcaaacagcctcacgcacgtcccgatcatgggtgcaagtcgtgggcagggtctcctggcaggagtctacagcgaggactccgggaatggaacaccgcgcagcattcacacataccacggcaccactcagcttcctactcgccgtgtacgtgtctggcatggatgcnnnnnnnnnncaccgcgaggactccggcaatgggacaccgcgcagcattcacacatatcacggtaccactcagcttcccactcgccgtgtacgtgtctggcatggatgctatgagctccgggatcttgtccgggcagccaggctcgatggggaccacgggcccgagcatggccgggagactgaacagggaagaagcagtccggcccggcgatccgtgcaggtagatcgacaggatcatgagccctgccgtgcaaagcaccatacatttcatcagcgtgcacatggctctgcaaggcctgacatgaatgccatccctgccaccggccccatgcctggagggccggagcggggaggccggggacaccttttgcattgtacaggcgcccgaggtatctatcccgtcacacaaatggactccatcccatggttgatcaggatggcatggcatgcgggcatgtcgatttgcgacccatggcatctgttccgaaaggattcgaatgtttaggcgcccaagtcgctgtgatggtgtgtgcttctcaaaatggtccgccgagcaaaaaattacttacagggagggagggggggcaatatcgggtacgtgcagatatctatctatatattgcgtcatggtattggcattgnnnnnnnnnncgcaggccctcgccggagggttctccatcatcagaggcacctccagctgacacannnnnnnnnngacgcgcccaaatcactgcgatggtgtgtgcttctcaaagtgatccgcagagcaaagaattacatacagggaggaaggggggggaagattgggtacgtgcaaggatctttctatatattgcgtcatggtattggcattggcagggcgtgtaggccctcgctggagggttccccatcatcagaggcacctccagctgacacatccggagcaggctgcgtgcaggcaccaggcatgcatgcgcctcaaggtaaaggtgaaggcgacagggggtggggtgaaagttgagtgcgcaggcgggctggaccctccgggctcagacccagggcagcgtcagctggggcgagacggcgccctgcttgctcagggcaaaggccacgatggtgacgatctggggcgcggtgtaagcgtccaacgccaggctccagtcgtaggggtcgccggtgggggtcacgtcaaaggtggtgaccacgccgccgttgggcgccagggccgcgatgcggtatgcccagggcgtgtannnnnnnnnntacgtcaaaggtggtgaccacaccgccattgggcgccaaggccgcgatgcggtatgcccagggcgtgtagccggcggtgaacttgaagccgtagccccagcgcttggggaggtaggtcacggtgccgacgaaggccggcagcggcggcagcgggggggagggatttggggggacgggcgggctgttgagcatgaccaggggaaacacctccacggcgtgcccgtcccagtcgaaggaggagaccgtggcggagtgcaggcgcgccgcctggccgacgtgcatgtcggtgatgttcagcgtggtctcgttggtgtgcaggggtccgacgaccacatgcgccagctcctcgtactcggcagagtacaggatgcacttcaccagcctggccacatagccgtgggtggtcacggcgactgtcatgccaaccctgtcgttggacaccaacccgatggtcaggttgccggttagggtgtagccgggtgggggtggtgggcttggtggtgggctggggggcggcggggggctggggg

SEQ ID NO: 43085 - DNA, 69 bp, Chlorella protothecoides
aaacgcgcgcccgcgccggcccgacgagcccgcgccggccacgcccacgccgctgccgccgctgccgct

SEQ ID NO: 43086 - DNA, 82 bp, Chlorella protothecoides
ccatgctccgcccgccgcttccgcgtatgctggctttgatctgggaggcggcgggtatgcgccgccgtctgggccacccttt

SEQ ID NO: 43087 - DNA, 61 bp, Chlorella protothecoides
ctcgattgcacatcgtccaatcgaacccccttggcgcagcctgtcgacagccagaacccga

SEQ ID NO: 43088 - DNA, 416 bp, Chlorella protothecoides
  modified_base (103)..(323): a, c, t, g, unknown or other
cgggggcagcggggctgcgcaggaggaggagcgcttccgctgcctctggcagcgacaggccgcgcgggacggagcggcgctggacgccgcgcgccgcgccgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngccgatgcagtgcatgcaggctgccacgcgatccccgcgccgtcggccccagctggaaaccgaccgccgccgccgccaccctgcgcagcctgc

SEQ ID NO: 43089 - DNA, 113 bp, Chlorella protothecoides
ggggatggggcggggggctgggtgggggcgggacgttgaacgggaccggggccatccaagaggtggccaccagctcccccccggcgtcggtgtaggtggccaccacgccgctt

SEQ ID NO: 43090 - DNA, 61 bp, Chlorella protothecoides
cctcctgcacttgcatgcacacatggctgggctgcatgattccgtctgcccttgttgccct

SEQ ID NO: 43091 - DNA, 61 bp, Chlorella protothecoides
tgaggcagaggatgatgacgacgtggctgggcctgctccaacctctggttgccttgccatg

SEQ ID NO: 43092 - DNA, 61 bp, Chlorella protothecoides
aaccccgagaacctggccatggcggccggcacctcccgcctggccatccagcttgcggacg

SEQ ID NO: 43093 - DNA, 104 bp, Chlorella protothecoides
accccccgcgcagcgccagcagcctttccttcccggcgcctgccaagaccaggcacgcgaccggcggcccgcctctccctgggcaccacttgtacgacgcggcg

SEQ ID NO: 43094 - DNA, 78 bp, Chlorella protothecoides
cccgaccagccggggccctgaggacaaacaagcccgctcctctttttcctcccttgccacgctgagcgcacctcccct

SEQ ID NO: 43095 - DNA, 8283 bp, Chlorella protothecoides
  modified_base (98)..(107): a, c, t, g, unknown or other
  modified_base (182)..(321): a, c, t, g, unknown or other
  modified_base (409)..(418): a, c, t, g, unknown or other
  modified_base (1837)..(1846): a, c, t, g, unknown or other
  modified_base (2425)..(2434): a, c, t, g, unknown or other
  modified_base (2981)..(3041): a, c, t, g, unknown or other
  modified_base (3202)..(3211): a, c, t, g, unknown or other
  modified_base (3269)..(3278): a, c, t, g, unknown or other
  modified_base (5527)..(5536): a, c, t, g, unknown or other
  modified_base (5982)..(5991): a, c, t, g, unknown or other
  modified_base (6456)..(6465): a, c, t, g, unknown or other
  modified_base (6666)..(6675): a, c, t, g, unknown or other
  modified_base (7243)..(7252): a, c, t, g, unknown or other
tccaggggcgcgccgatggaggcaaagggcacgccggccagcgccagcgcgcgcaggcgcgcgttgagcaccggcgcctcggcgcgcgggtcggtgcnnnnnnnnnnggcgcctcggcgcgcgggtcggtgccgaccagcagcacgctgtcggcgccgtccacgcccgccaggctggggttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccggcgatgcagccctcggccagcgtgttgctggaccccaggcggttgagcaggtccttcagcgccaccaccgactcggcgtcggccnnnnnnnnnncgtgcccgcgcgccctggccaggccctccgccgctgccgccagcgcgcgaggccaggtggccggctccaggccgccgccggcgccgcgcaccagcggctgcgacaggcgctgcaggcgcagcgcgtccacctggaagcgggccttatcgctgatccactcctggttgatggcgtcgttgaggcgcggcgtgacgcggaacacctccggcccgcgcgcatcgacgcggatggcgctgccaagcgcgtcgctcacgtccaccgactcggtggaggccagctcccagttgcggaaggtgaaggccgagggcttggccgtcagcgcgcccacggggcacaggtcaatcacgttggcggacagctcgctggtcagcatgcgctccacgtaggtcccgatctccgagtcccgcccgcgccccgtcatgcccaggtcctccacgcccgccacctccttggcgaagcgcacgcaccgcgtgcagtggatgcaccgcgtcatcaccgtcttcaccaggggccccaggttcttgtccactaccgcgcgcttgacctccgtgaagcgggagcggtcagagccaaacgccattgcctggcgtatgattgggggggtgggggggttgaggaggggggagtggagaggagggggggattctgtgggccgacgggcgtgcgcaggggcagagcttttggggagccatggggccaaaggcatcagccgccatgtatcggccaggacatagcacccaggcgtcaggtggaatgcacgggagcaccatgcccacctccagggggaacacctatgacggccatgcgaacccatgcagatgccttgccccacccccacccccacctggtcctgcaggtcacactcccctccctggtcgcagatggggcagtccagggggtggttgatgagcaggaactccatcacgccctcgcgcgccttcttcaccaggggtgtggaggtcttgatgttcatgcccgggccagcaggcatggcgcaggatgccacaggcttggggctcttctccacctgccgggcatggaggaagggtgtcggggtaagccaaatgacgggtcgtagagattgcccgcagcgtgctgatcaatcacaccagcgggtgaatgtgaagggaccgaggacgcaagcattttgtcttggacctgacgcgaccggctcccccagtggtcaggatcctgggcccattccggcctcgaggcgcaataccgatcgcaacacaaccatcccacctctacaaggcacatgcggcagttgccggcgatggagagcctctggtgatagcaaaacctgtgctccgacaggggggcgggaggggtatgcgcaatggggcaaaggcggcaagcacggcatgaaggataccgtcttcgccagatgttcgtatgtagcctcgtgccagcctgccnnnnnnnnnnacgggaggggtatgcgcgatgaggcaaaggcggcaagcacggcatgaagcataccgtcttcgctagctgttcgtatgtagcctcgtgccagcctgccttcccggatgatggaggcctctcggctcacctggggacgtccacgcccgcagcgtcgcaggcctgcagcacgttggagcccttgggcaccttcaccggtttaccatccactgtcacttcgatgagatcatctgcaggggcgggggcagcttgggcggccattgcccggcagggtactgtctcccacgaggagcccctccgggagaagcgctggagggcgcgcagccgctgcatgttgccgaccacctggcgtgccaatcgggtcagcctacttgcggcatgcaggtgtcaggaacgtgaccttggggtgggtgaccaggacgcaagcttatgcgtgtctcgcttggaggtgcttccgtccgtgggtggcgggaaagcagggagtagtaatgcaagtcgatgacttgaaaacattccagatgcagtaaacttcacaggttaacactcttcttcttatgcactgctgtaatgttgctacaaccnnnnnnnnnnagagtagtaatgcaagtcgatgacttgaaagcattccagatgcagtaaacttcacagggtaacactcttctgcttatgcactgctgtaatgttgctacaaccttgatgttgtgtgatggatgctgcctccaatctgcgatctcagggtgacctttgagtctcctgcacagagaagggggtggagtcatgccatcagatcgcccccctccaccatgactccacgcatccgaaaatgtatggatcatctcacacaacacggcgaccacatacacccaaaaattgccgcgcatagcgtccaaactgtggggcaagtggtactgcccagcaagccatactcacgcacggcttgcatgtggacatccataggtccaaattcaaggtcttggtaatgaagtaagctttgtccactgaatggcaccagatcgtggtggagaggcatgggtttgtcgaggcccaagatctgaagaaggcgggtgatgcagcagcccctcggtagatacggaagaaaaataatatccaccacccgcattcttgaggtcgtcctgcnnnnnnnnnnnnnnnnnnnnnnnnnnnnnnnnnnnnnnnnnnnnnnnnnnnnnnnnnnnnnctgctatagattgtaatgcaagtccactcctcctttgctcgatgataatgtctcggtgaaaggtgcccggctccatgcttcttggctccgtgcccagtctcaccacacatcatgccctggaggagacccccatgctggggcgtctggggccccaggacgtnnnnnnnnnnctgcgtggtgccagcgggggcgggggtttggcaaggctggtcccgcgttcacccctgnnnnnnnnnntctcgaaccatagtctccgctgtgctgaggggctgcagctatcggggtgagcattgcgtggtgctagcgggggcggggggttggcaaggctggtcccgcgttcacccctggcctgacgccggtcatggctgcgccggggggaaacctttttgtttgtaccttcttcacagtgaggacggccgggagtggagcagaggccatcgagcttctgcagaatgaggcgcccgacaccttccacctggtcctctcggtgagcggaagagagagagagaggtccccagtcgcgcaggtgtccagctgctccactgcctgggtccccacacgaccacatactctttaaaacaccccttggtctcgttttcgagcaggatgttcgcatgcctgagatcaccgggctggacctgctgtccttcatgcagcaggacgccaccctgtgcagcatgcccgtcatccgtgagtgtgcaggcagcagggcccctgtatccggcagtgtagagccttgagtgctgcatggagggatgcccttgcggcatgagatgctgggctggtggtcagggtttgcgcctccagctgtaactcccacccgtgtccaccccctcacccttacgcagtgatgtcgggcatggagacggaggggctggtgcatgccgcggtggcgtccggcgcggacgagtacctgtctaagcccgtgacgcgcaaggaggccgcgttgatgtggcagcacgtgctacgccggcgcgcgggcgggcggccacgcgtccccagccagggcaccgcctcctccagcctgcccagcgcggtggggctggaggccagcggcaacggggtggtgtcctccgtcagcccgccgcaggaaccggcggccggctcgacgcagggcttgctggcagaacccctgcccagcaccgtcttcaagtactgcgatgcggggcagcacccgaccctcggcgcggcggcctccctgagctccatcccccggcgccccagcaacgccagccaggcgatggtggacgtcgggtccgcggccgcccgcaccgcacccccgctggcatttgccgccggcgcccgtcgcggcgcgcccaccgcgaccaagggcgacgtcctggaggtgctgtgcgcgctgcggcggacgcaacgtgccgccgctggtcggctgcggcgccggctggaaaccgtggccagggacctggaggcggcgaaggaggaggccggcaggaggtggccccaggccggggaggaggacgccatgcagacggcggccccgcctgccaagcgccgggccgtgcaggcctctgatgcacggccaggagcggggggtgatcgggtggtgccggggagtgagatcgtcgaccaggccatggggcaacttcaagacctgtacttccaggacgtcgccaaagctggtgaggcggtttggggtgttcaggagtgcaaaagcttggagacgttggcctgttcagtgtgcacttgtcggtatcaagtggcctcttgttggaggagccctggatgtcgcagcatcccaaagggtgtcttttgacacacactgtccccagtacccccctcccaacctccacagatatcgcaggcagccacagcgaaggcctgagcaagtttgcacaagacctcgcggaactcacccgctgctcgaacctggagcccgtagccacactgaacagcgggcatctcggaggcacggccgaagtggtgagagtgggaggtggtggtgtttattttcgagtgtcagtttcacatcccttgggatgtgagagcgattcgacgagttgtcggatatctacgcctttatttccctttctctcatcaaatgcgtgaatctgcgagaagtccggggttcaaatcctcgcagctccagttgggcatttcggctacaggacatgtagcttcccaccatccttcggggttgtgacgcagtggtagcgtgctcgcttcgcatcttcttttcaagtttttaccatttcatccaacccacctacctgttctccgtgctcagatatgtgcggcggctttcgatgcctacgaggagcactttgcctctgtgggggtgtcccgtgtgatccgggtgtacgacttccacgccctcctggccaaccccagcgccctgcagtaccccatcctccagctgcacacccggtcgcgccttagcagcctgtcctggaacagctacctgcccggtcgcctgctcaccgccgactttgacggcggggtgcagctgtgggacgtgggcaccggcnnnnnnnnnnatcgcgcctgagcagcctgtcctggaacagttacctgcccgggcgcctgctcaccgccgacttcgacgggggggtgcagctgtgggacgtgggcaccggcgccgacctgaacttcttcgaggagcacagccggcgcgtgtggagcgtgaacttcagccgcaccgacccctcccgctttgccaccgcgggggacgacgcctgtgtgcggctgtggagcacgggcgacgagaccagcgtggccaccatcaacgtccccgcccccgcctgctgcattgagcaccggtgagcatatgtgtgtggggggggggagggtggatgaggtagagagactgagactggtggtgataagcggaaagcttattaacaagctggtgctctgtggcatttgcagtgcttcctggctgtgcagaaagacctacggcccatcttgctgcgactcgctctgnnnnnnnnnnatgataagcggaaaacttattaacaagctggtgctctgtgccaattgcagtgcttcctggctgtgcagaaagatctacggcccatcttgctgcgactcgctctgccagccttgcgccaaccctcacgatgggcatgcctccctgctccctgcatcgactcagacaaccatccctctcccaccaggccggacgacaacacccagatcgcggtggggtgcgccgacgagcgcgcctacatctacgacctgcgagccacgcaggctccccttgccgtcctgcgcggcgccagccgtgccgtgtcctacgtgcgctggtccggcccggaccggctgctggctgcctccaccgactcggcggtacgcctgtggcaggacccgggcggcgcgggcgccgacgccgctgcgcagcggcctgcggccgtgtaccgggggcatgccaaccagcggggttttgtgggcctagacnnnnnnnnnngtgacccgggcggcgcgggcgctgacgccgctgcgcagcggcccgtggccgtgtaccggggtcacgccaaccagcggggttttgtgggcctagacgcgcggcccgacggccgcttcgtcgtgggctcagagaccaacgcaggtgggtgcggggcgacatcgaggggggggaaaggtgctgggatgtcagattagtgttttnnnnnnnnnntgtgcagggcgacatcgagggggggaaaaaggtgctgggatgtcagattagtgttttgtttgggagccccgcatcatgtacgcaacctcaccgtcacaccctcacccccccacccacccacacaaacagtgtatgccttcagccgcggcctgcccttccacactgcctgccacagcctggagggcggggacgctcccggccagcgcacggccttcaccaccagcgtggccctggcgcggcgcagccggcactgcctggtggccaacagccgcggcgtgctccaggtgctgctgcagagctgaaggtcgcgacacctgccttgtgaccgcctgccgcgccgacgcacagcgcgctccgtgccccaggatacctcagcgatgtctggaaaccaggagaaaccgccacacactgctttccatttttacacaaggcccctgtagtccaggccgtcctcactgggcctccccctcttgtccccggctgccccctttcgaacggctcccttttccccccgggtgctcatccagtggcgtatgtagcgcactgcaaatctgccctgttccctgtnnnnnnnnnnccccctgtagtccaggccgtcctcactcggcttcccccccttgtccccggctgcccctttccgattggctccctttttccccgggtgctcatccagtggcgtatgcagcgcactgcaaatctgccctgttccctgtcactgctgtccgcgattgtctgcaagggaagaatgagcgtatgcatgccagggcaggggatgaaaggtcaggtggacagggcatccaggcaggagggggagtggggagactgcaggtttcttggcccggtggcccacctccgcatccgacgcacgtcatgctgactaaaatgtggcctctgttggagactggtcagccccccccctaacaccccttcaccgcttccgtcagacgtgggtgctggtcgagtaccgccgccccgcctggcggctgccgggctggggcacctgggcaggctcgccctcaggcgtggtgatggggagggggcgccgcatgggcgcggggggcagaggccccacgcccccgggccccatggccccgcccgccatgcccgggtagccaaagccgccggtgtagagggggtagggcgcgtccatgtgcagcaggggcaggtcggccggaagcccctgggcggcgccgtgctggggcgcaaacgccgcctgctgcccggggcccggcgccagcggcatccccacgtagccgtacggccccagtcccggcggcggcgccaggtccagcgcggacccgccgccgccgccgaggttggcgcccggcgtgccgaagacgtgctgcgggaaggaccctggggccaggggcaggtacgttccgccagcggggcccacgaacatggggccgcccgcctgggtcccggccgcgccgccgccgggcacgcccgccgcccagaactcgtcaaaggcggggtcggaggggaccccggacccgcgcacttcggaccccgcagacccggggcggaagccgggggcctcggcgctgagccggctcgcgccgctgctgggccgcaggggcggcgtcggccccgcgcggtagtcgatct

SEQ ID NO: 43096 - DNA, 61 bp, Chlorella protothecoides
gcgcaccgcgtcgtagaagcctgggaccagaatgttggcccgcgcgtccaccagcgaggcc

SEQ ID NO: 43097 - DNA, 79 bp, Chlorella protothecoides
tggtagggggaaacccacagccgctcctgccgagtaaggagttgtgtgtgggttggggggggggggggggggggggggg

SEQ ID NO: 43098 - DNA, 61 bp, Chlorella protothecoides
ggggaaccagtcaaacctcaactccccccctccccccccccaaaaaacaccaaccgcccca

SEQ ID NO: 43099 - DNA, 79 bp, Chlorella protothecoides
gtgggcctgcaggcacggctgcgagtgggggcaggtgggggagtgctgagcctggcccgatctgcaaggacggtgggct

SEQ ID NO: 43100 - DNA, 61 bp, Chlorella protothecoides
tcggggatgctgcagcacagggagccagggggggggagagggtcaggcagaggaggtgatt

SEQ ID NO: 43101 - DNA, 78 bp, Chlorella protothecoides
cagcctcccgcctgttttgacctcttccccccagtccaggccccccctgcgttgcaccctccccgcctccccctcacc

SEQ ID NO: 43102 - DNA, 61 bp, Chlorella protothecoides
gattccctgcaagcctgtgctggtggaggggggggaggcggcggacaccgcctttgttgcc

SEQ ID NO: 43103 - DNA, 74 bp, Chlorella protothecoides
ctcgacgtgcaggctgggccgcctgccgccgctgggcggcaggcgggccgggcaggcggccggcagcggcgcgc

SEQ ID NO: 43104 - DNA, 75 bp, Chlorella protothecoides
tcctcgatgctcatcaggttgccgccgccgccaccgccggccccggcgccggccgaggtgtccaccacctgctgc

SEQ ID NO: 43105 - DNA, 3561 bp, Chlorella protothecoides
  modified_base (298)..(307): a, c, t, g, unknown or other
  modified_base (369)..(378): a, c, t, g, unknown or other
  modified_base (446)..(455): a, c, t, g, unknown or other
  modified_base (691)..(700): a, c, t, g, unknown or other
  modified_base (1454)..(1463): a, c, t, g, unknown or other
  modified_base (2844)..(2853): a, c, t, g, unknown or other
ggcgccggcgcctcgggggccggcgccgccgcgccggacctgccgcgcggcgcggtggtgcacaccacgcgcggcgacatcgcgctcaagctcttccctgacgagtgcccgcgcacggtggagaacttcaccacccacgcgcgcaacgggtactacgatggcgtcctcttccaccgcgtcatcaaggggttcatgctgcagaccggagatccgctgggggacgggacgggcggcgagtccatttggggcggcgagttcgaggacgagatcagccgcaacctgcggcacgaccggcccnnnnnnnnnnacgcacggtggagaacttcaccacccacgcacgcaacgggtactacgatggcgtcctcttcnnnnnnnnnngggcgagtccatttggggtggcgagttcgaggacgaaatcagccgcaacctgcggcacgaccggcccnnnnnnnnnntctcacagagacagggctcgggcttgcgcagcgcgcggcgcgcccgggccatcgacagccttcccgactgcacgctccaacgctgccatgggcagtcgaatgacgccttgtggccggcagggggcagggcagtgccaatgggggcaggaccacctttccatttgcacgtctgaccccaatccaagcaacctcctcctaccctccacatgggcagttcttcatcaccaccgctgcannnnnnnnnnagaggaccgtggggtctctacagcgaggatatgccacaggggcgcctgtgcgcggctgggggtgtggctacagccctcacagagacagggctcgggcttgagcagcgcgcggcgcgcccggccatcgacagccttcccgattgcacgctccaacgctgccatgggcagtccaatgacgccttgtggccggcagggggcggggcagtgccaatgggggccagaccaccttccacttgcacgtctgaccccaagccaaacaacctcctcctaccctccgcatgggcagttcttcatcaccaccgctgcaacgccctggctggacggcaagcacaccgtgttcggccgggtggtcaagggcatggatgtggtggtgtccatcgagaagtgcaagacccaccccaagacggacaaaccctttgacgacatccgcatcatcaacgtggagccgcgggcgagtgtggagtgaggggcatgcaccgcgatcctgccagccgacgggccgcgaatgcacggagtgcacgagcggcgcctgggccatggaagctcccggagctggcgtgcagctcccgctggagacccccgtgccacgcggccccccgtccggacacgtctgtacgcctgggggctgtgatttcccagtgcatgcattcgccatggactctatgcatgctgcattgtatttgcaaggaatgtacctggtccggcatcggggatcgtatgctttgcgcggcgggggcgcagcggaagatatccnnnnnnnnnnaacgtctgtacgcctgggggctgtcatttcccagtgcatgcattcgacatggactctatgcatgctgcattgtgtttgcaagaaatgtacctggtccggcatcgaggatcgtattctctgcgcggcgggggcgcagcggaagatatccaattccatcaacgccgagatcaacgcacgtgaccggccaagggggggtgacaacccgcacaggttttggtgggggtgccattgtacagaaaatcacctcaaagacaaggaggttatcggctggagcgagcgattcagacctgacaagatgtgttgttgaagctttagcgttgcaaaggcgcggttccgatgatgtaccgggctggtttcgggcagagctcgccatccctgctcaacctcgcggactggcaggagaaggagaaggtcaaccccgtcaactgtgcggtagacgaaaacggagcccttcttgtgagtgggctgtgacctggcatggtttacggtggcgtggccgtgccctccaaccgtctgtcgaccctcccccgcccaaccccgcgtccgtaggacaacctgacgctggagctcagagtgaccccccctgagatctcaattgacaatactgtcaacagcaagtatacattcgtaaaactgagctcggccaaccgtcccggcagcctcatccatgtaggttgggtttccgagggtgtggatgtccctcgtacaggtcccctggagcagtccctcaccgctttcgcgaccctcccgggacaggtcgtgcaacatttcacggagctgggactgcatatccacagcagccgcgtcaccagctgcggcgggtggtttgtggatggtgagctggcggggcgttgtagctgggcagcagcggggtgtcctttggggcccgacatgcgggtgtgcccatgccgatgccatcgtcccaccgtgtcatgacccggattgcaagatgccgcggttctagttggtcggtcggcagagtagaatgtgtggggtgctggcacctggacaccttgcactacttccctgttgatgcctgcactaccatttatgaggcccaaactccctcgcatcgcagatttcctcctctcagagggagatggcaagaagattttgaaccaggccaagctgcgcagcatccaacaggtctggaagtagctgtggggttgttattcctgggtgttgctggtctggagtgcgtgtgcacgcccccattccaatgcggcagctccaggtttgagatgtatgtgttgatcaggatgggtgtggactcacctgctccctgagcgtgcattgcatcctgcaacatgattcatggtcatgagccagcctcgtccccatgccaccgccggccaaccctgctcgcatgcctccctcttcnnnnnnnnnncggtcatgagccagcctcttccccatgccaccactggccaaccctgctcgcatgcctccctcttccactccttgcccgcaccctcccccctccaacctgcaacccccagcccccacccacccaacccagatgctgagcgccttctacgccgacgacagcccctgcctgaatggggacgagaccgacgacaccagccgcgtagagtccacggtgtttgagctggccggccccgacggcgtgggcctgctggcagatgtcacgcgcctgctcacccacaacgggtgcaacgtgcgcagcgcggcggtgtggacctaccgcggccgcgtggccttcgtgctgagcgtgacggagaagggacgccccatcgccgacgagtacaagctggggcgcctgcgccagctggtcaccgccatcatgggcggcgaggcggtgagcaccatccggctgaagagtgtgcgtggcgaggtgcaccccgaccgccgcctgcaccagctgatgctgcacgaggagttggaggcctgggccgccagcggcggcgccgcggttgatgtcgaggcgcgggctcctgcgggcggcgccagcgccagtgacgacggcgacggcgacgacctgcccaccgacagcgagctcagtgccgacaccatgctgctggggtcgcccgactccgcgcgcggcggtggcgtgcctccgcgcgcgccggcccctccg

SEQ ID NO: 43106 - DNA, 61 bp, Chlorella protothecoides
gtcgtcattgggattgggagcgtcgggggggaatgttgagaggaagggccgtcgaggctcg

SEQ ID NO: 43107 - DNA, 61 bp, Chlorella protothecoides
accccagaaggtttctaaagtcttggcaggggccggccgaaagatccgcaggtcgagaccg

SEQ ID NO: 43108 - DNA, 61 bp, Chlorella protothecoides
caggaataagcgattcaagaagcagcaaaccgcagaggacaggatctatggcgtgtttgcc

SEQ ID NO: 43109 - DNA, 61 bp, Chlorella protothecoides
attccgattttcttccctcccccgacccattacctctctgcagcccgagcacatccggcag

SEQ ID NO: 43110 - DNA, 61 bp, Chlorella protothecoides
cgagcgcaagacgccacgcgacgtcgagcgcgcggaggtgcacttttcgtatgccgcccgc

SEQ ID NO: 43111 - DNA, 388 bp, Chlorella protothecoides
  modified_base (120)..(320): a, c, t, g, unknown or other
ttttgctcaaatacagcctcccgagtgcgtcctccccgtctcatttctcatcttccccccctcaacgcggtctaccaacccactcgacgtgcaggagcggaggaaggcagagaagcacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacctccacccgatgccaaggaggccgcagggggcccggcggccagcgcccagccggccagcaacaagg

SEQ ID NO: 43112 - DNA, 21172 bp, Chlorella protothecoides
  modified_base (137)..(146): a, c, t, g, unknown or other
  modified_base (453)..(462): a, c, t, g, unknown or other
  modified_base (1008)..(1017): a, c, t, g, unknown or other
  modified_base (1620)..(1629): a, c, t, g, unknown or other
  modified_base (2201)..(2210): a, c, t, g, unknown or other
  modified_base (2598)..(2607): a, c, t, g, unknown or other
  modified_base (3039)..(3048): a, c, t, g, unknown or other
  modified_base (3429)..(3438): a, c, t, g, unknown or other
  modified_base (4855)..(4864): a, c, t, g, unknown or other
  modified_base (5453)..(5462): a, c, t, g, unknown or other
  modified_base (5745)..(5800): a, c, t, g, unknown or other
  modified_base (5887)..(5896): a, c, t, g, unknown or other
  modified_base (5983)..(5992): a, c, t, g, unknown or other
  modified_base (6187)..(6225): a, c, t, g, unknown or other
  modified_base (6634)..(6643): a, c, t, g, unknown or other
  modified_base (6700)..(6759): a, c, t, g, unknown or other
  modified_base (6891)..(6900): a, c, t, g, unknown or other
  modified_base (7176)..(7185): a, c, t, g, unknown or other
  modified_base (7486)..(7495): a, c, t, g, unknown or other
  modified_base (7660)..(7669): a, c, t, g, unknown or other
  modified_base (7818)..(7827): a, c, t, g, unknown or other
  modified_base (8017)..(8026): a, c, t, g, unknown or other
  modified_base (8088)..(8097): a, c, t, g, unknown or other
  modified_base (8668)..(8677): a, c, t, g, unknown or other
  modified_base (9579)..(9588): a, c, t, g, unknown or other
  modified_base (10070)..(10079): a, c, t, g, unknown or other
  modified_base (10403)..(10412): a, c, t, g, unknown or other
  modified_base (11114)..(11123): a, c, t, g, unknown or other
  modified_base (11620)..(11629): a, c, t, g, unknown or other
  modified_base (12198)..(12207): a, c, t, g, unknown or other
  modified_base (12924)..(12933): a, c, t, g, unknown or other
  modified_base (15958)..(15967): a, c, t, g, unknown or other
  modified_base (16403)..(16412): a, c, t, g, unknown or other
  modified_base (16504)..(16513): a, c, t, g, unknown or other
  modified_base (17231)..(17240): a, c, t, g, unknown or other
  modified_base (17600)..(17658): a, c, t, g, unknown or other
  modified_base (17749)..(17758): a, c, t, g, unknown or other
  modified_base (18006)..(18015): a, c, t, g, unknown or other
  modified_base (18190)..(18199): a, c, t, g, unknown or other
  modified_base (18894)..(18903): a, c, t, g, unknown or other
  modified_base (19480)..(19489): a, c, t, g, unknown or other
  modified_base (20036)..(20045): a, c, t, g, unknown or other
cgcgccgccgccggccaccctcgcgctgccaccctgtggcctggcatggtacaccacgggcggcgggcgcgtgggcgtctggacccagccccacagtgccgtcgaactgcccatgggtgtgtgtgtgtgtgtgtggnnnnnnnnnngccctgcggcctggcatggtacaccacgggcggtgggcgcgtgggcgtctggacccagccccgcaccgccgtcgacctgcccatgggtgtgtgtgtgtgtgtgtggtttggggggggggaggggagcatgggggagggtcaaagtgcgggatgacatacgcttgcgcccagggtgtcactcatggaggcccggctcgggcctcagaaagtgccaggactgttgtcaatcctcctcaggatcccttttcaaaggaggtctgatccacactttcccgcgcctccgaatttcctcaggccacgcgctgcnnnnnnnnnngggcccggctcgggcctcagaaagtgccagggctgctctcaatcctcctcaggatccctcttcgatggagatctgatccacactcgcccgtgcctccgaatttcctcaggccacgcgctgcggcgcggcgccctgctcctgcccggcgtggtggtagagcatctctggtcctgcggcgccgtgctgtccacgccctacccgctgtcccgcggcgggcccctgtcctgggacattcagctggaggagctgtgggagggcgcggagcggctggccagcggcgccgaggcgcgtgcgcggggcggcggcggcgcagacacacggggcaaggacggcgccgacgcgccacgcgcgtccggccgcttccccgcctgcccggactaccacttcttcgtgagcaggcggggcgccgcccatgcccactgagcggttgacggagagaatgaccctcgcccggtgacgttgagaggtcgccatgcgccttgtggtggaaccgacccgtcccctccgagctccttgagaatcccgaggactgccattgtaggggcnnnnnnnnnnaagagaatgacccttgcccggtgacgttgagaggccgccataagcctcgttgtggaactgacccgtcccctccgagctcctcgagaatcccgaggactgccattgtaggggccctccaggcgcagtgacctttcctcgcctcgagccacccatttttcagtactgacacgcgaccttggtgcaggctcggcatgcacattcacagtttatttcatctgggcaccccgccctgcacttccgtcgcgagcatgttcgtatgtaagcgacgcgtgaggcagggaaatagaagcttctggggctggcctgtgcatcagctttacaagcaccagcgtgcagcagtgcagggtcacgcgatgtcgacatgcccgaatgccagcccctcatcccccgcagcttgctggggctccagcgtgagctgctggtcgggggtgctggacgggtcaaagtacagaccctctatggctcccgttatcctggggagggaaggaggaaagggagagtgaggcaaaaggcttcacgctttgcctgaaggataggtgtgaccattacagacgtagggctaggagttctcgatgaaggcacgatggcctcaagacatacgcnnnnnnnnnnaggagggaaggaggaaagggagagtgaggtaaaaggcttcacgctttgcttgaaggataggtgtgacctttacagacgtagggctaggaattctcaatgaaggcacgatggcctcaagacatacgcatgaacagagaggcatacctagcagaccctctctgctgcaacagaaacaatggggcggcacaacgattccaccagcacggcagactccagacctgttgtagctcatcacagcaccaccacaccctccctggccctcccagacatggccgcacctgtcgaggcacaggtagtagaacccggcgatggtgagccggcactcgcagccctccacgaagaagcgctccttccagcgcatgtacacgtggcggtgccgcgcgaggcccgagtgccggccgccgctcgccatcacctcctgggggtcaggagacacgaggaggggcgagtgaggtacccggctctaaatttcggtccaggacggatctaccagatccacattctcgagccagacttccaatctcagattgagagtccgtgtatccacttgccccctcgcgctccctcccggnnnnnnnnnnagaggaggggcgagtgagggacccggctcttaatttcggtccaggacggatctaccgaatccacattctcgagccagactcccaatctcagattgagtccatggatccacttgccccctcgcgctccctcccggccctgcgccgcactcgtcttagcgcctggaaggtcttgaagcgagaccagtgccgcaggtctgactctatgcacgctccgtactccgaggtgaagaaggtgtggttgacgttgtccacgatctcaccctcgaagaaggtggtgacagggcgttccgagtccgggatgttgtacgcctccagcgtcccacacaggcggcccatggcgtgcgtcactccctgatagtttgatgatgggaagggcactcccttggtnnnnnnnnnntggcccatggcgtgcgtcacaccctgacggtttgatgatgggaagggcactcccttggtgggggagaacaggacagtgccacacggtcagctgcatcgccctgcagtctgctgctatgtccagcttcagacatggcaactgccttgacgcagggccattgatgaatccttacaaagtccaccaacctgtattgtgacggtgacgttccagtgctcgcccttggagccatgcttgacccgttgccgaccctcaaatcgctgccccagctggaggaaggcacacggttccggcggggcctggggccgaggggagagggtggggccacgctgggttcgacccatagtgggatagggtggagttaacactagagcgctgaccagcgacgtcgaacctccgcggctccgcaccttgaaaccctgctgctgcgccggnnnnnnnnnngcccatggtgggatagtgtggagctaaaactagagcgctgaccggcgacgtcaaacctccgcggcgccgcaccttgaaaccctgctgctgcgccggggagagtgtggtgccggtggcccggtctgacacccagaaccctggtgaggggatggggaagctgcccagcacgcggttcagctgccgctggaacaggagcggggtctcctcccctccggccaagatcacatccacctctgccagctcggtggccccggactggcgctcccgaccccgcagctccgtctgctgaggtgtgggcccggaagggtcatgtgtcagaggtggtggtgactgagctacctgtcccaggggggcacgagcagctccccagctcctaggccnnnnnnnnnnaattgggctacctgtcccaggcgggcacgagcagctccccagttcctaggccctgccagtgcctcaggccccccctcaccagcaggcgcagctgtccctgcagcgcacggcgcacgcccacgatggagggctgctgcccggtttgcatggacgagcaggtttcgaggttcccggggcgcccctgactccctcgccgaccagcctgcggaagggagactcggtccgcctcgaggatgcctcttttcttctgttgaaagccttgcgtgcctttatgccgatcagtgaggtaagaatgtaatactgatggcattcaatgctccccttgagacgtcacaggcttgtcgagcctttcagatcgacatcaagccagctggcaaaccatgcgaaactgtcgatgaaaaacaatgacacaggcacgcatcatgatgctgcactgcgttctttgcccagaacatgaacctcgtccacatactgctactcatgacttgttcgggactctcatactgcttcctgccctaccaatgcaggggcggtgaacatctgggagggtgctcactcggcggtatgcatgatggagaatgtgcattgggtgtgggtgggtggatgggtgtggggggtgacgtcaagtcatctgttacatccgtcacggcaggctgtgatatacccgagggcaatgtgtagggcggtatccatttcaaggcccagctccggcgcaagcgtcgaggtgaggcggcgagtgtgcccgacttgggcagacacctctcccgtcatcaaccccacccatacgagcagatgccccatcacggccggccgttcagcactgaagtctctggtgcggcagggagcccgtccaggaaggccagccaggcctccttcacggccccgctgcaggtgggcaccaggtggcggcccgggtgacggtgggccatccgtggcccggagaaggtctgcgccagggcctcgctgcggtccagggggatgatctcgtccgcctcacccatcaggtgcaggctgggcagggccaggcccgggcccgccagggacgccgccaccgccgggtcgcggggcaggaatcccgagacgagcaccgcgaagcggagggccccctccggcagccccgcgcagtagatggctgcggcggtggcgccctgggagaagcccaggatgccgtgcactggggcgtgggccgccagggcctcgtccagggtgcggcgggaggccccccagccgctgtaccgcaccgcgctggagggcctggcctggtcggaccccggctggttcccggctggcagctcctcccagtcaaacctgtgtacgggtgtatcggtaggtggttgaggggtagtgaattgatagtgggcggcctggacctctggagcgccgcatactgctcgacggcatgatgagaggtgacacnnnnnnnnnntggtaggtggttgaggggtagggaactgatagtgggtggcctggacctctggagcgccgcacactgctcgacggcatgatgagaggtgacacacccagcccatgaaggtaacaaccacatgcgctgcgccagaatctcaaccccctaaccctcacacgcaccagctcttccccgtggtcttggcgtcgtggggtgcgtccacgtacacaaactctaggcgggacttgagggacttgcgcccgctcccagtccttgtcctgaaaatgtctgccgtctgagcataaccatgcaggcacagcacccgcagcttggcctccaccaggccacctggcgaggctagttgcggcatgctcaggctgggggtcgagccccacgaatcgatggccccagcccctggtgcccgttgattggtagtaatccccccgtccaggcttcggcgtaccaccctgcctccttaggagggattgaaacggctcaccgagattgactacaagtatatatttagtgatctgtgggtcgatgacgaagtcctggctactcatctgccatccattttggcagaggaagactttgtagggccacgtgtctnnnnnnnnnntagctcctggagcccgttgattggtagtaatcccccgtccagcctttggcgtaccaccctgcctccttaggagggattgaaacggctcgccgagattgactacaagtataaatttggttatctgtgagtcgatgatgaagtcctggttactcatctgccatccattttgacagaggaagactttgtagggccacgtgtctttcggaccaacatcgtcgactgccatttccttgcatgcgcacagcgtaataagccaccaagcaattccacaagaagtatatcnnnnnnnnnnnnnnnnnnnnnnnnnnnnnnnnnnnnnnnnnnnnnnnnnnnnnnnnacttcatagacagtctggaggacacccagcttgctgtgagatgggagtaattccggcttatgggactgcatgcaacgatgtggtctnnnnnnnnnntcttcatagacagtctggaggacgcccagcttgccgtgagatgggaataattccgccttatgggactgcatgcaacgatgtggtctnnnnnnnnnnccatcgtcgactgccatttccttgcatgcgtgcagcgtaataggccaccaagcaattccacaagaagtatatccggcttagtatagcttaagcgtcagggcggggcccccaaccgtcgctcttatgcactgaggagggaccgtcgcggtgtgccatggcggagaagccctccttgacgggagaggagctcaaaannnnnnnnnnnnnnnnnnnnnnnnnnnnnnnnnnnnnnnctcttgtaagaacaatctccaaggtgccagacctcggcactccctcgtcacccaccgcaggtccctgatgagctgacacagtatgccttgcgccgaactggtcatgaatgtgtcgacactcgaacgtacgcctcccggaaccaggggcccttggtctttgtgcatcctccccaaggcctggcccagcccacacccagctgttctccgtccccacccccagtgttaggctggtgtccctggcggcacagaggttcatcgcctccctcctggacgaggccatcaacgtgcacaagcgacggaagctggcgccggcctcgcagctgaaggcagatgggcacaacgtcagggacaagcgtgcggtgctgacaacggaggagctcgtggaggccctcaaggaggtgcgtcgtcnnnnnnnnnncattccccgtcccctccctcagtgtcaggctggtgtccctggcggcacagaggttcnnnnnnnnnnnnnnnnnnnnnnnnnnnnnnnnnnnnnnnnnnnnnnnnnnnnnnnnnnnnacgcggagtgcatgtgtttcgttcctagtcatacgcgacgcttcattgtgaacagggtccctcctcccatccggccatgcagtgtggcgtgaatgccaagttggcgccctactacgcagaccagcccaagcnnnnnnnnnngcgcggagtgcatgtgtttcgttgctagtcacacgcggcacttcattgtgaataggatccctcctcccattcggccatgcagtgcggcgtgaatgccaaggtggcgccctactacgcagaccagcccaagccggtgtctgggtccgcgtgagtctggctacgctttctacctaggcaccagccagctcatcccacacgcgcttgatcttgcacaggatctgactcgcagggtgcattctgtattccgggtcagggcatggcctgccgaatgtaagnnnnnnnnnnccccatacgcgcttgatcttgcacaggatctaactcgcagggtgcattctgtatttcgggtcagggcatggcctgccgaatgtaaggcatgacagcttcacgatacgcgcagcagtctccactgcactggcgcggcgcacactgtagtctgcctgctgcagcgtaggcaaagtgcacaagggacactccccctgaccagaccgctagtacggcgggtggggcctcggtgctcacggcaggcggggcctcggctcacacggcgcgcggggtctcagctggccccgccctgcctggccttcannnnnnnnnnacacactgtagtctgcctgctgcagtgcaggcaaagtgcacaagggactctccccctgaccagaccgctagtacggcgggcggggcctctgctcgcacggcgggcggggcctcggctgacacggcgggcggggcctcagctggccccgccctgcctggccttcannnnnnnnnnaagccacctgttcttcagtgggtgtgggcagggagggtttgggtgccgcagcgcaggagccggaggggaggactggggcctctgccatgcacagcagtccctgcagccgggggacctagcgacgcacacatcggctccaccagctcccnnnnnnnnnncaacggcgcgatccatcctccagcgcaggagggacagcacgatgttggtcacgggcgccagcaggacgctcagggccaggggcagcaccttggggctgagcgaggtcatggagtccatgagcagggtctggccaaaatcgggtgagctgatgtggtaggcccggcgctcgatgccctgcacgatgctgcnnnnnnnnnnaaccccggtgccggccagctgtgcgggggaggggggtgggcatgagcataaagcagcgtgannnnnnnnnngagccacctgtcgttcagttggtgtgggcagggaaggtgtgggtgccgcagcgcaggagccggaggggaggactggggcccctgccatgcacggcagtcccggcagccgggggacctggcgacgcacacatcggctccaccagctcccaaacaccctgcctgccttctctgccgggaagacttcgctgcccagcgccgcattggcagcgaggcagagcttgggtttcagctcattctcgctggcaaaaccgggggtctgggtgtcgggcgggtacccgatgctcatgccgaccccggtgccgaccagctgtgcgcgggatgggggtgggcatgagcataaagcagcgtgaccggccgatgaacgattgtggcgtgtgccgctgggatccctgctgtcggagcacagcaacagcaccagctccaggtgaaaccccaacaccacccaagcatcgatgtcgaaagcatgttgctcctcccttgtgacaatcgacgtcccagaccctttccacacacggcaggcccgcacggtctccaaggtcgcacctcgttcctcaggcagtctgccaggccnnnnnnnnnngcgctgggatccctgctgtcagagcacagcaacagcaccagctccaagtgaaaccccagcaccacccgagcatcgatgtcgaaaccatgttgctcctcccttgtaacaagcaacgtcccagacccattccacacatggcaggcccgcacggtctccaaggtcacacctcgttcctcaggcagtctgccaggccccttagggcccacttggtgggggcgtaggagctgtaccccgcaaaccctgttgaggagggacaggcagcgaggcgtcagcgaggcctgcacatcaccaacaccgaggaggcagcggctcagtcttggcccagggacaactgggtgcaaaagtttgccccaacgtacgcaagcaaacaacccccacccctaacctacttcgcccacaactgcgccggcccctacccaccacagatggccagggcagaggagatgatgcagatgtggccttgtcttcgctccagcatgccaggaaggaacgcctttattgtcttcacggtgcccaggtagttgacatccacctgcctctggaagttctccagactggagtcgggaaagagccctgcagcgagttgggcggtcgcccgggctcgtatggtacacagggacgcgtactggcccaaccatgacgggatccacccacggcttgaccccgagaccatccatggatgctgaggctacctggcaaggatagcccagcattgcagatgaccacgtccacgggtcccagggcgccttctgcagactgggctgcggcgtggagctgcaccatggttggaggcaaggggctcaggaatatgtgtggaccctccgacagcagattgagcgcgatcagcacaggttcatgttatacctggtcgaccgaggtggtgtctgcggcgacggtgtggnnnnnnnnnnaagcgcgttcagcacagcttcatgttatacctggtcaaccgaggtggtgtctgcggcgacggtgtggatcttgccccgtgaggctgggcatgcagcggcgaggctggcccttgccttgctcagatcatctctgttacgcgccgcgatcgtaactcgcgcgccccgccgcaggacctcctcggcaaccgccaatcctatccccttgctgcctccggtgatgaaaacatgttggtccctgaccggacacgatgccttccaaaacaccatcgtcagaatgtgcccgaccactgatgccaccacgacggtcagcagcacatcaagcatggcatgtggtggcttagaaccatacaagaactgttgtgggtgctcttgcacccttatgagatagatctgggtggaagttgtgtgatcatcgcatgaacgcgccccggtcgggaggaaaccccattcggagcaccctttctattttgcctacggttccnnnnnnnnnntggtcagcagcacatcaagcatggcatgtagtggtttaaacccatacaaaaactgttgtgggtgctcttgcaccctttcgaggtagatctgggtggaagttgtgtgatcattgcacgaacgcgccccggtcgggaagaaaccccatttcgagcaccctttctattttgcctacggttccggttttttcgacagcccgatagggatgcctcgaaccaacaatgccaaaccttttccaaagttacatgcgacaaataggacatgaacctaatcaaacccattgagaaggataaatacagctcaagcactgtagctccattgctcannnnnnnnnncgccaaacctttcccaaaggtacatgcgacaaataggatatgaacctaatcaaacccattgaaaaggatagaaacagctcaagcactgtagctccattgctcatcggctcagacattcgtccagcaacccggagcacccggccggcgagcgcgacccgcttacagtcatgcacatgcgaggcgccgatccagcgcctagaacctggtgtgattccagaatatgtacaacgcgaagtgggattgctgtgcgctgcgcacccaagcgcggccagggctaaccgaaccccacccgccccttacggatacccgtgcaggaggcgtccctcccaggttgtaaaacaggcagactcggcatggacttcctttccaccatccgaggtcgaaactctgctctcattcgatccccagtgcacctcgatccccggcaagtccgacttccaggcgtccctgagccagcagaaggaggacctcttccatgatgctgggcatctggagccgccgtcctcgcccatcaaggcttcctggagcacactccagtgagttccagggattcaaggacatttaatggcatatctgagggtatcgcaattgattgtacctggaaaggcaacttgaaagtacatgggaaccgccttggtattcctgtcgcactgcctcacgctcccacaatcggcccctgcaccagagccgagccttctcagnnnnnnnnnnaagggatttaaggacatttaatggtatatctgagggtctctcaattgagtgtacctggaaaggcaacttgaaagtacatgggaaccgccctggtgatcctgccgcactgcctcatgctcccaccattggcccctgcaccagagccgagccttctcagcacacgctgggagagggagtgccctccttctcctccctcgggtcggaggacgacgtggccagtctgcggggctggatcgggcacccactagagcatgacggacactttatggccatcgagtttgtcaagccgcagcggcccccgccgccacccccctcctgcctcacccagccccagggacagcagcacgccgttccagacctcatttcattctgcacgtgacaccccgtaccacacacctcttgctttctttaatccccccaccattgatggcctgccagccatcttcagagcgtgctcagggcaggaggataccgcaggatgtaatcaagatgccgcnnnnnnnnnncaccacacacctcttgctttctttcatccccccaccattggtggcctgccagccatcttcagagcgcactcagggcaggtggataccgcaggatgtaatcaagatgccgctgaatgaggaaggccagggatttgcagcagcacaggaaacctgactccagcagcagccagcacggcatgcattgggaggctgcagcattgcagggagcggacggtgcaggccgaaccagtcttcaagcttgatgtggagtgacagagtggaggggtcacgttgtcgcctcgatggtggccggggcttcaaattcactgagagacacagtgaacttgaactcctccaccagcatcctcatgattgtgcctgcagcgagatgcaaatggttgatttttgaagtccagctgctgcatgtccgaggtgaagcatggggatgcagtgtgaactgggccagctcagcgagtgcaccttcccacacctggaccccgaagcgcagggtaggaggtgggcgactggctcaaatactacctccccattccccctcccgacctggaccccttcccaccatgctccggatnnnnnnnnnngaaagtccagctgctgcatgtccagatgtgaagcatgaagatgcagtgtgaaccgagccagctcagtgaatgtatcttcccacgcttggaccccgaagcgcggggtaggaggtgggcgactggctcaaatacaacccccccattccccctcccaacctggaccccttcccaccatgctccggatgcttgtaggtcttgtaatcgtgggaggcgacaaaatcagcggcaaaccaatcctccacgatgccccacacggcgtgggaggtctcccactccgcgtggtcgctgagcgcgatgaaaaactcctgggtgcccgggatcattgccacgtgccccgccctatgagggcattgggaggcacagaggatcagggtgcggcgccctgtgctccaggccgcacagctcagctcatgccagcaccatcaccacacccctccctccattcctctccccgatacagatctccggcaccgcacacactttacttggagggacccctccaccgcagggtagggcttgctcaggtccattcggccctgcagaagcccatagggtggcccaaggccttccttcttctgtgcacaggggtgagcgggcatgggaattggcagttaggcgctgcacccgcttgagtatgggggcccaagaaggcgtcgtcagcgacacacagggcacgaattcaacttttatatcctgaatgacgcaccttgggcctgnnnnnnnnnntatgggatttggcagttaggtgctgcaccaccttgtgtatgggggcccaagaaggcgtcgtgagcgacacacagggcacgaattcaactgttatatcctgaatgacgcaccttgggcctggcttcgttccggtaaaaggcacagtctgcgcaggagccgggtctcgccaccatttccctcactgccgcgaccacggtgggagcattctccggcagcagtcggatgggaatggcaccgaaatcggtgtgcaggaatatccgttccgcgccgtccttcgtgtccagagacagggtggtgatgagcctgttggccgtggagccaggggccaggaccacaaggatccatagccaggcgcaacacaccagcgcccgcatgctgggaaggggagggcactaagacgcggctcaggcccaaggaggcactggttgaaggcgatgggcatcgtctgggcgcgcgtgtgtcggagcagcagctcgaccaccgcgcgtggggttcgtccggacactggctgcatgcaggtgccggtgagcacctgcatctccctcggacgcttttcctcgatgcccctgtatgggcatctctggccatttagcttctgcagcaccattacagactctccattgcgctgagacagtttccagagcatctgggtctcatcacggctcctgccccccctccacatccgccacctcgtcctcgtccctgtccagcaacaccgcaaccacaggctgcgtagccgccagggcgtgcagcagccgcagggacaccaccatgccgtcaaaggcggcggcgacggcggggctgttgccgtccaggggcacgccctcagggtaccccggataccgctggctgaagtgcgtgaggatggtggcccatgggcgcgcgatctgcgccagctccagcgcctgggcggtggtgctgtgccgcttgcgctctgcctcgccctcccgcccctccccaaaggtggcctcgtgcacgagcagcgtgggggggggcgagcacagcgcgcgcagatcggggttgggcgtggtgtcgcccgagtagacgatgctccaggaacgggcggcgtcgatgcgcaggctccaggcgtcgctgcagtggcgcgcggggcaggcggccaggcgcgcggcgccgctcagcgcggccgccagcctggcggccgccgggtggcctgccaggggaagcggccgattgtgtgtgtggaattgagagaatggaggtggttgggagaggctgcatcgcacgcagagtgcagggccactgggcattgacgaaaattcactaacccccgcccaagcccacaccaaaatcctcaccgggcctgcgcaggcagccggcatgcaggaactcgtagcgcaagtcctccccgccgcaggccgccagccagtcgcggagggacctgggccctacgacgagggggcggggggtgccttccggcacggccctcaggactccaggcacaccgcccatgtggtctgcgagcgccgtggggggtgggtgggagggaagggcagggcctggaagtggcttgaagcgaagggctcatgctggattcgcacgggagctctcttgcaggcaggcacatgggctctgggtgacccacggaccccatgccgcacgccaagccggggatgggcgcgtagaaaggtgacgcatcgtgccccactgcttcccccccgccacccccattcgtacccgcatggcgatgggacacccagagcacgcgcagcgtggccagcagggtgcgcgccgccacggcgccgagcgtgcgcgtgagctgacccgcggtgccctccccgcagtccagcaggatgctggaggaggggtccaggctgcagtggaaaggggtttgtcgggatgggtgagggatattctcgtcttgcctggccgacctgcggcgacctcgcaccggtgggttcagcgaagcccctgcctccccgccgcggccaaccatggggccctccccatacgccttcccttaaccccaaaacgcacatgggactcgcaaagccagcatctcacctgagccagatggcgctggccgaacgatacttggagggctcggccgaacccgtgcccagaaagtggagggatggcaggtcggccttggctggggggtggccaggtgggggcggcggctgcgctggaggggtgctccccgtcgaggcctgcccggctctgggaggcgttgctggaagggcgccttgtgggtgaggccggcgttgaacattctcctcgaggctgccgcggggggtaggcggcttggtcagggatgggtctgtagtggggtcgacgggcgggtgcggtgcaggggtaggcgcaccgactcctgtcgctgcaccagaatgctgatccgatgccagcctcccgctggcggcagcatgcgtggatgcaatgccacggcggcaccccggggtggatggcaaggcggatcccatgcctccctcaacggctggctcagcgtgctggagcgacttgcccagcagcctggctcgcagggccgcggcggctgaccagttggccgccgggggcagcgtcgggggttggcgggcgggaggactttcgagcatcgcaccctggcgcggagcagcaaagacacgcgcggcagggctttctacaagggacttccctggcaccaggccgcctggtggcggtgggactgccaaagcacttctaggtatgtcataaccctgcgcctgcacctccggctgggcctggtgcagcaccccgagcatgcccgccgccgccgggtgcgcctccagtgcggcagcccgggcctcgcccggggtcgcatgtcccacgcccaggcgcgtcaggctgggggtccgcacctcgcccgcgcggaactccagtgccagcgaggaggtgaccgtcaggggctctcctgtgcagagccccggcgtgctgcatgcctccaccgtaccatccactgcgagtccgtgcgggagcgggaagaaagcgggagcggccaggttcaggcgcgcagagacgcgcgcagcggcggtgttgcccgcctgtaggcccnnnnnnnnnncccgtgcgggagcgggaagaaagcgggcgcggccaggttcaggcgcgcggagacgcgtgcagcggcggtgttgcccgcctgtaggccctcctggggctccgggaggagcagcatcgggcagggcagggctgctgcaaggtcgaccaggccagggtcggaggcgggcaggccctcccccagcacgacagagcaggcggccagcctggcgccgttggccagcccgagcaggccgggcatggcggggtgggcctgcagcgcctccagctccactctgtttgccagcctggcgatcagcacgagcctgtccagcgacttgacccaggtcagcagcgccagagggctgggcgggctgggggcgacggggggagggggagccttcctcccgagcccgatcacgtcctcgatcgccacgtagagcgagatgcggtccgcgggnnnnnnnnnncgcgcccgcttcctgggcacagagtggagcagggacgcgggggggtggcgcgggccctgcgtccccggtgtgaactgcccctctgcggggcnnnnnnnnnnggggctgggcgggctgggggcgactgggggagggggagcctccctcccgagcccgatcacgtcctcgaccgccacgtagagcgagatgcggtccgcgggggtctggacgtaggctcgccccgcggacacgacctggggcctgcccaggtaggtgagactcacggtgcctgccccttcctcgcacctggcaggaccaggggccccagctccgtgcgccgctggagccggccgcgcccccgccgcgtccggtccagcgccgggcggcaggtagcgcgcccgcttcctggacacagagtggagcagggacgcgggggtggggcgcgggccctgcctccccggtgtgaactgcccctctgcggggctggagcggccaggttgcaccgggggagggcaggtgggtggccgaggactccccgcctgcccggctggcctcgtgtcgcttggtccacccttccagctgctgctgctcccagacgaggcggaggcagaggtccctgcctcgctgctactaccattgctgctactgctgctgctggaggacgcatcgtcagggctgtggccttcggaggacgtcccgctcccggagccctgctccgacccactctcgctgtctgacgaggacggctcgtcgctgctgcccgtctcgtcggagctggaggggtctgatgggggcgacgcgtgtctgtcgagccagtgtgggggatgccaagattcacgnnnnnnnnnnagagctggaggggtctgatgggggcgatgcgcgtctgttgagccagtgtgggggatgccaagattcacgggggccaggccagagcatggccaccgccaccagatcatcctgtgcaggggccgggggggaccccagagtgagtcgtggacgtcaagctactgatagaaacacaagtgcgccagaacagtaggttcccgggcggtacagcaagtcgtgctcacttgcaaggttatccagccagacgtgaggcatgaggaacccctgcacacctcaaacacaatggagtctccatcggggtagcaatcgctggccagcacgtgcggtgtcttccactgcacaaagtgctgtagggctgccacnnnnnnnnnnnnnnnnnnnnnnnnnnnnnnnnnnnnnnnnnnnnnnnnnnnnnnnnnnnagggttgcccatgttttcagtactccactcgcccactcaaatagcggcagcagaggagcctgaatggcatgagcaggcaccagatgcactnnnnnnnnnnggggttgcccatggtttcagtaccccactcgcccactcaaatagcgacagcagaggagcttgaatggcatgagcaggcaccagatgcactccacactcctcaccggctggtccggtcacatggacctgcccccctccatcgccccgcaggcgcatgaggagccctgccaaccccgtctgcaggtgtgtgaggacatgaggctggtcagcaaaggccctctgaccgcacaggatgcagcagtcccctgnnnnnnnnnnactccatcgccacgcaggcgcatgaggagtcctgccaaccccgtctgcaggtgtgatatgacatgaggctggtcagcaaaggccttctgaccgcacaggatgcagcagtcccctgcaccccttcagtagctccactacctgcagaccccgggcttggtaaccaaacactgcccgnnnnnnnnnngtctttagtagctccagtacctgcataccccgggcttggtaaccaaacactgcccggagccccaagcccgggcgctgtcgctgctccagcgccagcctggatatgccctccggagctccaaacatgtattgtacactggggcgcaggtgtggaaggtccagcagtattgctggtcccactccatccccgggggatgtcagcactcggatctccatctccgtcatcttttcggtacaactacttgtcgcatggcttcatttcaacatttaatggatactgacgtcgtagaaaaggatttctgccaactttgcttgttgcgtagttcaccaggtgatgcgcgttccactgcgataggacttgattcctttgggaacgagactacctgtcttgcagtcaattgaatgaaactttcaagaacatttaatctaaggaagcattaacgctggctgcctcgacgacgagctttgatggacaagctaatgcgcctgcataccggcctagctctcgcgggagtgcctcccgagctcatcgaatcactcgtgctacatgcgtggccctgagcgctaagaattatcacagtgcataacatgtgaacaggatggatgccccttcgacgtgagtgcaccacccttgcggacgcttcctgtgttccgggtgtgcagcgcagcatgcccacttcatgccagctccatccnnnnnnnnnncacatgcgaacaggatgaatgccccttcgacgtgagtgcaccaccctcgcggacgcttcctgtgttccgggggtgtgcagcacagcatgcccacttcatgccagctccatcctcacggtcatgtccttgccacaactagaaaggatttcagggccaagcgctatctgaatggcaatttaaaccgtatagtctctcgagaaattttcgtgcattgctaacactgacttgctgttctgcccgagtcagacatccagcccgggcgcgcaacgcacgcaggaactgaccctgtaccaccctcctccttctcaaccgcaagcttcactgccgacacgctccctcgatccagtcgtggactgcgggatgtcggagaccggagagtcagggcacgcacccctgccgagacagtcggaggggaggtcccagcctgcagctggaccccaggctgcccggcctccacgctcccgcggccggggtcgtggtagggggagaggatcgcacgcccccgccctaggtcacgagaggacggcggatatgtcccctgggcggcatgtgggcttcccagggcgaggaccccacnnnnnnnnnngagggggagaggatcgcacgcccccgccccagaccatgagaggacggcggatatgtctcctgggcgccatgtgggcttcccagggcgaggaccccacccgcatcctctaagaggcgatgcgcggcctctgggagtggagaccgcgcagcaccctcgaccgccgtcgcgcggtgatgcgacgggctcggagccggccccaggcgccgggcgcctggatggagagagcgcgccactcccccgccccctggcccccaggcgagggggccgaggggccgaaccccgcgcggccgccgccaggggccgctgccccggccgccggcacgcgcccgcaccaggccaggcagaggacgagcgcaacagcgccccctcccacgccccgccgccggcgtactcgcccgtcgtgccggccgacgcgccccctccccccgactgcatcgtgtgctacgaaccctgcgtggaggtggcggtgggtgcgtgcggccacgccacggtgtgcgcggactgcacgctgcgtgcgcgcctgtgcttccgccagctggcgtgcccnnnnnnnnnngccctgcgtggaggtggcggtgggcgcgtgcggccacgccacggtctgcgcggactgcacgctgcgtgtgcgcctgtgcttccgccagctggcgtgcccgctgtgcaagacggagctggcgtctgtggcgctgacgcagtggcgcgccggtctggccggtctggccggcgacgccgcgcaggcctcgcgggggctggtgccgctcagccgccaggctccggacatcctcgtggacaggtgcgagtgtgtttgtgttgtgggggaggggggcaatggggaggaggagggaagggacaagggggggaggagggaggggacaagggggggaggagggagggaacaagggggggaggagggagggatcatgggatccaaaccccgccaccgtgcccccttgcccctccaagccatgtctgtctacactccacccccactcgccagccccgctgggcctcgacccacacccaccccacaccccaaaccacgcactcctcaggctggcctttggcggcgccgccgccccagcaccctcccccttccacctctccctcctgcaccgcacctccatcggttgcccggcctgcggcgcggcctgcccgacgcactcggccctgctccagcacgcccggcgcgtgcacgcccccgcccgcctctgcgccatgtgcctgcaaggcgggcgcgcctggccgcgccagctggcgctgcatggcgacgaggcggcgctggccgcccacatggcggcccaccatcccgcctgcgacttctgccgccgctcctacatcgacgacgacgcgctgtgggcccacatgcgcgacacccacgtcagctgccacgtgtgccccgcccccggcccgcggccggcctacttccgcaactttgccgcgctgagtcagcacgtgcacgcggcgcaccacgtctgccccgagcccgactgcgcgcgccagctcaccgccttcgccacgcccgccgagctggcgcggcacgcgcacgagcgccactccagtcacatgccgcgctgggacccggggcgcgcgcggccgctgaccctggacgtcgcggggatcgtggtgggcggcggccagggtggccggggcagcgacgcgcccggcggcggcgacgcgctgacc

SEQ ID NO: 43113 - DNA, 68 bp, Chlorella protothecoides
ccagagtcaacatttctgcactgccagtactactgaagtcatggcttgggtgcgtagatgacccttac

SEQ ID NO: 43114 - DNA, 79 bp, Chlorella protothecoides
ggggcgggggcgtactgctgcgcggacgcgtactgctgcgcgggggcgtactgctgcggagacgcataaggctgcgcag

SEQ ID NO: 43115 - DNA, 61 bp, Chlorella protothecoides
cacccggcagccgtcggacgccccgcaccatccggacaccgcggccgcagacaccatgctg

SEQ ID NO: 43116 - DNA, 119 bp, Chlorella protothecoides
tggagtgcatgtcgtgaagtgggagcgctttgtccggctagcaccacaaggacgtgacaccagcccgtcctgcgaatccaagcgctcggctacattccgaggagcgaaaccagcgattt

SEQ ID NO: 43117 - DNA, 7507 bp, Chlorella protothecoides
  modified_base (138)..(307): a, c, t, g, unknown or other
  modified_base (780)..(789): a, c, t, g, unknown or other
  modified_base (2333)..(2342): a, c, t, g, unknown or other
  modified_base (2625)..(2634): a, c, t, g, unknown or other
  modified_base (3162)..(3171): a, c, t, g, unknown or other
  modified_base (4913)..(4922): a, c, t, g, unknown or other
  modified_base (5277)..(5286): a, c, t, g, unknown or other
  modified_base (5924)..(5933): a, c, t, g, unknown or other
  modified_base (6748)..(6757): a, c, t, g, unknown or other
  modified_base (6927)..(6936): a, c, t, g, unknown or other
  modified_base (7167)..(7176): a, c, t, g, unknown or other
cggcgagcagcgcgctcgccagccgcgccagcgtgtctgcccgcagaacctccgcgcagcaccgccgcgcgtcgcaggccagcgccagcgcggccagggccacctcccgccaggacggggcaggtgcgaggccttcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcttccccgacgcgcgccgcgccggcctgcagggcggcgtccagcgtgccgcgcgggccggcggtcggcgtcctgccgtgcaggcgggcatgcaggtcccagcccagcgcggtggccacgagctcggggagatggtgcgccccggcgcctgcgccgtcgccagccagggcggcctccaggccgctcagtgcggcggcctggagggcggggaccgggtcgccgggcgcctccgccgggggaagggtgccgggcagccacatacgcccgtcccggcccaggaggcccagcagactgtgcgtcaagtgggagtgagtggtgggacagggctgcgggtgtgttgtcgtcgtgcatgccgaggagtgcgtggaaatagaggttgctcggcaacgtcaaactccccaggaggtgttcgccaccgagcaatgcatcgtcccacggcccagcagcggccccctgcaactcacgaatcaagnnnnnnnnnntgtgcatgccgaggagtgcgtggaaacagaggtcgcttggcaacgtcaaactccccaggaggtgtttgtcaccgagcaacgcatcgtcccacagccccgcagcggccccctgcaactcacgaatcaagcaagtacctgagtgccagggcggggaatcgcaattgggaggggcggctggggggcaggccggaggccgggtgtagtgtcctgacgcaggctgccaccagggccgccagctggtgctggggggtgcacccgacgcaggtgctcagcagctccagcggtgcatcagggcctgcctccaccacctcgcgggagatcctggcaaggtgtgtgggggggaacggggtgagcaggcatgcaggtggggacgtgggcattggtgtgcgccagcatcaccgcggcctcgaccgactccaagcccaattcctagggcagtccaatgcacagcacccccgcttcgcagcagcagcccctcacacgcaccatccccagaggtcaacgccggccagggcgtcctcgggccaggcagcgaccgcgcgcatcagcgccgcccgctcggcggcggaggcgcagcgcgggagcagcgcgcgcgcccagcccacgtcgccggaggtggccgtggccaggagctgcgcctgcccctcgccggggtcgagcagctcggcccggagtgcagcaccggcgccctgtgccagcgcgcacacgcctgccaggatggacgaccatcccgcccgcgtctcgctcgtgctggcgtcgggtcggtcagacggctctccaccctcagcctccgctcccggctcgccgtcaccggccccgcgcttgccgcgccgccccgcgccagccttcctcctgggcttgacggcgggcttggccctgggcgccgagtcggggcccgtctcgcccacgatctgcacgctgagcaggtgctccgtcagcacagccagcagggaggccagggtccctgctcccacggccgggcctgtcggggggtgggaggcgtcggggtcggaggggatgggtttcatccgagcctgaatgcgcctcgtagccacatgtgtagagcgtgcattccgcactgctctcgacactgcacggcccttgtcctgccaagatcctcagccggggcaccacaccagcccctgatgacctgccccacccaagacccctgagacccctcccactcatgcccctccaaacgaaagtcacgcacccgagggcagggccaggacggtcccgtcctgcgccttggactccacgccgccggccaggtacaggcacaggcgacgcccggcctccggctggctgcgcaggagggagaccagcaagcccggcgccgactcctcgtcggggaggaaggagggcagcaggagctggtgcacgcgctgggacagggcgggggtgtcgcagcccagcacgccgatgaggtcctggggcgccaccacgtccagccagctcaggccggacagcccactgaacggggggtgttgtgggggacggcgtggatgggtgatacgtgcgctgctagaaagcaagaactgcgnnnnnnnnnnggggttgtgggggacggtgtggatgggtggtacgtgcgctgctagaaagcaagaaccgcgcaggagcatgcgtcgccatcgtggctcacggtggttggggctccaacacgtgggcagcacgacgactccttgtgagcagatccagttctccttcgcacaaacagatacccctgtgtcccctctgtgttggcagtcacgtcgggcggcgagcgtaccccgccacgagtctgccacggacccacctacccaccacacccacccgaggctcagcaataagtcggcnnnnnnnnnncggggctccaacacatgggcagcacgacgacgccttgtgagcagatccagttctcctttgcacaaacaggtacccctgtgtcccttctgtgttggccgtcacgtcgggcggcgagcgttccctgccacgagtctgccatggacccacccacccaccccacccacccgaggctcagcaataagtcggcaaacccagcgcgcacgcgcggcgaggcgtcaaagagctggggcctcagccggggcagcagcttcttgagcagcggcgccgccaacggcagctctgccaggcccgccagcgcctctgcggccgcacaccgcgcctcgatgctggccgtgtccagccccaggtcgcctgcacacgcggcggtttgagcaatgagctggtgagattggggtcaagaggagaaggaggaaaggaagggatggcgaagggtgagggaaaccggcggtgatgcccttagtggtgaggtgggacaagttcgagtggctggggcaactagttcctcccctcagagatgacaagatgcannnnnnnnnngggaagggatggcggggggtgagggaaaccggcggtgatgcccttggtggtgaggtgggacaaattcgagtggctgggccaacaagttcctcccctcagagatgacaagatgcacgtcgaggctccctctcaagggccccccccccctctgtccacttcccactcacagacgcgggagaggagggaggcagttagggcggcagggaccagctcccagtaggcgcccaggacctgggcggtcgcgcgcgcagcagcggcgcgcacggcgggcgcgtcgtcgcccagcgcgtcacgcaggcgccgaaactggtcgcccagacgttcgtcggccgcggcaccgtcctctgcggggtcacgcagtgggaacgcgtcggccaggaggcggagggcggccacgcggacgcgcgggttgggcgccgccaggcggcgcagcagcagcgggccgtaggcctccagcagcgcggcgtccacccccggctcgtgcttgcgggagtgcaggccacgcagcactcggcgcaggttggcccccaaacccggggacgaagccagcagcgcggcctcggccagcggctgcaggcagtgcgccaccaccgcgcccaactgctcgccctccgcgccggacaccgcgcggaacaggatctcgccgtacgcgtccaggactgcattcagggttgggttggtggtgtgtcggggggtgagtgggggtggagagggggttctcaggggagcagggcagccatgcggagggctcctgaaccggtccctgagcattttggaatgtgcgctttccagagtcacaccgatcctggcacccgagcagtggcagccatcactgtacaggcatcccaccccccactggccctcaccagcccaacctccctctgacttgcctgaggcgcgccccgccgggacctggttcttgatgatggccgtcagctccgcgacaaaagcgggttgcaggcggaagaggtgagccaggaagcggcggccctcgctgcagcgcaggaaggcggggcagaaggtggccttgagcaggaggcgcttaaggtggacgatggactcctcgtcctcgtagtccagcaggtccaggccgtgccggatggcgtggcaccgcttcacggccgcagtggtgcctggcaggggtggaagggttggtgaagggcatgcacagggtggcttgacactgaaagaggggggaaacaatacatggtggcaggcatgagcgattccccacagcacagtggtatgccctgaaccagggacctgccaaagcgcgagctggtcatatcgcctgcaacaatcgcccagttccagacgcaccggcccccacggcttcagcgacgaggtaggcgatggtggatgggacgagcgcgttcctgccgggcgcgcccgcctgccaccactccaggcacagccgggccacggcctcctggatgacgggggagtcgcagaggtacaggaggcagttgtcgtgcagcagcgcggccgtggcgtgcaagccagggggcggggatgccttggtctcccccagcatcaggcgggccaggacagcactggcgcccaggacagacagcgcggaagggggaaggcccggtgaccccggctcagcctccgaggcagtgacctcggctgtctggatctccaggacggctgcacaggcggcctccgtctgtgccaggggagggtggttgagggggcaggcttgatggtcacataccaacgcaccgggacaccctggactnnnnnnnnnntgcggcctccgtctgtgccaggggagggtgtttaagggggcaggcttgatggtaacataccaacgcaccgggacaccctggactgacgtccagcatcgaccatatcgctggcctgtgcagctaagtttcgagcacgctacgtgcctttttatagagtgcatcgcagagagctgccatctccttgcgctgggcgacttggaggcattcttgcacctcctggcggatgctcttgggaccctgccgaggggaggcatcagggagtttcagcgagccgctgtgcgcaagtcaaaggcgtcggtggacactggcacccttaaaatcgccctgatattcaccaccagacttgcatcggcgnnnnnnnnnntgagccgctgtgcgcaagtcaatggcgtcggtggacactggcacccttcatatcgcactgatattcaccaccagacttgcatcggcgagttggaggaatgtcgactcgctctgcacctccgcgccctgcaggtcccgtaacaaggagcccagccgggcgtgaacgccggcagacatcgcgtgctgatcttttatctgagcggagaagacatcttcaatgtcaagggggtctgtcagtggctccctggttgtggggcgtgcgacacagcacgaaagctgtcgacctgagattcgaaggtacccacatcgactgcagtacctcccaccgaacagtgtttgactctcccggagcagcgatcggcacagacgtgatcgacccgcgagatggaggctgccatgaagctctagcaaggaggctacatacccaaacccactttcaaccagcacactagctgcgatccgatgcatgcgccggtggaaagtggttcacgagtctgacggctttgggcaaaagtactggaccccctccgaacagcgatggaggtatgaagaaggaggaggtgccactaaagttaatagtttcagcaagtcttggatccattcaactcttcctccttacaccacagatctcccaccagnnnnnnnnnnaccctccgaacagcgatggaggtacgaagaaggaggaggtgccactgaagtaaatagtttcaccaagtcttggatccattcaactgttcctccttacaccacagatctcccaccagtacattaagcagaggaaggatttcggccggcacccctccttccggaacggccccattcaggtgagcacccacttcgatggctggacaagatcaccacgatggacatgaatactgcgccccaatcacgatatgcagaggtgggctcccctcccgactacaggtatttgtggaccagcgaccagacgaggagctggccgccctctgggttcccgtgtcccacgtgacgaggggcacccagtcgggccccagcatgtcggaacacgaggtgggtcctgattcaatcgtattctaggtgtgacatgccagacaatacaacatgtgggggtgtatcagaagatgttcctgcgccaggcagcaagttcatgctggtctcgacgcagcacggcagacaaggctttgtccatgcccatgcacgtgtgcaggtgaacaccgtggtcctccagacagtcagccaagcagtggatgcgaccctggggcgctggcccaaggacgtggaccccacagacgcccagcaggtcgccaggttccgcaagaaggtgactgggtttgaaaccagatcctacgcaccgtgtgggaatgagtgggtacatgacgaggagaacaaccgcgcacggcatgtgtgtatgtcctgtgcccgaaggtgggacgcagagcgccctgcaattctcttggaatgtctgcgcaccttcatcccatggnnnnnnnnnnagcgcacggcctgtgtgtatgtcctgcgcccgagggtgggacgcagagcaccctgcaattattttggaatgtctgcgcaccttcatcccatggtgttggtatccgctgctatgtcagggcagggtcgagggtatcccccaagccagtatccacattcatatctttaatcnnnnnnnnnnaatgtcgggccagggtcaagggtatccccaaagccagtatccacattcatatctttactcagatggagaaagatgaggactacatacggtgcacggtacgcctgggagcggtggtggaggagctgatcaaggagaacaacgccctcgacatctacgaggagtactttgcaggtggtagacgggtgttcagctgcagatggggtgacaaggcctgggatactgggtctgacnnnnnnnnnnggacgggtgttcagctgcagatgaggtgacaaggcctgggatactgggtctgactacgtctgccccctttcggacctacctcggcctcgccacccaaacacccccaacccaattgttcccctcccaaaaaccttgcagacgtcccccccctcgccgagctggacccgccctccatcgccagcctggcgacgctgctgccggagggcgccggggagccggtggtgcgcctgagttggcgccccgacgccgcggcctgcctggcggtggccggcgcctcccgcgtcagcctctgggacctggacgccggcccgccacgcgtggccgccgcgct

SEQ ID NO: 43118 - DNA, 109 bp, Chlorella protothecoides
cccatcctcctgcaaggtggtgggggttgacgagccagggttcgtgctgtttgagtgggaggagcgcggttgcgtggcggctgggccaagcctgtgctcgcctcccccc

SEQ ID NO: 43119 - DNA, 61 bp, Chlorella protothecoides
gccccgccgctgcgggcgccagcgcctccaccccccacaccgccagcagcggcgtgtcctc

SEQ ID NO: 43120 - DNA, 61 bp, Chlorella protothecoides
accccgcaacccaggttcgaattcgaatcatctccatcggtggcctcgtgtgatgagcttg

SEQ ID NO: 43121 - DNA, 81 bp, Chlorella protothecoides
ccctcccgcccgtctaagccctcccgcccgcctcaccccacgatgcccttgaagacacggaccagggtggggtccttgatg

SEQ ID NO: 43122 - DNA, 61 bp, Chlorella protothecoides
gacgcggcgccgggggtgcggctggcagggggcgggcacgccttctgcgccgcctgcctgc

SEQ ID NO: 43123 - DNA, 61 bp, Chlorella protothecoides
cctcgctgcgtgggggtgatgcggggggggggagaaggagagaatgaaggttttttggggg

SEQ ID NO: 43124 - DNA, 145 bp, Chlorella protothecoides
gcgggccgctgcttcagaacctgctgctgctgctgggatgccgtggaagagatggcggtggacgcttcagcgtggcccagggtcgcaaagccgctgctgggcggggcctgcagcggggagagtggagtgcgagccccgcgctgcc

SEQ ID NO: 43125 - DNA, 3199 bp, Chlorella protothecoides
  modified_base (148)..(219): a, c, t, g, unknown or other
  modified_base (837)..(846): a, c, t, g, unknown or other
  modified_base (1480)..(1489): a, c, t, g, unknown or other
  modified_base (1835)..(1844): a, c, t, g, unknown or other
  modified_base (1988)..(1997): a, c, t, g, unknown or other
  modified_base (2884)..(2893): a, c, t, g, unknown or other
  modified_base (2996)..(3072): a, c, t, g, unknown or other
ccgcgcgctggtgctgacgcgcgaggcgctactggagcggcgcgcgggcgattacgagctggcggggtggcgcccgctggcgcgcctggcggcggcggtacgctacgccgacgacccgcagtggctgggcctggagtggggcgacggnnnnnnnnnnnnnnnnnnnnnnnnnnnnnnnnnnnnnnnnnnnnnnnnnnnnnnnnnnnnnnnnnnnnnnnncaccggcctgcgcctacgtgaccccggcgcgcgacgcgctgctggcggccatcgtggacgtggcctcccgcgcggcggggcgccccatcccagtcttggcgcgtcccaccgcgcccggggacgcgctggtggcggcgcgcgggcaggcggcacgagtcccggccctgcgccccaacgctgaggtggagcgcatcgtcctcggccagctgacggcgggtgggtgctgagaaggggggtgcttttgggggcaagaaggtgggagtatgttcagagatcgcccaaccgggtggtacggggagcaggagcatgagtgtacgcaagtgcaccgagttcagagctctcatccccccgctcccacttcccccttgcctctcgcagctgcgaggcagtttgcggcctgtggggcgctgtcctcctcgtccgccaccctggccctggcggggctgtccagccaggcaggcctgaccgggcgcggggttgaggccggtgggggcggcgctggagtgggcctgaagaactcgggtgcggggcgtggagggtgcaagttgtttcggaagtcggggtgctggcgggggagtgtgaggagggcgggaaggttcccccagccacgacatcatnnnnnnnnnngagttgttgcggaagtcggggtgctggcgggggagtgcgggaaggttcccccagccacgacatcatcacgtgcagtgggttcttaagacgccccggggatgaggctctgcccgtgggcatggcctttggtcctcctgcatggctaccacgccccctcccacccaacagcaccccatgcaacccctcacgtctgtgcagggacgatgacgccgaggcaggacgccgcggccgcggccgtgcgccgcgcgtttgcgcggcaaggtcccggtgcgccgggcgggggccagggcgcccaggaccccgaggccgtcatcgcggccttccagcagcgcgtgcgggagctcaacgcctgcgtcccggccagcggcgtgcatgcaggtggggggagtggggtcgcgagaaagagggaacgggcggtcggaaggacgtgggtgatgaccacttgtgggcttttttcgcgtttgggtctgtgaacgctgctgcgggggaggccaatctcccgtatctccttgactgactggtgtacgacctggagtctggctggggtgggccccgttcccgcccaggccccacttcaaggcccttgtcctgttccttgcttttgccgctccctaggaccccaaaccgcactttnnnnnnnnnnctcccgcccaggccccacttcagggcccctgtcctgttccttgcttccgccgctccctaggaccccaaaccgcactttcccctttccccccaccccccacacgcaaacacattgccaggcttcaaggcggacgaggctgtggtggcggcgctggtggcgcacctgccacgtcagcaggccgcccccgtcccgttgggcctggacgaggccacgctggccatcgaggcgctgcagtgcttggaccgcctggcctcaaacctggtggtgggggcgcaggtggtcggcgcggcaggtgaggggtttgaagtggagttttggcggggggggggggggggggcgggggggnnnnnnnnnntgcaccaggggcccgtgcctttctgcaacctttgctgtcaaccgcgggcatcaggggacgctgtgattcgggacctcaagttcatggttcccacgttcacaacgcatcaccctcccctaaaatacaatcaagtaggtggcgccnnnnnnnnnncaccaggggcccgggccttactgcaacctttgctgtcaaccgcaggcatcaggggacgctgtgattcgggacctcaaattaatggttctcacgttcacaacccatcatcccccctaaaatacaatcaagtaggtggcgccagccgcctcttcgcctgcatgctggcgggcaatgcgcacctggcttacgaggcctcccgcctcctcctccgcctcttctcccccgccgcggcgcgcagcgggctacccgcctggcaagccggcgggtgcgcggcttccctgctcgggcccggacccctgcctgacggcctcctgggcgcggcggggtccgggcctgacgacccgccgctcggcgcggaggacagcggcgaggaggtggcggccgcgcgcgcggccaaggcggtggtcttcatctccgactcgcgctgcgacgcactggttgccccgctggcggcgggcgaggctgcctcgcccctcctcgtcctgggcctggtggaggcggtggccgccgtggtttgcgagcccgggtcgcgctccaccgagcaggccacgctgaccgccatgctccaggcagggtgctgtttgtgtttcaggttctatttttttgggggggggagagggtgagaatggggggcctcgtcccgggatgagggagcggagctgatagagagcgggaagaaacatgtgcaggggaggcgaaggcggctgggctgcagggaaacgggaagtgggatgtgccaggcgtggcaaccccctctctctcacaagatgcacggaacccttgcgactgcccgtcccgcacggggtgacctcgaccgccccggtgtcatgccaaccaccccagagccaggtgcccacccatccccttgcacaccgctcgcagtcgcnnnnnnnnnngggggggggggagaatggggggccttgtgcagggatgagggagcgcagctgatagagagcggggagaaacacgtgcaggggaggcgaaggcggctgggctgcnnnnnnnnnnnnnnnnnnnnnnnnnnnnnnnnnnnnnnnnnnnnnnnnnnnnnnnnnnnnnnnnnnnnnnnnnnnnntggcgtcgctggggcgccccctgttctgcctgtttgggcacgccgcgccgcgcgtcgccgacgcggccgcgctgacccagcgcgccgtggccgagggcggggcgggcgcggccgcgcccatgcgcgc

SEQ ID NO: 43126 - DNA, 387 bp, Chlorella protothecoides
  modified_base (139)..(297): a, c, t, g, unknown or other
ctccttcctcaagccaccgccccacgccgcaaaaaggcgagttgtgggggctcgattgtgtggtgtggtgaggatgcagcaaacctggtgttgcacgtactatcaagcccaccccctcaccgccccctcccggcgccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccgcggcggcgacccggcccctcctggggacggcaaggccgccttggatggcctgggggcctcgccgtccacctcactcgagcccaagat

SEQ ID NO: 43127 - DNA, 63 bp, Chlorella protothecoides
ctgcagcagaagcacgtggccgccgccgcggcgctgctgggcgccgactcccccgcgctggtg

SEQ ID NO: 43128 - DNA, 61 bp, Chlorella protothecoides
acccgggcctgtcggccaaggctgggctcggtgaccgcatcattgtagcgcgcgtgcggcc

SEQ ID NO: 43129 - DNA, 443 bp, Chlorella protothecoides
  modified_base (97)..(282): a, c, t, g, unknown or other
acaccgagggtccgagggttctcgcgagtccctcccacagggtatgacccttgtgtttcgccccccgcctccagatcgtgcgcggccgcctgaaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatcaggagaggcaagatgttggaaaggagaccaccgagggaagtggctgcagggcacctcgtgcatggcatcataccctgatgcaccggagatcagacatatagactcgccttcctcccccccctcccggttgccgccagaccgcgtggcgatgcaggac

SEQ ID NO: 43130 - DNA, 70 bp, Chlorella protothecoides
ccccccggaaacgtcccaaatgaataaatcgacgccttggtcgtcacccttgacgtcgaatcggagatgg

SEQ ID NO: 43131 - DNA, 61 bp, Chlorella protothecoides
gtcgtcaccccacgagacgctctcgcagagccgggttgcttgggaatgcagcccaaagcag

SEQ ID NO: 43132 - DNA, 61 bp, Chlorella protothecoides
agggacggcactgggcttgtataggaggggggacttccttgcgtgatcacatgcgcagtaa

SEQ ID NO: 43133 - DNA, 64 bp, Chlorella protothecoides
aaacacgcctgcccgccggtgccccgcccaatcccccctcacccctgcccttgtcaaagtgcat

SEQ ID NO: 43134 - DNA, 111 bp, Chlorella protothecoides
ctgcggaccctgttctgacttcatctcgtacaaaggtgcaccagccagattatttgccagtgtctcaggccccggggcggacagagcagctgggcttttgcaggacaaggt

SEQ ID NO: 43135 - DNA, 76 bp, Chlorella protothecoides
ctacgagggcgtggccggcaaggagctggccgggggtaggcccgtcgccgcgcgcgtcgtcgccgacttcctgcgc

SEQ ID NO: 43136 - DNA, 77 bp, Chlorella protothecoides
acgagcaccccttccctcccatcctgctcccccccccaaagatacaccacccctttcagcacctggcgcgcttgaag

SEQ ID NO: 43137 - DNA, 96 bp, Chlorella protothecoides
ggggggggggctctgcgctgcaccgccatggacggggttggcgcgtgggcgtgtgggggggcacgcagatggggttgtgggcgcatgtgccagtgg

SEQ ID NO: 43138 - DNA, 61 bp, Chlorella protothecoides
gcaccagggcaatgacagcctcgggccccgcgctggacccgacctcggtcagctccgactc

SEQ ID NO: 43139 - DNA, 97 bp, Chlorella protothecoides
gacaaggagagcaaggaccggcggggtgcacgtcgagctgccgccccccggcacagccacacccacgcccacctgacggaatgtgaaggacacacgg

SEQ ID NO: 43140 - DNA, 86 bp, Chlorella protothecoides
caggtgccagcacccccggcaccccgcagccgccggcttgaaacactaacatcctggaacaaacacccgcccaaccactcaacccc

SEQ ID NO: 43141 - DNA, 61 bp, Chlorella protothecoides
ccgcacgctctgcctgtggcactggcagggtctgggatcgacctgcatcaggtaaacttga

SEQ ID NO: 43142 - DNA, 3364 bp, Chlorella protothecoides
  modified_base (793)..(802): a, c, t, g, unknown or other
  modified_base (1294)..(1303): a, c, t, g, unknown or other
  modified_base (1696)..(1705): a, c, t, g, unknown or other
  modified_base (1765)..(1885): a, c, t, g, unknown or other
  modified_base (2049)..(2058): a, c, t, g, unknown or other
  modified_base (2420)..(2429): a, c, t, g, unknown or other
  modified_base (3289)..(3298): a, c, t, g, unknown or other
gcctccccccaagaaggcgtcgccgcctcctccaaggaaggcgtccccgcctcccaagaaggcgtccccacctcctccaaggaaggcctcaccacctcctccaaggaagaacttcccacctccacacaagaagttaacaatgtccccattcccctcaaagttgactttgccaccgaagcacacgtgacagtatccactgctctctagcgagaatgtccataccgcttgtgcaggctttcgtgaattccatgtccatttgcttgagtgtgccgcggctcctccggccgcctttgcgcagggtttgtcatcctcttcaccacgcataaccaggttgaccatgccgatgaatgactctgtcgacagtagcctttgcctatggtcaatagatggatcaagtgcaccattgaaatatcccaccccatgttgcggtggaagagtatcaagctgactagtgggatatttgggggcctgggagttggagggttcgtcaaatcatacagtagcacgatgggtggttacaaggtgtatactactgctcctaggacttcccagagattgaaagggctgccagtatcagcatccccagtctgtatctggtgctggatttgtacaggtataggtggctgggactttcctgggagctgctcttttgtgcagatcagccaccaagtattgcatcgtagctagacttacgattgcggaagagcgcacaagaacaggaattacttagagccacaggaaagggtgcatccccgataaattaggcagtggcctcaagatgtggacttcctcnnnnnnnnnnaattacatagtagctggacttacaatgggggcagagcgcacaagaacaggaattacttagcgccacaggaaagggtgcatcccccttatataaggcagtggcctcaagatgtggacttcctcatcgacgtcacagtgcatgactcgaggcagcaccttcccttcatttgcaccctgtcactgcccaaggtggcccatcccctccacgccaatcatcttacatttgtatctataagcctgcatgcagcatgacggccagagcaccacttgaaagcattgcatgcacctgccaggaatggagccagacacgcattcatgcaggcgcagaagaggcagcaactgcactcgtagcaggagtcttccaggagaccacgagggtccgttgcgctccagtggtagatcactgaaattttgatccatccaaaaggggggaggccaatgaaatggcttccaaaatggccaacggcttgctgacagggagactcagccagannnnnnnnnnaaaatgttgatacatccaaaaggggggagggccaatgaaatggcttccaaaatggccgacggcttgctgacagggagactcagccagaacattcaaccgacaacaccactcctgcaaaggccatcccaagactccttggggatcagcatctactcccacaacatactcgagcagtgcctcgtcactcgaagactcctactttggtcccatttgtgggtgttgcatatacgcgatggaggggtgtgcactccctgagtggctaggttgggtgacaaacaccatccccttccatgcaccataccccaccagccttgcgtcagagacacagcagggcagcccatcccctaggttaatgtgaccatgtgacagggatggactcggcacgagagaaannnnnnnnnntacccgaagactcatattttggtcccatgtgtgggtgttgcatatacgcgatggaggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttgaatagttggtacaggggactcttgtacaaacaggaatcgttgaagtagttgattaaggcaaaaacaggccagaagtaagcgtcaattgaagaactcgagatacggcactggtagcttctggccatcagtagactgtctcttggagtcggcccctgtgtgnnnnnnnnnnaatgaatacttgggacaggggacttttgtacaaacaggaatcgttgaggcagttgatgatagcaaaaacaggtcagaagtaagcgccaattggagaactcgagatgcggcattggtagcttctggccatcagcagactgtctcttggagtcggcccctgtgtgtgccaaccaaatgtggtccttggatttcaacatcatcactgcgctgacgctgcccccaggaacagcagacaacttgagttgtgtggtggtaatgtcaattcgacatgacatggacaagcaactcggggattggcgtaactttgtccttagggcggccctgagcttggacatgtgggacttgccactagccccacagccnnnnnnnnnntagcagacaacttgaggtgtgtggtggtaatgtcaatccgacatgacatggacaagcaacacgggaatgggcgtaactttgtcctttggtcggccctgagcttggccatgtgggacttgccactagccccacagcctggatcatgcgtcgggtcgaactggcctatggcaggcgatggtttctttctttccccgggatcgccgaacagcaacaaaacggtttcgaggggaccactgcattgcacagttccaaaggttttggcttggatcctgcaaaggattcatgatgacagaattgccctgacgaggccctgagtgcttcttccttgcgaggccctccctgcgaaaccccacccctcctcctcgtggacggcgactcgccacgcccatgacgctcaaagcgagcgtgaacgtggtcctgggaggccattggggctctgcaaagcgactgcttcatgctgcggagcgaggagacgccgcgacggtcaccgaggtgagcctcgcctcggaggttacgggaccgggctcgcagtggcgccctgtcagtgcccccaacgcgcagtcctcaccagcctgtgcccgccacttcccaggttctcactgcgcaccctcaactcgctgccttcgggggcttcaactccagcagcaccccgctccaccgagctgctggtgagtgtgtgtgggtgtgtgtgggtgtgtggggtttagaccactggccaccaaaggaaacccggccggtcgtcgccccctctcttgctggtgtacggggccatgttgatggcagagagtgcatggatgccctatcagaggtccacctgtggagttgttcccaccgtgccgtgccgtgcccgcccccccccnnnnnnnnnncgctggtgagtgggtgtgtgtgggtgtgtggggttcagaccactggccaccaaaggaaacccggcc

SEQ ID NO: 43143 - DNA, 61 bp, Chlorella protothecoides
aaacatggctaccccactgcacagtcaggggggacctggcagaaccatcgctggtggtctt

SEQ ID NO: 43144 - DNA, 69 bp, Chlorella protothecoides
gggcacctgggaaagcacagcattttgggggggggaagaggtgatacattggaggggacgagcacggcg

SEQ ID NO: 43145 - DNA, 469 bp, Chlorella protothecoides
  modified_base (101)..(228): a, c, t, g, unknown or other
cgccagctctcgctcgcgcttctggcgcgcagggtcggccagggtagtggtccctttgacgcggcccactcgcgcgctggtgccctccacgctggcggccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggagggagtggcttggggaataggtgggaggcacttgtgagtatgtgcagagaggggtgggggtcccgtaaggtgcccaccatacacggggcgggtttttggtatggagccgacacgaagaggtgaggagagcctgggatctggagggcaggaagagatggcaaggaggagccctcgccaacggatagctccccctgcccccaagaaccacaagacactgcacactcgcgcatcgcccgga

SEQ ID NO: 43146 - DNA, 63 bp, Chlorella protothecoides
cccccccccccccccccccccctccccccaaacgaccgacctgctttcggtagatcttctcct

SEQ ID NO: 43147 - DNA, 19711 bp, Chlorella protothecoides
  modified_base (180)..(189): a, c, t, g, unknown or other
  modified_base (1072)..(1081): a, c, t, g, unknown or other
  modified_base (1375)..(1384): a, c, t, g, unknown or other
  modified_base (1589)..(1598): a, c, t, g, unknown or other
  modified_base (3239)..(3248): a, c, t, g, unknown or other
  modified_base (3353)..(3362): a, c, t, g, unknown or other
  modified_base (3496)..(3505): a, c, t, g, unknown or other
  modified_base (3638)..(3647): a, c, t, g, unknown or other
  modified_base (3836)..(3845): a, c, t, g, unknown or other
  modified_base (4048)..(4057): a, c, t, g, unknown or other
  modified_base (4913)..(4922): a, c, t, g, unknown or other
  modified_base (5321)..(5330): a, c, t, g, unknown or other
  modified_base (5519)..(5528): a, c, t, g, unknown or other
  modified_base (5892)..(5901): a, c, t, g, unknown or other
  modified_base (6293)..(6302): a, c, t, g, unknown or other
  modified_base (6550)..(6559): a, c, t, g, unknown or other
  modified_base (7014)..(7023): a, c, t, g, unknown or other
  modified_base (7899)..(7908): a, c, t, g, unknown or other
  modified_base (8158)..(8167): a, c, t, g, unknown or other
  modified_base (8744)..(8753): a, c, t, g, unknown or other
  modified_base (9331)..(9340): a, c, t, g, unknown or other
  modified_base (9447)..(9456): a, c, t, g, unknown or other
  modified_base (10358)..(10367): a, c, t, g, unknown or other
  modified_base (11157)..(11166): a, c, t, g, unknown or other
  modified_base (11706)..(11715): a, c, t, g, unknown or other
  modified_base (12302)..(12311): a, c, t, g, unknown or other
  modified_base (15023)..(15032): a, c, t, g, unknown or other
  modified_base (15487)..(15496): a, c, t, g, unknown or other
  modified_base (15888)..(15897): a, c, t, g, unknown or other
  modified_base (17452)..(17461): a, c, t, g, unknown or other
  modified_base (18460)..(18469): a, c, t, g, unknown or other
  modified_base (18799)..(18808): a, c, t, g, unknown or other
gggggaggattgcgcagggaggagctgcagcaggatgcctgagaagccatgagtgcaaagccatgccgcgcgcttcgacgaggcacggcacgcagggattctgtggggcctcagagctccccacgccttccccctttctcagccccgcgagccctccgccctccacactccgcgtatgtnnnnnnnnnnggcaggatccctgggaagccatgagtgcaaagccatgccgcgtgcttcgacgagagacggcacgcagggattctgtgaggccttagagttccccacgccttcccccttcctcagccccgccagccctccgccctccacactccgcgtatgtgcgcaccgtgagggctgcctcgacggccgcccggacggtgggcgtgcccaggagccccggctccaccctgaccgcctcccccagcgccttgagcgcacgcgcacgtgtcgcgggggcggcggcggccccgtccagggtgtccaggatccagcgcaggagcacgtgccgcgcgcgcttcgtgcggccctgggacgggcgaggaggtgtgtgtgtgtgagacggagcaggagtgaggttgcgggctgctggggaggagggcagcatgcccagtcgttggtcacgcctgctccccagtccgcccactgccaggggttcttgctgctgagtctcgtcagtcctgctccccctccgacccaaacaagtcacatcagcccaaggctctcccaccccatccaatacctccccacatggccccttcaaccccctctcagcacaccagggatgcagctctggaggcgcggcccgcctcagcatccgtcagtctggtggtgccgaatggggcagcctccaagaggcagtgggcctgcaggagcagtgcctcggcagcttcagccggcacagcctggggtgcatcgccgggtgtgagggtggatgcctgcggtcggaatcgtagtaggtcggcctgttgagcaccaggcatcggcaagggacggcaaaccgcccagcgaagcgggcgacgtgcccagatcgagactcggagcctgaacacaagaggcccttgaattcatcgcnnnnnnnnnntgcccagcaaagcaggcgacgtgcccagatcgagactcggagtctgaacacaagaggcccttgaattcatcgcctacggtcgccttgcctgcctcagctgctgcacgccctccgcatagtgcaggaccgccgcaaagcgcgccgcatgtggaagcccacacgtgacaaggtggcgggtcagcgcagccgtcgcagcgccggcgggatcgggcgcctcgccgccctctgcatgatggaaggaggggcaaccgtcggcgactgcgggatgcgtcgtcagactgctgactcaccccnnnnnnnnnncgatgtaaggaggggcgaccgtcggcgaatgcaggatgcgtcgtcagactgctgactcaccccaccggccttgcagccatccgcgttgcccagtcccaactgcaccgtcgtgcccctccacctgccccacaggaccactcgcctgcggcctggtcgccgcctgcccacgccacgtcccgggtcggcgtgacgctgaggaggcccnnnnnnnnnnaagtcccaactgcaccgtcgtgctcctccactagccccacaggaccactcgcctgcggccgcgtcgccgcctgcccacgccacatcccgggtcggcgtgacgctgaggaggcccaggggaccgaccagcttgcctgccaccgccaggcagaactgctccatgcccgcatctgcagcgcgcagagcgccagggcgtggatgcagcggctggccctcatggcgattccaggtctggccagctgcagcattcatcgccacccttgcagcctcagatctcttttgcagcccccgcgccccccccaaccccaatcaccctacgcaccccccgttctggaggcgcacaccagtgcgggcaccaggcggcccagcatgcactgcgccgccggccactccggcgcccaggccaggcccaccagctccgccaccagcgcttccagcgcggcgcgcgcgtcgtgctcggcgtcgccacgctgcgcgcgctgggccgtgcagcgttccagcagcccccgccacacgccgtccgcacaggacagcgccggcgccgagcagtcgaggccgggcgcggagcaggcgccgggggcggggagggcgacgcagcggtgcattcccgcgagtagggccgtggcggcgtgcgtcgcagcgcgacacggcagctcgacgctggggtgtggaggcacgcccggcgtcatgcccggcgcagggtccctgagacctgcaatcgtcgcgcgcgtggtgccgccgcccagcggcagcagggcatggcgcagcacatcggcgacgacctcctgccggagctcgggacaggcgcccagcacggctcccaccagatctgagcgggggagtgggtcggtggcagtggagctgagcgcgagtcaggagcgcggtgtttgggtgcggcgcgggaggatcagaaccccatgacggccacactcagcctgctacgccgagccgcgtccatggcccgacctcctccacccccagcgcacctgccgcccgcgcgcagagggccgccgcgctgccggcactgcccgcggagcccagcacctgggccgcgcaggtgaccacaggtcccagcgcgtgggtgggcagcggctgcccgggcccggagacaaggtcggcaaggctggcgagggcggcctgagcgtggtggcacaccgtctggaagtcggggccacgcgccgcctgggccggtcctccacgagccttgccctcctcgtcgggactggtccccagcaagtccgggcggaacagggacgcccaggccgggtccaggaaagggagcaccgaatggcaggtgaccgatcggagtgagcggcagatgcgctgcagcacctccacatctgatgccccttctgcgacggcggaatggagtttgaagtggtgtgagagtcgaggtgtcggtcataatcaaagacccttgcctcctgttggtatcccaatggagggcctcatgtgcatcgtcactgttgacctgaggctgggcaccgcacctccagagagaaagggatgcagagccaggatcaggagacatcgggtgcccaggatgttgaccttgtatgcttgctcctcaggtgatccgtcctgcatgaatcgcagcaagaagtgagggatctccggttcccggcctgaagctgaaataaannnnnnnnnngatggaatttgaagtggtgtgagagtcatggtgttggtcatggttaaagacccttgcctcctgttggtgtcacgatggagggcctcatgtgcatcgtcactgttnnnnnnnnnnccccagccctgcatgcacgaaaccctgcatccaggacagccccaatgctgactcccctccaaccccaccgacttccttcttaccctatcaggagtggggcggcagggctctgcgccaccagccgctacgagcannnnnnnnnntcccagccctgcatgcacgaaactccgcatccaggacagccccaatgccgactcccctccaaccccaccgaccccttctcaccccatcaggagtggggcgggagggctctgcgccaccagccgctacgagcannnnnnnnnntcgagctgcactgcaccagagctgtgagcagccggtccagggcctgggaccgtgccggccagtcggtctcgccgctggccgcatgcacaggctcctggcgcaggtactcggcgacggctgatgccagcgcatctgcgcagcattgaggggattacttgatttctgtgcatcctggcctgacactgctgnnnnnnnnnngcgactgcgtcagcgctgatgcgacatcgggtggcagcacaggtcccggcagcagcttcccggcaacggcgtgcagcatggcagggcacgagctgcactgcaccagagctgcgagcagccggtccagggcctgggaccatgccggccagtcggtctcgccgccggccgtatccacaggctcctggcgcaggtactcggcgacnnnnnnnnnntgaggcttgtcggcagagttcgtcttgggagggtgccatctccttcttgatgcaggtcatggtgaatggcaagaccgtgcgcctttgctgcggagcaacagcctgtgggcgggagatatggccttaacacagcctggccctccaagcattgatgtaagacttcagacagcacaaaggacctgacacagaacagctttcaagtacaaccctcacccctgcgagcggctatacctgaggcattgttaactgtggcgatggggtcatgacctgactccgattggctgcagcaccagcatgtgctccaggagtggttttctcaccggtctttcggcgtgcggaagcccgcgtgccgggccgagaggccagcgtggaggtggcgtcgaagagggtggggctgatctccagcaactgggcttggaggggggtcatagcagcagaggccccaggcgtttcgtcacaccgaggattcctgcaaaaatgacatgatgcaataaacaatttatcaactggtcgcttatactatgcatgctttttgttgcccggtggcatgggtacgacaagcaagcccatccccgtcttacaggaaggagacgtcggtggcagcgatgaggcccgccagctccttgacaaattcatctgatacctttgatgatcctgtatcctccgtacagcagcttttgtagtcgtcggaaggagggaatggggtgggcaggaagcggtggaatggtgggtccggaagcagtgtcgtctccagtcgacatcggtaaacagctggacctgacatgatgctattataatgttaatggtccaattcacggatccatataagccccgatgaccatgcgcgagtccggcnnnnnnnnnngaacagctggacctgacatgatgctattgtaatgttgatggtccaatccacggatccatttaagccccgatgaccatgcgcgagtccggctagtctgcatgctcagctatttgtatttcaagggattctttcttcccgctacaatcggggggcgccagaactcccggcctagcccaaattcgcagcaacagacggagatcgtatcgccatctcgtacccgaatcgtcctggtccacaccagcacacaaactcagaatatcgatagcccacatcggaatctaccgcgcgtcggcgcgcttctccgtttgcagaagagcacccgcgcggagagtcaccaaggtgcaaaaaccggcacccggcgctaacatttttgacactagactcgaactggcgtagtgnnnnnnnnnnctgtgcagaagagcacccgcgcggagagttaccaaggtgcagaaatcggcacccggcgctaacacttttgacactagactcgaactggcgtagtgcggaacaagttggagcgtaattcgcctcattcaacgtattccagaaagttcggcgagtgctcaaggaaccagtctcgagataccgttgagccgnnnnnnnnnnatctcattcaacgtattccagaaagtccggcgagtgctcgaggaaccagtctcgagataccgttgagccggggcacatggaagtccccaccccgacatggaagcctcgtcggccagtactggagcccctcaccatgaacccctggccctcgaccagcgacaggcagagcggtgatgcttcggtggacctgagcatgcacagttgcccatccagggttcaacccatggaggtgagacaggaattgttaccgtgtgggtcatgaacagatgctgagactcctaggttgccatcattcagtctgcagcgcaatcttctgaactgcctggttgtctctttttaaccgcaatgttctcacctccctccnnnnnnnnnnccttcagtctgcagcgcaaccttctgaagtgcctgattatctttttttaaccgcaatgttctcacctccctcctccgacctggatccccagtttgatggcgcctgctcaccgtccaaggacttcaacccttttgctgcaatggaaaccatggaacaaaccccaatgccggacggccgggcatgcagtcccactcagcagccctgtccacccgtcaactgttacaaggatgggccgccacctgacacggcgcctcaaggtgagacgcacgtgtgtgcaggcacaccggtcccacgaatatgccaaacactctatgggctggacgatattgaacgagggaggtgcgcagcattctccctgagtacaccctccctccctctgtatccctgcaggnnnnnnnnnntaaatactgtatgggctggacgatgttgaacgagggaggtgcgcagcattctcccagggaacaccctccctccctctgtatccctgcaggaatcgcaaggacatgcccccccatccaagcgcccaggaaacagcggctccccggcaggacaaggtgaggttaagttgaggggtttacttgcccatcactacttggtagtctgtgaccgtcaccatgcagaaggtattgcaggcggtcccaaccccgcnnnnnnnnnnggttgaggggtttacttgcccattgctacttgatagtctttgacagtcaccatggagaaggtattgcaggcggtcccaaccccgccaggacttcagcctgacgccatcgccgcgcgccgcgcacgttcacacgcgtgccgcctttgccgtcgtcgcagggcacggcgcgtcctgaagcttgccggggacgaaggcacggcgcggtgcgcctctgcccccgatccgctgcccggccatgtggtgacagggtacagccgcaagcgcctggaagaggacctggtcagccccctgatcctcaggaaggccacgcggagggtggaccccctctgcccctccagcctgctctccggcctctgcatcgaggggaggggcgccggcggcgacgggctgcgctgaccgtgcccagccgccagaagactcacggtgtaccagacacacccacccattgcaatcannnnnnnnnnaaggggcgccggcggcgacgggccgcgctgaccgtgcccagccgccaggaaacacacgatgtaccagacacacccacccattgcaatcattgaaagagcgagattgaaactgccaacccccactctccttcctgccgcctgcagcgtgcttcggacctggcccctgcccaaactccacgtcatgtcattgcatgtcagtgccggtgtgggcaaatggcaagggtggagggtgtgtgtcagccacgaacagaaagggccagctgaacgcctaggtatcggaagattccccattcccactcgcgccgccaccccccgccgctgccgccgccgcaacaaggcccttgagctcgccgcaggccgccagcgcggtaaggaggttgaacaccgccggcacgtagtctgtccggcggcgcaggttttcgtccgaccaggcggcgcgcctcgagcactccgcgtccagggcggcggagaggcgggcgccctcgtgccggcaggccgccagctcctgggcggccgggctcgaccccggcgccgcctcctccagcgcggcgcaccgcacccagttgtcggtcagggcgtcttgcagcgcggtgcgacggcacctgcacggcgtacagacgagtgggtgggtgggagtgcgtggcgagggcccaaggcgctgtgcccgggtcctcatcccagcctcgacgcagttctggtccagtcagaggcccatgctcgctttggaggtctcattccaaggccttcatccccaggcttccagtgcaaagcactattcgcaggcctccgccatcacccccactcccggcccctgcgttccgggtcccaatgcggccctccccatcgcacagcctccagagccgccgcccccccccnnnnnnnnnnggaagggttcgatggggaggggcggggtgggaggggtgcttccattgggggacttgggccgagcaccgggagctgtgcccagggccagttcaaagccctgcctcaacttccacccccaagcccagcagccccgcaacagcctcacacctggccggcctcgccaaggcagacggggccaggctgcagaccatccaactcccagatggagccgtctcggtgggtgtaggccacgaagtggaaggcctcgccnnnnnnnnnncttggtgacggcgaggaggttgaacttgatgtcgtgggaggcatgctgcgcgatccgcttcttcatcgcgctggctgcagtctgcgtccactcgtccttgagaagggttcgacgaggaggggcggggtgggaggggtgcttccatcgggggacttgggccgagcaccggaagctctgcccagggccacttcaaagccctgcctcagcttccacccccaagcccaacagccccacaacagtctcacacctggccggcctcgcccaggcagatgggtccagcctgcaaaccatccaactcccagatggagccgtcccggtaggtgtaggccacgaagtggaaggcctcgccctcggagtcattgtcggggttctccgggaggagcgcatgcggggcggtgaagctgttgtgcaccctccggatcgtctcgctgttcccgatggcctcgcctgggcaccgggggatgaggcagagagcaggtctgaatggagttgcaggcatgggtgaggcatgacaacatgggtccggacggccagcaaggggccccagctgagactcacccctgagatctgcggggannnnnnnnnngtgaggcagggagcaggtctgaagggagttgcaggcatggggtgaggcatgacaacatgggtccgggcggccagcaaggggccccggctgagactcacccctgagatctgcggggaaccccgccgtgaagttgcggaactgggacagctcctccccaatgtccagctctggtcggttcagcaggatgctgagtatggcctgggttgcacatgcgttgttgatcaccctgcaatgtacatgcctcgccagggtggtgaaggcctgcacagatggcagctagtatgctgtccattccccacactggcaccctcggcactgcagcggcttcattgagaggcccctgccagcaagctcattccaaatcaggctaggtcaggagttctttcagcctgcgactcactgcttggcgaagaagatgccgcgctcctcgtactccgggtatatggaacgggccaccggctctgcctgccacttgaacaagaagatcagtccgtagatgggcctgcacaccacaagaagcgtttgcgtcgcttcaagggtgcggccatgatcgttatttgcagagcattgccctcagnnnnnnnnnncagaatgctgtccttcccccgcactggcaccctcggcactgcagcggcatcagtgagaggcccctgccagcaagcccattccaaatcaggctaggtcaggagttctnnnnnnnnnnggcgtttgtgtcgcttcaagggtgtggccgtgatcgttatttgcagagcattgccctcagcgctccccgcatcgcaccccagggccgaactccctcccgccgtcaacccactcgaaagcttgcagggagtcggcatccagcgagtacagctcctccacctgcacgcatggcgcttgagctgagacacaatcgaagcccatcgtgcgcatcgaacgggatctccagtagactcacctgcacccccttgacgccaagcctctcgatcagttcggtgaacacgcccgggtcgctctcgatggtggtccacgcctccccagacatgacaacctgttaatctcttgatgtaaaccacatggacgacgtttcgcgttcgtcctgcccgtgcacacctcgtggtcttatacatgcaggccacatccgcggaaccgtgcaaggcgcgaaattggcaaaacggggggggtcctgggctgcccagcagcggcccccaacccaggcaggctttcagtcaatcagtactggagagggacaggtatcaataattaaatgcaggggggggaggggaggggcccgcggcagcggcccccccccctgctcacgccgtggcctcgaccggggacaggtggatggcccccagcttctgctcggcgagggtcacggaggaggcggcatcccccgccgcgccgccgccgttctcctgcgcgctgcgcttggccggcgaggtgcactgctggctgctgccgtggcgcctgtccgccgaggacggggagcgcgtgcgcttgggcgacctgctgccccgggaggggttggggcgccggccgtcgtcgcgcggggggtccacaggccctgagcccgtgttggcctcgcactcgctcacccccgccagccaagggtgctgcagcatnnnnnnnnnnctccacaggccccgggcctgtgctggcctcgcactcgcccacccccgccagccaagggtgctgcagcatctgggcggcggtggccctcttgctgggcacgtatgcgagcatgggcagcaagaagtcgcggagagccagggcctgcagagcgggggagggtgggtgggtgggaggggtgggtgcgtgccacaggcgtgcaccaggacacagcagagactctgcacagaatctgtgacgcttcagggcgtcagtatggcaagcacaggtgcatgtcaaatcctatgttgaagtctcaggaccccacaacccgccatcccctccccgcacgacgatggctcagagaattgtagtctatcgattgcgcatcagccccgaggcgtagccaagggtatgcatcgtatggtgtgtttcctcactgccaagcgcatgctggaggcccatgccggccatgatcgaaccccctctgttgctgtgtccggcccatccaaatgtaaacattccccacaccagccactcacatcctcgcgcgggaggtggtacttctcccgcagcacccggtccagcggccagtggttgagccggtggatgtggcgcaggcggccctccctggtgaagaactcgcgggagcgcttgccgcccagggccacagcgcgtggcatgcgatccagcaactctatcatctgatgatgttggtaaagggtgggtgggaagctgctcagcatggctggtgtggagcagtcataccgcgacatgcaccttattgtcccagcacagaccggggtcgattccnnnnnnnnnngctctatcatctgatgatgttggtgaagggggggggtgggaagctgctcagcatggctggtgtggagccattataccgcgccatgcacctgattgtcccagcacagaccggggtcgattccaggaaataagaaaccccgtgtcagacctgtgccaggtggtcttcgtcccgcgtgtacccatggccctgcttgggctcgaacaaaaagtcccctgtcgccagctcaaacaccatgcaggccagcgaccagatgtcagccgaggtgtcgtacccccccccgagaatgacctggcaggtgatgaggggaaggaggggagcacagtgagttccggacatgatggctgagagcgtgtgaggccgcgcaggttctgtaacttagaatgggagcgccaaagagctgcacatgctgtgcaatgcgcaaggcttggcagcatggcccatggtatggagctcatgagattgcaaaggtgaagtgcatgagtgtttcaagcaaagaggtgttggtgctgaaaaaagtagagtgacggggaaggggccggnnnnnnnnnnattggaatgggagcgccaaagagctgcacgtgctgtgcaatgcgcaaggcttggcggcatggcccatggaatggagctcatgagattgcaaaggtaaagtgcacgagtgtttcaagcaaggaggtgttggtgctaaaaaagtagagtgacggggaaggggccggcctgtcccatgggacaggccggcccgcccaggacgtcacccgtcgcaatgctacccaattgctgttggccgtgattacgagggtggcggacacatggccccgccacaggggcaggaaccagtcaaccacctagataccaaacggccttgcatatgctggggtattgttctcacccacgtcaaacccccgcccagccgaggtggacatgcaacaaggtccaggcgggacagcacatgacctgagggggtatgcacctgtaaccaggccacacagacacaaactcagtgcctgtccatcaggtttccacgccatattctcctgctcgtcctcatatccctcccttgccctcctccgtcccccacccacccccaacccagcacacctcgggcgaacggtactgccgcgtctggatgtcgtccgtgnnnnnnnnnntatgcaacaaggtccaagcgggacagcacaagacctgagggggtatgcgcctgtaaccaggccacacagacacaaattcagtgcctgtccatcaggtttccacgccatagcctcctgctcgtcttcatatccctccctcgccctcctccgtccccaacccagcacacctcgggcgatcggtactgccgcgtctggatgtcgtccgtgaagtgcttgtgcacccagcaggcattgccaaagtccacgaccttggcgggcatggtcagcagccgctgctccagagcccgcaggtccacgcccggggaggagggccgggccttggcgtcggcggccccggcctgcgcgccggcgtcgcccctggtctgcgcgtcgccgtcgctcgcctggcgcgccgcatccccccagccggaggtctgcgccccggccgcctcctcctcctcctccccctcgctctcggcctctgcgccgggcccccgcccctgcttcttcttcaggttcttcttctgcgcgcgcgtcagcggcactcccgcagcgaccagccccgcaatcttgccctgcgcggcggcaggcacggccggcgccggcgccgcggccgcgcgccgcgggcgcaccgggtcgcgcagcatcacgttctccggcttcatgtcggtgtggattatgcccggcccgctgtgcatgtggtccagcgccaccagcacctgccgcgtcagcgcgcgcaccacgggcagcgggatgccgcggtggtcgtataggcggatgagggtcagcaggttgtcgcccagcacctcgaacagcatgcagacgtggcgcccatgcgggcccacgtgatcgaaggagtccagcaggcgcgcgcagcagcaggcgtcggccgggtccgactcccggatctggcgcagcagcgtgatctcgtcacgcgccgcctcggcatagtgcggcgccgacttcaccaccttgagcgcgcccaggccgccggtgtgggtgtcgcgcaccatccacaccgtagagaagtggccccagcccagcttgtgcagcacctcgtagcggccatccttgaaggtctcgccgatgtgcacgcggtggtacccgcctggcgagacggtgggattgaggaggatgagcaggagcctctggcccggggaaggcctcggaagggcaagcaggctgcataatgcacggcgagccacagatgaagggcccgacaggtgagccgcttctggggggagtcacccaaaatcaaatgcatggccccctcccattcaattcacagcacaggcacctcacccttgcagtagtcctcctcgtcctcctgatcgtcagaatacgaccctgaggcgctgtcgggctccgtggagctggttgagggattgcgatgcttgtctgtgggagaaagagggggggttcaggaggggcaagcttctgtgcaggccgccggggcttccaggtcgaccgcgtggggacgggcacaatccccatttctcaccatgcttcttgccagtatgatgggagtgggaagactttgggatcggcatgccttgcggccgatggaaggggtgaagctgccgggaccagagtacgtgtttgcggccctcgaacagcctcaagggaggacgggagggtcgtacgctccctcctcacggtccctaatcccctctctgattatttgtatcacggacactgatgacgtacggcgtcgagcgctggcagcttgcattgagatgcgctcccttcacagagcacgggcaggcgcagctggagatgggggcctttagcgcgggaaaatcctgggacagggaggggcggcctgccatgcaggcagagctccagaacctcatcaggcgaatccagggactcggccatccctcttcgcaactccgtgccttgctaccacaatctgcgaggtgcgtctgcgtgctggcaccgacactgctgtcttggctgcggccgatgggcgaggctgccgggtcggcacaacgaatgcaagagacctcttcgctcccccctcgcaggctcatcctcgaagacgaaagactagggaggcagttcacacctgtcgaggaccaacatgtctgacgggtgaggacgtgctgctgcgctgctggtatatagagcacacccctgcgggacgcccatggctcgccggcactccagatttcgcgcatccccaaatctcacttccaccctcctcacctccctcttgtgcagaggggatagcccacgtgccgctcccgcggcggagcccgtcgctgccgcccccggcgagcctatggacgtgaacactgccgtgcagcaggtactgaagaaggccctggcccacgacggtctgtcccgcggcctgcacgaggctgctcgcgccatcgagcgcggccaggcccagctggctgtgctggccgacgactgcaaccagcccgactacaagaagctgatcgaggctctctccgccgagcagggcgtgtccctgatctccgtgcccgaggcctccgagctcggcaagtgggccggcctgtgcaagatcgacgctgagggcgaggcccgcaaggtggtcaagtgctcatgcgcagtggtcaccgactacggcgaggagacgcccgccctggtggtgctgcaggagtacctgaagtcccgctgaaaggggacccataagctgatgagctaggagggggtgacctctgcggagcgtgcgcacggcggcgaggggagggagttagcagcccnnnnnnnnnngaagctgatgagctgggagggggtgacctcggcggagcgtgcgtacggcggcgaggggagggagttagcagcccaccttggagtctgtgcaactctcgcccacatgtatgcggccatgtgcatgcgctggtcatgcggtgtaaccctgctccctgctgcgtgcagccactggttttggaggttgggggacggaaggggacggtcctgcggcgccgcacgtgtccaggacacgccaccgccgtgacagattctggacgggtgctgggggcccgcagtgaactacgtctgcaagtcgacaaaccgaatctgcactgagtgcttcgtggacgcttgtagcggtctgatcatagattacaagggccatgctcccaacccaggctgccagcaggcgcctcagcgcgtgaggtccagtagggagtacaggtccgagcgcttttggtcgttgtacggcaccnnnnnnnnnngggcccgcagtgaactgcgtctgcaagtcgacaaaccaaatctgcactgagtgcttcgtggacgcttgtagcggtctgataatagataacaagggccatgctcccaacccaggctgctagcaggcgcctcagcgcgtgaggtccagcagggagtacagatccgagcgcttttggtcgttgtacggcaccccctttcgctgctccgcgatttggtccaggtccacctccgcgtgaatgatcgcctcgctttcctcggccgcagccaccacccgcccaaaggggtccaccagggcagaatggccccaggagtggtagccagcggaaaggtcgcgtgccggagccactccagccacatacaactgggatgtgatggaggtaggagggggatgtgnnnnnnnnnnattgtgcaagtacaggatgtcgcttgaggaccaacagggatgtcaactgggtcagacagcggccaaaaccctcctcgtcggaggatgcccgcactcgcaaggcacgcattcagcctcgaacgccagcatgcctgtgcatccacggccctcgctcgcaggaggagctcccagtgcgccgggcccgtggtcatattgaaggcgcctgtgcgcggatgggacacgatagcctgggtggggccagctgaaatttgggcctcaggacgacagggacggtcccacgaggcacgcagagggtcaagctggaactcgtcggtgcctccagcctcactgcacctgggtagacgaggagctggcagccccgcgcggcatagagggccgctagctcggggaaccggatgtcgtagcagattgccaccccgatgcgacccagctcggtgtcgatgacggtcaggtcggacccgggggtcagcacctccgattccttgaacctgattttcccagggatgtcaatgtcaaagaggtggacctggtgggaatgaggtgcagggtggtgagtgacccgggtgagctgaggcgatgtcttgcgcaaacaggcataggatggagcatgcggatgggatcattctgacatcctcgatccctacccctgattttccaccttgcgatgccgacccaggagctccccttcggggccgtagacaaaggaggtgttgaacagcttgccctccgagcgttccgggatggagccgcccaccagcacgatactgttggctgcggcagcgtcggagagcatggcagtggagggcgactcgcccccgcccacctcctcagcgtagactgggaagctatcgttggagtagggtgagttccagatctcaggaaggattaccaggcgggcgccctcgcccgccgccctgtcgatggcctggcgagcatgctggatgtttcgctccttgtccgcacccacagccagctggcaaagtgccagcttgaactgcgtggggatacaagaatgtcgggacgaggagaacgatcagtctgggggaacgcacattgcggtagcatagtgccccgcatggttgaacactcgtgggtgggggattcgtcacgtgcaacaggacgagtcatcccatggatcctcacccgcacaccttggatttggagggggtggggggtgcgatgcgatctgtggtagcattcaccgccgtcgccatcgttctgaggggtgatgacagcggcccgatagggccagtgctggcacgctgaggggtcttcgcaaggccgggcgctgctgcagagattccacacgcaaaccctgtatggatcaggtgaggcatagatttaagaagtgatcggagtttggacatgacaacctatcgtgggtgtatccaaactcagagtaactgtgcgccaatccgcggccccaccccacacccggctccggaagactgtcgtcgcgccctggcccgtgctttccaatgttggtttttgttttacgggtgcctgtccgatcgtgcgacgaaaatgcggggcatcacagtgcaattcgctggtnnnnnnnnnngccgtgctttccaatgtgggtttttgttttgcgggtgcctgtccgatcgtgcgacgaagatgcggggcatcacagtgcaattcgctggtaatatactctgtacagaaggtgcacacatcaacagccttgtgttttcctttcgaagaggtctgtgagcgcccttccatacgattttcgatgctcgacttcatccccgcccaccgctcgacagagggcattgtctcaggcctaaaacaggccttgcgggaagctgcacatgacagtgaccagactcagcctcaaccttcgacaactcagctcacgcttcaagtatcggccctccacaatgctttccttgcattgtcagatgcattcacagagagcttgggtaggtggtggctgtggggctcaaactcttggtcatttccatgcaatgtgcagcttcatcatggcgtacatttactatccagagtccttacaagagcggagcacgcatgcctcgagtcactcaccagccctgcatttgctctcacagaggtcagccgtcgtaaggagctgcagtgggaggctgccatgcaggctatccaacagagatttgccagtgaggtagctgctgtggaggctcttcgagatgactaccaccaactagcgtcgaagaatgccggcctacacaaggaaaactgctggctgcgagcaagggtcgaaggactggaggggagcatcagcaggtgtgagcttcagtttcgcaagtcctgcattcctcaaggaatcatgtcaggttgcatttgtaatgccaaatgcatcagctcaaattcctgacacaagctcacattctgcagctccctcacttgcttcttgcccacgccaggctggataccgagctctggaaacaggagcgccaaatatgggacgtcagccaggaggtgaacatggccatcgaggccgacctgccagctgcctgtgaatttgctgcaaaggagtgggccgaccagcacctgcccggcttggcaaggaccgcgnnnnnnnnnngcatggctatcgaggccgacctgccagctgcctgtgagtttgctgcaaaggagtgggccgagcagcacctgcccggcttggcaaggaccgcgctcgctgacatcaacaacaagcttgttgaggagggttctgaactcagcagtgcacctgctggagatgtggaccactctggtccttcccattggaggaactacagcttatgaaaggaaatggattcaatgatctgacgacggcacttgtgactcatcatctcactcagtgctccacaaccctgagatatgcattggcgactcccatttggggaggcttggtgctttcagagctgtaaannnnnnnnnntggattcattgatctcacgacggcacttgtgactcatcatctcacccagtgctccacaaccctgagttatgcattggtgactcccattcggggaggcttggtgctttcagagctgtaaaaacaagagcatctgtacaggggaaggattgcatgcctgtccctggggttgtcaaaaagcgcattactcacaggtcaggggatttgtactgctgaagaatgtatggaattgggcacaccccattgggagtcgaccaactccccccagcaacagtcaggacatgggttgcttcggttgacattcgtggtgggatgctttggggagaagaaaagacagtcagagccaccacccgacccgctcagggtgcccaggccgggcgatggccggcggcacgctccctcaggctgcctatggtacacacgcctacaatacaacaacactctccgacacagcacggctccaggtgctacgcagcacctgcagtcccggctgactatgggcccagcgggggccgaccatgctcccatgcagcattgccgactcaggccgcagagccctgcgggcagaggcgcaccgcggcgcgcagcgccagctccggctccggccagtacccccacaccggctccacctgcgccagccagcgctggcgctcgcgcggcgacgcggcgccgtcctcctggaccccggctgcgtctgcatgacgctcaccgtcgaccgccgcgtcgctgtcctccccgggcgagccagccacctccccctcgcgctccagccagccgtagcgccggcccaggtcccaccgctccgcctcgcgcagggcggggacgctggtgggcgcggcgggcgaggctccgcccggcgcctcgccgtcgctgctctcgtcggcgtcggggccggggcaggcggcg

SEQ ID NO: 43148 - DNA, 348 bp, Chlorella protothecoides
  modified_base (97)..(272): a, c, t, g, unknown or other
acgcgctgcgcctggggcggcgcggcgcggcgcagtgaagccgatggcaggcatgggcgcagggggggctgtgctgtcccctaaactacttggagtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcatagagagaggggggattccaacagccctacatgtagaagctctggggagcagacgctgagagtcaaacagaca

SEQ ID NO: 43149 - DNA, 94 bp, Chlorella protothecoides
tctgtgcatgcctggtggtgacaagtgtgcccccactaccctgcatgcccttgtagactgttgttattacttgccctggccttctcacatcccc

SEQ ID NO: 43150 - DNA, 64 bp, Chlorella protothecoides
cccggcccagggccgctcagcgacgccgacggctgggcccccgggcaccgcacaggcgggcgcg

SEQ ID NO: 43151 - DNA, 71 bp, Chlorella protothecoides
tttgtagtcgtggtggtgtgggggggggggaagggggggggggaacaataaactgtaggatcgtcccgcga

SEQ ID NO: 43152 - DNA, 61 bp, Chlorella protothecoides
gggacggagaggtggcgggagtcgaggcagggggagtggatgtcttggggctggctgctgg

SEQ ID NO: 43153 - DNA, 133 bp, Chlorella protothecoides
ttccacaagggaccccgcacactccctggcgtgcacctttggcgacagaacccgggctgcatcaggatggcgccgccacccacgtgtcaccaggccacacacagggtggcatgcactgcccatcgtcgatcga

SEQ ID NO: 43154 - DNA, 62 bp, Chlorella protothecoides
cccccccccccccccccccccaaaaaaaaatcccacaaatgcaggcatcgagctggcctgga

SEQ ID NO: 43155 - DNA, 73 bp, Chlorella protothecoides
gtcgcgcttgttcaagtgcgcaggcgtgcggggggagggggggccacgaccaggggcgctgcctgccagacat

SEQ ID NO: 43156 - DNA, 71 bp, Chlorella protothecoides
cagtctcatgccgcacccagcggaaggatttatgcaagaggtccgccgcaaccctcccgtcgcctaccccc

SEQ ID NO: 43157 - DNA, 76 bp, Chlorella protothecoides
gtacatgcacggtacacgccctgtgaaagggaaaacagcgccgatagggggtgcagcgcaggcagcagcagggtgc

SEQ ID NO: 43158 - DNA, 75 bp, Chlorella protothecoides
tgagtgatattgtggagtgggtagatcttgcagctggcttgcgacggggggggggggggggggccccgggggggg

SEQ ID NO: 43159 - DNA, 9618 bp, Chlorella protothecoides
  modified_base (477)..(486): a, c, t, g, unknown or other
  modified_base (749)..(758): a, c, t, g, unknown or other
  modified_base (2008)..(2017): a, c, t, g, unknown or other
  modified_base (3782)..(3791): a, c, t, g, unknown or other
  modified_base (4118)..(4127): a, c, t, g, unknown or other
  modified_base (4473)..(4482): a, c, t, g, unknown or other
  modified_base (5011)..(5020): a, c, t, g, unknown or other
  modified_base (5261)..(5270): a, c, t, g, unknown or other
  modified_base (5650)..(5659): a, c, t, g, unknown or other
  modified_base (5757)..(5766): a, c, t, g, unknown or other
  modified_base (5930)..(5939): a, c, t, g, unknown or other
  modified_base (6171)..(6180): a, c, t, g, unknown or other
  modified_base (7127)..(7189): a, c, t, g, unknown or other
  modified_base (7471)..(7480): a, c, t, g, unknown or other
  modified_base (7864)..(7873): a, c, t, g, unknown or other
  modified_base (8356)..(8365): a, c, t, g, unknown or other
  modified_base (8722)..(8731): a, c, t, g, unknown or other
  modified_base (8868)..(8877): a, c, t, g, unknown or other
  modified_base (8949)..(8958): a, c, t, g, unknown or other
ccgtggggacgcacagcggcggcccgctgcggcggggacgggtcggtacccgctgcgcgcccaggcgcaggcgggcggggacggagggggcgtcgccacgccacgggtacccgcggtagcccggggccgtggcgggggccgcgccgggccgcacggccggagtccgggatcagatgcaagcggcagtgggaatgacagcggggcacccagtccggcccggaatgacgagtggctgagtggctcggacggcgaggcctcaccgccggaggtggtccagctcatgccctcaacggctcgcgccgataacaatgtcggttgatgggctgcggggtggtatcggggtcggtggggtgggcggatttcttatgtcagcctcctcacagcgttgctggcgggacctcctgtcgctgcctgggctgaagaccccgcatctgcatttcgctgttttgcctgagcgcggtggagcatggcagatgnnnnnnnnnntgccgataacaatgtcggttggtgggcagcggggtggtattggggtcggtggggtgggcagatttcttatgtcagcctcctcacagcgttgccggcgggacctcctgtcgctgcctgggctgggaaccccgcatctgcaactcgctgtcttgcctgagcgcggtggagcatggcagatgctgggctttgtcgccagtagtgttccccccagccctgcgcatccttgccctggcaccctccctctcagccgccccttcccaccnnnnnnnnnncgggctttatcgccagtagtgttcccctcagccctccgcatccttgccccggcaccctccctctcagccgccccttcccaatctccctcctcccaccgcatgcatgctcacaggactaccccgaccatgccgtgctgaccgctgccttcagcccctgcgggcactgcctcttcatcggaagccaggactgcactgcgtcttgctggagccaggcgccgcatgtggaggcgggggagcctgagacgtgcgaggcgctgccgccgtccttccacccctctgacacggtggaggtgcagcgcggcgccgtacatctaatcgcgttctcgcatcgcggcgaccgcatcgccatcggcaccaaggacggccacgtcgaggttcgtgggccgggggagctggggggcgcggcgcaggcctggtgtcctgcgtgcttccagcgagcgccgcaggtgcgagcagtccagccactgcttcgccctcctgaagtggccccctgcccacaaccgtgcaaaggtgtggcgtgtcaatgacaggcggtcgaggaaggtgcggaacggcgaatggacgcgggagcatcagatttcgctgccatgcacggaggagcagagtcgccaggacgagcggcggggcctgccaggccttgccgtcaaccagtttgcatggaactcggacgacacctggtgaggcatatatgctgcagtggctgtccccgctggtgtgcaccagacgggggtcatgcctgcgaggagacaggggtcaccgtgtcaggtgcaggcaacatggccgtccttttccacccaccaccgtcttcgcaggctgctggcggcctcctcccaccgcatcgtgtcggctcacagcattggcagccggggcaacaccccccactttcgccacttccctcccctgcaacctaaggccggcgaggacgtccccagccattcgggggcgatccatgtgctggaagcccatcccagtgaaccctccatcttcctctccgcctgctatggcggggatgccatgctgtggcgtctggacgggggcggcacaccgttcctgtgcttctccaggtgcggggggggggagaggattcatctggcgtggtgcgccgcaccctgggcaaccattgctgccgctgggagaatagggcctgcggtctggcgggcggcactggactgcgacgtggaaggcgcggggtgttacactcgagggtttttgcccccggcgcgtgtttgagcccgcaagcttgccggagnnnnnnnnnnggaggattcatctggcgtggcgcgccgcacactgggcaatcattgctgccgctgggagaaaagggtctgcggtctggcgggcggcactgggctacgacgtggaaggcgcggggtgtcacactcgagggtttttgcccccgacgcgtgtttgagcccgcaagcttgccggagtcagggggcacgcaaaccatcacatctccctccctcccccctgtcgtagtctaatgtcgagacctggagccctgcagtgggaggctgcgctgccctacattgagggccggtttgcgccggatggggagagcttctgcctggcggacgcctgcggccaagtgcacctcttctcgtgagcctccgggagcagtgttggctgcagtggctgggtgtcagcccttgggacatgcatcggggcatcagcagcaaatgaatgtgggtgtcccattggggcctcccgttcccattcccaaggcacctcaagcaagcgctgtgccggtgcccggctgctccagtcgccgccgcccggcccaggctctcctgtaccgccccgcacgacacaggacataccggcgactggaccagggcatcctgccacgtgtacccgaggaccagttcttcaccacagactacaggcagctggcgctgactgaggaccggcaggtcgtggatgccgccctcaaccgccctttccacggtgggcggctgcagtggacagcatgagctgcgggaaagagtggctgaggttgcccgagggatctgctgaatggggttccagccgcagacaggatgcctgggtgcgcatggagcagcagcagatggaggcttggtccgcaggtcgctcagccagtgagggacctcagcagcagcttcccggcggtgacctgtctcccagatactccagcccttgctcatcgaccccaacgtgcgccacacatgcagagctggcgctggagcgggtgctctgcgacgccagcaatgtgaactatgacgagcgtattcaggacgcattccgcgagggtcggctgtcagccatgccggaggcccagtggcagaagctgagccactcgcagtctgcctcctacgcctacgtggcgccgccaaccctggccgccgggtggctggtaagtgggcgctggcacagaattggcatcgggcgctgtgctgaggacaacaaatgtgctcctcgcaagacgaggagtatcagggctctgcctgtccattcccatcatgcccctgaggagacacacccctgcagctgacccgtctcctccacaaagacccgcttgctccccatcccccacatgtctgtcccaggttcagcagcggggtgggcaagagacggagacggcggatgccatggcacaggtgggcgccggcctggaggcgtattacgtcagttgcccagatcttttgcgagagatggtgaggcccaagtaccacctggacctatgggatgttgacccgcccagcgaggacgaggagcgactgcgtggcgaggaggatgcacggcggagggtggccgcagatggagtggggactgaagcgtggcggtgggagggtagcgatgaagaactgggcgacagggcgacgagcagtggaggaggtgcgaaacaggaggggctgggaagggcggggcagagggaatggaccctgccagcttgcagtgatggtggggggcgaaggcgacatgaggagcacgagggcagggcccgggcgcgaccaaggctggcggtcaaagggggttgcgccgacccggcgcgcccctccctcnnnnnnnnnnagcgaaggcgacgtgaggagcacgagggcagggcccgggcgctaccaaggctggtggtcaaaggtggttgcgccgacccggcgcgcccctccctcgaccatgcaatgcgctgggcttgaatggcgagacggggcatgcagcttcgagagtgctcctggacgcgccggcgtccttccgcctggcatgccgtctggatcccttgatggccagtggggctggctgcctgccagcagcaactccctgtgcacccctgcccacctgcaccccgccccatcagccgcgtgttctcccccccctcacgcgcgtgcagaggcgaggccggttcannnnnnnnnntccctgcccacctacaccccgtaccatcaggcgcgtgttccccccctcttcacgcgcgtgcagaggcgaggccggttcaataccattacttcagcaactcggagtcaccctcggatgcctcccgcgacgctcatgccaatcagcggcggcggcacgtcctcaggcacagcgcacggctcgccgcccgccaggccacgcagggggcggagaggccgggcacgccggggccgggtcccgccccgcagacccgggagcagcagcgcgcggacagggtgagcggagggacctcggtctcttgggaggcggggttatggattccttggtctgggtggctgggttggagctnnnnnnnnnnagcggagaggccgggcacgccggggccgggccccgccccgcagacccgggagcaacagcgcgcggacagggtgagcggaggggactcggtttctcgggaggcggaggtgtgggttccttggtctgggtggctgggttggagctggagagccctggctggagaggctcgagcatgaggatgggtcgtgcgcccacggacactgcaaagcactggtcgacgacccgcacccatgtgggcgcgggctggcgcggtggctgggtgagcacccccgccccctctcccgcaggctgcacgggcggcgcggcggcaggaggcgctggcggcgggcgcgggtcccccgcagcccccccggccgaggaggggggccgggcgcgcgcgtgatgcgcccacacaccggaatttcgacgatgatgatgatgatgatgatgatgaggtgggtcaggttgggccgatgctgctggcgcggtggggtctgagaagaagatgccgagcacccaaccccagcgacgtttcccgccgcacgtgtctnnnnnnnnnnttgatgatgatgatgatgaggtgggccaggttgggtcgatgctgctggcgcggcggggtctgagaagcagatgccgagcacccagccccagcgacgtttcccgccgcacgtgtctgggcatcgtcccaccatctcccccactcctcacccagtcggcatcctggggtgatgcgggggcagggccgcctgcccaggctgcctcgcgctcgtctcgcaggcgacgcgctcccccgcaaggggnnnnnnnnnngccaccatcaccccccccccctcccccagttggagtcctggggtgatgcgggggcagggcctcctgcccaggctgcctcgcgctcggctcgcaggcgacgcgctcccccgcaagggggtccgcgcccgtcactcgcctatgactggctcagggtcctcaggcccggcatgcccttctactgcccgcaggtcggtgggtgggtgggatggcggaggggtccgagccacagagtcgagggagcatgatgcaggggagggcatgtgcatgcaccagctccagcctctggatggcagggccatggggtgcgcccccctttccttagccacgggggcctgtcccccgtggcatgcctccatgcacgccgccttcccccccccccnnnnnnnnnngtggggtgcgcccccctttccttagttgcggtggcctgtcccccgtggcgtgcctccatgcatgccgcccccccccccccccccccgggggggggggnnnnnnnnnntcagggtccgccagccatgagtagtgccagttggtcaacaagggggcgggggtcgctcaggctgtcgccctctgaaccacgccccactgatccacggctcatgcccaacccccactcactgccccaatctcgaccccaaaccgcttggcccccttggtagatgnnnnnnnnnngctagccatgagtaataccagttggtcaacaagggggcgggggccgctcaggctgtcgccctctgaaccatgccccgctgatccacggctcttgccccacccccactcactgccccaatctcggccccaaaccgcttggcccccttggtagatgggtgatcgtgtggtgtacttccgaacgcaacacgccacgtgctggttgaagtatcacccaatggactttgatgaagannnnnnnnnnctcgcaacacgcgacgtgctggtggaagtatcacccaatggactttgatgaagagcgtgactgggcgccgtggcacgtcgtgaccggtgggcttcccatgaacgatagcgagccttgcaggtgaggggggtggcctggccacgcaaggcgcgtgcaagtgtactgctgcgcacgcagtgcgtaccagtgggatggcagtggcacgctgagtgcgggatctcaaccgtccccacccccttcaccctctaacccccgggaggatatctttgtgcacagggtggtcggcatcagctacgttatcgatgaagaccttggctacaccgcctgcgacgtgcgattgagattggacgccagcccctaccgatcccacactgaagaccccagccagccccaccagccacccccatacgaggtggggcgcgcgaagggtgaagtcgcctggtgggagggggtggggtttgggagcgcagccaggtgcacacgaggctgccgctgccgaccctcagggcaccatggaccgtggtttcttgatccagggagccctccctcccccccgcccctgccccagggcgaggagatgacggtgcgccttcctcacccggaccgggatatggaggagtttgtgattttggcacgtgactttggacggagcctgagccaacacctggccatcggggacaccgtcgtggtgcgtggaggcatggggtcgtgtgggcgggtcaggcccggcagtcccagccagcacctttggctgcaggtgctgaagcatggggcggggtcgctccgcccctgtccaggttgccggcccgtccggcgacagccagatgccctggccgcgccaggcccagcctcaccgccgccgtcgcgcctcactgttgcccaggggttctggagggaggccgtggaggaggaggaggatgcccagggggccctggccggcgccaggnnnnnnnnnnnnnnnnnnnnnnnnnnnnnnnnnnnnnnnnnnnnnnnnnnnnnnnnnnnnnnngccagtactggaagggaatagtggtggatgttgatgatcatagaccatacatgcacaaccatccctcccccttggagcccttccacctccgcgacaccctcctctacaactccgtccgcgtgacgtgggaaggtgagcgtccggggacgctggaaccaaatgccgaggaaggggtggggggtggggtgggggtgggggtgcatggcggcggggacgctgccgcgtgcttgcctttcatctaaagccgctgggggcgggcagtccaccctcaccgctgccacnnnnnnnnnnaggtggggtgggggtaggggtggcatggcggcggggacgatgccgcgtgcctgcctctcatctgaagccgctgcgggcgggcagtccaccctcaccgctgccacctgctggacaccgtggtgcgtcccctgtggcaggcattctcacagatggccaaggcggttcgggcgtgaatttcgaagaggcggggctggaggagggggaagccaacaccacacgctcctgcttctgggagctggacacctgggaggactttgtcggggagaggcggctgcgtgaccggcaagccctggtggtgagcgtgccagtgccggcgccctgcccaggcgtgccagggtacggcctgggattttaggcagggccccttcgccagcaacccagccnnnnnnnnnntgtgccggcaccctgcccaggcgtgccaggggacggcctggaatttcaggcagggccccttcgccagcaacccagccttccctagcgggcagggccagggccttgggcgctttgccagcgctgtggcacgtgcatgctgtctccgcccttctaccctccccacaccaacacgctctcgcccgctcaacaggtggatgcggagaggcacagggcactcaaggacctccttcccgggtctcgaggcagcagagccgccagcgacgagctgatggagctgccgggccaggacgtgcagttcgtgtcggtccgggggacgccagagttttacaatcgagtggtgcgcctgggtgggtgcaccgagctggtttcctgggatccgggtgcatccaaccttgctcccaggctggcaggctctggtagtcaaagcaccttgaccaagttacggaattgacggggtgctcagctcggatgagagcaggtttnnnnnnnnnncagcgccttgaccaagtgacggaattgacgggggtgctcagctcggatgagagcaggtttggcaaggtttggcaccagagccaacattccaccacagcgttgcggacccatcatcccctgcaggtgccactgccgctgtgcccggcagacgtgatcaggaggctgtgcaatgggtactacaggacctgcgaagcctttcaccatgacctcgaggtgagctggcgtacgaggagtgattggaagggagtatgctcaggcctgctgggtatgcgccgggtcgtgcagggaccattgctgaggttggtggggccaattgagggcttggttgaacctctagcacgcccgccgacgctgtcnnnnnnnnnncggcggacgaggagtgattggaagggaatatgctcagggctgctgggtatgcgccgggtcatgcagggaccgtcgctgaggttggtggggcagttgagggcttggctgaacctctagcacgcccgccgacgctgtcnnnnnnnnnnctctcgcatcaggctgccgctgctcacaccgaccacctcgccccctgcacaggcgagggtgaccgaagacgnnnnnnnnnnacctgcgtgttgttgggatggagagggttgaagggagtggaaagagttctgaacatccgcagtcatcaccctcatggccctgctcagaggtctgtctggggcagatcgcggatgcactgccccgtctcgcatcaggctaccgctgctcaaaccgacgacctcgcccctgcacaggcgagggtgaccgaagacgatattgtgtttagggtcgcccccgacaggggccccatagacccttggccatggctgagcgaaacggaggggaggattggggagggtggtggggactccgacgcggcgggcccgtcccacggcccccgtcaccagcccgggccgcagaggcagggcctgcgaccacgccgacagcctcgcgcggggtcgcccccattgcggagcggcggggcgcggcggaaacggagccgctctggctcccacgacagcagcagcagcggcagcggcgggtgggagacggactccgacggcggccgcgggcgactcagcggccgcgccggggccgccggggtctcctggccccggcgaggcgcggcaggagccagccaggtcgtgcgcctgaacctgcgcggcgcctcggcgcgtgccgccgggaccacgcgctccggaagggctgtgcagccgccggcgcgcatggcggaggaggcg

SEQ ID NO: 43160 - DNA, 153 bp, Chlorella protothecoides
agatgctgccctcccaggcatgcagcgtccagcacgcccaccgctggaccccatccagcacttccccacgcatcaccttgcctctcctatgagcatctgcccacccccctttcccccccccaaaaccagtcccggagcaaggcagacctactc

SEQ ID NO: 43161 - DNA, 68 bp, Chlorella protothecoides
tcggccatgagggcggctgcatggaaatccaagggggtggggggggggggggggccgtaagaggcctc

SEQ ID NO: 43162 - DNA, 1410 bp, Chlorella protothecoides
  modified_base (246)..(255): a, c, t, g, unknown or other
  modified_base (597)..(606): a, c, t, g, unknown or other
  modified_base (857)..(866): a, c, t, g, unknown or other
  modified_base (1189)..(1331): a, c, t, g, unknown or other
gttaagaaggttctgattgacttttgaggggcgggtgggtgggcggggttggagacccacgtcacagggcaacgcgcctgcatctcacgatctcacgcccacccgctctcacgctcaaaggctcgctagagggctcggtgcgggccggcaggtttgtgccccgtgggcacgccgcagataccggcaccctggagcgcctgccacaggaagggcatcgaggcctgagcgcgggcgtggcacccgtgnnnnnnnnnngaaggttctgattgacatccgaggggtgggtgggtggacggggttggagacccacggcacagggcagcgcacctgcatcgcacgatctcacacccacccgctctcacgctcaaaggctcgctagagggctcggtgcgggccggcaggtttgtgccccgtgggcatggcgcagatgcgggctccctggagcgcctgccgcaggaagggcaccgaggcctgagcgcgggcgtggcacccgtgccccccaccctggccccactgcgtggcctcggcggcggcgcaacggcggcgccggcgccggctgcggagcggggaggccagccaggatccatcctccagccnnnnnnnnnngctgcgtggcctcggcggcggcgcgacggcggctccggcgccggctgcggagccgggaggccagccaggatccatcctccagccgcccctccccacggccggggaggagagcgacacctcgggcgacgagtgcttcacgccctccctgctgcacctgctctcctccgcgtcggcggaggactcctttgccccctcggcctccgtggacttggcgctggccgccggcctggcccccgaccccgccgcgctgnnnnnnnnnnatgctctccgccgcgtcggcggaggactccttcgccccctcggcctccgtggacctggcgctggctgccggcctggcccccgaccccgccgcgctgctgacccaggagctgggggccgcgagccatccccccgagcaagccgcggtgggttcgctgggccgcgccgggtccctgggcgtcctgctaggggccggggggccgtttgcgggcccgccggcagacgggggcctgcccgccggctcgctcggccgtgcggcgtcggcggccgcagcgctcccggcgctgcagaccaagacagaccaccccggcttccctgtggctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcagtggactcagcggtctccaaggggagcgttccgagtccaacaccacggcggcggcggcgggcgggcaggcagaag

SEQ ID NO: 43163 - DNA, 61 bp, Chlorella protothecoides
cagctgtcctggagtacctggcagccgaggggctcgagttggccggcaacgccgctcgcga

SEQ ID NO: 43164 - DNA, 61 bp, Chlorella protothecoides
gatcgacgagatgcaaggcatggcgggtgggggggggatgggatgggtaattgcttgccag

SEQ ID NO: 43165 - DNA, 101 bp, Chlorella protothecoides
gggccaggggctcgtgtgcgctcagcctgaactctctcccatgcacccccaaagactctgacatcccccttcgcccctgcatcaggtgctgcaagagattg

SEQ ID NO: 43166 - DNA, 497 bp, Chlorella protothecoides
  modified_base (132)..(141): a, c, t, g, unknown or other
ggagccgggcgcgggcgtgcgcgcgcacgtagagggccacggcctcgtggccgtgggcagcgctcgctgggcgctgggcgacgagggggagagcggggcaaaggagggcgtcggcgccgcgccccggggcgnnnnnnnnnnggagggccacggcctcgtggccgtcggcagcgctcgctgggcgctgggcgacggggaggagagcggggcagaggagggcgtcggcgccgcgccccggggcgtccacgccggcaacccgagcatgcgttcgtcgcactcgccggcaccgccatcacctgacacaggttcccacgccgtggtgcacgtgagcttggagggcggcgcgctgggcacgctggagctggcggacgaggtgcggcccgaggcgcgcggcgcagtggccgcgctgcgctccctcggcctggccgtgctcatggtgtccggggacggggacggcccctgcgcggccgccgccgcgcgcctgggcatcgcccccg

SEQ ID NO: 43167 - DNA, 61 bp, Chlorella protothecoides
ggcaaccgaataccaaatctggggggggggcccgcagtacaaacggagcaaccaggatgtc

SEQ ID NO: 43168 - DNA, 61 bp, Chlorella protothecoides
ggtgggtgcagagtggtggcgtatcggtgggggcgcctaaagtctgcgccgagggattcca

SEQ ID NO: 43169 - DNA, 84 bp, Chlorella protothecoides
gcagggggcggatgcccttggagggaggggggggagctggtagtgggtgttgggaggatcagagaaatggaggttgacttctgg

SEQ ID NO: 43170 - DNA, 15346 bp, Chlorella protothecoides
  modified_base (111)..(120): a, c, t, g, unknown or other
  modified_base (200)..(361): a, c, t, g, unknown or other
  modified_base (782)..(791): a, c, t, g, unknown or other
  modified_base (1377)..(1386): a, c, t, g, unknown or other
  modified_base (2337)..(2346): a, c, t, g, unknown or other
  modified_base (3395)..(3568): a, c, t, g, unknown or other
  modified_base (3729)..(3738): a, c, t, g, unknown or other
  modified_base (4723)..(4732): a, c, t, g, unknown or other
  modified_base (4845)..(4854): a, c, t, g, unknown or other
  modified_base (5040)..(5053): a, c, t, g, unknown or other
  modified_base (5726)..(5735): a, c, t, g, unknown or other
  modified_base (7057)..(7066): a, c, t, g, unknown or other
  modified_base (7603)..(7612): a, c, t, g, unknown or other
  modified_base (8157)..(8166): a, c, t, g, unknown or other
  modified_base (8730)..(8739): a, c, t, g, unknown or other
  modified_base (9183)..(9192): a, c, t, g, unknown or other
  modified_base (10113)..(10122): a, c, t, g, unknown or other
  modified_base (10291)..(10343): a, c, t, g, unknown or other
  modified_base (10727)..(10736): a, c, t, g, unknown or other
  modified_base (11582)..(11591): a, c, t, g, unknown or other
  modified_base (11792)..(11801): a, c, t, g, unknown or other
  modified_base (13154)..(13163): a, c, t, g, unknown or other
  modified_base (13865)..(13874): a, c, t, g, unknown or other
  modified_base (14314)..(14323): a, c, t, g, unknown or other
  modified_base (14893)..(14902): a, c, t, g, unknown or other
gtggggggtggggcggggtgacgggggcagtgcctggggtgacgggggcccagtgcctggggtcgtgccaagcggcgggaagatgtggagcggcagggcagggggagggcnnnnnnnnnngcagtgcctggggtgacgggggcccggtgcctggggtcgtgccaagcggcgggagattgttgagcggcagggcagggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccgaccagtacctcaacaccgagcccttcatcaaccgcatcaaggaaacgctggagagcaagtttggatacaagggcgaggaggccaaggccaggctctgaggagctgacgcagggaggggagaggggggctgtccgccctgtgtgcacgtgcgagggtctcggaggctcccgcaaaacatgcaccccgtagctcgcccgtgtaaatccgaatggacctggcaggggagtcagggctggtccactggctgcaaccgaggaaaggtctcccaggctcagcaagcctgtgtccccgcctaggctgctgcccagaagctggtggtgtttggccagagcaaactgtgtgctatcaaagcaagcagttgttagcatgtgcagcggtgccagtggggctgtctgtcttccacccccgtgatgggatnnnnnnnnnngcgcagcgaggggaggagggggctgtccgccctgtgcgccggtgcaagtgcctgggaggctcccgcaaaaatggctccccgtagctcgcccgtgtaaaatccgaatggacctggcaggggagtcagagctggtccactggctgcaaccgaggaaagttcttccaggctcagcaagcctgtgtcctcgcccaggctgctgcccagaagctggtggtgtttggccagagcaaactgtgttctatcaaaggaagcagttgtcagcatgcgcagtggtgctgtctgtcttccacccccgtgatgggatggcaagtgcggcgcaaagcacaatgcagcagctgcgctgatggtcgaggcgatgtcttcatgggggggttttgaagctctcctcagctttacatggtgaaaggtctacatcatttcatgcacagatgcacgtggtggtacacttgatggttggacatgtccagtgccaaaggacggatgcggacggcagactcgaggacctggtgcagggccatgttgtgatgcagcaatgtcgtcatgggggatggcttggtagggtgtaggtatggacttgcttgcaagnnnnnnnnnnaggggtgtgtgtgaagctctcctcagctttacatggtaaaaggtctacatcatttcatgcacagatgcacgtggtggtacacttgatggttggacatgtccagtgccaaaggacggatgcggacggcagacacgaggacctggtgcaggtccatgttgtgatgcagcaatgtcgtcatggcggatggcttagtagggtgtaggtatggacttgcttgcaagtggatgtggaaggtgtacagaggtgaaccttgaaagggttgaaacacgttgctgtgaccatgactgcaaacaagataatgcaatgagtataactttctctgacatggagccccgtggaaagggcgaaagggggaaagggctgtaaggaaacgagaaaccctcacagatggaaggccgcattcctggtggccagggaggttagctttcgccagaaattcttcttggttttggcgttcgtcgaccgcctcaagtgggccctggggccactgcctatctgggcaagaggggccaagaggggcacgagcgcttgagatgttggctcaggggaggtgcaacacccatcaagcatactgtttgctaactctgagatgaggcagggaagctagattcaagcagcttcccaacttgacctccgcaagctatacaatgagactcacctggtaagttgttgtgtgcagagcggtgaaatgtgcctcagccatcaccagcctggagtccatactaccagaacgcttggacagcagtcgcccaacacagtctgactgtgctgctaagagcaaggctttggcagctgcaagctggacggtggtgctctggaggctggctatgaactcagagcgctgcaccctgtaggcctcgctctggcgatatgcgtgctgcaaggatcgccaggcttcccacgacgccgtggtcatgtcgaccatttctgcttccagatcggagataagcnnnnnnnnnntgctgcaccctgtaggcctcgctctggcgatgtgcgtgctgcaaggatcgctaggcttcccacgacgccgtggtcgtgtcaaccatttctgcttccagatcggagataagcttttttgcgactcgagagcgctctgtagtctcctaaagcctggctttcacagtttcaatctcgttgtgaccgctgtcgagatcctcagccgggctggcctccagcagtggcagcaggcagtgcagcagcatacaagatgcagacatcgccgccacgctaatgggatagtgtatctcccaaagctcctgcgagtagtagcggacgggaagtgactctgcaatctgtggtttgtactgggtagggtcctgattgcactgatgggcatttaggtcgtatggcgagggatgcgggagtgcagcttgcacgaggtggacgacgttcatacagcagcttaagaatcccatcccaatgattgaggagcatggactgaacttggccccacaaatgctcttgctcagctatacgccaaagggctgaaagggaattcctgtcgaggcgctgtgctgagtacgaacgacgcctagccctctacaaaaacatttacggccgtggatgacagatatttgagctggtataacgaattctgcacacgtttactacttgatgggggaagctttcagggagctatttaacccggccaatgttggtgctggcaagtggattgtcactggcagtttgcggaagttggtagcttaccggtgttgcactgtgaaagctctggggatatcaaaggtcaaaggcgatgcggattgagtacttcggcccggttccgtcggagatgcgttagaactcccccagagcgcaccgcgcgcgcagaacggaaggtgccgagtcggttagatctcaactaccatcagatgcattcgggagtgtgttattctcaagcgcattggcaagccgacagagagagttgtcgaggacagaattaatcgcagaacatatcagaccacattggtgcagtagtaattagagcctgcacctcgtcgtctggtatcgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaccagcccctcctccaccgtgccccagagcccccccgactccgatgccaaggtcaggccccgatgggacgctcggatgctgggccatgatattccgactgcatctgcgcccaccatctctaagctttccggggacaggttctgcattgtcggggttgcatnnnnnnnnnnttcgaggacagaagtaatcgcagaacatatcagaccacataggtgcagtagtaagtagagcctgcacctcgtcgtctggtatcgttgtaccccagcaaccatgatcgggaacctagaagcgcttggggctgccgtttctcccagccgcagcgcaaagaacgcattctctcgcgtcgacaagggtcacatctcgtgcgagctagacgtctggccgaccgaggtcggccccccgctcggggaagccagcccctcctctaccgtgccccagagtccccacgactccgatgccaaggtcaggccgcgatgggacgctcgggtgctgggccatgatattccgactgcacctgcgcccaccatctctaaggtttcccgggacaggttctgcattgtcggggttgcatgctctccatgctgtgatccctcatgccgacgcaggccccaagcacctgctgatgtggaccagcattagacacccattgtggtgcaccaagccttcccccattcacccaccttcaggaagaccaggaggtgccgggcgtcagcgggagctcggccgagtggtccatccagcccaacatgatctccagcagcaccacacactccaccgaccccgctggcgagctggctgccgcgctgagcgagcggaacgccctgcgctctcagctggccgacgcagagaccgactttggcgaggccggcaaccgcatcttcctactcaaggcccgactggcagaggagaagctggctctggatgacgacctcgatgccctgaagtaccaaggggccaaccacgcccagcttgagaagctggtcagtcacaccaccgcctgcctggaggacgccaaggccgagctggtggcggtgcacagcatgctcgccgcagcacagcatgctcgtggcgaggccctggctgcagcagctcccgaccccggcgcgggggttgggggcatcacacgggaggtggagcgctatcgccgcatcttcnnnnnnnnnntaaccgcatcttcctactcaaggcccggctggcagaggagaagctggctctggacgacgatctcgatgccctgaagtaccagggggccaaccacgcccagcttgagaagctgnnnnnnnnnntcccggcgcaggggtggggggcaccaggcgggaggtggagcgctatcgccgcatcttctcctatgctgctgccaagcagaggctcgtcaccgtggtgaaggtgcgaggctggttgggtggtggggcagccctcccagctatgccctgaggaagctcaggtgccagcacccccggcaccccgcagcnnnnnnnnnnnnnntgcctagtccctcccgcctgcaggccatcgtccctgtcaagaagcctgtctgtcccccctcgcccgcccacgacgccacgcccgcaccgaccaagcgcttcagctggtccaggctgtcctgcttccgcaagcccctgctccaggcatgaaggggtgccgtggcactgcagcctggtgcctgcccccttcacttggaacagtacacatgggtgtcaacatccttgcgcagccttcaggcatatgcactgggccagggcaggcatcactgcgatcctcggtcatcaccaacattccgacatatctcctaggtgactgtggactcccaaacccatgagcaatccccggtggtgtgaatacccgaggagccatgcacaggagagcagcttctcaggtgctctccacaccttctgctgattcatctaatacgatactgtgcggacgaggcctcacagcaattttctgctcctctgaactcaagggcatccttcataccggtgctcaatcgtgatagcagaaccaccttgctattcttgacttgctctttgaatgactttagtcctcttgtgcaagcacatgaccgtgatgccttgtaaatgtctgcatgtacatccagaaattccggcagagaggtagggaaatagagcagagacccaaatgcttagatgttattcannnnnnnnnncgtctgcatgtacatccagaaattctggcagagaggtggggaaatagcgcagagacccaaatgcttagatgttattcactgggtgccctggctgcttctactaaaacatgcaggcagagttgaacatcctgcagcatgctgtggattgcatgtgaggtatgtctagacagcacccacagggtatataacacaaggtgcaccatggattgtgagcctgagctcgtcctggcggcatgtcctgcgaggcataggcacagagtctgatttcagcacaggacggtctccctgatatattatatgtgaaacacgacgttgataactacccttgacccggtagttcgtaaaagccatggcctcctgctgtgcgtgcttcccagagggcatctacctgcacctaatgacgcacgaagtgcacagtgactctgaacatcctcgtcaatatgcactgatcacgcgtacatcgtcacaagaactcactgcatatactgttgatcagaaggcagggactggatcaagctgcacagccccgcgatggctgcccagacggtgcgtagtgctagggcgatgacacctgccatcaacctttccaggtggtagagaatgattctttagacgaatcagcctgttgaacctacttttccactgcaggaccctctacgagagttcgcagactccctgcgaggcaagggcggggtggaggcccgggcagccgtgtaccaggcccagcgtgtggagatcgtgaggggcaaggacctgggccggtggatcgcagctcaccccgaaccttcttcccgctttcacaatggaggtgcggaccctatgcgttgggatggtctaacttggggtgcatctgtcttgtccaaaaagtggagcaaagcctgcatgcccgagaccacagcgacacccccgtccctcgaccattcctgccaacagccaagactcctgaggatcaggctaaagaggtggttgagctgctgctgcgccgcaacctcctgcagcgctgtgaacggatgttcaagcgtccacccccaggcagcaagaagctggtcaagtttcccaagaagctggtgccgccgggcccaggggatgtgaaggtatgttcttattacaattatctgctgatttaagagcatgtgctcagattcctctcagccctttatccaagtggcacatgtgccattgtattacacagagcttgcttgcacaaggatggattaacggtacacccacgtgtctcacaacctgccgctcgttattccccttctcgtttcatattgtgcagtcgtttgcagaggacgcgttctatgcctggacgtatgacnnnnnnnnnncatccaagtggcacatgtgccattgcattacacagagcttgctcgcacaaggatggattagcagtacacccacgtgtctcacaatctgccgcttgttattccccttcccttttcatattgtgcagtcgtttgcggaggacgcgttctatgcctggacgtatgaccggccatcctcaccttggatgctggtgttcacgatcctgggcatggctggagtcttggccgcctgcctcttccccctcgccccctacggcatcaaggtcaccgtgttttacctagcctccggcctgctgaccgtcatcctgggcaccctggtgctcaggctgtttgttgcagccacaagctggatcctgacggggaagacactgtggctcctgcccaatgtcctgtctgaggtggggggatgtgggcgcttggcggtgggtgttgacagggaggaatctcacacgcgatccatacttcgccggcgggcactgtgcacattaatgtacaggcttggaggattttggcgtgtgccgtcttggagtgctcatagcnnnnnnnnnngagggaggaatctcacacgcgatccatactttgctggcgggtactgtgcacatttatgtacaggcttggaggattctggcgtgtgccgtcttggagtgctcatagctgcctctgccctccgctggcgtcacacactttgctactctcgcatgtatccggactcgctgctggtcccctgcacacctgcaaaccaacctcaccccggcttggctgcacacccgcccatgcaggaggtgcccctgagcggcctcctcaagccactcgtctcggtgcagcagccagatgaggacaaggcctgggccaacagctggttggcccgcctatcagtgggtgtgagcctggcctccctcatcttcgtgctgtacacccactcccctccaaaaggtaagagggttgttgggtttgggatgtatgctcataagtggcctagccacagtattgacctttgcattaagaagctagaattccgactgctttgacgtgcacaaagctttcccaattccattgagtctcaacaggggctaccccagcacaatacctccgtnnnnnnnnnncgtttgggatgtacgctcataagtggcccagccacagtattgacctgtgcattgagaagctagaattccgactgcctttgacgtgcacaaggctttcccaatgccattgagtctcgacaggggctaccccagcacaatacctccgtgtccgtgctcaccctgcaggcaccgtcacggccgaggcatcaaggtatagggacgagctgttcgacctgttcaacattcggaaagaagggaatgcgcgtctcggcaactccagcgcaagcacggcgtttgaagaggcccctgccgtggaggatgtaatccatgacagtgacctgtgactaccccaataccaagcaggcatgcccttttgtacgtgtaagttccagatcctcggattgtgtgtgaacccttgagtccaccatggcgtaccacacgcacaaaatgcaacaaggtttccagtttgggacttcatctgcctaaaattcctggtttccaaacacgtacaaatatcctcgcaacatgagtaacagatcgatctccattagactatgcaggagcatgccactcagcattaatcannnnnnnnnngtcctcggattgtgtgtgaacccttgagtccgccatggcgtacgacatgcacacaatgcaacaaggtttccaggttgggactcaacttgctttaaattcctggtttccaaacacgtacaaatatcctcgcaacatgcgcaacagatcgatgtccattagacaatgcaggagcatgccactcagcattaatcaccgaattttgatgtattacattcctctggtgtcgaaagcatcttgccagcgggtgtcgcccagggatcttcaaccctagtagatttgcaacggcgatggccgcgacctctaccaagtcggagaaggagaagatgctcgcaggcgagtgtgcattgcaatgaagctgatgtattcagattcattacacgtttgtaaggagccaccgctgcggcaggtgacgcattgatcacttctgttctgatgaaatcctannnnnnnnnncgtattcagattcatcacaagtttgtaaggagcgaccgctgcggcaggtgacgtattgatcacttctgttctgatgaaatcctacacaggcgagctgtactgggctggcgacccccagctgctagcagaacgccgcagcacacgcaagctcatgcggcgatacaatcatgagatcgactatgaggatgaacccaccaagctgtctttgctgaaggagatgggcatcacctttgacgcgcagcacccccccttcttcgagccacccctcttcttggactatggctacaatatcaccgtgggcaaagagtgcgctgggaaagggtatactcgtttgaaccgtgtcttgaggcctttccattcaatagttctgatcatcacgaggctggccggcatggttcatgcagcgctaagctgctggccatctcccccttgtgattgcgcatggccgcgatctcggcccctcacttccctccgcaccgtcaaggttctactgcaacttcaacaccacgttcctggacatctgccccatcaccatcggcgaccgcgtcatgctggcaccgggcgtgcagctctatgccgccttccacccgcagcatgccgccacccgcaacggcggcctcaagcccgagctgggcgcgcccatcaccatagaggacgacgtgtgggtgggagggtcggccgtgatcctgccgggcgtcaccatcggagcgcggtccatcatcgcggcgggggcggtggtaaccaagaacgtggagccggacaccgtcgtggggggcaaccccgccagggtcatcaagaggctagacccaaaccaggccgcagcctgagaatgatggggatgagaaccagctcgtgaaccgtctgaaagatactgggtcctacgaacgaatccaggaggatcctcaccccccttgttcagcnnnnnnnnnngggcctgagaatggtggggatgagaaccagctcgtgaactgtctgaaagatactgtgccctacgaacgaacccaggaggatcctcaccccccttgttcagccccctggcctgcgagagtcttgtcacaaagctaattccgggtgtcagaaaatgggcacgagaggggannnnnnnnnnnnnnnnnnnnnnnnnnnnnnnnnnnnnnnnnnnnnnnnnnnnnccaggtgactacacccacagctttctacacgctgttgtcctccccatcactcaggagcctggcctccaggttggaaaagatgtcctcatcaaaagattcccagccctccccacagggctgggcccgctgctcagtgcctgggacctcctcatcggtagacagcagggcgacgatgactgggagatcctggtctgccgcttggcagggagcgtcggggtcctctagcgcgggggggtcaacgatctcggcccctgctgagtcctgcgctgtgcagtcgccaccaagtggtgctctcactgaggggtccagaatctcgtccctgatctgctgctcgtccagcgaaatggtctccgcgctgatgtccaggccaggcgcaagggcctnnnnnnnnnncagcgcgggggggtccacgatctcggcccctgccgagtcctgcgctgtgcagttgccaccaagtggtgctctgattgaggggtccagaatctcgtccctgacctgctgctcgtccagcgaaatggtctccacgctgatgtccaggccaggcgcaagggcctcttcaggggtgacaggcaccgaggacgctgctgcgcttgagctggcgtcctctggcccctgaacgaggcagtgtgcattctctgcacaggctgctccttctgacgcttggatgatggatgtagcagaatgaaggggctcttgtgttgccgccgagcctacaccttcttcaggctctttgcagagcccggcgtcgaacacaggcggaggagtatcgccttcagaatccaatgagaggtccccagttgcacatccgctggccagggcagcgcccgccatcttggcggcctcagccgcctccggcgcctcggtcgcctcatccaccttccccagctcggtcattgtcgccggttcgccagccacgccgtactcaacaccatctgctgctctttctgccacggtctggaccatggcagagaccacctgctccacctccacctgaccaggcgccgcttcaatctccagcagttgctccggcacggcagcactttgcgtcttgcccttggcaccccgtggcgtgccgagggcacgctcagcattgcccttcttcctcgccatggcggcccgctgcttggccgaggtggcagccgcctcctcgctcacctgggcagtggtttgggtgtggggtagaggtggtttttctcggagcggacttctgccgtgcgctccgtgccgcggcgctccatnnnnnnnnnntcatggcggcccgctgcttggccgcggtggcagccgcctcctcgctcacctgggaagtggtttgggtgcggggtagaagtggtttttctgggagcggacttttgccgtgcgctccgtgccgcggcgctccatcccccgccctcctcccccgtgccgcgacggcgccgcaaccaccggcttcacccctggtacccaccttcnnnnnnnnnntccatgccgcgacggcaccgcacccaccggcttcacccctggtacccaccttcatctcgcgcacgaccttttcgaagagcaggacgaagtctcgcacgacgtggacgacgtgtgcggggtccgtctccttgaaggcctcgccaaagtagtcggccacctggtgcagatcctcgtacatggccttctcctgggcctgcaaggatgttggtcagggggcattgcagcgcgagtgtgttttttgagggcaaacatgggtggctagaccatgccaggtggcgtgtgggaaggctggcagggctggacttcaggtttctcaccatgccaactggcgggcccacccacccagaccattcgctgctgcagctaataaccatcccccccaaccaatgcgcacctccagggcgcagaagcgggtggcggcgtccacgtggaacgcggccatgagctcgctgaacctgcgacatcctgccgcgtcctcctccccatgcgcagactcggccgcacagctggcgtgcccagcgcgcgcagcgtgcatgatctcctcggtcacgccgcgcaggcctgccctcagctcgtcgatcatgccacggatgctggtcagctgcagggtgaagtgtgggggttggtggggaagtgagctccaagcagggaagtagggtcaggaatcgcccagatatgtagcagcaactgcattatctgtggttctcgtatttgaatcagtatgctcaggagccccaacaaggctcctgcagctttccacgcccactcgcctcttcacccaaggtacccgctggccctccctttctcgaggctcctcctcccgtcaccgcagcgtgccccctccaaccctcctctcctttcctacacctgtaacctcgcacctgcatggcagccgcgggccggacggcggagagctgggcgggcagctggacgacgatgtcgccctgggctgccaactggcggaccacaaagtgcagcaggctggtcttgcggtccacgcccttgacatcggccagtttgagcagggtgtccaggcggaagccggcggccgcaccgcggtgggtccccgcattcaggtggttgcccagctccagcaccgccgtcagcagctgggtcaggcctgggcaggtctggagctgggagcaggcgctctgcatgatgcccaggtggtcctcgcactgtgatggtgggtgggtggtttggatgggaaggaggggtgattggaggcggagggcctggtgaagaggaaaattgtgcagggcaggcgaggatatgaaaatatgtatggttctttggtgaatcttttagtctctaaaaatggctctcgattgggtctgcccctgtgcctcctgnnnnnnnnnnggacggtgggtgggtggtttggatgggtaggaggggtggttggaggcggagggcccgatgaagaggaaaattgtgcagggcaggcgaggatatgaaaagatgtatggttcgttggtgaatctttcagtctctaaaaatggttctcgattgggtctgcccctgtgcctcctggcttgcccaccgtcgtgtcttgcagtactccacccagcaacagcgagccccatgcgtaagcactccagccccacccccatccccctcaccaggccggcggtgctggcatacgtcctgctgaagatgaggcagcgaatacgctgcgccaggcgcgggatgtccttgatctccaggaagtaacgctccactgtacccaggcggtctgggtcgctgaccccgcggtgttttgggtggctgccctgcagatacagctccaggtcgcggcgctcgctgtcgtcggggacggcccgagaaagcgcactcagctgctccacgctcaaggccccagcgtccatgctcaccagggcggcctgggaaagtttgtgaggtggagggggtgttccgggtaatcttggtggatggcagtgagttcaagggcagggcgaggggcatgcagtccgtgcatggcggccttggcacgcagcaggtcagacttgattcttaacacctgcccattgattgcctcacagactcgttcagacatgctccaannnnnnnnnnctggcggccttggcatgcagcaggtcagggttgattcttaatacctgcccattgatcgcctcacagactcgttcagacatgctccaagatccaatactatgtggttattcaacacctccagtctccccctccctttcacaaagtcacccaccccaatatccccaccttgatgtctgcaaagggcctgcggatgccggacagctcgatgcaaatgttgtgcgcccggcgatgctccaccagccgcacctcatcgctctttgcgccagaggtcagcttcttcagggcattgttctccaggatctggtgaggcatggtattttgtatggagtttagggctggggaactgggaggacacggggtgctcctcgggagcgtctccagcagtcaggccaatcgtgccacatgtaatacagtggtccagccaacccccacctgccctnnnnnnnnnnggaggcatggtattgtgtatggagtgtagggctggggaactgggaggacaaggggtgctcctcgagggcgtccccagcagtcaggccggtcgtgccacatgtaacacagtggtccagccaacccccacctgccctctcatgacaggagctataaccccctcacacccacgtcccctccatccccacctggaacagggcctccagctcttcgaaattcatggagagatgctgctcgcgagccaggcgccacacggtgccttcacccgctgccttcagcttgtcccagtgcagctgcttcagtcgcagcttctgggcaagctgctgctgcaccgcctcccgtgtgccgccctgggggccgatcgccccagccgaggtgttgaccggggcattctcgtctgtcacgggagcgccttctgttgtcttcgcacctgcggcccaaggaggtgggagcgctgcgatgaatgcaccagcaggcaccgagggcagggaggcggtgtttgacactctggcacacacagcccagtcgtggcaccgtcatgggccccatcccagctccatggctcgcatgcnnnnnnnnnnagtgtttgacactctggcacacacagcccagccgtggcgccatcattggccccatcccagctccatggctcgcatgcagacggaaggcacatgctgtcgcggccccacatggaccccgcaccagacgttggggcctccgggctcagagacagggtcttggcgaccccgtcgcctcctgaaccggggtgtgcaggcgtgggcgggggtgcaggaggtcccttcttggcagtggcagtcttagggggtgggggtggcggcggtggtccttttcccttctttgcagttgtgggcggtggcggaggaggcggagggggtcccttcttccccgtcgagggtgcaggcgggggggccggcgggggcccgcccttcttctttcccgtggtcggcggagggggtggaggagggggaggggcccccttcttggtcgtcgacggcaggggtggg

SEQ ID NO: 43171 - DNA, 61 bp, Chlorella protothecoides
tcacagtatacacaaaagcatggcagggcgggtatccgcggcagatgactctgagctttga

SEQ ID NO: 43172 - DNA, 79 bp, Chlorella protothecoides
ctccttgacgtcggcagggttggccagcgcggaggtccaggcccccgccaccgaggcaaagaggcggtccggggcgtcg

SEQ ID NO: 43173 - DNA, 71 bp, Chlorella protothecoides
cgaggacattcggaaggcaccccagatcaccgcctcagcggggccagcgcacgctcaccagtcggagttgg

SEQ ID NO: 43174 - DNA, 99 bp, Chlorella protothecoides
agactcccgcccaggaagcactgaagggtgttgtggagagggagaggtagggcatcataaacattccactggcgagtgcgataacctgtggcgtcttca

SEQ ID NO: 43175 - DNA, 135 bp, Chlorella protothecoides
gggggggggggggtgaggggtgtgcgcccatccctcaaaccttgcgtccctgcactgaaacgtgcgggagggaccctgcagcgtgcctgcaaccccgatcaaccccggtccctgcagctgggcagggtcggccat

SEQ ID NO: 43176 - DNA, 61 bp, Chlorella protothecoides
gacgtccaccacctccaggcgcagcggccatggctcgtacaccgcctcccagcgcgaggtg

SEQ ID NO: 43177 - DNA, 61 bp, Chlorella protothecoides
tgcgtttttttcgcctggcctagatggaggggaggggtctctgcaacctatgtgcgtcttg

SEQ ID NO: 43178 - DNA, 61 bp, Chlorella protothecoides
gagggtgctgcgattgctgttgccggcaggggtggtgggaggacggggatagcatggcacc

SEQ ID NO: 43179 - DNA, 61 bp, Chlorella protothecoides
aggggggcatggacgaccagccgcaggggctgactggctgtggcaaggggaggaggggtgg

SEQ ID NO: 43180 - DNA, 62 bp, Chlorella protothecoides
ttgtgaatccgatggctatatcgtcgtcgtgacgctgcggccgcgacatgtttgcgtgcgcc

SEQ ID NO: 43181 - DNA, 19534 bp, Chlorella protothecoides
  modified_base (1400)..(1409): a, c, t, g, unknown or other
  modified_base (2492)..(2501): a, c, t, g, unknown or other
  modified_base (3601)..(3610): a, c, t, g, unknown or other
  modified_base (3833)..(3842): a, c, t, g, unknown or other
  modified_base (4284)..(4293): a, c, t, g, unknown or other
  modified_base (4716)..(4725): a, c, t, g, unknown or other
  modified_base (5658)..(5667): a, c, t, g, unknown or other
  modified_base (6702)..(6711): a, c, t, g, unknown or other
  modified_base (8416)..(8425): a, c, t, g, unknown or other
  modified_base (9263)..(9272): a, c, t, g, unknown or other
  modified_base (11087)..(11096): a, c, t, g, unknown or other
  modified_base (11568)..(11577): a, c, t, g, unknown or other
  modified_base (13304)..(13313): a, c, t, g, unknown or other
  modified_base (14130)..(14139): a, c, t, g, unknown or other
  modified_base (14775)..(14784): a, c, t, g, unknown or other
  modified_base (14874)..(14883): a, c, t, g, unknown or other
  modified_base (14992)..(15001): a, c, t, g, unknown or other
  modified_base (17626)..(17635): a, c, t, g, unknown or other
  modified_base (17814)..(17823): a, c, t, g, unknown or other
  modified_base (18384)..(18393): a, c, t, g, unknown or other
  modified_base (18669)..(18678): a, c, t, g, unknown or other
  modified_base (18772)..(18781): a, c, t, g, unknown or other
  modified_base (18923)..(18932): a, c, t, g, unknown or other
  modified_base (19183)..(19192): a, c, t, g, unknown or other
gacagcatgtgggaggtaccgccaccgagcagcaggcacgggcacaccctgcctctaggcctcgcgactcgcagacatgcgccgcagcgccctcctgcacgcctcgcgccctcagcggaccccatagattacccccaccatcccagcacgcacctggttgaagtagtacttggaggccaggcgccagtgcccgccgtagaactcgtgcgactggtgcggcccctccgcgccgccgccgtctcccgcgtgatcctcctccgcgccgccgccctcgtaggtccaggtgtagagggcgccgtcctgggccagggtccagaggtgcggcgtgggcaggcccagcaggcccgccgcctcgcgctgcgccgcgctggagaactgcacggccacggtcggggcgcggtggcccatcaggctggggacccggtacccttggatgggattcagggaaaggggtctgaccaccagatcctccgcccccgccgccagccaggtggagcaggggctccaggccaggacggtcacgtcggcgtgggcctggccgtaggtgcggtgcagggccagcggggccacgctcttgcgcagctccggcgcacgccagacctggaccaggcgcccgacggccaccgccaggaaggcgccgtcgggggagaaggccgccgagcgcacgcggtccttgaaggagaagtggtgcagcagcgcgcggcggcggcggttgatgaccagcgcgcggccctccacgtcgatggacaccagcaggcggccgtcgggggagagggccagcgtccgcacctggtgcccgttttcaaacggcagcgtgctggacgtggactgggtcagatcgatctgcgggagtggttgtgagatgtggggggtggggactcggaggtggagggaggggacgaggatcgcaggtgccctgggctcatgcgcagggcaacatgggcgctggagcttgcaagtagagaagctcagccccccgctgagcgcaagtgcgccaggcaggcgagcctgcaccatcgcagagccccaatgaggacccagccaataatcgccctcgcgcaatctgcaccccagaagacgcaaacaaccaagctcccagcagggcatcatacctgtgacacccggttgccgacggggctgaggagctccgagccatggatgagcaacgtcccgccccggtagggagcccccaacaagtttgagaacttgtagtccattgcagttacggtcttgccatgcagatgggggggattctaggcgtcaggcggcgtgccgaggagctcacgtccagcatgcggcgacgagtacgccgcgaagatgcatacagggcggcacgatgagatataggaaatacgcaaattgaatctggcacatcctctgtatgactggtgtggtggtgnnnnnnnnnncaggaaatcctcaaatcaaatctgtcacatcctctgtatgactggtgtggtggtgcagcgtttgcagggtgaatgcatgcatgtgttgccaggccaagcgccccagcacttcgactaagaaacgatggcgcaaaagtttgacaaaccaattgatgcgcgacaggggatcgtacgataccccatgcgtccactctacattgcgtttctcttatcaaagtcatccacaacctttcaacgacacttcacgagtagcttgcatgcgagtaagtccctgcagcgactgattcctgcgcctgccccgagcctggcctgaccgacttccccactgccaaccgagagtctcggacctcagtgaggtggggttcgacaaacaccactagctcgattttatgcagtctcgttctgcatcgctgccgtaatctccgacttgctaccccgatcgcagggggtggggagcgagggagagtcgacagccagaatccataacccatcacagcgcccgacgccctttcggccacagactgtggtgaaacacacacatcgtatgctacgataggcaaatcgtccatactactggaccatggctcccttggccagcgaaatcgggcccaggcctctgaaatctgcgatgaagccccccaggttccctgccaaccaggacgagacccccgcagagggcccagccccgaccgggaagcgcgtgcgcatccgcagcatcaacaacgtggtccacctgttcagctccgggtcccgcgaggagacgcccgagccagatgctcagccctccaccaccaaccgggtgctgcagtttggcggtccttcctgggaccccaattccccggaggacggcggcggcagtcccctggaagacctggcaaagggccatccctccagggtggcgcagcagcggcggcgacggggaggctcccccgcagcggccatcgcggcgacgctggcctggatgacggcctcctcggccctcatatttttgaacaaggacatcatggtggacaggggatggggctacccctttgcgctcaccgccatcggccagttctccagcgccggagcgggtaagaggannnnnnnnnncgggaggcggtgtgcaccatccagcctgcaccaaagtcctgaggggtacctattgcagcagaggctgtccatcgcgcccctgcgatacaattgatgacctggcacgacttgcgctcttgggcaccttcccgccttcaccaacacatatctcagacaagccccccccccggaataacctcctcccacgccccaggctgggccatgggccgcctggggctggtccggctcaggcctcgcacctctctgggcaccaggccccgccagcacgcgctcgtggccgcctgcttcgcggcctccctcttcctgggcaacgccgcgtacctgggcctctccgtggccttcatcggcatcctcaaggcactcgcgcccgtggccacgctgggcgccagcctggcgctggggctggaaaggatgtcgctgcccgtcggcctggccaccgccctcatcgcggcggggaccatgttggccaccgcgcaggtcggttgggaggtgggacccgtgtggcactccaggaatgggggcccaggaggtgttgcaggtgccggtggaggcactgagctccctcgaatggcctgcggcgggggctcatcatctcacaatgtgtggcgctcgacatggtgtgctgccggggccaactctttgcgattcaaggatcatgttgcgcctgcaaggagcccctccagcccctccccaacctcctctgacccgacagcacaccccgctctctcccaatcaccacccgcccctggcaggaggccgcatcctcccacttctcggtgctggcattcgcagcgttcgccaccagcgtcggcttcgaggccctgcgcgtcgtactgacggagcggctgctggcgggggagggcgccgcgccgcggatgagtgccgcggaggtcctggtctacatcggccccttgacgggcctcatgctgctggcggggtccgtcctcgtggaagggccccacatcctccggcgggtgaggggtttgcgtgcagggttcgcacggatggagggtctgaggaggttcgatgtggcacggcaggaggcggtggacggcgatggggcagagcgcgagtgccacggcggactccgttgagatccnnnnnnnnnngtcgctgtggcacggcaggaggcggtggacagcgatggggcacagcacgagtgccacggcggactccgttgagatcctaggagactcgcacccacgaggcttgcagtgtatccctcatctgaaagaaaccaactcacacacaccttcaaacaggtgcaaggcggagagctggcggcgctggcccccgctttggccctggcctccggcgtcagcgtcctggtcnnnnnnnnnngcacacaccttcaaacaggtgcaaggcggggagctggcggcgctggcccccgctctagccctggcctccggcgtcagcgtcctggtcaacctgttctgctactgggccatctccgcgacgtcgtccaccaccttcaaggtggtggggtgcctgaagaacagcgtggtggtggcgctgggcgtcgcggccggcgaccccatgaccgccagggagctgcaggggtacggcatctccatgctgggcttcgggctctacacctggatcaagcagagggcgtagggatgaagggtgttgagtttcccttgctgccgaaatggcaacccccccttcatgccccgcagcgcgcgatgggacctcggtgtaggatgatcctagcagacgactcctcagactcgcaatcacacctgtgtccgagcattacggaagtatagcagggaattannnnnnnnnntggtgtaggatgatcctagcaggcgactcctcagacttgcaatcacacctgtgttcgagcattacggaagtatagcagggaattatagcagggatggatcggtcaacgggatccgcgaagaagaagaaggtcatgagtcctgcggccaccgccccagcgcccgtagcagtcccgaaccgggagccctttgggcccaagctcgcggccctgtgctactttggcctctttgcatccctcgcgatctgcctcaccggcatcctgggcctcgccatcctcatgggtagggccaggtgcttaggtcaaggcgggcacgccagctgcgccgtgccaccgagttgcgatgcagccccagcccctcccaaccccgtgcctctcctctacccgcagatgtaaggacacaggagcagtggtactccaagaccnnnnnnnnnnctgcgatgcagccccagcccctcccaatcccgtgactctcctccacccgcagatgtgaggacacaggagcagtggtactccaagaccgcattcgcgcctctgtggctgaagttcacagagaacaacccctacacaaccacctgtgcgtgggtgctttggtgtcaagtgcagggcctgggtgtccatgccagatcccctgcaacgatgcgtaacgcgctcgggattcctatgctgcacgggtgtgcaaagtgctcagtcaattgggtcttaacaccctttctccctgcagtgtgcgtcaacggcggcgccggcctcgcaatcttcctggccaagcggatatacgagcacaggagcgcgctcaaggcgagttgatggggcgtgggcgttgtgaggttcttgtcagtgcagacctagaggccggacttatgatgccagccatgcatgccagctgtgctctgatgcttggccaccctgatctcgcctctgcaggcacagaagcggaggtgaccctgctgcttgggagcgctgcactcaccctgtggttcttcagtgcttccatgattcgcaccctgcctgacaattccttggtgttacagggacaaacacacgggtcggggacagacgggggttgagagctgtgacgtggagcaggtgtgggcatcggctggaaatgaggggctgggtctgcagggcagggcagcctcctgcctggcgacgggagcggtgggggagccccggcgacgggcgattcacggcccggcgccgtgctgctcgctctcacgaggagcctgccctcatctcatcagcatgcctggcgctgctgtgcccggcggggagcggcaggggttgcaggggggtgacgccaccacctcctttcccccctcccaagccagccagaggtccgcggtgccaccaggccgccctcacacgtcnnnnnnnnnncccccccccgcccaagccagccagggggtcgcggtgccaccaggccgccctcacacgtccacctgggtcagctccacctgcgcctgcttcatcatgttgagcttgttggtcagcacctcgcgccgcttcatcacgccctcgtcctcgcccagcagccgcttgagcgcaacctcctggtcgcccgccacccccgcctgcatctcctccagcagccgctccttggcctgtggcgagtggtgggtggtgggagaggggagtcacgcgcgaggctggtgtccacacgcaacaaggctgggggcagcagggaaagtatcagtcagcatcatcaacatgccttcctccaccgacacaggcacacactcacatctcctcgcatgatcatacaaatcatcacgaagttgcaggcccgcatggcaggtccctcccccctgcccgagcatcaccaccctcccatgccctcctcttgccccaccccccctctcccaatgaagccacacccccacccacctggatgaccatgcagtgcacgatggccttggggatggtctgcgtcatctgcccgcacacctcgcgcacatagcccgacacctggttgatgatgcgcttgtagtgcttctcctcgatggtcccctccggctcctccgtcacggggcgcccgtccagcgtgtacaacaccttgccgtcaggcatgcgccccatctggatggcgcggaagtactcggcggtgatgtagttgcgctccatctccaccatgatgttcaccatgcgccgcgtctcctccttgaagcgctccagtgcacggtaggccgccgtcacaatctcccggcgcagcgtggggtagcgccggagggcgcgcacctggatgtttttggggggggggaggaggagcacgtgtgtttgtgtgtgtgtgtgcgcagggtgtcgaccgtgaggggtccgaggtgctcatccctcgccagggtggctgggatgtgtgtgtgagagcgtgcctggtcaagaccccccccgccccaccactcgaacctcacctcctcnnnnnnnnnnattatttggggggggaaaggaggagcacgtgtgtttgtgtgtgtgcgcgcgcagggtgtcgaccgtgagggtgccgaggtgcacatcccccgccagggtggctgggatgcgtgtgtgagagcatgcctggtcgagaccccacccgccccaccactcgaacctcacctcctcagacccggcgacgctgtcgaccatgcgccggagcagcacaaacacctcctccacgctcttctcggtggggtccttcaggtagcccagcgcctcctccagcatgcggcggtacccggcctcgggcgccaccaggtggggctggatgccgtcggcctcctcgatcacgcgcttgacgtagttcacctccagcagcttcttgaagggttgcttttcgatggcgtccggcagccgcttctcaaaaacagtgaggatgagctcgccgccccccttcccgccgtcgattagcttggcgaacccggtctcgaacttgcggcagagggtgaggacgaggtggatcatctcgccacgcgagttggcggcggggccgcccatgccgtccagctccttctgcagctccgccacgttcttgttcacaaacgcggcgatgttaggcagctggcggcgcacgctggccaccagcttagtggacagctccgaggataaaaatccggtgccaatgttgcgtaggccctggtagtcgggcttggcctggaagaagtccaattccttctgccgcgcgcggcccatgtccatgcgggagttgatgtcggcctggccgcggttgaccaccccgatccagccgttgcgcagggtgtaggccgcgccgtccagcacgtcgcggcagttggtcccggggtccatgatgtcgatcttggtgagcacgccgatggtgcgctcgccagtgggatccacctcacgcgccatgcgcagtgcgtcgctggtggccaggtcggcgttggcgggggtcaccgccaggatgatcacgttctcgtggcgcacgtactcgcgcgccatggcctccagctcggtgacgatggacttgggctgcccgtcgatgggcaccttggtaagccccggcatgtccaccagggagagcgcgggcagctggggcgacacaatgcgcagcgtcatggggacgggggacacgatggtcccgcgcttctctgtgtgccgccgtgtctccgcctcaatctccgcgcgaatggcctcaaagtccaggaagcgcttgccgggcaggtgcccgaactcgccgtactcggccgcgccggcgtcgggcgaggtctccagctgcagctccagggggcggcgcgtgacaatgccggtcccgcgcggcaggaagtcgcggcccaccaccgcctccagcacgctggacttgccgctggactggccgccgatcaccacgatcttgggcagctgacgggcgagggagggcatgccgccgccgccgcgcgtctcgtcgccggcctgggtgtcgcccgccagcgccgcgatggccgacacgcggttgatggcccggagcacaccgtccatggtggcgggggtgttgtggtacggcctggtgtgtggagaagggagaggggaggctgtcaggaggatggctcttggacccctgggccagggcggggggtggcagggaaacggaaggggagggtgctgtgccatgggggcgcggagctgccctcagcactcgatatcacatcgcatgatgatggcnnnnnnnnnnagggtggcagggaaacggaaggggagagtactgtgccatgggggcgcggagctgccctctgcactcgatatcacatcgcatgatgatggctggcagtgcaaattacttgctcggagaacccccgccccggggatcccgtggtcgggggtggcactgggatcgcgtgggtgcacctgaggtctcatccctccgtgcacgaccccactcagccaggtgcacacctggagcaaggatcaggggggcgagggtcggcgagggaggagcgggtgtcagtagcgtgttcgtccgcaaccgcaggttgacctccgcgacgtgggtgagcagcacggttaaagcgatgtcgaggctgtcactgcccacaaatgccagatacaggtgcttggtcgccagccgagggcgccgtgggacggtttcgtacccccaaggcaactgctcgccatgccgagtgtgaaccagggcgcgtgagatctcggacctggcgccaccaacctcccctggcacacgccgcggggcccggtccccgatcatcaatattaaaagaatgcaacaagattcgacagcatgagagagaccctgcatccatgctcggcaggcgatggccctgagcaagcccaacaatgcaacaggaggctggggtaccagcagggtgcgcctacagccccttctgcgcctcgcgcatggtctccaccgcctgcaccaggttctcggcgctggacacgtccacagctgcaggcgtcttgtccacgaactgggaggggtagaccggttctccagtgatgtgcgctgtggggagaacgcgcaggcacgcagaggccgtgccgggcgccctcaaccccannnnnnnnnngacggttctccagtgatgtgcgctgttgggagaacacgcaggcacacagaggccgtgccgggcgccctcaaccccaggaatgaggtgcaggcagggccatcacaccttgccctgccaccatcacacctccaccaccctcgcacaccagattcaagagcacgccgttgtccaggatagccgcccagcgctgggacttcgggccgccctcctccccgatccccagctcgacgcccaggtagcgggtgagccgcccgcccacgtccaccacctgccgcacctcctccggcttcaggccgagcttgctggcccactgctccgcctcgcggggcgtgccctgggacacgcacagcacgggcagctgcacctcaagctccttgaatcgctggagggccttggcaaagccgggggcatgctgctcgctgcacacctttccccggtccggcaccccaaaggcgatttggagcccgccctggggtgtgtgtccaagaatggggagtggggaggtggagaggagagcgaggaggcaggtctccaaatgagcttttgaagcaggatggtgcgcattggatgcaccatgagcttgggctgaagaggagcaagctccccagagaaaagcagtgctgcccccgggagcagcaggtttcaccctatttgtgaagtccagcatgcggtactgagctgggccccacccacccacaccggggtgacgagcgctcaccttgaagacatccttcacagaaagtgtcttgccatcgacctgcagctggacgtggcgcaggtggtacagctccttccgtcgcagcaggccagcgtggcaggtgtgtggcgtgagctccgagtccttgtggccctgaggcacctcctcgcaccccggaggattcttattgctgaagaacctaaagtctagcaggcctgctccgcccgcacatggctgtctgagccgctgggcggaggacgggaggtgacggagcatggaccccaatccccgtcgcgtgctccttccccactcggcgaggatgcagcaccctccccgtgttcacgtctggggtgagatcagtcgctcggagttttggagtggatcgccagcgatccatgcccacccaccctacgtttcgacgacctgatccgtcgatcgtccgcacgtgccgaaaccgggccgcagcgaagctcaccaaccacgcgggggattcttggccatcgcactggctcccaccagaacgaacgaggtggaggatcaatgtcttcacagtccattcaggcatgcaagaaatcacgaggttcacgaaacatgagatggtgcattattggaaagggcaggcgcgtggggggtgtggatcatgggtcggctccagccaccagttgcagcagcacatcctccacatcctccagtcccgtcagcatcccgctggacaccacctgcgcaagcacatgggcttaagtttctgctgagcagggcgttgttacccggtgcagtacacgccgccatagaattcatgaccgacattctggcgtccccctccccccccatcaccacccctcaccttgctgacttgcgaggccagctggaggcaggtctcgtgcacgtaggtccgcacgacgggcagcaccgcctgcagcacagctcgctcctccggcgcgatggccgactgtgctgcccccgggcacgccgcccactcgtcgtggctctgctgactcagcgtccgcccagggctgccgggctccccccgcccctcgccttcctcagtcttgtgcgcctgggcctctgcgccctcttccgccggcgacccgcccccccgcagctcggcctcgtcaaannnnnnnnnncgactcagcgtccgcccagggctgccgggcaccccccgctcctcgccttcctcagtctcgtgcgcctgggcctctgcaccctcttccgccggcgccccgcccccccgcagctcggcctcgtcaaacactcgggtggagatcttgcggtccacgccggtgccgacgggagcgtccagctccgccccctccgtggactcgagggccagcgtgcggggcagggccagggcggcgtcctttaatcccggcacgtccccgtgcgggccctcgatggccgcccacaccgcctccacccacttgttccgcgccgatggcgactcggcacgcagcaccaggcggggacgctcgctgcccgcggctaggccgccggccagcaccacaaacaccgtgggcgaggctgcggggtggcggcacgggggggtggtcagtacgtgtgacgcggcagacttgggcacgggaagcgaggcaagggagnnnnnnnnnnaaggggtggtgagtgcgtatgacgtggcggacttgggcacgggaagcgaggcaagggaggggcatggccatcgaccgggaatcgatgctttggagggccaagctcgcctgtgcaccatcagcacagccaatctcatgtgatgcgagtccaggcaccttgttggcagcccccctggcccccccgatccccaccttcatgcctgtcgcacccatagtgcacgctgaaggcacaagtagcccctgctccccatgcccaaccccatgccacccaccgatgtcggtgtcggcaaggacagactcgccccccgccagcgtggcccccagcaggcccagcacgccgcgcgtggcgtttgacccaggcttgtgcatgtaccacatgcggcccagcccggagctgaccaccacccagcgccgctgccagcgcccgtggcgcgaccgcttctccagccagcccatgtagtagctgtgcagcggcaccgccgagggcttgcgcgggaggggggcgggcgccggcgtccctgccgccgacacggccagggtcgcatcctcgcccgccctcctgatggccgccgcctcgcgctgcgcccgcgccaccaggcccgccacgtcggccagctgcgcgcgcaggcgcgtgaaggccggagaagaggggaatcgcgcctcggccgccagcgtggcgctgatgtgcgccgaggtggcgtcgcggcgcgcccccaggaagcgcaggcacgcccgctccgcctcctccgccagctcggggctgcgcggcgcggcgcggaccgccaccgccgccagcatggcgcgggccagcagggcgtgcaccgcgcccaccagcgcatgcgcggggagctgccaggtcgagaagcactcggccagcagcgcccgcaccccctgctcgggggccaggatgtagtcctggtacccctgcccagccctgcatggcgttttggtgtgtgggagggggggtctgactgagtttggggcatgcaggggtataggccgggacggagatgggcggtccatgcaccgggcgcgctgcccgccgccctcgatccggcgtgggctcccgaactcgtgccgtcccaggtttgggactcactcctccccgactcccgacgcatcgggaaccctgatccatacctaaacacggtatgcgcctgctcgatggtgaacaactcatccaggcgctggatgttgagccgagcagccacggcctcggtgctcagctctgccgcgaggtcccttcggagctcggcatccgtggagcccagggacccgcaggccctccccagagatttaatgaggaggaggcgatccacagcgctgagatcaacaggtgggtcgtgggtcgtggcctccccgctgtcctcctccagggccacaggagcatgggccatgggtggggggccccccgcagaaccgcgcgtgatggagcagaagacctgccggctgtacattccttctcagagcatgagtcgaggatgcggttggatggatttgtgtgtctccagggagcctcgctcgcatcatggcgctgcttgggtgagggatccggttcccgtcacatggcggaagtcagtgggggcgcgacgggatccggacagatccgaggttacgggaggcgccgaagctgctaacccggctggggctctgcatcacaagaaaaaatggattgaaaatgtcttcttatcacctcaacacggcgttcgcatggggcggggggcgggnnnnnnnnnngacccggctggggctctgcatcacaggaaaaaatggattgaccatgtcttctatcacttcgacacggcgttcgcatggggcggggggcgggatgctcgcaccacgatgaagcagtgccgcaccacgtctccagtccgccctgggcagagcatccaggtcctcaccttccaccaggctgcgtgcagcgccacggagctgcgccaggcaccaggagcctgagtcagatcaggacgcctccctttgcaccggtgaccctgcccctggtgggccccgcacctcgccacgcctccgggcccggaagaactccaccatgaggcgctggcactcatccgccagcacgcccccccgcacctccagccccgggtggaaagggtgggccggcgcacccggcccccgccccagcagggacccccaggagccgtcggcgcccatgagcggggagcgcgcgccgtacacgacggccgccaggcgcgccgccagcgcgccacccgcgcacatggcgcacggctccacggtgacgtagagcgtggcgtccggcatgcgccagctgggtgcgacgcccgccgcgcggcgcaggcacagcatctcggcatgggcggtggggtcgccggtggcctccacctcattgtgggcgctggccagcagggagccgtccgccgccgccagcacggcgccgatgggcacctcgccctttgaggcagcctgtggcgtggggcagggtgcaaggacttgggcagggctggggggcctgtggtgcagccggcacccatgtccgacctgggtcctgggaatcccagcggccagcccgaagaaaatnnnnnnnnnnggtggggcagggagcgaggacttgggcagggctgggggggctgtggtgtagcctgcacccatgtccgacctgggtcccgggaatcccagcggccagcccgaagaaaattccccaggaccccgcaggagccgaaagtccaagcaccttgtgagcctggtcgagtgccagacgcatgtagtggctgtccaggccggcctccaggggcgggcacgagtcatatcggggaggcacagcctcgaatgtgcagcgccggtggtcgggcgaggcccgccggctcggggccatgcccgcccggcgggttcgcaaccccactccaaggcacctcatggtgcatgccccggcctgccacgccatgctggcgaagccttgcgaggcacgacaccgggtgcgtggaggggtaaagttggaggcttcacgccatgccgctgccgaggtagagaagtgcagaattccaaaacgtaatataattgccgtttcacagtgtcagaccatcgacttccccacatggggtcgtcgttgtcagagtgaaccccgagcgcgccgtggtgtgccatggacgctcacatgcatgacgaaccattcatcgactaccaggctgggctgtcatgtacagttgggaccagcatgatcagtctnnnnnnnnnnagcataggattgtgtaccggccgagaggcgacatgagcgtggcgagaaagtggtgctaccctgcccctttcagacagagcttcgactgtnnnnnnnnnngtgccttgaacttgacaggtatacgagttgtctcacggtgcagctgctctcacaatgcaccgagctgtgcagacagatcctgatacgccaggtctcccaggctgtacgnnnnnnnnnnatgctttcaacttgacaggtatacgagtcgcctcacggtgcagctgctctcacaccgcaccgagctgtgcagacagatccctgatacgccaggtctcccaggctgtacgagcaggggattgatgttctgcgggcataggattgtgtacctgccgaaaggcgacatgagcgtggcgagaaaggggtgctatcctgcccctttcagacagagcttcgactgttgtctagtcccgatcatttcatctccggtttatctccgaatcttctgcatcaagttcacgaatgacttactaaggagggccaaaatccgactaaagaagccgcgagcgagcagaaggtgtttcgttacagcagaaccgatccaatgttgcgccctcgcgatctggggaccagggggagcacggtcccgggcgcggctcagagacacaacaggcactcaagcccctcgccagcaatatattctgcaaccatgaagtagaagggtcgcgtgtgtgggcgggcaggtcgcagcgctcgacatgttccgcacttgcttcgcagcgacgattgcggaggtcaagggtgcacggcaggccttcatcacctcccgcttcgagatcgactccaagggccttccaacagatgccaacatcctggaattttgtttcccgctgggcgctgcagccgtagtccccaaggagtaccaggcggtcgaggtaggtgggacacctgttcatcatgggaccaggcctggaaagcgaatggctgccagagatcatggaacacaggactgttcctctcccccccgcacaagtacctcgtgcaactccattgcctgcctgacccggccctccccgagccactctccgcaggagttcctgtttgccctgacggggggtggcggcgaccgcctgtatggcttctgcaggcactccctcccccccaaccgccccggggagggcaacggtcgggggatcgccaagctccagcgatatccccaggcgctgtgcatcgtctcgccccacccatgggcccagttcttcttcagggtgcggtttgatgggctggggattgtgggaggccaagcggcgagtcggggtgccagtcccgtgatggacctgctcaggcgccagcaacctcggcagcaggcccatgagatacctgtgtgtgtgcttctcactgggccatgcaactggcgctttcacccttgccaacgcgatgctccaaggggccagaccatgtggtccgagataccctcggcgtgccacccgcctgcccatcgaacaacccccgcctccctcccacgcactcctggcgaggccccttgcctgatccccaccccctcctcccccaacccttcctcccccaccccaccctctcacatccgagcaggtgctggaggtgctggaccgcacgctgcgcgtgctgccctccccgaccctggacggccacgctttcctgcgcgacctggacgccgcggcccccgccgcgcttgggtcggtgctgcgcctgccctggccggcctgcctgcacgccgggtccctgccccgccagcaccgcgccttcgcctcccccgccgacccgggggcctggctggccgcaggcgagggcggcgtgctggagctggaggtgccccccgacgtcggcggcggcgcctccaccgccggcatcccactggcccccctcctctggcacctcacgccgcgcctggcggtcagcctcctggctgccctgctcatggagcgccgcgtggtggtggtctccgccgacctgggccgcctgacggccgccgtggccgccgcggccgcgctgctgcaccctttccactggcagcacatcttcctgccccttgtccccgcgtcgctgctggtagggcgagtctttcattcctcatcccttgcactcctgtgttcatctgtctgcctctaaaagatggccatagcatcccacctctgctttgcactcacacacacaccctttgcccccctccccatccaactcacccacaacacacactcccaggattacctggcggcgcccatgcccttcctggcgggcgtgcccgcggcctgcctgcccacgctgcgcacgctggccatggaggaggtgctactcatcgacctggacacgctggggtcggcctcgccgccgccgggcgggccgcgcgacgacgcgctcctcctgccccatgccgacgcgctggaggcggccttcgacgacctgcgcgacctccagcggtcgcccgccgaggcagcctccacgcccaaggccgccgagatcgtgcgtgcctgggcggtgcgcgtgttcggcggctaccgcgctttcctccgcccagaggacgcggcgggggcgggcgcggcgctgggggggccaggtcagcaggggctggtgcacgtcgcgcgcagcacaggcagcgtgcagcgcgcccggtccgacaccagcatcaggtgggttgggtgttcaggcggaatgaggggaaaggagaggggggggtggaggcgaccggtggaggtagggacggcaggatgagatggaagggagtgcggtcaagcgaggtgaaagcagagagaaaatgtgctcgagtacaggccagcgactccgtggatgaggggtgattgtgggcagaaggcccggcgacgtgcattcnnnnnnnnnngaagcagagagaaaatgtgctcgagtaaaggccagtgaccccgtggatgaggggtggctgtgggcagaaggcccggcgacgtgcattcacaccctctccctggccctggccactccattcctgcctcctgcctccccttctcccctcgttcccccacagcacaccccttgccccacccnnnnnnnnnncttcctgcctcctgcctcccctcctcccctaattcccccacagcacaccccttgccccaccccagaaccctctcacacctgcccattccccaacagggcgcatggcttcgtgttcgacctggagggtttcgtgaacggcccgcgccgcgcctcgcgcctcgccgccttcttcgccgccttccgccactcccagatgttcgaggtgtttgtcgtggagcgctgcgcggcggccgcgcagggctacccgctcaccgacgcgttcgaggccgaggtctccgaccgtgtgggccagggggcctcgcccctggcggcggccgcggcggccgccgctgcgcgcggcgccggttcgcgcatcggcagcctctggcgcaagacctccgacgttgtgcgacagtcctccgacaccctggtcaccgccgtcaggacgctgggcacgctgcaggacgactacccactgcccgggtgagtttctgagaggggggtgtgtctgatgatgtgacggtattcctgatccgtgcccgtccacgcccctgggccccaccccctgcccctggccgatcnnnnnnnnnngctgatgtcgtggcggtagtcctgatccgcgctccgtccacgcctctgggccccaccccctgcccctggccgatcatccgcaggcagacgctgcgcaacccctcccagacgggcgggccccccctggtggccgcgcctcggccgggcgggcccccccggcagacggggcgcctggcgcccctggccgccgggatcaagtcgctggacgacgtgcaggctagcctgtactttgcccacgcgtcagacgccagcttcgactccggtgagcggggaggnnnnnnnnnntgggcggcccccccctggcggccgcgcctcggccgggcgggccccccccgcagacagggcgcttggcgcccctggccgccgggatcaagtcgcnnnnnnnnnntgggggttggggggaggggggcgcagctggccggtgttcctggcagaagggcagtgagtgcattcactgtgttccggcctgctggactggcgctccgcctggggtcatcagacaaagagcctgcagcgtggcgacgcctcgnnnnnnnnnngtggggttggggggaagggggcgcagctggccggtgttcttggcagaagggcagcgagtgcatccactgtgttccggcctgctgggctggcgctccgcctggggtcatcaaacaaagagcctgcagcgtggcgacgcctcgggcgaggaggaccggccgttccgacccaatcttttggacatggtctgctgtgctctgaacccacgcccatcattctccgtccctcccctgcaccccttctcccacagatnnnnnnnnnntgacccaatcttttggaaagggtctggcgtgctctgaacccacgcccatcattctccatccctcccctgcaccccttctcccacagatgcatccaacaccagccgcggcagcgtgcgtctggatcaggccgccgcccgcccctccgacatcccggcaacaggccccctggcggcgggtgccgcctcggcgaggggcggctgggtgcccggcggcgcgccgcccagctcgctgagcaggggaccggccgatttcgcggcgccccggccccagccgccaccctcctccgcctggagcgcggtgggggtcggcggctggggcgccggagccgcgcggcaggacgg

SEQ ID NO: 43182 - DNA, 4745 bp, Chlorella protothecoides
  modified_base (1320)..(1329): a, c, t, g, unknown or other
  modified_base (1609)..(1618): a, c, t, g, unknown or other
  modified_base (1823)..(1832): a, c, t, g, unknown or other
  modified_base (2009)..(2018): a, c, t, g, unknown or other
  modified_base (2239)..(2248): a, c, t, g, unknown or other
  modified_base (2589)..(2598): a, c, t, g, unknown or other
  modified_base (2839)..(2848): a, c, t, g, unknown or other
  modified_base (3611)..(3620): a, c, t, g, unknown or other
  modified_base (3839)..(3848): a, c, t, g, unknown or other
  modified_base (4285)..(4294): a, c, t, g, unknown or other
  modified_base (4362)..(4371): a, c, t, g, unknown or other
ggcggcacctcctgtcgccccctgggccctgcccggcggcgccgcagcgtcgcaggacccccttgctgggactgggatcgagtccagctcgtgggccgccagcggggtcgagcctgcaaacggcgccggagaaatgcatgcgcccgaccacgccccgacgtggagcggcatctgcgaggcgcccccagcccctggccctctttcccccgccccccatgagcaggagtcctgggcgtcggacccggtcttccaggaggtcctggccttctggtgggtgtaccgcgcggcgggctggcccgctgagtccatggcggcctgggcggcgcagcactacgaccccccccacgccgagctggactatgaggccatgctgctggatcctggcatgcaggccctggccgccgagtacgtggccgcgcatcccaaccggacctcgccgcagggcagcccacggcggggcgaggagggggggggcctctggcgcgcgggcatgcccggctcgcccgccgccggcctgcacggggcggcagacctggatggtggagcggctgatctgcccgaggacggcgccgggccgcccacggccttcgcggcggcagcctattccatcgaggaggaagcccacggggcgggcgtgtacacgcagcaggctaccttgtgttccatggatgccggagcttacgctggtgatgccgaagcgtacgctgacggaacagccggagcgtacgctgacggaacagccggagcgtacgcggccgatgcggaggcgtacagcgtcgatgcggaggcatacgctggaggcagcgcgggggagcaggacgcatctgcggaggcaggctcgggcgagcagagcgccgcggcgcgcctgcccgggagctggtctgtgcctgaccgcgtggggtccatctggcagcacgctgaggcgggggacggctgggcggcgccgacacaggtcgcgctgggagtggacggctacgaccccgagggggcggatgtgccgggagaggacggcgcggcggcctctgtgcagtaccagccccaggcggcgcgcgagctgcagtatcccggggcggacgaaatggcggcgtggcaggaactgcccggggcggcgccgggtttggcctcagagcgcttcgcgacgcacggcgccgggcccgggatcgacggccagttgccggtgttggagccgcagccctttgccggcttcgacgagggcgaagagccgggagtgggggatggccatgcagggtgggctgatgccggtcagcccagcgaggaggctgccgccatccggccgagcgaggcagccgccgccatttnnnnnnnnnngcgcacggcgccgggcccggggtcgacggccagttgccggtgttggaaccgcagccctttgccggctttgacgagagcgaagagccgggagcgggggatggccatgcagggtggggtgatgccggtcagcccagcgaggaggccgccgccgtccggccgagcgaggcagccgccgccatttggccaggcgaggagtcccccgctgtccagcagggcgaggaggcctctgctgtccggccgggccagcctgccgacccctcgctgggcgacatcctgggcnnnnnnnnnngcccccgctgtccagcagcgcaaggaggcccccgctgtccggccgggccaacccgccgacccctcgctgggcgacatcctgggcggcttcctgcggccccacctgcaaagctttgtgggcggcgggcctggaccagagggcccagacccgactgcaccgggcacggccccgcacgcgctgacggccatcgtgggcggcgtgggtnnnnnnnnnnactttgtgggcggcaggcctggaccagagggccctgagtcgactgcaccgggcacggctccgcatgcgctgacggccatcgtgggcggcgtgggtgggaccctgaaggagctcctgggtgaggcgctgtgctgggggctacaacacttgtgtgtgtgtgtgtgtgtgtgtgtgtgtnnnnnnnnnnttgggtgaggcgctgtgctgggggctacaacgtgtgtgtgtgtgtgtgttgagaggggacgcagccgtttgatgctatggcttcagcatcacgcacctgcgcctcgaggctgattgcaagctgggttgcgctcgtgcacccacccgctccctttcgggtttctggagcaggggtcccgagcaccgagtcggggaagatgaccgcccacctgccgtgggagnnnnnnnnnnagaggggatgcagccctttgatgctatggctttggcatcatgcgcctgcgcctcggggctgattgcaagctgggttgcgctcgtgcaccgacccgctcccttccgggtttctggagcagggggtccgagcaccgattccgggaagatgaccgcccacctgccgtgggaggggtctgaggcggccccgggcaacggccccgaggccgaagccgctcgctgggccgaggctgggccgcacgagtggggctcccaggcggaggcggggggggctgaggatgcatctcacggcgcgccgcagccttcccggggtgccgaggggcttgcgggcgaggacgcccgcnnnnnnnnnntgggtaacggcccagaggccgaagccactcgctgggccgaggccgggccgcacgagtggggctcccaggcggaggcggggggggctgaggatacatcccacggcgcgccgcagccttcccgcggcgccgaggggcttgcgggcgaggacgcccgcctgtacaccctccccgccgccgcggaagctgcacatgacatcgaccctgggcgcggcgctcaccgacacctgggccccatgtcgcnnnnnnnnnnacggaatttgcacatgacatcgaccctgggcgcagcgctcaccgacacctgggccccatgtcgcccgggcgcctggcctcggagctgggcgtgccgcgctcggcgctgaccagcgccgccgccgtggtcgccgcctccgacgccgacacgctgtccacccgcgaggccgccagcgatggtgagggggaggggggcggggaatggaatcgcgactctcgctcatcggggaaggaggaggccggcatgctgttccagcagcgagggcactggccctgggcccatggggtcgtcgcaggcgccggggcggtccctgtcgtttgtgcagtttccggcatccgggttcctcagcaagcactcagcgctcctgcctgggtttcttcgaggtatctgctcacgcaagccctccaaacccactgtttgccacgcagacgaagcggaggggcaggatgtcgggccgccggtggcggaggacgaggccgtgcacgaaaacggcagggcggcagactggggcgcgcctgcagacggcccgggattaccgtccggcgccggcgtggccgtagacgccctgcccagccaggacccctcgcccaggtttgctgccctggcagaagacctggacgccggcgcagacggtgagtggggggatgcggtgcgtggctgttcggttccttgatcaccagagtaggtgaatggccacctgcctgcaatgctaaacctactgcatcctgtgcgctcgcgatcacctcgccctggctgtgttcgnnnnnnnnnntggtgagtggggggatgcggtgcgcggctgttcggctctttgatcacgaaagtaggtgaatggcctcctgcctgcaatgctaaacctcctgcatcctgtgctctcgcgatcacctcgccctggctgtgttcgccattggcaaatccacccttcatagcttcggacaccttcacattcccgcctcgtggcaatgcatgcttggcgctcccacccctcccnnnnnnnnnngagctttggacaccctcacattcccgcctcgtgccaatgcatgcttggcgctcccacccctccccccgcccttccccatgccctcagcagcctggggcgaggcctgggacgagggcgggctggaccttggcgagctgggcgagcccagcccgccggccaagggcgcggcaagcgcaggcgaggtccaggacgcatccccccatggggacccggtggccggcctggagggatccactcccgagcggtcggcctctgccgccgagccggagagccccggcttcacggccttcgcccccgcgcccggccgcttcccctgggacacgccggagcttgcgccggcggggcggagcgcggagccgtccgcctcggccgagctggacgcgcgcgaggcggcgcaggttgttggtggtgatgtgcacgacctggctgccggcgcnnnnnnnnnnagcggcgagcgcaggcgaggtccaggacgcagccccacatggggacccggtggccggcctggagggannnnnnnnnntgcctcggccgagctggatgtgcgcgaggcggcgcaggttgttgttggtgatgtgcacgacctggctgccggcgccgggagtgcgggtggcgaggcggggcccgttgggcatgcccttttgtcccaggccgtccaagcccctgcgtggagcagcgtgcacgagaacgcggcggcgggcagcccgccgcgtggacgcccaggctcggaggaaggggcgctgcgagatgatcgcgccgctgcggtggaggcggagctggcggcctcccgcgcgctcatcgaggagctgcgtggacgggcggaggccggggcggcggaggcggccgcggcccgcgccgaggccgcagagctgcgggcgcaggccgaggagggcgcgc

SEQ ID NO: 43183 - DNA, 61 bp, Chlorella protothecoides
gctacttcatcatcaacggctcggagaaggggctcattgcccaagagcgcatggccaacaa

SEQ ID NO: 43184 - DNA, 61 bp, Chlorella protothecoides
ggtgacacagggtgagctatggctggctgggctgtcaatcatgtctgctcaacaggaaagt

SEQ ID NO: 43185 - DNA, 142 bp, Chlorella protothecoides
aatctgcacgagtgctgctgcccagggtctacacctccccatcctcattgggtgctcgcccgcccacccaccctggagcacgtgcagcaacgtctgcagggcgctgcgccgaagcccgtcgtagtgctcctggaatcgcttg

SEQ ID NO: 43186 - DNA, 5788 bp, Chlorella protothecoides
  modified_base (542)..(551): a, c, t, g, unknown or other
  modified_base (626)..(635): a, c, t, g, unknown or other
  modified_base (951)..(960): a, c, t, g, unknown or other
  modified_base (1359)..(1368): a, c, t, g, unknown or other
  modified_base (1660)..(1669): a, c, t, g, unknown or other
  modified_base (2453)..(2462): a, c, t, g, unknown or other
  modified_base (3223)..(3232): a, c, t, g, unknown or other
  modified_base (4761)..(4770): a, c, t, g, unknown or other
  modified_base (5185)..(5194): a, c, t, g, unknown or other
cccccctctctgacaggtccagtgcctgcccgggaatgcgacgcacagctggtccccgcgggtgacccacgttgtggcgccacgcttccttcgcaccaacaaggtgctggccgggctggccgccggcaactgggtggtgtcgccagactgggtgtgggccagcgccgaggcgggggcctgcctggacccggtgagtgggatcgggggccgcggcgtgagcgagggtgctcggcgaggggcgagtgagtggcgagtctcacttttcgaggagggtgagtgaccccggcgaccggcgctgaatgtgccctgcaggaaccctttgagctgaggggcgagggcggagccggcatcgcacggcactggcgtcttcgagcccaggcaggcgcagatggtcccttccatggcctcaaggtgggagggctgggccagagtggcatgtgcgggacggggccatcggcacccgcctcgatctgcccaggcaccgcaccttcccctgtgcccacatggatccccagcatggctgtcatgcatgccaaacacannnnnnnnnntccggtgagtgggatcgggtgtcgcggcgtgcgcgaggttgcatggcgaggggcgagtgagtggcgagtctcacnnnnnnnnnntctgggccagagtggcatgcgcgagacggggccacgggcatccgcctcgatccgcccaggcaccgcaccttcctctgtgcgcacatggactccagcatggctgtcatgcatgccaaacacacgccctgcaggttgccattggcgccatgggaaagccaggccccacacggcatgacctgaggtgaggaggggtttggcgcgcacctacgcgcaggttcgtgctcttcatcccaccagcgctagacttctcgtcgcgaggagcgttcaatatcctctccttcccccctcggcagagctattgtgaccgccggtggannnnnnnnnntttggcgcgcacctacgcgcaggtgtgtgctcttcatcccaccagcgctggacttctggtcgcgaggagcgttccatatcctctccttcccctctcggcagagctattgtgaccgccggtggaggaaggctcgtgccgatgaaatcagcaggacaggcggatcttgtcctggccgacaaagcgaccctgtccaaggggccaaccgccgaggctaccgtcgtcacgccggacttcctcgtcgcgtgtctcatgcaatcggggtatcgagaaatgcttcccgcaaaccccaataggacgttggtcagggctatgggcgccatgaagtgaaaactcgtcgccgcccatactggcccccatgatccagctgtagatgccaagaaaactgcacgcgcgagttgnnnnnnnnnngggacgttggtcagggcaatgggcgccatgaagtgacatgtcgtcgccgcccatactggcccccatgatcgagcgcgttgcagatgccaagaaaactgcacgcgcgagttgtcaagtactttcagcccagacccgacgcttctcacgcgactcatcgcgatggaatggcgtacttcgtcggatattacatgaggctgcatggtagtgtccatggggatcatgggtcgaaatgggcatcggaattttcgggcttgctccaggggcatgcctgtcagcgaattcgaccccgggnnnnnnnnnnggaaatggggcatcctgggacggtattcccttgctccagaggcatgcctgtcagcgaattcgaccccgggggcagttgccgcatccccagttgcctggcgaccacccaccatcctcagaacacggcgttggccccccttcatcgactcaaacaagattatctaccccgtgcaaactctgggtgggcactcctgtggtgcggaacccaccggggaggcatattgctgcaccccagtgtcggagatatttgaatatagtcaaagccggccgggccttcagcaggctcccgggctcatcacgagctcgcctaaaaccagttcgactgccaaactcccggtattgtcggccgagatcacctccgcacgcgttctcaggtgggctcggttctggtcgcttcttccgcccggggtcttccgggagtggtcctgcacatgacgttggcgcgttaactctgcacaattctctttggtttggtatcccgagggatcttggagggcgtagcggccttttgcagctcggtgtcgcgccccacctcggaacgcgctggttaacatccacctgcctgcaccgctcccttgctcttcctttcgcttcccagcctgtcaccttcacccgattccatctattttaccggcaattgtgcgcaagtggcgaactttgtggtgcgacagttatctttccctgtgtcgacggcctgcgatctgtccgtcgggcggccctcgcccttgtctgcctcgtcttcacctcggcaaagtccctgatagtggcttcaaggaacctctaannnnnnnnnnagtcgggcggccctcgccctggtctgcctcgtgttcacctcggcaaactccctgatagtggcttcaaggaacccctaacatcactcacgcttcgtcccgacccttttccgcctgtcgcagtggccaaggacggctttcccgggctgagcccatagtatggctgtgggagctcccataacgtacgatcgttttccgggagcggacatagctcccaagaccgatgactggatgcgggccgggagcggtggcgccacccagcaccacttgcttcgacactctttgcccaccgacagcaagggtgcaacggctctatctcactttggggcggccactgtggcggaagcaggcaagaccatcaagcgcatgagtcagcgtgaccttcagaacacctttcgtgcggtgagctgggtttgggccagcagtgttgaataattgcaggcctgtactcttgttgcccaggcattgtcgtttggctgccatgtggtgcatgccttggtttctttctgagccgccccgtggggctcctatagcaacttccagctgaactcgtgggctctcatccatcgcaggtgtacgggacaagaacattcagcaataacaacaactggctccgccgcaagctgtgcgagggtaaggagtggtacaaagctcgatccttggctgctttggtggggcctgagcctcatgcttcatgcccctgcaataagacctgaggtttctgatttaccctctatcctacacgctggctgcagatagagctnnnnnnnnnncggctgctttggtgggggctgagcctcatgcttcatgcccctgcaatgagacctgaggtttctgatttacccactatcctacacgctggctgcagatagagctcccttgattgttatcatcttccatcccctctcttcatctcacaccctttcccttcaacattgatgcagccatcgggatcgatcctggcaagggtccctccgccaagcggtcgtccaatgcagcaaccacacactccaaggcgaagcgccgcaagtctgtggctccgaaggcgcacgccatgtcccctgaggacgcagcacaggccctgctcaccctgggagagagttccagctgggacggcgacaggtgagtggtaacgcggggagaggggggcagagcaggggatccttgccttcatgtgcataggtaaattgtagcagaatgtatctcatgattgtggcttgtgggaccgaaggaggcttgggcagggttgttgcgcatgaggcctgcgtgtccaatgccccgctccccccgcctccacacgcagctattacgatcgtggcagcagccgaagtgccgccaccgggccacctgcggtggggctggaggagctgcagctgagcatgagcagccaggccgatcagacgagtggcgccggcgaggaggcctccgtccatcgtacccaggcggccgaggtctacgtgctgcccgccccagaagcgcacattctggcgctgcagcacgccgtcccacggaccgtgcacagctcgacgacggcgcagccaacgcatgccggcgctgacagccggccggcagcggaggctgcgccgcaggccaggcaggcttccccgccccgtcccacccagggcatgcccgcctgggtgtcgcccgagcttctcatgcagctgcgcatgctgctggactctggcggctacctggccagcggccaacctcccgccaccagccgccccgcctcacgccaccagccgtcgctgcggggccccgagcagcgcaacgactgggaggcggtggcgcgggcgggcatccccctgcgcgccatcccgctgcccctctccggcgtctccacctgggacacgcagggcaagcccatggtggggccggggaacggggccggggccgacgccgcgccggtcgtggtgctgggcggcaggtcgggcgccgtgtcgcccggagtgcgcgtgttcacctcctgaccaggagaacgaggtgcgcagcccgcccctgagcctccgggggcctgtacttctccccgcgccgtgccccgggcagcccactccgattgctgttttccctacccctgtgtactactagccaggtgggtcggcggcctgccggcaaggcggccgcaatccctcttgtgtcccatacagcctgggcgcccccctgccgatacgccagatcgtttcggggtggggcagtcggccggcgccgcttcaaagatgcccatcgtctcaagcccccaccagagtgccccgacggccccccccagcccgcccctccctgtactccgtcctctcgcctgccnnnnnnnnnnttcggggcgggccgttcggccggcgccgcttcagagatacccatcgtctcaagcccccaccggagtgccccgacgccccccccccgccccgccctccctgtactccgtcctctcgcctgccccctcccttgtgacaaaacccgtatgtttcttcctagcttactacccagcgatgctctcaccctacgtgcctgcctccaggctgccatgcctgaccctcatgcccttatgtttgaaatatcttctgccccgcggcccctccgggggtccaccgaggaatcccctgctctgcccagacggtctgtaccatatgtgccctgagccaccaggattgacacaggcagcagccgtcaagaggagccaagagcgtcagcggcgacgggcgctccgcccaccctcacccctgctcaggctnnnnnnnnnntcagcagccgtcaagaggtgccaagggcgtcagcggcgacgggtgctccgcccaccctcacccctgctcaggctccccctcctcacgggcgtgctcctccgccagcgacatctgggtggtcggaggcgggggagtgggcggctgtggggggtctgatgcagatgcctcgcagccgccctgctgctgcatccaggggttcttagaatctcgccctcctgtcctcgccggcccgagaacagcacggcaaaacgcaagtccatcctcgctgcccgcatgcgggcccctgcccattcccccgtcgccgggatcaaaccctcttacctggagcgcgagagcgagctccggatcgtcctcttccatgccctcctcctcctccctcgccggtggggcggggcgcggggcctcctccttgaccggcgcggcgggggtgacggcggccgccgtggccgcggccggcgtgggctgctcagcctgcatggacagggccagcgcctcctgcagcagcacgtcctcgtccatggcctccacgtcgtcagcctcgcccgccggcgcgggggccgcggcgcgcggggcgggcgtcgcggcgggcgccgc

SEQ ID NO: 43187 - DNA, 69 bp, Chlorella protothecoides
ctcctcctcctcctcctcctcctcgtcctcctcccctgcccgcccgcctcccaaggaccctgccgggcc

SEQ ID NO: 43188 - DNA, 61 bp, Chlorella protothecoides
cccccatccatacacaccgtcttgtggccggtggcatacgccaggtcaccaatgtggtaga

SEQ ID NO: 43189 - DNA, 19899 bp, Chlorella protothecoides
  modified_base (2935)..(2944): a, c, t, g, unknown or other
  modified_base (3205)..(3214): a, c, t, g, unknown or other
  modified_base (3603)..(3612): a, c, t, g, unknown or other
  modified_base (4050)..(4059): a, c, t, g, unknown or other
  modified_base (5800)..(5809): a, c, t, g, unknown or other
  modified_base (6887)..(6896): a, c, t, g, unknown or other
  modified_base (7429)..(7438): a, c, t, g, unknown or other
  modified_base (7936)..(7945): a, c, t, g, unknown or other
  modified_base (8542)..(8551): a, c, t, g, unknown or other
  modified_base (8779)..(8788): a, c, t, g, unknown or other
  modified_base (9030)..(9039): a, c, t, g, unknown or other
  modified_base (9116)..(9125): a, c, t, g, unknown or other
  modified_base (9209)..(9218): a, c, t, g, unknown or other
  modified_base (9854)..(9863): a, c, t, g, unknown or other
  modified_base (10279)..(10288): a, c, t, g, unknown or other
  modified_base (11501)..(11523): a, c, t, g, unknown or other
  modified_base (11606)..(11615): a, c, t, g, unknown or other
  modified_base (14255)..(14360): a, c, t, g, unknown or other
  modified_base (14629)..(14638): a, c, t, g, unknown or other
  modified_base (14736)..(14745): a, c, t, g, unknown or other
  modified_base (14814)..(14823): a, c, t, g, unknown or other
  modified_base (14892)..(15127): a, c, t, g, unknown or other
  modified_base (15462)..(15471): a, c, t, g, unknown or other
  modified_base (16178)..(16187): a, c, t, g, unknown or other
  modified_base (17396)..(17462): a, c, t, g, unknown or other
  modified_base (17824)..(17924): a, c, t, g, unknown or other
  modified_base (17998)..(18007): a, c, t, g, unknown or other
  modified_base (18915)..(18924): a, c, t, g, unknown or other
ccggggggggggggggggtaatgcgctttggggttgggacttgggaagcttgggcggggcgggagggggatgaggaaacaacatggcgcccatggccagaggagatggtggtggccagtcccgggggatgctggttggtgccagccaccatcatgccactggccctcagcctaacaaaagattccccggagggatccagcaaacgcacctgatgggaacggcgcggccgcccgccgcctcgatccactttacaaaccctgcagctacatatgacctgtagggatgatgaacggggagtcggggttagggtccgcgcctccttgggacccggccgggcgggtggtgatcagttctttcggacaggtcccgaacgacgatcctcaccttccggggcagaagtggcaggcctgagtcaggataccgatcaggggtttatcgttcttgtacttgccatccaccccgtgggcctccgcctccaaggtgtcggcgtctaggagctgacgtccggtggcaggggcagtgcagatgcacaggagagccaggagtgcaaggggcaccactttattcaccatgatgttcacaatgctgtgaataggagagtatatgacggtcgtgagtgggacagatgcaacaggttgacttccgaatgcagtcgtacacaggtgagctgagcccaatacttcaaaacatggtaaagagcaactcgcctgaaattatgtcgctgcattcactatgtggcgtttcctaaaggtgggcagcgccataagtaggcagcggccgggccgctccccccccgctcgacagtcacgaggaaagattggcgcccgcgggtccccacgtgcttttgataccacaccacatgaatttagattgatgatccctgagatatccaccagccagctcttgatacatcattatgagttagagcaagcatggaaagttgttgcaggccgctcatcggtggtgggctaaccagacaatttacaccactctcggcccctcgttcattccatcatggccagcagctcgaatccaagcgccggcgcagcctgttacatgggcgcgaggagtcatcgacgacgagaataacggtacagagggtctccgtgggtgtcatgagcacgcagtctggctcctctgcgttcatgaggccaagccgctcgagttccatgcctccatgcgcaggccgtacctccactccagaatggggctgccgtccctctcaacaccaggcgtctgtccaataaggacatggagtccgtcctggtggggatgggcaccgactacgacccccagcgcctgtctgcatccttccgtgataggaggctgggcctcacctcccgatcgattgccgtcttctcaaagctcagcgtatttgcagccaaggtgaaagttcattgggagcatgcttgagtttaccagctgttgtgcatatgtatgtgagggggagggaatgcagggtccctacattgctgttgatctttgattttgagtggtcagggtgaccgctcagatgtaaaccgacaaggtacaatgccaagcttgcgacgtcatccatcacatcagcctcatcctttgatccgtcctggacaatgctaggtggctctggacgtagcacaaggaaagttcctggagcgggctgatgtcagagcccccgagctgcgcgacctcctcgcgagtctggggccggcgttcatcaaagtcgggcaggctctgtcatgtgaggctggggacctggtcacggaagggcaattgtcgacagactggtctcaggcctagctttaaagtatgctttgtgataagatcattccctgcttggggcacccccaggtccaatatgttcctgagcaaggatctcccctcccccactcgacattacattgttgttgcagcccgtcccgacctgctccccccggagtacctggcggccctggcgacgctgcaggaccggctcccgcccttcccctctgacactgccaggcagctcatagaggccgagctgggccggctcatctcccaggtgtacagcgagctcacgcccgagccagtggcagccgcgagcctcggacaggtgctcaaggatgacttttgggataagcttgttgaagtggttcatgccaatgcatgcttggtcccacgcttgctgcagatctggtgcgtggagtgtcgtctgccagcgcctgcccatcagccatcttcgctcccccttgcccacacgctgtaggtgtacaggggtcgactgaggtccacgggcgaggaagtcgccgtgaaggtgcagcggccgggcatcctggagcagatcgcgcaggacatggtgctcctgcgccgcgtcatttcggcagtagacaagcagccctccaaattgtccctggtgggtgtggtgttatataagggtgaagtcgtgacggtgatgggtttgggaacgatgtgcactgggtttcctggctgtcgacgagtctttgaagcttgttggaagcagagcatgggtcctgcgatgattcctgggctcgtacaaatattcatctggaacaagcacgcccacgtttcccctttttcttctggtgcagttctcccagcccctgacgccgctggtggacgagtttgcggcccggctgttcggcgagctagattacatgcaggagggccggaatgctgagcgtttccaggccctctatggcaccatgccgcaggtgcccgagacggcgcaggcttgtggacggtcttgaggctgactgatcttaggctattgccatgaagtccacatgttgcctggcagcatggactggggctccatctgggagtgcaggctggcacaccagactctccaagtggctagctgtttcttgtgtcccaacatgcgccattccatagtccgccatcccccacttgcgtactcctcaaactaggtgaggacacctgcgatcaagtgggaggnnnnnnnnnncatccccatatgcgccactccatagtccgccattccccacttgcgtactcctcaaaccaggtgaggacacctgcgatcaagtgggaggccacctccagacgtgtcctgaccatggagtggatcgagggcgtgaagctgacggacaaggtgaggctgtagccctggggaagttatcattgagtttgccaggtcttgtaacctgccgtgatgcgaagtatggcacggcatgaagtactgccccttacagcctctgttctctgnnnnnnnnnnctgccaggtcttgtaacctgccgtgatgcaaagtatggcacggcacgtagtactgccccttacagcctctgttctctgcgtctgtttgctgcctcgtcgatcacactccctggccaatccctgaccctcccaggctgccatggctcggagtgggctgtcggtggtacagtttgtggacgtcggcatcgagtgctccctgcggcagttgctggagcatggtttcttccatgccgacccccacccaggtgactggctgttcagagggaggagcattgcaaatggttgcctcatctctgggtgtggtgtatgcttgcacgccttgcctcgctgtcatgcagcgcagccagtggtgggaaactgtgctgcgacagggtcttgacgtgtcaccnnnnnnnnnntagaggggggagcattgcacatggttgccgcatctctgcttgtggtgtatgcttgcatgccttgcctcgttgtcatgcagcgcagccagtggtgggaaagtgtgctgcgacagggtcttgacgtgtcacccccagctcgtggccatactcttgaccaaaagctcatgttacagccctgtctggagccgcggtgtcgaggctcagtgatgcatgcccttcgcagtggaaagtagccagcccccctatcccgactccgctcctgcacccccagccatgtgcccctacccaatcgcgcagccagccctccacatgccccccatcacggcccacccaccctaaaccccacaggcaacctgctggccacggcaggcggggacctggtgtacctggactttgggatgatgtcagagatgccgcagggcgcgcgctatgctgtcnnnnnnnnnnccagccagccctccacatgccccctatcacggacccccacccacccaccaccacccaccccaaaccccacaggcaacctgctggccacagcaagcggggacctggtgtacctggactttggaatgatgtcggagatgccgcagggcgcgcgctatgctgtcatcgcgcacatcgtgcacctggtcaaccgcgactaccgcgccatgacgcgtgactactacgcgctggacttcatcgaccccagcatcgacaccagccccatcgcccccgcgctggccgccttcttcgacgacgtgctgaccgcctcggtgtcaagcctgaacttcaaggcgctggtggacgggctgggggaggtgctcttccgctaccccttccgcgtcccgccctactacgccctcatcctgcgctccctcactgtgctggagggccttgccctgtccagcgacccagactacaagctgctggctcaggcctacccctatgtcgcgcggcggcttttgactgaccctgcgcccgagctcaggtgctttgggggagtcatactggggaaggtgggggtggaggggaagaaaggaggggtagatggtgggaatgcggttctcatgtctgcacgacaggtgggagaatggcaggtgggcagcggtgtgcatgctcagggtgaggcagcggctgctgttcaccagtcaacggttgcgccatgcagtgatcactggccgccactggcatgcctgatgtgagagggccttcccattcggcgccctgctggagttctgagcgtttgttgaggtggatgcacccagagacaccccccctgcccccgaaatctcccctgcccccctctcccccctacacacacacgctcgcaatcagggcgtcgctggagcagctggtgctgacgcccagcaagcagctggactgggaacgactggagaacctggtggagaacggtagccgggccgcggagtttgaccccggccaggtctggctgctggccgattgggtctgctcgcccgccggcacggggctgcgcgccagcctgaccgcggaggtcacagccctgctggacgcggtggcggcacgcgcagcgcgcgccgacttggcggcccgcctgcgcaatccgggtctggcggcccgtctcgtgccagagggcaggggggaggccgccagcgccgcgcgcgctgagctgctgtggcgcctggcccgggagacctcgcacgccaccacctcccccctggctggcgtgtttggcacgctcgccgacctgcagggtgagaggttggtagcttgtttgcgtctggttttctcctctctccagccttcaactccgccaatcctgccaagccctcccccacccctcccctctctcaaggcacgcgccctggcgcagcgctgaggcagctgcaggagctgctgctcaacgccccgcccgagctcaaggacggctttctgcgtcccgaggttcaagagatggtggcaggcgtgcagctggggctgatgcagcgggccgctgctcgggcggtgcaggtgctggcgtcgccctggggcaacaacgtcccggcaacgggcgagggcaggggggctcagcgcggattcttatagccgagtggtgccccagaccgtggcacctttgtgcctcgtctgggacactgaaagtcctgtgctgaccaggtcgccctgcaaaacctcgattgttttattcctctgtaaaatagcctaagaagttcaggggcttgcatcccgnnnnnnnnnncgaccaggtcgccctgcaaaccctcgattgtttgattcctctgtgaaacagcctaagaagttcaggggcttgcatcccggtggcctggtgctggagacgaatcagatttccgctgatctgtcagatctgcgctgcgtcacccccagctgcgcaccagggtacagcccctcccgccaggttcgaatggtcgacagcgccacaatccccatccggcgagccttcatccgcactcgagcaaggaagttttcatcccgaaatccttgccctttctgcgccggctctctctccggtgcgcactccgcaccagacccttttgacgagggcgggccagtcactttcagaacagcggcacgaccctccccctggctccaccgccgattcgagcctgcatgcacctggcaggcgtaaacgtgtcccctgtgccctcccgtaacgtccgtgtgacctgtgctcgacccggctcgcgcgcgcgatgtctgcgcgtctctgctgtggcgaacttcgtgcgaaccagtcctggacgcgaggcggtgctgtgccagaagttcaagggccatgattcggcagttgccgcctccctcgtcttcgaggactccggtgagggggggccaacgggctgcgcccgaggcatgcaccttatccggagggttcgggcgcccgggtgccagattgtgtgacgacagcccgtgcctccatatacgaggttcgaggaaccccgtcctcacctcccgactatgaatgtggcctgtcgacatgccacccctgcaaagcctcggtgatactgggagtgctcaggtgatgttgcccctcatgcgctgcagagcagcaaaagcttgtggtgacgagcagcctggacaagtccctccgcctctggtccagcaatgtgagtgtggccctttgttcggtgtcatcgtatatttgattacctttggcccatcggtatgacaaggaggggcctgtgcatggctgtgtcgggggcctgagtctcattctcaaagtctccactgcccacgagatcctccgctgtatgtctctcagggaaacaccgactccctgtgctccggaggcttcaccaagnnnnnnnnnngagtctccactgcccacgagctcctccgctgtacgtctctcagggaaacactgactccctgtgctccggaggcttcaccaaggcagccgacctcaacccagagggtggcccaatcttcagcctgattgaggatgagcgctcattcgacggcctgaccaatcagatcttcctcggcaagcaggctcgccagatcgtggcctgggtgccgccgcgtctgagcctagacgacaaggtgtgcgggtccagtgttggggctcgtggatgtaatctggtgtgcttcagcgtcagagtcgagggaaagttcccaccgcaatcgaaatgttgccggcgtggcaccctgggcatggtctggagttcaatccacccgtctgcctcagtaggctgtgtgggcttttcccattgtgtgcttgctgccaattcccaggggccatgtgtgcactggttgtcgtgctgcgtcacgctcaacttcaccaaacctccgcaattcccccctttccaggtggtgcttggggaccacaagggctgggtgaggnnnnnnnnnnaactgattgtcgtgctgcgtcaccctcaacttcaccaaccctccacaattcccccctttccaggtagtgcttggggaccacaagggctgggtgagggcgctggccacctccaggacgcgctggctcttctccggctcctgcacccagctgcgggtgtgggacctgggccgcgccgtcccccgctgcgtggccaccgccagcgtcgaccgcggcgacatcgtgtgcctcgctgccaacggcgacgcggtgtatgccggcaccgccgacggctcaatttggtggggcacgaggaggtgtcactctttctgcaggggggagtggagggggacagagcacagcgaaggtgttctggcgtgtgggatgttttggtgtcattctctgaatgcagtggatcccacttgcaccactgcgaggtggaagtgggttcgacacacttccacaatccgacccccacacatccctcgactggcaggatgtggagcgtgggcaagaagggcnnnnnnnnnngatctggtggggcacgagggggtgtcaccctttctgcaggggggagtggagggggacagcgcacagcaaaggtgttttggcgtgtgggatgttttggtgtcattctctgggtgcagtggatcccacttgcaccagtgcgaggtggaggtgggttcgacacgcttccacaacccgacccccacacctccctcgaccggcaggatgtggagcgtgggcaagaagggcgagctcaagtgcctgaagacctggcgcggcgcgcacgccgatcgggtgactgccctcgtgctgcgaggggagacgctctactccgccagctacgacggcagcatcaaggcctggtctgcagagggcctggacctgctcatccccctggaggccgcgcactgcggccagcgcatcaactgcatgacggctgggccggacggcctcctgtacagcggcggcgacgacaaggtgtgcttgctcgtggggctgcggggaggggggggagcaccgtgtctggatgcgcgggtgcagcagaggggtgggcgagcagccccatgaggaaagccgggcgaggcgatcgactgcagaggggccacccaccttgtgtcaggnnnnnnnnnntttgctcgtggggctgcggggagtgggggaggaccgtgtctggatgcgcaggtccagcagaggggtgggcaagcagcccaatgtggaaagccaggcgaggagattggctgcagaggggccacccaccttgtgtcaggtccttggccaggctgtaaaccgactactcaatcagtgcctgacccatcccacacacaccttggaacacacagctcctgcgtcgctgggtcnnnnnnnnnncaccgaccactcgatccgtgcctgacccatcccacacacaccctggaacacacagctcctgcgtcgctgggtcccgtcgctgctgatgcccgcggctgcggcgctgcactgccaccaccacagcgtgcgcagcatcgcggcaggctccagcgagctgctcgtctccggggacaagagcggagagctggccatctggaagctggcggggcccagtagcgcgctgagcccctgagccctgcagnnnnnnnnnngcagggtgacttgtctttgcagtcccacacatcgcatgccgacccgccaccccaccacccccagccgcgatttgatnnnnnnnnnnttggtcccggcggccagccgccgggcgtctaggacctcgacagctgtccttgaagatgcctctctctggctaccgcgaggtccnnnnnnnnnngaggtcccggcggcttgccgccgggcgtctgggacctcgacagctgtccttggagatgcctctctctggctaccgcgaggtcccaggccccttgacacacccaagtacagggtgacttatctttgcagccccacacatcgcatgccgacccaccaccccaccacccccagccgcgatttgattgcgcgcaagaatgcgtcgtgtgccctgtacctcatctcgcagggacgttctctcttcattctcgttcctctccccttagttttccacccctccctccagccaggtggggggtggccctcgcagttgtgcccctcatgtacttgttccccccttcattcccgaacagggaaccctttgcgcccatctttcccaggcccgggcgcccccacacccgagtgacagcgcttgccgctgtggctcggcatgacaccgcgtcacatggttgccccaggagcaagatacctcgcatgcatgccggaggggagctgctgcgtgccccctcgtgagatgtaaatgcccacacatgagcaggggccggctgaatggacgcgttggggaggttgtggcgggcagctgcaagaaccttccaggcatgcctgtaaacacaccgccgacttgatcccatgctgctcnnnnnnnnnntagcaggggccggctgaatggacgcattggggaagttgtggcagacagctgcaagaatcttccaggcatgcctgtagacacaccgccgacttgatcccatgctgctcccctcattcctggggttgcagagggtccggttacaaagaccaggtgggacacgggggtgtaaccccgagtcatgccttctttcttcaaagcagagactatagacgtgacaattctacgccagcgcgggtgcggtgtggtttgggaagagcggggccgggggcgtcctgggatgggccaggggttcccacatcattccgcagcaagccaggatgatggatggatgcggcccctccgcgacaccagggggaggatccgggaacagcgctcctgatgatggagggcgcctgcgccctcctggccgctggggnnnnnnnnnnaaccagggggaggatccaggaaaagcgctcctgttgatgtagggcgcctgcgccctcctggccgctggggcccgggctcccccttcggcccctcctccccgagcatgggtgctgctcgctcgtgcgcctcgggcgctcacttctcggcctgggacttgaggtttgcggccatggcgttaagcgcggagccgtgcttgaaccaggtgatctggttgtcgttgaaggtctggttgacggggaactcgtaggtagagccgtcggggcgcgtcccggccacggtcagctgcttgcccggggcaaaggtcttcaggccgcggatggagatcttgtcaaagggccccaccttgtcgtagtcggcagggtcggcaaaggtgaggggcagcaggccctgcttcttcaggttggtctcgtggatccgggcaaaggacttgaccagcaccgcggccgcgcccaggtggcgcggctccagggcggcgtgctcgcgcgacgacccctcgccgtagttctcgtcgcccaccacgacccagcgcacgcccgcggccttgtaggcgcgggccacgtccggcacgccgccgtactcgcccgtcagctggttcttcacgctgttcacctcgccgttctccgcgttcaccgcgccgatcagcatgttgttgctgatgttgtccaggtgcccgcggtacttgagccagggccccgccatggagatgtggtcggtggtgcacttgccgcgcgccttgatcagcaccaacgcgccctccacgtcctccccgtcccaggccttgaagggctccagcagctgcaggcggctggactgcgggtcaaccaccacctccacgttggacccggcgggggcctggtacgtctcctcccccgggtcgtagccgcgggggggcaggtcgtcgcccgtgggcggctccagcaggatctcctccccgttcttgcccaccaacgtgtccttctccgggttgaaggtcaggtcgcccgcgatggtgaaggcagtcacaatctcgggagacatgacaaaggcatgggtggcggggttgccgtcgttccgcgccgcaaagttgcggttgtaggaggtgacgatggtgttggctacgcccttggccacctccgtccgcttccactgcccaatgcaggggccgcaggcgttggcgagaacggtgccacccaccttgatggttttagggggggggggggggggggggggccnnnnnnnnnnnnnnnnnnnnnnnaggagttgatcagtacggaagggaggacagggaagcatgggtggggttcggattcggacccctcctctggagcacccctctannnnnnnnnngggggagaggagttgaccagtacggaagggaggacagggaagcagtggtggggttcgggttcggacccctcctctggagcacccctctacccctcccacacacatccccccccccctccaaaagccaccaacccctcgcaccttctcgaacacctcgatcaggccgtcgcgctcgatggtggcccggatctgctcggaacccggggtgatggtgaagggcaccttggccttcaggcccgccttgatggcctggcgcgcgatggacgcggcgcgctgcatgtcctcgtaggaggagttggtgcaggagccgatcagcccggcgctgatctcggtgggccagcccgcggcgcgcgcggcgtcacccagctcgctgatgccgtgggccaggtccggggtgaagggcccgttgacctgtggctccagcgtggacaggtcgatctcgatcacctgatcatactcggccccggagtcggccttcaggttgtcgcggaaggagtcggccaggtcggcgatctcgcgccggttggtggccaccaggaagtcgtactggcggctgttgaaggggaacatggaggtggtggccccgatctccgcgcccatgttgcagatggtggcctgcccggtgcaggacagcgcctccacgccggggccaaagtactccacgatggcccccgtcccgcccttgacggacaggatgcccgccaccctgcagatgacgtccttggggctggtccaggccgagggcttgccaaccagccgcaccccgatcaccttgggcgccttcagctcccagggcaggcccgccatgacatccaccgcgtcggcgccgcccacgccgatggccgccgcgcccaggccgccgccgttgggcgtgtgggagtcggtgccgatcatgaggcagccggggaaggcgtagttctccagaacgatctggtggatgatgccggagccgggcttccagaagccgatgccgtacttggacccggcggacgccaggaagtcgtacacctccttgttggtgatgttggcgtacttgaggtccgccacgccgccatacttgttctcgcgctcgctctggggagcagtggtcccctcgatcaggtggtcgcagtggatggtggagggcaccgccgtcttgggcaggcccgaggagatgaactggagcaccgccatctgggcggtggcgtcctgcatcgccacgcggtctggcggcaagggggggggggagggggaggtgagtctatgtgcatgatctccggtgcatcagtgtataatgctatgcacggggtgtcctgcgaccacttccctcagtggtctcctttccaacatctcgcctctcctgatccccattacatgggaccccctctggcccggcgaccgatcacccgcgccatccactcaccagggcgcaggcgcaggtagctgacgccgcgctcgatctcctggctctcgggctcgtcaaggtgaccgtagaccactttctcggcaaaggtcaggggccggttcaggcggccgcgcacgatctggaggcagggggcgaagcacaagggtcaaaccctgtgggagagactcgcgagaaccctcggaccctcggtgccgcggccgcgagcaaccccaaatatgcagcgccgaggacctttaactcaccccaagcctcttctcgatggcgtcgtaacggtcgttcacgaactcgtcaggctcgacacggctcatgggcgcctgcggcgacggaggcagcaggttggaacgctacatcgaccgcaactatacaatacgaaagagcctatatttcaacgacgcacctttgtggacatgctggcgctcacggagaagcggccatacagcttgccggcccgagcctgtgagggttggtggagagggggagagtgaggtaggtacaaggccaaaccccatgcacgcctcctcgcctatggcccagactagtggatcgaacgccaacataccccgttcagggcccgctgggcggccttgcagcagtgcatcctggctccccctccgctacggagtgaatggcagggcagcaagggtagtgaggggtgaacacgcagtggggtcgacagagcaccgaatgatcttgtcaaattatcagtatgacggcgcaagggggactgcgatgagataagcgctctgcggttgcattagtaaaaagttacaatcacagggctgacgcggggtcccattgtagaaaggccgaccccggcgggaaatcgaggggactgggagttccctgcacggagagagggagcaaaccctgtctgtatctccggcaccgagctgtgcctgcagggacggagcactcactgcgatcctgagcatcgctttgaaaagatcacgagaaggggcacgcgaaccccgccctgaccaggctcctgcgcccagtctcactgcgtcacggtcgcaggtgtcccaagccctgggactcgttgaggcgccatgtcccgggccaccatgacagccctgagggcattgatgccgcgacatggtgagaccgattgtatctggtgggggcctttcaggagaggggaggttgtccagcctcttgcacccgtgtgggcacggcacgttaccccattccgcccaagagcctggtgcctcgcaatgcgatcacaacgagccacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctctagccgagggatggccacctaccccagcgagctcgccatccgcaccaactctgcaattcagggcggcaagggcgggcgctcctcggtgcgtttctggttggatggggttagtcgggaacatgcttgcgagccctgatgggagcagtggtgtctgtcattcgggctccacacgccatcgcactgcgcccggccatgggcccctcttgcagagccacctcgtcacgcgtgtcaccgtcgcacccaacccccacctccgcaggtgagcnnnnnnnnnncagccatcgcactgcgcccggccatgggccccctccgcagagcccacctcgtcacgcgtgtcaccgccgcacccaacccccacctccgcaggtgagcnnnnnnnnnncgaggcgatatttgtttcccataccatgagcggcgcttcggttcctgagcaggtgcggccgtggaggcnnnnnnnnnnagaggcgatattcatttcccataccatgagcggcgctacggttcctgagcaggtgcggccgtggaggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcgtgacggccaccatcttcggctgctccggcttcctaggccgctacatcgcgcagagcctggctcgcattggctgccagctggtctttccccaccgctgcgacgatctggacgtgcagcacctgcgccccatgggcgacctgggccaggtgagaggggatgtgtgtttggggtttggggggggggacgacagcgtgctgcgccagcagtcctcctcgcttgttgtgagcccacacccgacgttgtgggagggccaaaccacttcaatacatacccatatcgccccccctccccccccctttcaatcaacacccgcaggtggtgatgctgcccnnnnnnnnnnagggatgtgtgtttgggattttggggggggagacgacaccgtgccgcgccagcagccctcctcgcttgttgtgagccctcccccgacgttgtgggagggccaaacctcttcaattcatacccttatcgccccccctcttcccccccttttcaaatcaacacccgcaggtggtgatgctgcccaacttcaacccacgggacgacgacgcataccgccgcgccatctcccgctccaacgtcgtgatcaacctgatcggcgcggaccaggagacctggaactacgggttcaaggaggtgcacgtcgacatccccgcccgcatcgccaaggccgtgcgtgagcacggcggcgtggagcgcgtgctgcacttctccaacatcgccgcgcggcccgacgccgtgtcgcagcgcctgcgcaccaaggcacgctcgggtggtcggggggtgggggggggacctggggccgagtgggaggcgtgggaagatcgtttcagccttcggcggcaagcgagacgtgggctcgagggatcggtgcgccggccccctcctgagctgcggcggagcggaactccgatgcccgcacgcgcctccgccgcgctgccgtgcctgggcgtcctgcgatggcatgcagccctgagtgccccgcccgccccgtgcatcccaagactcacccctctcctccaccgaccaccctctccacggtagggcgannnnnnnnnngcccctcctgagctgcgtcgagcggcactccgatgcccgcacgcgcctccgccgcgttgccgtgcctgggcgtcctgcgttggcatgcagccctgagtgccccgcctgccccgcacatctctggactcacccccctcccccaccgaccaccctctccacggtagggcgagggcgaggcgctggtccgctccgagctgggcgacctggccaccatattcaaggtggcccccgtcaccggcaccgaggaccgcgtgttcaaccagctggcgcgcctgatcaaggcctacccggccctgcccctggtggcgggcggcgcgctgcgcctgcagccggtgtgggtccgcgacgtggcccaggcggtcttcaactcgatgcaggaggagggcgcggcggggaagacctacgcgctggcgggacctgaggtcctcaccctgtcccagctggccgacctgacctaccacaccatccgcgagccacacaatgtgctgcccgtgccggagagtgagtggggggacacatttattgatggacagggggagggcgccccaggtctgctctgcctggcctggtggtgccccggtgcagcagatacagcgggccgaaggcgacctgccatcgtgcactctggcactggtcagcgcgcggccgaccgggccgcaaacctcgagcggggatggccagcggaacagaatgtgtggagcacaggaccgggcagtctgccggcttttcaatcccccctcacaaccccaccgctcctcgttcaacccccttccacacacccacactcaccaccatgaatcgcagagctggccgagctggcgtcccgcccgctgggctggctgggcaccaaaacgcccttccgcgccaaccccttcttctcctccgactccgtcgccgagctggcccgcggcgacttcacgctggccgccgccaccgccgaccagcccctgctgaccattgaggacctgggcgtggcgccgcgccgtgtcaccgagggccaccccatcgagttcctgcgctattaccgctccggcggctacgacatgggcgcggtggccgaggtggactctgcccccacgcccgcacgctgggagcggtgatcgctgggtgctggcgtggtgcctgggcttgccgaggggcgcgcgcgctcggtctgtagaaattgtcacggatgagtcaggtgccgaggccgagtcagctggagggagnnnnnnnnnnnnnnnnnnnnnnnnnnnnnnnnnnnnnnnnnnnnnnnnnnnnnnnnnnnnnnnnnnncctcggcttcatgaacatcctgtggggaagcaaattcgtgtttaaagacattccaaccaaatcgcatcggcctctgatcatgctgaggctggccacggcgagactgggagccgtgggtacgggagggcggagcctgagcgccctcgccggcccgcgagatcaggtacacctgcgcggcctcattttccacgggcaccatggcgtgtacgaagaggtgggtggctgatgattatgcaggcaggcgtcttgtctggtgcgatggctggagcaaacggtggtgtctgcttgtaggaccccaccgtatgcttgatcccctgcccccaaaaacacaaatcgcgataggagcgcaagctgggccagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtgttcagggtttttggtttggagggtgcaatccacaaccccaaccctgctgtcatgctgcacgatctacagnnnnnnnnnncgcggctgatgattatgcagtcaggcgtcttgcctggtgcgatggctggagcgaacggtggtgtctgcttggaggaccccaccgtacgctcgaccccctaccccccaaaacacgaatcgcgataggagcgcaagctgggccagaagttcaggatcgacgtgaccctggacacctgcttggctgatgccggcaaaagcgacgacctcaaggatgccatcaactatgccatcatctacaagtccgtgttcagggtttttggtatggagggtgcaatttacaactcaaaccctgctgtcatgctgcacgatctacagcgcggcctccgtaacatcaagcatgttactgcagcctctgtagcctcaagcattccccatccacgtctgcccgcaggacggtggagggtgtggtcactggcccgccggcccagcttctggagtgcgtggcggagcgcatcgcctccgccatcctttcctcccagtcccgcgtcaacggcgtgcgcgtggaggtggccaagccgcacgtggccgtgggtggtgtggtggagggcctgggcatctccatctaccggccccgggtggctgtgtgagtgcaggccttagaaaattgggcatgcgccaaaggggtgtttccgcggcgctgggctgcagctgccgctgggtgcggcatgcggcggccccaccagcagcgcggcttggcaaatcaaggcctggccttgctcggcggcgcaccccagcactgggtgctgcctggaggctgctgcgctcgtgcctgagggatcaagcacaggcagcctgtcggaagcgctgcacgcgaccacggcttgcacggacgtgcctgccctctccagcgacgattgtggctcgtcggctcatacctgcccgggcatcgacggtcaggagggccactgnnnnnnnnnnagctgtggctcgtcgggtcatacccgccccgggcatcgacggtcaggagggccactgcccgcatcccgtccggctgcatgcgccgtgcgcacggcgctcggcgtctggtgcgcctcgctcgtaggactgcggacgacccccagtcaggcgcggggcacagccaacaagcgcagcaccagccgctgctcccgggcctggttctcccgcgtctggaccgtgaggtagcccgcgaatcggggcccgaggtccacctgccccgtggcctggccgtcgcccatgcgccgcaggtcgttctgcggggcgggggccagtgggcgggtgtgtttgacgcactctcagggcgccgtgcctgggaccttgtgtcttgtaacgtcggggaagcagtggacgttgcgtacaggactgaggagacgggcacgatctcggcctgactcaacaagcaaggagtcgggtcggcgggccaggtgttgacatggacactcggtccacagtgcaaaccaccagacaggagcgcacacaggcacgcgccgcttccccaatcgcccagtgcccagggccctgatccccatcccaggcaccccccctccccctcccacccatcgcacctccccctgcgggccaaactccttgactagcagcctgaccacgagcgcccccggccgcgccagcaggcccgccagcttgcgcgcctccgcctgcccgatgaggaaggactcgatgaccatggcctccacgccaaaccccgcccgccccgcctgctccgccgtggcgtacgcgtccacggtgcagagcagcgcgggcgccgcgccccgcacccggtccgccatgcgcagctggccatgccagacgaggacggggggcgccgatggcgcgaccccggggccggcggcaggggctggcgccgtcgcggcggggcctagcatgggaaccggcgcctgcgtggccggcaggtggggcggcgtcccgccggcgcgc

SEQ ID NO: 43190 - DNA, 61 bp, Chlorella protothecoides
atcaagtttgacatcataggctgttctggggtttcacatggtggaatccattcccaaaatc

SEQ ID NO: 43191 - DNA, 74 bp, Chlorella protothecoides
tcaggccctgttccagttggtcagtgagtgggtcgagggagcaggagctgggaggcggcatgctaggtgcagca

SEQ ID NO: 43192 - DNA, 79 bp, Chlorella protothecoides
cccgcctctgaacctccattgatgcagggtaatagaagccacataccaactcgtgatgctgcccgacggccacgtgctc

SEQ ID NO: 43193 - DNA, 7748 bp, Chlorella protothecoides
  modified_base (105)..(118): a, c, t, g, unknown or other
  modified_base (432)..(441): a, c, t, g, unknown or other
  modified_base (1180)..(1189): a, c, t, g, unknown or other
  modified_base (1259)..(1476): a, c, t, g, unknown or other
  modified_base (2016)..(2025): a, c, t, g, unknown or other
  modified_base (2388)..(2397): a, c, t, g, unknown or other
  modified_base (3614)..(3623): a, c, t, g, unknown or other
  modified_base (4430)..(4439): a, c, t, g, unknown or other
  modified_base (4958)..(4967): a, c, t, g, unknown or other
  modified_base (5062)..(5071): a, c, t, g, unknown or other
  modified_base (5762)..(5771): a, c, t, g, unknown or other
  modified_base (6040)..(6049): a, c, t, g, unknown or other
  modified_base (6545)..(6554): a, c, t, g, unknown or other
  modified_base (6949)..(6958): a, c, t, g, unknown or other
  modified_base (7149)..(7158): a, c, t, g, unknown or other
ggggggggactggagggcatcggagcgatcatcatcatgacaactcacagcatctgcccagcaaaccctgccagcgccctgcacaatcacaggaccctgccaagnnnnnnnnnnnnnntcatcaacatgacagctcacagcatctgcccagcaaaccctgccaacgccctgcacaatcacaggaccctgccaagcgcctgggctccgtgacggggggcgacgacctcaaatcccacccctggtttgccgggatcaaatgggccctgctgcgacacagcgggccggtggaccttgcaggggtgtggggggacgcgggtggcgagccggcagaggccccgggcaccggcacgcccaaggtggggagctggtccgacggcgacatgccccccctggagtagacgaggcggcgcagccgctggtggggagggcggnnnnnnnnnnacaccagcacgcccaaggtggggagctggtccgacagcgacatgccgcccctggagtagacaaggcggcgcagccgctggtggggagggcgggagggtcaggagccctcgtccctgcgcagagctcgtcagatcctgccagacgctcatcttgtcggagattttcgagggtggacgaggagcctcctctggtcgaggtggtggcactccttcgccccttcgcccaatcttgatcagcactcacctttcgtggtacgtttcccagcagtttccccttgccaggcacggcgagttctcccgtgcccaggcacgtgctgtgtcagggggcaaagcccacccaccgtgtcaaacgcatgcctcgagcccagcacatgcttcgaagctgcactcggacttgttgagtcttgtcaggacgcatgcaccttctcttccccctacttggcagaccccaaccctataaatgcatcaactcgttccataggccccaccctctttcaccccttgttctgacccatccatgcgtccaaacacctgttctaagaccttgaggacgcagtcctgtcccaccttatgcgttgctgtctgggagccgagtcctcagctaacctatttgtgcgcgtgtgccatcgcgcttcattccatggcccgggaatgtctcggcgcctgttggggatgacagaaagatccagtgctgccaatcactatacccaagaccctaacccccttaagtggctgctttnnnnnnnnnngctcgttcctaggccccaccctctttcacccctttttcagacccatccatgcgtccaaacacctgttctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaagattgagggtatgaggggagaccgaaggagaattcggacatctagcaaggataccatcctagtgactggtgccagagggattgtcactgttgagcgcaaccaccgaatttggtgatgcgggcgcttcgtacgcatgtgcagccgcaggcatgtccctcccacgatgctctgagaacaccgcatctcctccttccgggcatgacctcgcgaattacatcctcagggcgcgattgtagcatgagtgtcgcttccatgtcgcccagcagggccggcgtcgaccagagcttgagctcgggagcgaccttcatgacaggtgcccgcattcatgccgtccgacaagcatgcccctgccgaccccgaggacgccattccagggtacaggacagtgcgcgacgccgggatgtcgtcagatgcgccctggtgagtcgggaccctgggccccatgttgggcgcgcatgcgccatcgaagcagggtgtgtgcatcagaacgagccagccgtcttgtgagacgagattcgagggccatccccatccttnnnnnnnnnncccccatgttgggcgcgcatgcgccatcggagcagggtgtgtgcatctggagaagccagccgtcttgtaagacgagattcgagggccatccccatccttcaccctgcaggaccctggctctctcgtccttgtggcaggagccacggggggtgtcgggcaactggtttgtgccaagctcttagaggtgggtgtgggaatgggagccgaggccctgcactgacatgcagatgtcgcccacatcctgacattcagagcgggcatgggggattggatcccgctggagctggagagtgtccagggcgcaaccacccagccccccgctcccccccgccgagcagaggggaatgcgcgtgcgggccctgnnnnnnnnnnaactggatcctgctggagctggagagtgtccagggcgcagccacccagccccccactccccccgctgagcagaggggaatgcgcgtgcgggccctgtgccgcagtgaggagcgcgcggcacgcctgctggggcggcgggagggcctggaggttgcgctgggcgacgttcggcagccgtccacgctgcgccccgctttccaggcggtgcaggcggtggcatgcgccatgggcaccaccgccttccccacgctgcgctggctgggcaacaacacgcccgccgcggtgaacgaggcgggcacgcgggcgctgatcgacgccgcgcaggaggcctgcccggccgcgccctttgtcctggtcagcagcgcaggggtggaacgcgccgatcggctgccctacagcatcctgaacgcgggcggggtgctcaccgcgatggctgccgccgaggcggcgctgcgagcgtctggcctggcctacaccatcgtgcgccccggccggctcaccgacgggccctacacctcctacgacatcaacaccctgctcaagggggtggcgggccagcgacaggcggtacagctggcgagccgggacgtcctggacggcgaggcgtccaggattgcagtggctggtgagggacggctggtgatgtgatgcttgggggtggggtgagcctcggaggagcagatgcatgcatcaccgagtgcaggaaagtttcgaagtccaaatgttgtgtcggaatccggcagaatccaggtcctacaacccctaaaccccaaaaagtccacgtggtgcagagctggtggtccaagcgctggtgactggggccctccgcgacacctcggtgtccatcagcagcacgacgggctcggggcccggagatgatacaggagaatggaaaaaactcttccaaggtttggcctgaggctgaggaccgatctgctcccccgagtggaggggaaccatgggtctcggcattgggaagggctcccagctgtcggatggaacgggccccggggtcgacgaggcacaaacgatcgtgcgtgcgaagtgtcaatcggccgcgatcgatcttccttcactcgtgtaagtcgactatcgccgccaggcatcgcctgacgtcaataaccttgcatgccgcggtcccagtaggatacgcgcagcagccgcagcttcttgaaaccctaactagtgattccgtggtttccagacacgttcatgtnnnnnnnnnngacgcgcagcagccgcagctgcttgaaaccctaagtattgattccgtggtttccagacacgttcatgtcagctctcgactttccccacatcccaatagccgcgtggcgatttcggcctcgcgcatcttttcgtgatgctctattatttctaaagagtttcaatgacattaatgaggctttgttgacggctgcaagggcctgccccagcggctctgaccccccgtccggaccctccgtgcatggctgtcgagtctgaaagcagagctcgctcgtatggcctgcgcaagcgtcgatcctcccctgagtgcgtcatgctgtgagagatcgcgatttggggcggaaatcgagcctcgccttgtaatgtgttggtcacctgacttcccgcgtctctttcgtcatgactcaggctgcagagcccccatgacgacaagtctacgctggagcaggtgcttgccaccgcccgcaaagtggtcatattcactggctcgggcctgtcggccagttcaggtgccttgacagggcgtgctcagggtgtggggccctgtgcgcagggtgtgctgcacacggcagtggtgtctgcacagggcagtggtggctgcatcggcgggcaaggggcctgtggaaccacttgtggagtgcgtaggttcttgaggtctgcagggcttggtgttcatgtggcctcctgtggcattgttacccctgtggcaccatcgcctgggaccgcatggtgcgatgtgcctccagccatcccacccgcccctttccctggctcttcgtgcaggcatgtccaccttcagcaccaagggnnnnnnnnnntatctgcagggcttggtgttcatgtggtctcctgtagcattgttaccctgtggcaccatcgcctgggaccgcatggtgcgatttgcctccagccatcacacccgcccctttccctcgctcttcatgcaggcatgtccaccttcagcaccaagggagggctgtatgagcgagcgcagaagcgtttccgggtggtagacggcaagtccctcttcacctacgccttctacgccaagcacccccgccccgctcaggccttcctggcagaggtgcatggggaggcggtgcgcgccacgccggcccccggccactacgcgctggcgctgctgtgcagcctgggccgcctctcgcggcactacaccctgaacatcgacggcctgagccagcgcgcctcctccgccttctcctacagcaaggcctgcgcctggcacccagacgacaacccgggaggtgcgtggtgtacttgcatgagcaggtgtgttgatagtcgagctcccgcgggttccctcctgtgcagagtgnnnnnnnnnncgagcgagcgcagaagcgtttccgggtggtggacggcaagtccctcttcacctatgccttctatgccaagcacccccgccccgctcaggccttcnnnnnnnnnnccaaggcctgcgcctggcacccggacgacaacccgggaggtgcgtggtgtgcttgcatgagcaggtgtgctgatggtcgggctcccgcgggttccctcctgtgcagagtgagtgtctcatagcaagcgtggcgtcatcccctcatcacccacccccctcacatccccaggcctcctggtggagctgcacggcagcatccaccagttggtgtgcggcgcctgcggcgcgacccggcaggccgcccctgcccaggtgtccacgctgagggcggagggccgcgtcgcctgcccctgcggcgacccggcgggcatgcgcttccgggtcatgctgtacgacgacgcggagggcgagcgcatcacgcccgacgccgtgctggacgtgatggagggcgacgtgaaggccgcggacgtggtgctctgggtgggcatctccttccagcaatcagcctccacgcactacttccgctgtgtgcggcgctggctggccgaggcggggcgcacgcaggcctgcccccaggccgtggtcaaccccagtgacgaggcggtgtggaacctgcgcaccgcctccagcaacctgtgtgagcagtgaggggagggggtggagcgtggaggaggggcggcgaatgagggcgtcctgggatggggggcgcagcggggtcttgttcgggacgctggccgagggagcatcagannnnnnnnnncgaggggagggggtgggagcgtggaggaggggcggcgaaggagggcgtcctggggtggggggcgcagcggggtctggttcgggacgctggccgagggagcatcagatggttttggaagcgcgccccggggagggactgtggggtcgaggtgttgacggcagggccgagccagctggccagtgtgccacagcatgcagacggcacgcctccctctggcgtcttgaccatcctctccccccgtacaaatctcacagccgagctggcggtgnnnnnnnnnntgcctccctctggcgtcacgaccatcctctcccctcgtacaaatctcacagccgagctggcggtgctggaggtcctgggcacggccgatgaggtgctgccagcgctggccgcccaggcggccctgcgccacgccagcgagggcgcccaggcggccgcgcagggggcctgcacggccggcgcctgggcgccggagacgccctcctccccctcctcctcctcctccctctcctcgcccctgacctcgcagccggagggagaggaggaggtggccgggccgccccagcggcccggcgcgcgcagacgccgccggggctgatgctgcggtgcgagcctgcagttccaccctggctctgggggtggacggccctgggtgctgccaccccacgggggagctcgctggcgcccctgtctgccgatgcatcctctcttccagccggcctgagtggaggcctgggctctcgatggattttccccgcaagtgaggggagggggagnnnnnnnnnnggccgccggggctgatgctgtggtgcgagcctgctgttccaccctggctctggtggtggacggctctgggtgctgccaccccacgggggagctcgctggcgcccctgtggtccggcgtgccgatgcatcctctcttccaaccagcctgagtggaggcctgggctctcgacagattttccccgcaagtgaggggagggggagcgagctgcacaagccctcctcctcccgaccctgtactctacgcgtccctcaccctttctcgcccctgcgcggcagtgcatgccgccgccctgactctcccttgcacatacctctcccggctgccctccccccgtgcaaacgaatcccctgactgtgcagactgccgtccccccccccccccccccccccccccnnnnnnnnnntgcgcacacgtctcttgtcggaacttgccctctgagtttacaggtttggggggtgaaggtataaatatagagtagaccctgtggctgggacatgggccggacgtgcatggtgcagcgtgattcaggaacgcatgccaggcgaggacgcgcgcggcgcgttcgacgatgactggggcgccatcatcggatgnnnnnnnnnngcgtgcatggcgcagcgtgattcaggaacgcatggcaggcgaggacgcgcgcggcgcgtccgacgatgactggggcgccatcatcggatggaggcgtggaggtgggccccgaccccccccgcgggccccgccgcgcccttgcccctggcctccgggaagacgttccagaagcgcagcgtctcgtcccccgcccccgtgaccacggtttggccgtcgggggagagggcgaggtagagcacgcgcagcgtgtgccccgtcagcgtggccagcttggtcatggccgggtagcgccagaccaccacctggttctggctgtagccgtgggtggacaccagctcgttggcgttcttggcccaggccaggcagcagacctgggagccggtgtccacggtctgcaggcaggacccggtgcccgcgttccacagccggatggtgcggtccgcggagccgccgccggaggccagcacgccgtgcgcgtgcggggaccaggccagcgccttgaccgccgcgctgtggtcggtccagcgccgcagcggccgcgacggattgctggccggcgcggtggcgccggcgggaggcgtcgggctgcc

SEQ ID NO: 43194 - DNA, 76 bp, Chlorella protothecoides
cctggaggaggagcagggcccgctgcaggctggcgacggcgatttcgggcacggcggcgccaactgcacggcctgc

SEQ ID NO: 43195 - DNA, 61 bp, Chlorella protothecoides
cgccgcgccggagtcaaaggaccaggcgcgggacagcgccttcaggaaggctgcgttggcc

SEQ ID NO: 43196 - DNA, 68 bp, Chlorella protothecoides
gctacatgagactgagcaggcagagcgcacaagggggcgggggggtggagtctgtccagcagtgtcgt

SEQ ID NO: 43197 - DNA, 1284 bp, Chlorella protothecoides
  modified_base (195)..(204): a, c, t, g, unknown or other
  modified_base (392)..(401): a, c, t, g, unknown or other
  modified_base (746)..(755): a, c, t, g, unknown or other
  modified_base (1059)..(1220): a, c, t, g, unknown or other
gccgcgccgcgcgctgcgggccggggcccatcctggcggtggccgagaccaatgcgggcgcggacaacctgctggagggcctgcgcgcgcgcggcgtcgcggcggtacgcgtcggccagcccgcgcgcgtgcgcccggacctgcgcgcgctgacgctggatgcactgagcgagcggacgggcgagggcgcgcggnnnnnnnnnnacgcccggacctgcgcgctctgacgctggacgcgctgagcgagcggacgggcgagggcgcgcgggtgagaggcgctgtttggggggggaagggagagggtgtgtttgcggaggcgcagggggatggatctgggagaaggtggggaatgagaagggggcagcggcacgcagtgtgggaaccactgtcgnnnnnnnnnncggaggtgcaaggggatggatctgggaggaggtggggaatcagaaggggacagcggcacgcagtgtgggaaccactgtcgttgatgcatttgccggaagaaggctgccctggactccggccatgaatcatatctggggacacctgcattgctatccgttgatcatggtgtgtgcacggattttcagaggccttgtgtcggattccccgggaaactcacacctatcatcactccccattcattcctccacacccacacccacacgcctcatttcacccacccaatcccacacaaccctccgcctcccaggcggtgaagctgcgcgagcgtgcctcggcgctgctcnnnnnnnnnnccgcccacccactcccacacaaccctccgtctcccaggcggtaaagctgcgcgagcgtgcctcggcgctgctcatgcgcgggcgcgaccgcacgcccgtcggtgcgccgcccacccccggtcaccccgccgccacccctcccgcgccgcccccgccgctgcgcctggaggacagcgtgccgccgggcatggtggcctcggtggtgaccaaggcatggcgcgaggccgacgcgctgtccgaggtggccgccgcgcgcgtgctgcgcgcagcgcaggtggtggtggccacctgcgcgtccagcgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggaggccagcacgctgtgcgcgctgctgcgcggcgcggaggccgtggtcgcggcgggcgaccc

SEQ ID NO: 43198 - DNA, 61 bp, Chlorella protothecoides
caggggccgccttgtcgcctgcagagggcggcgcgcccggcggcgcgctccgcacggtggc

SEQ ID NO: 43199 - DNA, 61 bp, Chlorella protothecoides
ctggtccccgccgcgcagggccccgccactctgctgcgcctgcggcacgaccacctgctgc

SEQ ID NO: 43200 - DNA, 61 bp, Chlorella protothecoides
atcggcaaaccacggggtttggggggggggggggaggggaagcaggcccccccaaaaagct

SEQ ID NO: 43201 - DNA, 4387 bp, Chlorella protothecoides
  modified_base (163)..(172): a, c, t, g, unknown or other
  modified_base (1010)..(1019): a, c, t, g, unknown or other
  modified_base (2275)..(2284): a, c, t, g, unknown or other
  modified_base (2666)..(2675): a, c, t, g, unknown or other
  modified_base (3112)..(3121): a, c, t, g, unknown or other
ggggcaggggcgcatgtgctgcctttcatgggccagggagcgacgaggcagctggaagcggggcattgggcagtttgggtggctcaatcggggcagtttcttctgagtgtggctctgccaggtccagcagatcctggcgcaccgcaccccaaacggtgctctnnnnnnnnnncctcgcgcgtggccgacgccgcgctgggcgccaaggccgccgtgcaggtgggctctggtggggagcgtgcggggcaggggcgcatgtgctgcctttcatgcgccagggggcgacgaggcagctggaagtggggcattgggcagtttgggtggctgaatcagggcaatttcttctgagtggggctctgccaggtccagcaaaccctggcgcaccgcaccccaaacggtgctctcgcctggcgccacatgagagtcatccctttgttgcacggaggtcatcatgtccccacccgccgccattaccccccgttgacctcccacagctcccatccatacccccgcccctaacaaccctcctctcctctctcctcgccttctcctcaggcggagcgcccgctgaacgacgcacgcgcggcggtcctgctcctgctcatgggccgttgcatcgcggtgcctgaggacatggcggcggtgggcgggcccgccttcttcgcgggcctgctgcaggagggcgatccgcgcatccggcgctccgcctccatcttcgtgctgcggcacctcatggccacgcggcgaggggagtaccagcgcgccctgaggcaggtgctggcccgcgcacagcaggccaacgaggaaagcatggtcaccgacccctaccagcagatgaaggccatcctggacatgcagctggttgacctgagcacctgaggcaggagcagtgactggccgcgggcgcgagccagaggcgcagccctggcggaacaggcacctgccttgctgggtttttgcgccggctccgccccctgcgaggcccctgcatcccgtcaccccttgacacnnnnnnnnnntgccctggcggaacaggcacctgccttgctgagtttttgcgccggctcacccccctgcaaggcccctgcatcccgtcaccccttgacacatttccccactgtacttcctcccccccgaggctgtgcatcagactgactatggtacagcaaggggccaaggtgggagtcggaggagggacagggggcattgtgaatccagctcttcctttgagcgccacggcggtccaatcactatagcatcttctggaacaggtccaggagggcctggtcctgcacgaactccggcagctcatccttggcagcccagcgcaggtcggagtagggaccgccagggacgagccgcaccgtgcccgcgatcatctggcagcggtggaaaaaggtggtgccctcacctgtctcgacatgtcccgcgggggcgttgcccacgaagaagggctggaggccttcccgcacgagcgtcaggcccagcgcccgttccgcactcccgcgaatggtctcgccctgtcgagagggtggggatggcgagcctggcctgaggagtgtccatgcgggacggcgccaggggctgcacaagcaatgctgccactgcaaatgtacggcgtacacccttgggaaccctgtgttcacccataccccatgcacgcgcgcggacaaaaaaaaggcattgaaggggatgacggcggtgctcagatggggaagggtaatcgatatcgccaccctcgcggaaattcacgagtcggattgaacagcaattgtaatttgtccgaaatcatcaccgcacgccgtcgtctacgatcaaatggaaactcaagaaaaggcaaacaaagtggctagaaaccccgcacccatagttccacaaaccaacccgcagggtgtcactgtcgaggccatggtcagcacccagcaacccctcacctcctcgtgttgcaccgcggggaactcccatgcgccgctgccaccttttcttcgcaccagcatgaacacccgctggtccagccgtcgcttcaggctgcgcacgtcgccgctgcggtccgcctcggactccaggggggcgggcccccaccggttgctggccgccaccgccgagtcggtctcctccgtgcggggctcgtcgatgaagtcggcagggtacttcttgaaatagggcaggttccactcaaagcgccacctgctgtgctccacttcccaatcggggtgcgggggtaccaccaactgcgggatagaagataaaggagattggtggatgttgtgatgannnnnnnnnncggcaggttccactcacagcgccacctgctgtgctccacctcccaatcggggtgcggggggaccaccaactgcgggatagatgataaaggagattggtggatgttgtgatgaacgcaggaacgctgtgccacgtgttctaggcgcacagtcctagcacgacctgcaagcacaacctcaacccaccgggagcctctcgaagacgcaggccccgaatacccttccaggagcggcagcctgcgagcacatgatgtttcaaatgttgtaagaattgattcatcggctagaattaggtatctgcgtcctgtatcgctgggcaggggaacacctccacaccatcacacctcggctattgctgagaaggccgccagccgaaccggctgnnnnnnnnnngtcatcggctaaaattaggtatctgtgtcctgtatcgctgggcaggggaacacttccacaccatcacacctcggctactgctgagaaggccgccagccgaaccggctggggcgcacagcctacattaagtgatgagacatgccggagcgaggtttgaagggatatggtgcgcctgatgagggctgcagccatcccgagcccgccggctgcagcagcggtgaacaccaaggaaccccccgatcccacactgctgtcaccaatctagcaccgcagctttgattctgccagaaggatgcgtcttcgatcgcttctccaatgctggtcgtggtgcttgaattttagtcaggagttgggttagccggcgatggtagccccccctcgtgggctagctggaaagcggagcattggaatccttgcaaccatctgtgatctgagcnnnnnnnnnncaccccccgatttcacgctgctgtcaccaatctagcactgcagctttgattctgccagaaggatgcgtcttcgatctcttctcaaattctggtcgtggtgcttaaattttagtcaggagtcgggttagccggcgatggtagcccccccttgtgggctagctggaaagcggagcatcggaatccttgcaaccatctgtgatctgagctgcgactccaacctctccgggacacgatattcgccgtgttgacggtgtcccattctgaacgcacacgcccgcagcaagcttggagacccccagtgtcagcttcctaccatctgcccagtgcgcggagtgccgggactgcccctctcgaacggtctaggcagcgtcggggaggcagagggagtggccacggcctggcgcccagcatggctgctacagtcgtcacacaattcgagaccggtcaccaggatgcgatccacgatgcaggtgtgcacaggccacgcctcacaggagtgtcttgctgtgcaggggtgcacggacaccctcacggaccattcccaccaatcttcccgaccacaccctcgcacaccctgtccagcctacgactactacggcaagcgcctggcaacctgctccagcgatcgcggcatcaaggtgttcgagatcgagggcgagcaggtactacggagggggcaggtgttgggtttctgggctcgatagctcttcccagggccgtcatgccttgcagaggcctggaattcatatgttgctctgttcagcctagtgtcaggctccctcttcccatgctgcatggcgcacccacgtcacgggctatgctttaccccctcccctccttcccacccccccacccggctcctctcctgaacaccacaggtgacgcacttggcggacctgcacggccatgacggcccggtgtgggaggtggcctgggcgcacccctccttcggcaccctgctggcctccgccagcttcgacgggcgcgtggcggtgtggggcgaggtctcccccgcctcctggcagcaggtgcacctctccgccgcgcactcggcctcggtcaattccgtggcctgggcgcctcccgagcgcggcctgatgctggcggccgcctccagcgacggcgcgctcagcgtgcacagcgcgactgccgacggcggctgggccgcggagcgcctggaaggcgcgcacccgcccggcgccgccgcggtgtcctggtcgccggacggcctgcgcctggtcagcggcggctgcgacggcgtcgcgc

SEQ ID NO: 43202 - DNA, 61 bp, Chlorella protothecoides
agccccgcatcgtcgccatccccgacggtccgccccgcggcctccccctccccggcggcca

SEQ ID NO: 43203 - DNA, 7262 bp, Chlorella protothecoides
  modified_base (103)..(112): a, c, t, g, unknown or other
  modified_base (190)..(213): a, c, t, g, unknown or other
  modified_base (278)..(287): a, c, t, g, unknown or other
  modified_base (752)..(935): a, c, t, g, unknown or other
  modified_base (1436)..(1487): a, c, t, g, unknown or other
  modified_base (3439)..(3448): a, c, t, g, unknown or other
  modified_base (3787)..(3796): a, c, t, g, unknown or other
  modified_base (4941)..(4950): a, c, t, g, unknown or other
gggggttgagggcgggggcacggggtggatgagggtgacgaatgggatacagccgctacggtgccgccatgacggccagccaggcacacccccggggccctcnnnnnnnnnngggatgagggtgaggaatgggatacagccgctacggtgccgccgtgccggccagccaggcacacccccggggccctcnnnnnnnnnnnnnnnnnnnnnnnngcaccctctactccgatgctgcctccgacccccgcccccgatgcggacgatgtgcccgtcgccgnnnnnnnnnnggcaccctccactccgatgctgcctccgacccccacccccgatgcggacgatgtgcccgtcgccgaagcctgcacggaggccgggccggaggaggccggcgagggcgagtccgccggcaggctccccgccgacgaccgtgggcggggggcatcctgcgtcgccgtggcccccgccgcgggggcggtgccggcggggacttcagggcgaccccccgcagcggcctctggcaggcgcagcaggtccaggtccagggtgtactgctgcaccgccgtgcgctgcaccgccgcgacctccacgcgcggcggcccgtccagcgccagcgcgtcggcgctcagcacgggctgggacaggccgaagcgcgcgccggcgacgatgcgcgggcccgcgcccgtgccgggtgcgggccccaggcgcagcgccaccagctcccggctccccgccagcaggagcaggtcggcgccacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcaggagccggacctcggcgccgccgcccaggatcgcggcggccacgggcggcccggtggtgccggggcgcccgccgcgcgccgccggcagccactccaggccggagacgggggcttcggccagccagacgcacgccgcggagttgacctgctcggggccgtggtccatgctccagaagtagacgctgccgtcctccaggcccagcaggcactcggtgtcgtcgcggccgggcgccaggctcagcgcggcggaggacagcaccaggtcccgcacatctttgggttcaagcgagcaggtgtgtgtgtatgtgtgtgtgagtgcgagaggtggctggacatgctgtgcatgggacgcgtaccgcaggacggcccttggccagccatctgtctcacattcctgttgccaggagtcatggctcctcaggagccgctcgtggtgacacccagcgacccttcccccccgactccagcagcgcacccatgagcccaatccccccaccnnnnnnnnnnnnnnnnnnnnnnnnnnnnnnnnnnnnnnnnnnnnnnnnnnnnaaaccccttcactccttcctcaccttcggagcggcgcctgagggaatagatgtggaagggagccgagtggcccgcatacccgagcgtgaccttgcgggtgcccctggaccaggcgatgacgcggtcccggctgagccaggccacgctgaccacgcctggtgccaggccgcgcgtgccggcatgcaccctgtccacgctgaccgtgccctgggcgtcggccgccagccgccagacgatgagcttgccgtcggggccgccgctggccaggacgctggagtccgagcaattgaacctgggaggtggtgagcatgcatgaggctgagggtgggcatgtgaaggttgacaagcaaggaagggactctgcgacttggcagaggtccttcctgcctcataggacggcatcggctccaggacccctccccaacccacctgaggctggtgatgagaccggtgtggcccttgagcagggccctgccgcccgtggagcggtggatgaccctgatgtgccccggcttgaggccataggcgataaagtccatgttgacggcgatgaggcggttgctgcccgcgccggcatcgcaaggcaccatggttactggagttacctgcatgggaggggcccagagcagcgagtggtgggtagaacggatgtgctggcctgcctatatcacagatgccacctgtgatgagaggtccaggctaccactgcatgcaggaatagcgagacccgggcgagaaggtgatctcaaggcgtgcgcctgactccccccccccccatatttctctctaagcggcactggtggcacatactggcagctgcggggcctcggcggagcttgggagctcaaaattggtgccatcctccgtggggatcgcgacggcgacgcggcgtgcatcggatgcgctgtttccattggaggaggtatgaagagatttctccaatgcttggactgccgcgctgcgggctgagaaagagccttcatcgggaatagaacccctcgaaggaggttttggggcattcatgtgtggcgttgctgagcagccggttcccccttgcactcgagtccgtagccagccaagccttgagatcgttgctgagcggttggagggatcgacagccgaatcgcaatgctttctccagtgtctacacttttatttacaggtctttgtgcatcgctgtgcccactcgggaggggactgtgccaattgaaagccatttgcatgtgaacagcgagatcggggaaatcgggtactgactcacgcgcagtaccggagcaagactcgcgatctcagtctcacgcgcattgggcgtgacccaacaaaccagccctcagcaggtggcaggaagaatgtcacttggttgagacattgtcaccgtgctcctggctcgttgacacgtaattgccatctcaaggaaggcagctccccggtgatcgcggttgggccccgtcgtatgctggcctgaacggccccaagtttggaccggatctgagtagtggagagtatcaccatggcgacaggggctgccccgatcaacgtccgagagattctctccgtacgtggggccctcggggcagggtcctcctccaggcgttggttgactcgctcccaggacccgagacactcaacccccttctcccctaacccgcagctgcaaaacctgggcatccaaaatgccaacatcaccttcaccaacgtcacgctggagtcggagaagtacatttgcgtgcgggagacctcccccactaatcagctggtagggagcgtgggtgtgggtggtaagggagggaaattcacctgacacagcagggtcttcaatgtgcaacggaatgtctcgaactggggcttctggagcacgttggtggcccatttgacccttgaatgtctcaggccgccctccagtatggtgcctcgccatccgatcggccagtgcctgcgctgcgtgagccgtnnnnnnnnnntacggcatgcctcgaactggggcttctggagcacgctggtggcccatttgaccctcgaatgtttcaggccgccctccagtatggtgccccgccatccaatcggccagtgcctgcgctgcgtgagccgtggagctatagtcccttcagccagcgtcagcagtctcatgagaccatgggagctgcccgggtacccttctcaccctcgcacactcctctcctcgggtctggatcccctcccatcctcaccctcgctggcaggcccttgcccttatccagcgtgcaacatcccttcccacccctcctcccttagcctccactcctcttccctgcgcaggtgannnnnnnnnntaccctcgcacactcctctccttgggtctggatcccttcccatcctcaccctcgctggcaggccctcgcccgtatccagcgtgcgacatccttcccacccctcctccctcagcctccactcctcttccctgcgcaggtgatcatcgacctgagcaaccccagctcgccccagcgccgccccatcaccgccgactcggcgctgatgaaccccggctcccagatcatcgctttgaaggccgcggtgcccggcgtgacgggggacaacctgcagatcttcgacctggcggccaaggccaagctgaagagcgtgcagttcccgcagtcggtcgtgttctggaagtgggtgagccccggccgcctgggcctggtcaccgccacctcggtctaccactgggacctggagggggacgcgccgcctgccaaggtcttcgaccgcgcggccaacctggagggcacccagatcatcacctaccgcgtggacgcggcggggaggtggtgcgtgctggtgggcatcgcgccgggcgcgcccgaccgccccgccctggtcaagggcttcatgcagctgtacagcgtggaccaggcacggagccaggcgctggaggcccacgccgcggccttcgccagcctggccctgcccggccgcgccgacccggtgccggtcatcgcctttgcccagaagacggcggcggcggggggggcggtgacctccaagctccacgtcatcgagctgggcctgcccgggaagaccagcctcaagcgcagcgcggagctcttcttcccccccgagttcgccgacgacttccccgtgtccatgcagatcggggacaagtacggcctggtctacgtcgtcaccaagctcggcctgctcttcgtctacgacctggagacggccaccgccatcttccgcacccgcatctcggccgaccccttcttcatcgctgcgcccgcgccctccaccggcggcttcgtcgccatcaaccgccgcgggcaggtgtgtgttgtggggggtcgaggggaagagtgttccagatgaaggggtgctcgccagaatgggatcgcttcagtagcatggagcagatacagcatctgcgtacaccctcagactccctcagaccactccccccccccccccccccccccccccnnnnnnnnnntctgaggggaagagtgttccagatgaaggggtggccgccagaatgggaatcgcttcagtaccatggagcagatacagcacctgcgtacaccctcagactccctcaaaccactcccccctcccccctgacacacgcccgcaggtgctggcgggcggccccgcgccggacgccatcatccccttcatcgcggggcagctgcagaatgtggagctggcgctggccctggcccaacgcggcaacctgcctggcgcggagggcctggtggtgcagtccttccagcggcagtacgcagcggggcagtaccgcgaggctgccgagaccgcggcgcggtcgccgcaggggtcgctgcgcacgcgcgagacggtggaggccttcaagcgcgtgcccgccgtcccagggcagacctcccccctcctggtctactttggaacggtgctggcgcgcgaggcgctgaacgcgtacgagagcgtggagctgggacgcctggtgctggcccagggcaagaagccgctgctggacggctggtggcgcgacggcaagctgtccgcgagcgaggagctgggcgacctcttccgcggcgcaggcgactgggacgcggcgctggccgtgtaccgcgccgcgggggcgcagggcaaggtggtggaggccctggcggccaagggcgactttgaggagctggggcgctatgcggccaccaccggctcccagcctgactacctcttcctgctgcagagcctgctccgcgactcgccggaggcggcggtgggcctggccaaggccgtggcgcgtcagcccggcccgcccctggacctcaacaccatggcggacctgttcctgcagcgcaacgcggtcaaggaggccaccgccttcctgctggacgcgctggccgacgactcgcccgcccacgccgcgctgcagaccaagctgctggagatcaacctggtgacggcgccggcggtggccgacgccatcctgggcgcgggcgggctcacgcgctacgaccgcccccgcgtcgcgcagctgtgcgagaaggcgggcctgtacgcgcgcgcgctggcgcactacaccgacctggccgacatcaagcgcgtgctgggcaacgcgcgcgccatcgaccccgccgcgctcgtggagtactttggcacgctgtccgcggagtgggcgctggactgcctgcgcgtgctgctggaggccgacccggcggccaacctggagctggtggtgcgcgtcgcgcgcgagtacagcgagcagctcaccgtggcgcgcatcgtggcgctgtttgaggccgccgggtcctgggacggcctctacttcttcctgggcggcgtgctggcggggagcgaggacccggaggtgcactacaagtacatcgaggccgcggcgcgcacgggccaggtgaaggaggtggagcgcgtgacgcgggagagctcctgctacccccccgaccgtgtcaagaccttcctcatggaggccaacctgcccgacgcgcggcccctcatcaacgtctgcgaccgccacggcttcgtccccgacctcacgctgtacctgtacaagaagtccatgctgcgctacatcgaggggtatgtgcagaaggtgtcccccgccaagacccccgccgtggtcggcgccctgctggacgccgaggccgacgaggccttcatcaccaacctggtcctctccgtgcgctcgctggtgcccgtggccgagctggtggaggcggtggagtcgcgcaaccggctcaagatgctcaacccgctgctggagcagctggtcagcgaggggtcgcgcgatcccggcgtgcacgacgccctgggcaagatcatcgtggacgccaacaccaacccggagcacttcctgaccaccaacccctactacgactcgctggtggtggggcgcttcgccgagcgccgcgacccgggcctggcctgcgtggcgtacaagcgcgggcagtgcgacgaggcgctggtggcctgcaccaacaagcacgccatgttcaagctgcaggcgcggtacgtggtggagcgcgccgacgccggcctctgggagagcgtgctggggccggagaacgccagccggcgccagctcatcgaccaggtggtgtccaccgcgctgccggagtgcaagaacccggagcaggtgtcggtggcggtcaaggccttcatgggcgccgacctgcaggcccccctcatcgagctgctggagaagatcgtgctgaacaactcgtccttcagcaacaaccacaacctgcagaacctgctcatcatcaccgccatcaaggtcagggagggggatggtgtgtgtgtgtgtggggg

SEQ ID NO: 43204 - DNA, 76 bp, Chlorella protothecoides
ggcagcgccaaccccgagatcctggcggtgagcagcgcagtcgtgcattggtctggataggaatggggccctgggt

SEQ ID NO: 43205 - DNA, 66 bp, Chlorella protothecoides
gcgcgcagcagccagggcgccaccagcgtgtctgggtcgccggggctgagggtccgtggcgtcgtc

SEQ ID NO: 43206 - DNA, 122 bp, Chlorella protothecoides
ccccaggccgctcactagcctagcttcaaaccccccggccccacgctactctacactcttgccccacaaatcaccccccctcctctccaacacaaacacgcacagcatcgcctccctggcgg

SEQ ID NO: 43207 - DNA, 86 bp, Chlorella protothecoides
ctccatggcgcgcaccagggccgccgccaggtggcgttgggagacgcgggaggcgtcctggccgggagcacgccgcgggagcggcg

SEQ ID NO: 43208 - DNA, 80 bp, Chlorella protothecoides
cagagcgccgcacgactggactggtgctcatggcccctcccacgaggggccctgcaggctgacagtgctgctctgcaccg

SEQ ID NO: 43209 - DNA, 127 bp, Chlorella protothecoides
ctgcaaaggaaggtcatgtggctgggggttgggggcatggcgagcggcgaggtgtggggggtgggggagcaccccgccgagggtgcctcgatgtaccctcgacccactccgcaccttgccgctgctg

SEQ ID NO: 43210 - DNA, 12350 bp, Chlorella protothecoides
  modified_base (103)..(112): a, c, t, g, unknown or other
  modified_base (2998)..(3007): a, c, t, g, unknown or other
  modified_base (3353)..(3362): a, c, t, g, unknown or other
  modified_base (4261)..(4270): a, c, t, g, unknown or other
  modified_base (5279)..(5288): a, c, t, g, unknown or other
  modified_base (8216)..(8225): a, c, t, g, unknown or other
  modified_base (8652)..(8661): a, c, t, g, unknown or other
  modified_base (9103)..(9112): a, c, t, g, unknown or other
  modified_base (9441)..(9450): a, c, t, g, unknown or other
  modified_base (9577)..(9586): a, c, t, g, unknown or other
  modified_base (9997)..(10006): a, c, t, g, unknown or other
  modified_base (10656)..(10665): a, c, t, g, unknown or other
  modified_base (11205)..(11214): a, c, t, g, unknown or other
  modified_base (12107)..(12116): a, c, t, g, unknown or other
ttgatgccaactgtggaaggggtcgggtgcagtcctctgggcgaggtcgagcagggcgtcaaatcgagtgaaggacagtcgcagggctcatgcgcgtgacgcnnnnnnnnnngatcctctgggcgaggtcgaccagggcgtcaaattgagtgagggacagtcgcagggctcatgcgcgtgacgccaggctattggacctggacctccacctcaagcgtcccacgtagtcgcttgtaagccccgcctgtcgccctggcaatcatacccaacccctggaaacccgctcaggtgatctccctggcggcagacacgctgctgatcgtggcctgcgccattctgggggacggcatcaactgcacgctgaacggcatgctgcgcgggtgtgggcggcagacgctgggcgccgtgctgaacgtcgcctccttctggggcgtggccctgcccctgggctgggccctcggcttccgcctcgactggggcgtgcgcggcctgtggtggggcctggtgacgggcaactacctgctcactgcctccctgcttgccgtgctggccacgacagactggggccaccaggtgcgccgcgccagcacgctgaccgagggcctggaggcggggccgccggccgaagatgagcgcaacgtcctggtgctctagcgcacaggactgctgcaggcgagtggccgagatatttatgcagagtgctgccgagcaggatggggtaggcatccgatgcgcagtcctgctgtgccatcaccgccagtgaccatactgtaattgccccccctccttccctttccctgagatattctttgttccccgcacactcagcccccccttccatgtctgcctgcacgttgagtggcagtgctgcaccccctgggagcgtgattgatgtaacattctcaaggcacaggacgccaggcagaccagggtgcagggcggcatcgtgacagcacggttcatcactgcacggcgactcgcaggtcgaggtcgacctccctccactcggcctcctgcggccccctccagtcgaggtagcgctcccggcactgcgccctgccgtcgcgcccgattgccagcagcgtctggctgcgggtgccgtaccacgagtcgtcccccagggcggggaggtgggtgggcgggatgaagacgccggagaccagggactcgaacgcggcgtcgtacccggtggcgggcaggggccctgcctcgctcgccaggacctcgggctgggacatgatgccaaagagctggcccggggatggtgggggtgagtgctggagccgtggcccagacggtcggcacagccagtaccgagctgtgaagctggcgcaggggacgcagcaatgaacaccttcgaagctgtggccacccaaatccaagaccctcctccctctagactcaggccacacctcttcccagggaaggtcgtctccatcaaaagccccgctccgctgcaacgcaaccagctggcgcttgccgtgctgcaccttggcaaagtcgggggcgtccaggaggccgttggccaggccatgcaggccggggtccacgcccgcgcacacccgctcgccccgcccgttgctgaggtaggcgcaggaccggcgcaccaggtccaccagcagcaggttgaatccctcaaacgcctgcagtggtgaaggggtgggtcctcaccgtgcgaccctagggagtggtgcgctgtgtctgagcagcgccaggcaggcgcccagcgcctcacctgcgcatcgacgccgttcaaaaactctgcaggcaactcagcactgccagatgcgagataggctgcaggcagcaggccccggctgggacgtcccgcagagggtgcggccttctggatcagggcagtggaggtggaagggggggcagaccctgtgacagcggctgtctcgtacctcatctacatctcacagagcactcgtgagatcctacagagtgctcctttgaaagcaacgagtactcctgcctcagcaaatccccacctggcgaaaggttgtcagccaggcagccttgccctctgtgctggctgcgcaccaggtcccacccccgagctggtcccggcccccgaatatgcctgcctctccaccatcccagacatgtgctggcaccgtaggactgcacgggggtgccgatgggccgggcggctgggcatggcatggggcggatcccggcccccctccggacacttgctggcagtgcggacttaccggctcagcttctcgtccctgttgaaggcaatcagcagcacatggtttggaaggcagtcccagaagaagaacgtgacgcacattcacatgcggggccgagattactcctcgatatgttgatgggcaatagctcgaggacgggagctgacgcggggtcgtgtggactgttgcctgagatgcggcacggtggaccctgtcctggagaacggatgtgagagattactgggttgcaacgccatcatcggctcaaggtcctgtttcgaggtgtgtgcaactgttacgagatcggtggtccaccgggctgacgaggacggctgcacgatccggcatcgacatgaaacacacttttctgcacatcgcttcccgaatcttccgttgaacttgatacaagggggaagggagggggtacaggcagtatacaggtcacgaggggttcagttcccgggtaaagtccccatgcatcagaggagtgaggtgctgctggactgctcgcaggacatgccgccacccaggagctcgtccagggtcgccaccatgtgcccagagtgggcaggcgtgacttgcgtcggcgtggcagccaccgtcgaggcctcgctccctttccagctgccaaagctgtcccctgccaggtccaggcccggggtcgcaggcgcgtggggaccgccgcggccgccggcctgggcgccctcgggggcagcgcccagtgagaagcgtgcgggccacgccgtgggctcattcattcccttcttgccccgccccgccgcaaatggcgaggtcgnnnnnnnnnngagcgtgcgggccacgccctgggctcattcactcccgtcctgccccgccccgccgcaaatggcgaggtcggcggcggcggcgagaggcggaacacgcccgtgaggtctacgcagctccggccggggctggcgccgcgcggcggccccggctccggctcattcccgctcggcgcgcatggcgcccggcgcgcgtgcaggggaacggcggctgccgtggtggcaaaggtcgacaatgcctcgctcaggctgctgtccagcaccacaccagcccccacctccggctcgatgcgcagggaggccgacgggacggcgggtggggacacgtcaatcagcgacctcatgctgnnnnnnnnnngtctacgctcggcgcgcatggcgcccggcgcgtgtgcaggggcacggcggctgccgtggtggcaaaggtcgacagtgcctcgctcaggctgctgtccagcaccacgccagcccccacctccggctcgatgcgtagggaggccggcgggacggcgggcggggacacgtcaatcagcgacctcatgctgggggtgccggatggcggctggggcatggacgggtgctgtcggccctcggcaacgagcagcacggttccaggatcgagctcctcgccgtcggtgttgggactcgcagcctcgccccctctaccccgttccggccccagccccgccgcctcagattcctgcgggctcggctccgccgtactaggggccgagggcgtggcaccaccccgctccgccacgccgcgcggcgactcggcaccgcccttcccacccacgcgccgcactgcctgggccacggtctcgctgccgttgagctctgccaggacggccagctggcggggggtccagggccgcgtcaggcccagcgtcagcatctcctgcagttcctccagcggccagcgcgggacgtccttcttcaggtagtccaccgccgcctcgatgtcctccacctccagcagcagcggcgcggcggcgcgcatgacggccagcgccacctggtgaggtggggatggtaggagaaagggtggtgggtgggtgccttgacaagggtttcccaagggtatcgagcaagtgagggcgccacgtcgcctcagcttggaggggggctttggtggtgagcgtcggggacatggcgcggggatgaagtcgggtgtggcaaggtgtgcgcgtcacagaaacacctccaaggaggaccaagtcagctctgaccctcgctgaccacgctcccacggaggannnnnnnnnnggagggtggtgggtgggtgtctgggcaagggtttcccaagggtatcgagcaagtgtgggcgccacgtcgcctcagcttggagggggctttggtggtgagcgtcggatacatggcgcggggatgaagtcgggtgtggcaaggtgcgcgtgtcacagaaacacctccaaggaggaccgggtcagctcagaccctcgctgaccacgctcccacggaggaccatccgccccctcctcccccaaaataaaaacaagcagacaaagaccgtgcaccttcatgatgggcgccgcatagcagtcggtgaccaccaggtccatgatcctggcagcaaaggggagcgggaagtcggaggcgaagcaggtgaggaaccagctggaggcgtagaggacggggaggacggagtgggcctccagatgcgccgccaggcgtggggggagcagcctgcccatttgccacagtcggacctgcggggggtcggaggggcgatttgggttgctgagctgccgtgtcacactgggggccatcgacccgcctccttggagagctggtggtgcatttcagtaaaaccctgggtccctgggcaacatgctggtgacaactgggcaggctgacccatccaagccaggacttgagcctccaccctgccaccccagacctggagcatgctcatgtccggcttgtagcagtcgcgcagcccacggccgtgcatgatgagccagaacacgccaaacgcgccggcctccgacgggacatacgacaggatgaggcctgcgacaaagttcatcccctgggtgtagccgatgctggggtccgccaccgcatacgccttgaggacgcggaacagggcccgctgccccggtggagtggacagcctatgctcgatggacagggcagggatctcagggcatacacaccagggtaaagaaaattggtggaggagcttggcggtcccagacccgccatgttccccaagggattcacaggactctccatccctgggcacaaacaagcnnnnnnnnnntagggcatacacaccagggcaaagaatattggtgtaggagcttggcggtcccagacccgccctgttccccaaggaattcataggactctccatccctgggcacaaacaagcacagcgaggcgcgcacaccccgggcgcctacctccaatggcctgggtaggtgcggtggaggtccttctcgatctccgactggacggaggaaggcaggctctgtgcgagggccagcatggtcacggatggggcgttagggtttggtggaacaatacaaaatcgggtaccctgccaggcccggcccccgcgtacccgtgacaccaggtgcgcaaactcctcacaggcctgcaccgcctcccgatcccgatgcatctgcgagagccagagctcagcccgcatccgggctgggacgctgttgaagaccgtgcgcccacactggagatcgacgagctcatcgcagccatttatattctcggatgtgttgtctgcccccaggacgtactggaatgcgtcttggccgagcttctgcacaaatgccagagccatggctcgggcctcctacaggaccccgtccagaaggtcgagtcggcaccttgcacgcatggtgggacccaaatggtctcgatagccttcgatttttattcactcgcaaagcctctctcgaacaccgtgcacaggcttcatgacaccagttttctcgtggggtgcatatgctcgaccggtagaagggaggaataccatgccccgtctgtccctgggtccccctccctcaccgtcaaagtccaggcgccgggccccaagcggcacagctccccggttcttcagccagctctccccgccccccctcctcaccagattggtgactttcaggcccgtggcccgtttgtctccgtctttgatccgccagaatgcgtgaggtcatcagtatccacatcggccaggtccgtcccggttgatgggctggggtgtcaccttccgccctatccactctatatattgttgttgacttcctcactgatgtcgtgacattccattcgacactcttcatattcccgtggtcatactcggtagctcgccttccacctgtactgcgccccagtttaaatttgtgtgcgtgcgcaggcatgtacacggtccccttttgctgttatgttccataccatctgctggcaggcccgggccgtggcgtccggtccatgactcggcagtccggcgcaacacggcccgtgatccagccccgtgcttccccttccgcaggccggcatccaggtcggtaacgcctgctgggagctctactgcctcgagcacgggtgaggagaagtgttccgggccgacgatcgccgaccgacactgccgtccggtgggcggccctgctcgcacccctacccgcccagctgagcccacccgagtcccactttcaacccccacccgccatgcgcagcatccagcccgacggccaggtcccctccgaccgcaccttcggcgccacggacgatgccttcaatacctttttctccgagacgggtgccggcaagcacgtgccgcgctgcgtcttcgtggacctggagcccacggtgatcgacgaggtgcgcaccggcacctaccgccagctgttccaccccgagcagctgatcagcggcaaggaggacgccgccaacaactttgcgcgcggccactacactatcggcaaggagatcgtggacatctgcctggaccgcatccgcaagctggccgacaactgcacgggcctgcagggcttcctggtgttcaacgccgtgggcggcggcaccggctccggtctgggctccctcctgctggagcgcctgtcggtggactacggcaagaagtccaagctgggcttcaccgtctacccctcgccccaggtggggtgggtgcaagggagaggggaggtggagatggtggacggaggacgcgccttgcctcgacgcttgtccactcacagtctacttcactcgccagaacatctgattcccctttgcaccccacaggtgtccaccgcggtggtggagccgtacaacagcgtgctgtccacccacagcctgctggagcacaccgacgtggcggtgatgctggacaacgaggcggtgtacgacatctgccgccggtcgctggacatcgagcgcccgacctacaccaacctgaaccgcctgatcgcgcaggtcatctcctcgctcaccgcctcgctgcgcttcgacggcgcgctgaacgtggacatcaccgagttccagaccaacctggtgccctacccgcgcatccacttcatgctctcctcctacgcccccgtcatctctgcggagaaggcctaccatgagcagctgtcggtggcggagatcaccaactccgcctttgagcccgcctccatgatggccaagtgcgacccgcgccacggcaagtacatggcctgctgcctcatgtaccgcggcgacgtggtgcccaaggacgtgaacgcggcggtggccacggtgaagaccaagcgcaccatccagttcgtcgactggtgccccaccgggttcaagtgcggcatcaactaccagccgcccaccgtcgtccccggcggcgacctggccaaggtccagcgcgcggtgtgcatgatctccaactccaccgccatcgcagaggtgttctcgcgcctggaccacaagttcgacctcatgtacgccaagcgcgcctttgtgcactggtacgtgggcgagggcatggaggagggcgagttcagcgaggcgcgcgaggacctggccgcgctggagaaggactacgaggaggtcggggccgagtcggctgacgccgacgacgacgagggcgacgagtactagggggtttgcgggggaagagaggcaacggtgcggtgagcggtgagacccccccggtctcctggtctcgacaacccacccccctgacgcatgactgctggttgtnnnnnnnnnnatgcggggagcggtgagatccccctcggtctcctggtctcaacaaccacccccctgacgcatgactgctggttgtaagataccacgccattgatgaacaggggggcgcacacgcatgggaggcagggcacgagcttgcaggcgtgctcgcacgcagacagcatcacgttcctcgctggcgggcgtgccacgccacgacgtcggcgtagggcagggcgccgccgaagacgtccagcgcgctgcccaccgtgatgtgcacgcggccctttccagccgccgccacgcgatcaaggtcggcctggccatgggtgtttgagggagggcggggggggggggggggggaagccggccctatgtcgacggggccatgcggcagagcccctggacatgaccaccatggtcgcagccatgcagcccacccaccaggnnnnnnnnnntacgcagtcgagcccctggacctgaccaccgtggtcgcagccatgcagcccacccaccagggtgcgggcgccgccggcgtaggtgcaggggatgggcgacagcgcgcccagcaggcccaccagctcctcgtcgatgcccagctgcttgccctccacatccacgccgtgcaccaggaactccgcgcagcgcgcgcccagctggcgcagcgtggcctcgctggaggaaaggaggaatggagagcgacttggggtggggagcggggggtcgtggagcactccgccaaacatgcaggggaactgtactcgagggtcctccatgaaattcagggcttcctggccctggagcagtggtcagacctggtcaccctccttgcggccctctccctccagactcacgtcacggcaaggtcgctgaagcgctgccagcggtcagtgacaacgnnnnnnnnnngggtcaggcctggtcaccctccttgcggccccctccctccatactcacgtcacggcaaggtcactgaagcgctgccagcggtcagtgacaacgtagtactggccgtcgtcctttttcctgcagctcaggtctagcaccaggcggtcgctgccaacagcctcgacctgaagcagagagggcgtgcggaggaggtgaggggtgcattgcgcctccgtcgacgaacatcccatttggtgctgccgtctgcgctagccatcgtccgcgcagtctgccaccaggaaggcagaccctgatgacacgcgcgcgccccccccccccccccccccccnnnnnnnnnnaaacgcaaccacccaccaggccggccaggcgtcgctcattcagcctgccctcctggaagacataagaggtcacaatcacgtggctggccccagccatcaagtagcgtgcagcgttctccgcggtgannnnnnnnnnaaagacgtaagaggtcacgatcacgtggctggccccagccttcaagtagcgtgcagcgttctccgcggtgaccccaccgcccacttggaggccacctgggtaggcctgcagcgcctcgatggctgctcgctcattggcttcgctggcgcccagcatgatgacatggccgcctgtgaggttgtcacgcgcaaagagctcagcaaaccaggacgacggctgggtggccacgaagttggtcttcagctcggaagcggcgctgcagggtggcattgatggagaaagggggggtctagtggaggtctgcaaagtcttgggaagatgcctgtgtgagatctgcatgtactcgtacagcatcgcttgtccattatagaacgaatacgtagaatccaaaagacggagttcagactctcnnnnnnnnnnacctgtgtgagatctgcatgcactcgtacagcatcgcttgtccattataagacgaatacatagaatccaaaagacggagttcagactctcacccttcaccgtccttgagggaggagcccacgatctgcttgacggaaccctgcagccgtatacacggagggttggctagcaaaccagtgctcagaatcacaatgctgcataggatgcccagtcgcacccccccgctcacatcgtggatgtcaatgcatggtctgaactgggttccactagccgtgatgtggctgcatcgaggccgcgcttgacatcgcactgggaccttggaggtaaagggacggtcggcaggagaaagtcgggtacctgcacacagcgctgccccagtggatttcattcttactctagaaccatgctgagtatctccatatttgcatgcgtgcacttggctggtgatgggagaggttgggaacgacaagggcctgcaacctgctgtggtccgtgttccggtgtgggcgcgagttcgtattatatcatgcgagccctttccaccgtagcttgtagaggagcccttgagaccaagagtactgcgttttatatgagaaccagcttacagatgtaaaatgttgaacctttgagcggaccagctctcgctggcnnnnnnnnnntttgagaccgagagtactgcgttttatatgagaagcagcttacagatgtaaattttggaacctttgagcggaccagctctcgctggccaggcctcgccatgccggccaaggccaaacgcaagtcgagcaaccaacttgagagcctggccacacccaagaagcccatcaagcccggtgcatacggcttgagacaggatggctctgtgctgcatgccacactgcctcctgggaaggtgaggcacgaagcatggatgctccttgtgtaggtgcaggctagcaaggtacgctagtgcagggtggcgttcgcaatgacatcatcaaatattcctactcttcccacctccacgacagtccctcatgttcctcggggaggctgtgctccatgtcatgcgaggcagggcgctcttcaatgggtgagggggtcaagaatgtgcatgtgcgggtgcctaatgtactcttctgacccccggtacgtccgtcaccttcagtgtgaacctttgtgtgtcttgaagcggcaatcaattcaattctctgatcagnnnnnnnnnnctatgtccgtcaccttcactgtgaacctgtgtgtgtcttaaagcggcaatcaattcaattctctgatcagcatgcatccatatcggcacacatacccacagggcgaccctcggctcaggcagcgtctgctcgatcgctgcggatgcagtgaacagcggcccgctcctcatcagccaggcggccgagggcaatcactttccctttgcgcccacggagtccgtcctctacctgcagctgcgacccctgcccgcagagcagcggctgagcgggggcttggggtcgaccactgctgcgcgcatggcggacgatgtcggctaccaagcctggctgcacaacgacccctccgcgcccggctgccttgccacccccgacatctggtcgcaggcggtggaggagatggcgggcctggcctaccctggggccgtgtacgccgtggtgggctccaagaaggtggggaaatccacgctgggcaggctgctggtcaatgagctgctgagcacgcacagcagcgtggcctacctggaaacaggcgagttgtgatgcagggatgtggaatgaatggaggggagaatgcatgaacacggtgactcccagacaaggcccaccgtgtcaggagggctcaccgtttcgttcccccgaggtggcctggatgctctcactccacacattgcacaaggtgtcacaacagctgacgaactcagcctggatcagcgcatccacgcacgcagactgcggccagccggagttcggcccgcccggcctggtgtcgctgagcctcgtgtcccgtcccctgacgggcccgcccttcctgcacccggcccaccccccgctggcctcctacttcgtgggagacgtgtcccccgccagccacccccagcgctacgcggcctgcnnnnnnnnnntccccccgctggcctcatatttcgtgggcgacgtgtcccctgccagccacccccagcgctacgcggcctgcgtggcggcgctgcgcgccgcgcacggcgcgctggcccccgacgcgccgctgctggtcaacacccacggctggacgcgcggcgcggggctggaggcgctgcccgatctgctcgccgccgcgcgcccggcctgcgtcgcccacgtctcctgcggcgacccgcgcc

SEQ ID NO: 43211 - DNA, 61 bp, Chlorella protothecoides
agctggccaggcttggcaggcgtataaggggacaccagacatggacatgctgcagccctga

SEQ ID NO: 43212 - DNA, 79 bp, Chlorella protothecoides
agaagccctgggagttgtaggcgcagatgccagcggcgtcaaacaccctacttcccgcgctctgcagcgtcagggtgga

SEQ ID NO: 43213 - DNA, 98 bp, Chlorella protothecoides
tgatccccacccccacccaccctttgcattcctccgtcacacatggtacggcgccgagcccgggcgctcagtacacgaggccctactcacgttctgcg

SEQ ID NO: 43214 - DNA, 14904 bp, Chlorella protothecoides
  modified_base (556)..(710): a, c, t, g, unknown or other
  modified_base (907)..(916): a, c, t, g, unknown or other
  modified_base (1158)..(1167): a, c, t, g, unknown or other
  modified_base (1832)..(1841): a, c, t, g, unknown or other
  modified_base (2457)..(2466): a, c, t, g, unknown or other
  modified_base (6011)..(6020): a, c, t, g, unknown or other
  modified_base (10124)..(10133): a, c, t, g, unknown or other
  modified_base (10347)..(10356): a, c, t, g, unknown or other
  modified_base (11479)..(11488): a, c, t, g, unknown or other
  modified_base (11996)..(12005): a, c, t, g, unknown or other
  modified_base (12907)..(12916): a, c, t, g, unknown or other
aggccctggccgccaccgcagacccggcctccggcgtggaggccgacgtcgacgtgcgcagtgcggcggtcgccgcgctggccgacctggcgggggcctgcgtcgcggcgcagtccgcgcccgccctcacgctgtgcgcgctgggcctgggcgccgcgctggccgcgctgggggactacacggtggacaatcgcggcgatgtggggagctgggcacgggaggccgcgctgcgcgcgctgcccggcatgcttcggtgccgggcggggctgggggggcccgattgcaaggatgggggggacgcgatacgcggcgacggcgaggacggggcggtgtttgagcgcagagactgccatggcgatgcagcctcagggcctcgcgccatggagcgcttcgctttcgagtgcgtcgccgcggcctgcaagcagggggtggagcgcatcgggcgcgtgcgcagggcggcgcgcgacgcgctgcgtgagctggcggacggcgagctgctgccgcactccgcggcgccggcaatctgcgccgcggtggcgcacgccgtcgacgccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagggctggtgcacagcgtgggcgggcgcgacgcgcaggtggcagccgcggcggccgacgcgctggcgggcgcgtgctgtgaggcaggggcggcaagtgggcgggcggtgggcggcgccttcctccgcctgtgggacgcggaggcggggggggcgcaaggccggagaagcccggagtcaggagcgccgtgcggtgcnnnnnnnnnnagaggcgggtggggcgcagggccggataagcccggagtcaggagcgccgtgcggtgctccagaggcctcggtcagcggatcagccaacaaagcgcgtagagcgcatgtgcagcggctcgccggcgtccccctgctcgccagcgcagaggtactgctggcccggacgccactggcgggcgacgacgccttccagctcggcttgctggaacggttgcgtgttgaagttgcccggcggggtgccnnnnnnnnnngctggcgggcgacgccgccttccagctcggcttgctggagcgattgcgtgttgaagttgcccggcggggtgccgacctgccccggctccaggcggccgccgcgctgctgggcgcgctgggctcgggggaagcctgcgcgcagccggcgcgccgcctgctgtgggccatgctgggctcgcgcttcccggcagtgcgccgcagcgcggccgagtacctgtacctggccctgctttccagccccgacgaggcagaggatggaatggaggccgaggagcaggcgctggagctgctgggggagaggaactgggccggcccggctggggaggttgccgacctggcagtccaggtggctgccctgctcaaactacaagacgcctgagagtgtatggcagaggacgtgctcccgagtggctgtcgctgggactttgatcaactgtgatccagcttgttgcaagtgctcatagctacaggggcgggaggagatacaatcaacaggctgcactgcatgcgtgtgcatgcgtgcctgcatgcaactgcagtctctagtcacaacaggagttacaggggggtgagatcccaggcggctgtcgcggaggcattcgaatcgacgatgccgagggtggaggaatcggaagacccgtactctgcgcgcccaacacatccannnnnnnnnntacaacaggaggtataggggggtgatgagatcccgggcggctgtcgcgggggcattcgaatcgacgatgccgagagtgggggaatcggacgacccgtactctgcgcgcccaacacatccaagtgtgccatgatctggtgggcctcctgctcaagagcattcatgcctcgctgatcactcgcattctgtgcacatgccctggccacgctaagggttgagggtcggcaagcaggagcctgcgctgtctactgcctgtctcctgcctagacccaacccacccagatgatgctgcggggcgtacgcatcccagggcaatccagaacttctcaatcatgggttgtgacgagctcagacgggcaccgcgtggcgagacggcagcgtccggcgcagggtccccgatgcgaggcggtcaagcgatcgaggaagcgtcccacagcgagcccggcccctgccagcgatgagatcgccaagctgatccgatcgccagaaaccgcgactgaaaatctcaagaagaccactcttgagcctatccgtcagcatcgcagcgtgttaccctgcagatctggtggccaggtgaggtgaattcgcacccctgcttaacagtatcttgcagtgcnnnnnnnnnnggatgagatcgccaagccgatccgatcgccagaacctgcgactgaaaatcccaagaagaccactctcgagcctatccgtcagcatcgcagcgtgttgccctgcagatctggtggccaggtgaggggaattggcacccctgcttaacagtatcttgcagtgcccatcccgacaggcagtccgactgcctgcgacctgccctcctacttccccccaccttggcgtcccccaggcaacggtatcggtgacagaggatgaggagaccatcgccgtcaccatccagctcagcggcggcccactctccggtcttgcccgcccgcccaccctgctctggggcgtgtaccgcggctcctcccggcgctggcagcaccccgcgggctgctcacccccccgcagcaccctggacgagcgcagcggggcgatgcggtccccctttgacatgcacggcagcatcacgctgcgctttccggcccgcctggcgcccctgaccctggcctgggtgggcgcggcggcggggcggccggtgctgcccctggtcgcccgccactttgcggtccccctgggcacgctgccggggaccccggtgccgctggggccctccctggcggggcggccgggagcggagcggggcgccaacttcgcgctggcctcccgctcggcgcatggcgcctgcctcctgctcttccgccgcggcggggacggggcctgggccaaagccctggagctggagctggacccggccgtgaacaggacgggggacgtctggcacgtcacgctgcccacgctgagccgccgcgaggggctggcctacgcgtggcggatcgatggggaggtggcctgggacggcgggaaccgcacgcagccaggtgtctgggggattgagggttgggaggtgtgtaggaatgcagggaaagggacctgggcaagcaggggagtagggttggtgccatgccactttgacatgcccttccttggcatctccattgctgagctgcgatggatggagaccatgtacctacaaaccaaggtgacccagccgagccgaaggcgcgccacagtgcatccccaaacacccaaacccctgcaccccacccccccacgatgcgacagaccgtctgctgctggatccgatggcgtcgtcgttggtgctgacgcgggaggcggtgcggggcctgggccccctcaaggctcccagcatctcgttgcaggagggggaggtccccgcattcctgctttccgggctggacgtgctgggcgccgacgtggccgccggcaggcccgcaggcaggagccaggccgtgcctcccactcaccagcgctgcatggtggccgtggatgtgcggggcgccggcgatgggacgctgctgggcacgctggacttgatcccggagatccaggccctcgggttcaacaccgtggtcctcagcccctgttatgccaccgcctgggcgggtgagtgccatgtaccggggtctcacggtgcctcctttcttgtgagagggccaggggtgcaccgtcctggcctgtgagggttcacccttgctgaggccccaccccggcagcccatcgggtcccgctccccgtgccctcccccatcccggcctgctccaaccccctcctccaccaccagggacccccctggacaggggcagggcggcggtgtcgtactgggcgccggaccccacgctggcatcctcgcccgaggcggcctccagagaggtgcagcggctggtggcaggcctgcatgccgccggcctggcggtgctcatgcaggtccgcgcctcgaggatgggaaaggaaacgctgctcgtgcgctgtgcaggcgccccatgggtgtgaacttccgtcacctcacccgccgcacccgcgcgcaggtcgacttcaccttcacggccgagggcggcgacgacagtccgtgcccgctctctttccgcggcctggaccacgcggtgtactaccgccgagcaggcgtcctgaacgccgggcacgcggtggtgcggcagtacatgatcgacgtgctgcggcactgggcgctggactacggcatggacggcttcaacttcatgggcgccgagaacctggtgcagggtgcgccggatcatcactgattggaggggtggttcttagcccctgtgtgccgtttctgggtgacatcctggggctccaaggcagggtggcttagctgccctggggcaggaatctgggaggatggcagcacggcagggcttgctctgtgtcctcatgatgacccccctacaccaaacgtgtcgttggatctgcgagacctggtgccgggacacctgctcacgccttcgccctcccctccccagatcgcaatggcgtcatactggatgcgccgcccctggccgccgccatcgcctacgaccctgtcctcgctgggctgcagatgattgccagcacggcagacaagaccctgcttcccaggcacgtggcgctcgtgatgttgggaaagtcatctgagctgcaattgctcgtctgttgggttcgccaggcacccaagccttccatcccacctccctgtgcctagggagggtgtgcgcggcttcccgcactggggcgagtggcaggagtctgacgggtcgctggcggccgccacgctgggcgcgctgtgcggctcggcgctcgcacacccaccgtccttgagggaggcgctggaggcctgcccggccgtctttgccgccgagggggagggcctcgttcctggcaacctggccgtggcacggccgccctcggcctgcgtgcacactctggccctgccgcccggcggccaggacgtcgcgctcaagacggcgctgctggtcgcgctgtgcgcggcgggcacgcccctgctgtccctggacgacgcggcccgctttgcacgcttcgtgggcggggtcacccgcctccgccgacggtgggcggacctcctcctgccggccgcgtttgggcagggcgcgcgcagcgtgcgctggcacggcgccgcgccgggtgatcgaggagggtttgtgcaccgaggagcactctggggggaatccatgccatcgccttgcgtgcaaagggtgctttgggtggccgtatggaagtattccccgctatcccgaggatcgtcgttgacatctgcacccggcccctagcatgcccaagccccattcgagcatgtccagcggctcaggaccgaccattcgacatcattccacttgcccaatgcaccctcagggagcgagcctgactgggacgggtctgctgcgctggctggattgccagaggctggatttctggccatggcggtcgtggggccgggcggtgcgccagccctgtacctcgctgtgaacgcctctgacgtggaagtcacggcgacacccccagctcccccggtgggggctgatatgcagcattgggtgtttgggtggtgccatgctcgaggtgtaggatgagacagcgacgcttgggcatgcatgcttggctgaagtaggaatccccaggacattccgtcgacatgcgctgacctccgacctgccttccttgccacctccaggctcggcacccnnnnnnnnnnaaagtaggaatccctaggacattccatcgacatgcgctgacctccgaccttccttccttgccacctccaggctcggcacccatggaggcgggcggtggacaccggtctggggccgcccgaggatgcgatggccagtgctccgccccgccaccctttcccgacatacacactgcagcccaaggcggggctcctgctcgtcgcagattttgatgcctcttctgcatggtgaggaggctgtgacagcttctgagagacagaaagaagagattggtagctccagagctaggggtgtggctgggtcccggcgacaggtgtgcagtcagcgtagatggaggtgggcgcgcgtcaaatagcgacggccagctgccagctgcctgcggtggccagaatccagtcatcctcgtgatcctcaagcaccgcagcacacaggggcgggctgcattctgcctgctttctgtcctgtgcgtcgaggccgttgcgtgaatctggagtgctatcgtgtccggtcagtccagcacggttttagccatggcctgtgtcgcccacgcctctctcgtcgcgccaggtgaggagcatgctgtgggccccatgtggacatcaggggctgcattgtgtcaagtggtagttttagggtcctcgtgtgagtatgtgtcggcccactgctcttggcgtccatggccaacccatgccggtcgtggtcagcacgagccatgctggaatgcttccccttgctggggcatggcagccatgcccagcacctttttcagtgcccactgcacctgtttcattcctcgcaagcttgcagctcggtccttgcaacgtgtgcccttccacaccgcttcttaccaggaccctgtgggctgcgcctcggcaggtgcctgcggtccgccccagcccggccccagctgcgcccccgtgtgcagacccccgcctcctcctccagcctcccttcctcggcccccggcctcacccccggcaccagcggcaacggcatcaccagcggcggcgcacccccgcccgagcccacccccgtccgcatcacccatgacgtcaacgtctcagccgtgctttctccccaggccgtgtaccacaaggtgggtgtgatgaacggaggacaagatctggcttggtatggggtgagcggaagggtgtgggagggccaggtgtggtcggcaaccgcagtcctggaactcaatgctgcatttgtatggcacagcctcatggccctgcaagcccccacacatgtacacacattcgcagtgcgcggacctgggcgcgtacaaggccgccctgccctggtggaagatcgtgctggcgggcgccatggcgggcatgtatgtctccctgggcggcatgctgctgctcaccgtaggccccaactgcgtggccatggccggggacaaccccgggctggcccggtacatcaccggcgccatcggcttcccctacgccctgctcaccatcctgacctgcggcgcggagctgttcacagggaacactgcggtggtcaccgcagccgtttacgagggcaaggccgacctccggtccctggctaagtcctggatctgctcctatgccggcaacatcttgggcgccgcagcgggggtgggcctggccgtggcttcggggctgctgccgcagctcacacgtggcgccaccgccctggccatctataagacgggggcgccggtgggcgtgaccctggcgcgcgccatcggcgccaactggctggtttgcatcgccgtctggcagtgcaccgcggcgcagacctacggcggcaagttcattgcctgcctgggcccaatctccgcctttgtcaccatcggtctggagcactgcatcgccaacatgttcttcgttcccctcggcatcctggcgggtgcgggtgtggtttcgatgagaggctggggtgtggggggggggtgaaggggaatgtctgggaatcctgtcaatacttggcaattcacagtgaaagggttctggcatggatgaacgctgcactgaggtgcccgctgtgcaggctgcacacctgcatctcccatctcatcagcttctttccctgtcctctcgcacctcgctgcctcaggcgcggatgtcaacatgcgcgattttgtgctgcgcaacttgatcccggtgacgctgggcaacatcttcgcgggggtggtgtgcgtcgccaccctctactcgctgctgtacggagcgctgggcgaccgcatcatgggcaagaagccagccaccgcatgagaagcagcttgagactcggcactggatggatgggggctcagatgccctctgtgccgtgccagcctggtactcctaatattaagccagtccatggattgctccatggaaacagtccgccctcacctcctaattcacgcctatggccatccccaagcccctcccatgccctccctccctccctggctgcatgtgtgggagtcttgacatgccgacttgatatctgttgcgatcccatgttatttaagcaggagatgacgtctaagagtttgcgccaagcatcctccacattcatgaaacatgggactgtgggcggtgaagcaatgcacaccatgaaggtggatggaagtggtgggctggtgcttatatgccaatctgcacactgcagcatctaaggtagcgacatccaggttgcaaatcagagcgctgcaggggttgccgctgggaaaatggcctggaatgtcacctcccaagaccaaagcggcccaaaagagcccgctccttggtcttcttatccgccagctgaggactggccgggtctgcaaggataaagcaaagatgcaggacgaatggtgatgtgctggccagtgggcttgaagtgtgtgacggaggacggcagccagaagcaaggcgcagggcagtgtcaaacagaccatgtgcccgcagcacactcttcccagacctggggtcgaggagacgtgcacatccttggccttgggcgtagagccctcagctcccttcttgtcagacctctcgaaggcagactcaagggaggactgcaggccccttgctgcctgcgaggatcagggcagggttgcacgaggtcgagtggggatgccaggcaggctgtatgttgctgaagactcagcaagacgaggcggattccacagcaatggggtgaacacagtggccagcacagagggatgtaggccatttgaatggtgccagaagtggacaagcatgcctgctgggcccacctgaagaagtgcagccccatcccaatccaggcatataccctattcccatcccctacataacatgccttggacagcttggacctcagcgagcgcttcttcttcccgcgccggttcaactcggccaggaggacgccctcccgctccgcgctttccacctgcacccgcgtaagctccagctgcagggcgcccacctgcgacagtcatggtcgagcggggattaggagtgagaagcggccacagagtaagcatgggggtgtctgtgcttaatggccaaccgtgatctgagattgggagtcgaataaatccccacccgtcccaaagtgcaggctgatgatgatgaccacccctttgcacaccctcctagaccacctcccccccctcctccgcacaccgggtcccaccttcagggacagcgcgttgagctcgtccaggcgcgtggcggtggcccgcgccgacagcttcgcgctttccagctggcccacctcgccgcgcaagcgctcggcgtcctgcatgccctccaccagcgcggagccgaggcgtgcaagctcggcgttcagcaggcgtgcggcctcgtcgtggaccgagcgcgggtccgcgccgacgcgggcgcgcgcctccatcagccgctccagcacctccgccaggcggtctggggtcaggccgggggccgcaccgcgccgccctccaaaccacaggctgccctggccggcgctggcattggcctggcgcgcccgcgccgcctcgatggccgccagggctgcggcggggggcggggaggagccggaggcgtcgtcctcctcctcctcctcctgctccggttcgccttccaggggccgggcgcgggccaggctggcgcgcagctcgttcacctgctgctgcagctccnnnnnnnnnnaccggaggcgtcgtcctcctcctcctcttcctgctccggttcgccttccagggtccgggcgcgggccaggctggcacgcagctcgttcacctgctgctgcagctccgcgctctggccgcgtgccacggccagtgcctcgaccaactctcgctcctcgggccgaggggcatcagccaacggtattgccccggggcctggccggtcagcggcgcgnnnnnnnnnngctctcgctcctcgggccggggggcatcagccaacggtgctgccccggggcctggccggtcagcggcgcgcccgccggtcccaccaaacccacccccatccacggcacccaggtccagccggggcaccgccagcgcccgctccacgccgcccagcgccttgcgcagactctgctcggcggcacgaagcaccggggaggcggcatccatcgcggggaccgcgcgggcggtggcagggccggacggcgggtcggggccgaaccccgccatgctggccaccatgctgatgcgcccggggctggggcggggcgaggcgacggccaggctgcccaggccctctttcaatgcgccctgcgcttggagcagcgcctggcgcgcggacagcgcggcctcgccggggcctgcggcggctggggtcggcgacgcggcggccggaggcggcggtgatgccactggtggggccgcggcggcggtatcgcgccgccgcgccgcccactccgcctccgccagccgggcctggagggccgccacctcggaacgctgcgccgccagcgctgcctcgtgcacggcccgagggacgcccgggtcgccgccggcgcccacaatacctggggccggggtcgagcgtgaggaaagcacggcggacttgcgaggggaggactgcctgcccccctccgcctccagcaggcgggcctgggtggcgcgcagggtctctctggtcgtctgtgaagggggtgggagggagggtggttggcagcccggcgagcagattctaggagttgcggagcgatggacgccacagcacacagcggccgatgccgtgtttgaaatcacggagtctcccgcagaaaaaacaaaccctcgcacctccagctccagctgcacggttcgcaggtactctgtgcgctgcagcgcctcgctgcgatgcctcgccgcctccgccttggactcggccacacccgcctcctgcaggttcagctgcttctgcgagggcagggtggaacggttgaataaaacagcagtattctgggatgcagcctgcagcatgtccaggcctggtgaggagtcccacatccgcaagccgcgctgtagactcagcagcttcccctcagccccttacccagnnnnnnnnnncgcatctccaagcctggtgaggaatcccacatccgcaagccgcgctgtagagtcagcagcttcccctcagccccttacccagccacccacctgtagggccgccacctcgtcctccgctgccctgccatcgcgcttgaggaccaccctctcgttctccagctggcgcacgcggaggtgcaggccctccatgctggacagctcctccgactgctgggccagcttcctgtctcgcgccgtcagggccgccatcatcgtggactgggaggccttcagctccttgacctcggcgcgggcggcgtccagtgcgctctgcagcttgtggttgccgtcgttggcgcctggcagggtgtgggtgtggggttgatcagtggtgggggcgctgcctgaagcagcatcatgcctgctttcagcacacccatcccgcaatccccttgctaccgcaaaaccattcagccatcctgcccggcgtcaccaaaacccaccctccaagacggtctgtgcgctgccnnnnnnnnnngggggcggggttgatcagtggtgggggggctgcctgaagcagtatcatgcctgctttcagcacacccatcccgcactccccttgctaccgcacaaccattcagccaccctgcacggcgtcaccaaaccccaccctccaagacggtctgtgcgctgccgctcctcgccaccagctgcgcgctgatgcggtcggcctctgcattggcagctcgcacctcgctgcgggcggctgccaggtcggcggctgctaggctggcagctgtcgtggcagacttgacctcagctgcagattttgagattgagggtggggccagatggtgccactttctcagtacaatccagccattcatctgcaccgcagtgtgcaggcgagcaacaggcgcgcatggcccagaccctccccttgttaaatcccaccaacacacataccttccagactcaggatcttgttggtcctcgccacgatggtgtcttcggcctgggccagggcctgggaccggcgggcgaggtcggacttgagggtctggacctccgcctggctggccagcagcctgttctcccacagcttgatctcatcccggagcctgggaggggagcgtggaccggtctaggtgccgatctggaataaaaccatgaaaattcccatgtgggtccagttcctgtagcgaccccgactcaccgttttagctcctgcagggcgaaagtgtccctgtccatggtcgggttggtcatacccagaccagcccgcgccttctctgtaatccggatctgggaaacaaacaactacacggtcttcagaagtttacaccgcttcccccgcttcgagtattgaggtgggtcgtcgtggctttccgaccccgctccagatcctcgtcctggtgggaaaccctcgcgatcccaggnnnnnnnnnngcggtctccagaagtttacaccgcttcccccgctccgagtattgaggtgggtcgtcgtggccttccgaccctgctccagatcctggtcctggtgggaaaccctcgcgatcccaggaggaagagacttctcgaatacttatccaaggtgtaactatgatgatataccgacgtttctctgcctgtccatgtggctcgaggctcgagtctctgtgtttcgttccacaacactcggtcgtcaccacgtgattgggccgacatcttttttcagatcctgcgattttggcagtaccctgaacgcagcatgggtccttcattcatctcaacgatgaagaatcttttcgttctgattgattctggagtttctgccgctgcggcagcatcaccgggctggggcccatggccactctgtgccatgctcgggttttcacctcgcgcagacggacgatctccccggcatgcctcgcagcctcggttgctgctccccgcatacagctacctcacgagctgggcctgtccaccgcctgcgttcaggggaacggtggtgctgcctacattctaggcatctcccatgcgtccagggtctcatgccagcagtcccgccagatcctgcgcatggtcccagcccacaccctgatcctggagctgtgtcaggacagggtggggctgctggtggatcccaggtcgccgccgccctcaagctggaaagccgctggtctgaagctgtccggtctgcccggctggctggcaatggaggatgttgcacccctcctccacgcggccactgggatgcccatcactgagcgaagcattgcgcaggatgttatagctctgaaggccacaggtgtgggtgggggtcggctggaaacttgtttgattaatgggctgtgtcgcggtgtccacaaataagattgtatgctgtgtatgtgtcctgatgaccatgaggtgtgtctgctggtgcttgggtgctctcggcggttgaggttgtgtgattctaaatgtcgatgggtttactgccaagtttggcttgctcactcccttctatccccacgcacaatcctacttctccaggaatggtcgtctctgtgcgcgtcctgacagcccctcccccgcccgaggccaatcccgacttcttcagcagccccgagtggcggaccgtggcgcctatggggaagctggagtatgtgatcagctccaaggctgagggcggaactggaaacggggccttaaggatcgatgccgactccatccgaccctggctgtctccaggttttgtggggttttggtgcggagggcaggaaaacagacttgggagaggttttttgtgtgggagtggttgaggttctaatagcctcactggacctcggagacgtgccaaagtgcaggatacttggctcaacttttgctctcacgcacaatcacagagcaggccaagcgtgtccaggccgaggtggggagaggggcaggcggcgccctcctccccttgtttgtttcggtagcccgtcaattgcggcgcgtgctcgcgcgggacgggttgcggactgtgccgcgcggcctctgcgcagtcctgcgccccggcagcgtcggtgatggcgtggcgctgagcttggagatgcacccaggtacgacgccaggggaggaatggttgaggggaagccggccgatggctgctgcgtcgggcaccaacccagagtgttcttagctctcgcgttcctaacaagacctcaaagcctgtctcaccgtccttcattgtcccccgctcgtgatttcctcatgccaagcaggcagttccggtgtcccaggcaaggcccaccccgtggcgctgctccccctctgggactgcgacgcgatcagatgcccggatccagacgcacacacgcaagccgcacccgcgtccgcccacgccccgcggcacccgctgggctcggccctggcgggggccctgacgcgggcgtacgctgcgctccaggagcgggcgggcaggaaagtgg

SEQ ID NO: 43215 - DNA, 40284 bp, Chlorella protothecoides
  modified_base (128)..(137): a, c, t, g, unknown or other
  modified_base (385)..(394): a, c, t, g, unknown or other
  modified_base (455)..(505): a, c, t, g, unknown or other
  modified_base (569)..(578): a, c, t, g, unknown or other
  modified_base (1377)..(1386): a, c, t, g, unknown or other
  modified_base (1670)..(1679): a, c, t, g, unknown or other
  modified_base (3274)..(3283): a, c, t, g, unknown or other
  modified_base (3981)..(3990): a, c, t, g, unknown or other
  modified_base (5020)..(5029): a, c, t, g, unknown or other
  modified_base (5494)..(5503): a, c, t, g, unknown or other
  modified_base (5744)..(5753): a, c, t, g, unknown or other
  modified_base (6418)..(6427): a, c, t, g, unknown or other
  modified_base (9128)..(9137): a, c, t, g, unknown or other
  modified_base (9908)..(9917): a, c, t, g, unknown or other
  modified_base (9975)..(9984): a, c, t, g, unknown or other
  modified_base (10066)..(10075): a, c, t, g, unknown or other
  modified_base (10626)..(10635): a, c, t, g, unknown or other
  modified_base (11047)..(11056): a, c, t, g, unknown or other
  modified_base (12373)..(12382): a, c, t, g, unknown or other
  modified_base (13017)..(13026): a, c, t, g, unknown or other
  modified_base (14552)..(14561): a, c, t, g, unknown or other
  modified_base (14629)..(14638): a, c, t, g, unknown or other
  modified_base (14746)..(14755): a, c, t, g, unknown or other
  modified_base (16665)..(16674): a, c, t, g, unknown or other
  modified_base (18617)..(18626): a, c, t, g, unknown or other
  modified_base (21382)..(21391): a, c, t, g, unknown or other
  modified_base (22121)..(22130): a, c, t, g, unknown or other
  modified_base (22738)..(22747): a, c, t, g, unknown or other
  modified_base (23292)..(23301): a, c, t, g, unknown or other
  modified_base (23592)..(23601): a, c, t, g, unknown or other
  modified_base (23801)..(23810): a, c, t, g, unknown or other
  modified_base (24117)..(24126): a, c, t, g, unknown or other
  modified_base (25747)..(25756): a, c, t, g, unknown or other
  modified_base (26052)..(26061): a, c, t, g, unknown or other
  modified_base (26661)..(26670): a, c, t, g, unknown or other
  modified_base (26946)..(26955): a, c, t, g, unknown or other
  modified_base (27590)..(27599): a, c, t, g, unknown or other
  modified_base (28283)..(28313): a, c, t, g, unknown or other
  modified_base (28498)..(28507): a, c, t, g, unknown or other
  modified_base (32077)..(32086): a, c, t, g, unknown or other
  modified_base (32784)..(32793): a, c, t, g, unknown or other
  modified_base (33289)..(33298): a, c, t, g, unknown or other
  modified_base (34024)..(34033): a, c, t, g, unknown or other
  modified_base (35008)..(35017): a, c, t, g, unknown or other
  modified_base (35997)..(36006): a, c, t, g, unknown or other
  modified_base (36088)..(36132): a, c, t, g, unknown or other
  modified_base (36188)..(36197): a, c, t, g, unknown or other
  modified_base (37939)..(37948): a, c, t, g, unknown or other
  modified_base (38894)..(38903): a, c, t, g, unknown or other
  modified_base (39391)..(39400): a, c, t, g, unknown or other
  modified_base (39626)..(39635): a, c, t, g, unknown or other
  modified_base (39868)..(39877): a, c, t, g, unknown or other
  modified_base (40121)..(40130): a, c, t, g, unknown or other
cctcattcttctacacaactgctttgatgatggtatgattgtttggtcctgcaaggtgcttcatttccagggcatgcttgtgaaagctaatcacgaacatagcacttgcctctgcacccaagcacatnnnnnnnnnnatgttattatttggtcctgcaaggtgcttcacttccagggcatgcttgtgaaagctaatcacaagcatagcacttgcctctgcacccaagcacattccatttcgccatattttgaggtcttttacgtgttcgaactttagagagctggtgtgaccatggtattttcgccacatgacatccccacaagtttcccaccagcctacgccccagctatgtatgaaggcgccttgccttcttccatcgcaagnnnnnnnnnncttcccaccagcttacgcccaagcaatgtttgaaggcgccttgccttcttccatcgcaagnnnnnnnnnnnnnnnnnnnnnnnnnnnnnnnnnnnnnnnnnnnnnnnnnnncgttcttgaggttgttcggattcgagctcgctccagaccgtcaaacatttcgatggcggaaaannnnnnnnnntctcaaggcgctccgaggtctatcctgcgaggattttgaccacacggaaaggcccgcggccacctgggatcacctcctccagcccgccctgttcttgaggtcgttcggattcgacctcgcttcagaccgtcaaacatttcgatggcggaaaaggcaaatttcgtcaatgtctcaccttcggagctgaagttcaggtgaggaccggtccccctgcgtgacgggggggcgacctgagttccagagaggagaaggaggtgtccgtcaccgctgatcccttccatcctccatggctgtcacccaggttcgagctgaagaagaacacgccggtgacgctgacgctgcagaacccctcaggggaccgggttgccttcaaggtgaagaccaccagccctaagaagtattgtgtccggccaagcaatggcttcgttgagccgaacagcagcaaggacgtgcaggtcatccttcaggcccagcgggagatgcctgccagcctggcaggtggggcgtaggtgtccatgtgtgtcgggatcacgtcaggcccatgcaggacgtccaacagtccctgggcacggggccctgacatttctatccctctctgggtgcagactgcaaggacaagttcttgattcagtgtgtgaagctgcctggatctctaccagagcagaacgagatcaaggagatcacctccgacctcttcgacaccagccgcgtgaaggacatcaggtgcgagggcggccaggagggcaagcatgctgcatggacctgtgtgcaaatgcacacatgcatggagagtgtgtgnnnnnnnnnntgacaccagccgcgtaaaggacatcaggtgcgagggcgggccaggagggcaagcacgctgcatggacctgtgcgcaaatgcacacatgcacggagagtgtgtggacaccttggagggccgctcctcgctccggtcggtgaattgtgaattcgttattcctggtcgcgtatgtgcccacccttgggcccaggcttcgctcactccagcgggactcccgtcctcaaccgttcaatggaacactcttgtggcgcaccccccgcacaggcaaacaaagctgcgtgtgnnnnnnnnnncgactcctgtcctcaaccgttcaaaggaacactcttgtggcgcatcccccgcacaggcaaacaaagctgcgtgtggtgctggtggcgccgcctcggcccccctccccagtgccagaggggaatgaggagcccaactcccccctgaccaccaaggatggtgaggcaggggcgcactttcgtctgttgtccatggtgcacgctgaattccagggcaggagtggcaagtggtggcgtaggcctgtcgggtggtcagcgtggtgctggctgcagcggctggatgtcgccctctgtcatgcgtgcctggctgaggcctccaggacttccaccctgcgactgcagcccgcgaactgaaacccctcaccctacccaccgttttccatagtcctggcacacaacctggacaaaaagctgaccaatgccgcctccgacaagtcagacatccgtcgccggctggcggagttggaaggcagcgtgggcagccagcagcaggtcgcggtgagttttaggatggagcggctttgtaagccaggcgggtggttgggatttaggaagggtggagaagttgcagtcgagccggtggcggcgcctgctggccccatgacaacccgaccccttcttggtgtccagcgtgcgtcgctggtgtggtccgccttcactgtctgtcattgacctgctgggatctaccatccccacaccctccgccctgcacacctctccaatgttgcagaggagcacgggtgcctatggcgtgacccagcttgtgctggtcgccttgctggcgttcgtgctgggctacttcatgcaggtgcaggcgcccgcgctgcggcacctgctgggaaggtagcggcaggtccgacatgctgccccactgcgatgtgccttggccacccctccccatcatctgttgtgaaatgacacgtggcgtttgagcgagtgacacagagactgccgagctagacaggggctgaggacatgatgcacgactcatggcctgccaaggagccctcgtcacgcaggctgggctgtgagcttgttacaaccatagggtcgcgagccgagggcgatgccaccctcttcatggaacatgccggctcttgcgggcatgagtgaagcccaaggggcaggccaagccgcacggagcaggggcgttctcccatgccagcccgcacgccagcatgcacgcctcccgcctggcactcagaacttgtacacgttgctctcgtcgaagccaagctccttgagcaggccggtcaggggcccctgggacttgtcgggtagcttgtccccgctcagcgcgcccatcatgcccggagggccgcacaccaacaccaggctgtcggggccggggtggggcaggtgctgcttcagcatgtcctgcgggccgggaggagggggtgcaagggggtttgaagtgcgtgccagggcaccgaagcagggtctggcagggcgtgcgtgcggggaaacatccgcgatcccatgcccgccaccgctcaccttggtgatgaagccgacgccgccgggccaggacttgctggttgccttgtccaccactgtggggagaagcgcggcatggagggtggggggtggcgggtcgnnnnnnnnnncgcgtgcgggggaaacgtccgcgatcccatgcccgccaccgtgcaccttggtgatgaagccgacgccgccgggccaggacttgctggtcgccttgtccaccactgcggggagaaagtgcggcggcatggagggtggggggtggcgggtcgggccccgcggggtgcgtctcggatgccgcacccctggcgagagagggacgcagctaggcctgcaggaggccgccccgaggcaccccgcacggcgaccctcctccctcttgctcctgcgcctcaccatagtacaccctgaagttgtcgtgcttggcagccaggccgtccaggtgcttgcgcatgacaatgtcgtcctcggacacgttggcgaagatgaagctcagcttgagggggaggccctggcgcagcgcctcagtggccacctggagcatgggtgtcaggcctgtgccgccagccaccaggccgacctccttgcgcttggcgatgtcggacaggctcagcttgggcagggggccctgtgaagcgggagggggaccagtgagtggagggcagggcacggtggcgcaggcgcggtcccctgtaggctgcaccgcgcagcatgccaacccccctgtcgccagaccgcacttccccaccctcgcacaccttgaagtcggcgctgtcccccacagatagtccctcgaagaaggtggagacctttccggggnnnnnnnnnnccccccctgtcgccaggctgcaccacccccgcacaccttgaagtcagcgctgtcccccacagataggccctcgaagaaggtggagacctttccggggctgggctgtttgtagaccttgatggcgaggtcgaagtggcccctggcatcgggggctgtgatgggagtgtacctgcgggcagcagggagagggcggaccttgtgatggaaccgatcggtggcagatcctcttcccctgtagcaacttaatcccatctgacggcaaggacagtaggtgcaggcatgggagagcaggcacagcccacttgctgccactcaagggccactgtcacccacccgcactgcaccggtaatggcatgaactccctcacccagtccctactaggctccgccacaaagcaaggcatgccccgccactcacgggcggatgacccagccggggtgaccgtccttcttggtgatgggggcgcgcgtgaggaggcaggaggccactggcagccccaccacctgcttctcatctggtagtgcaaagcggaagagccagacagggttggtggtcttcgtcagctgctccttgtgcacaagcttcaaggagcgccactcgtcggggctcagagcactggcaggcgtggcggccagcgccgggcgggtggcctgtgggaggtggggtcgagcatccgtgagatcgggcgagcaggtgcccaatcggacagggctcccctccggcgccactgggggtgatcagatgcggcagatctctgcacaaacctggagctcaccgtccaaaccgcatatccgccgacagccgcggtcgctccagctgcggcgagcagggtggggaagcgtgcccggattccctgcagcatcgcggagccaaggagcaccttgaatgcagtgcaaagatcggcgggctctagattctgagcaagcactgtccctgatgaattacagaattgggcgaaggggttgatgggtccacgctttgggtatggacagtacagctcgggcgcgtccattctcaattaagtgatcnnnnnnnnnngatgccgtgcaaagaccggcgggctctagattctgagcaagtactgtccctgatgaattagagtgtcgggcgaagggttgatggatccacgctttgggtatggacagtacagttcgggcgcgtccattctcaattaagtgatccttttagtcgacagggtgccggcgggtccaatatgataccctgacgacctacattcaacggcagcattgcgctactgatcttttaacatcatggatgctcaagcagcaaggctcttgacatgtgacgccagctctgccgcctgcttgtaccctgcctccatgcacttgccaagtgcgacacctgtaagtgaggatggtagatgcccagctacattaactcttggcatgtggaataatggcgtctgcctgccagagcatccttgaatcaaatagaactgaagccaaccaaggcccacctgcgacgtagtttcctccaaggtgnnnnnnnnnnatctgcctgccagagcatccttgaatcagctagaactgaagccaaccaagacccacctgcgacgtagtttcctccaaggtgcagaccctgccacccctgcgacgccaagtcatccttggcctcctgcagatgcagagagtgtcgccctgttggtgcacacacaccttgccacagtacacgatcactcttggcatgcagtagtgcaggccgtgctttgcctccaggactcacacctctggannnnnnnnnnaagagtgtcgccctgttggtgcacagtacacgatcacccttggcatgcagcagtgcaggccatgctttgcctccaggactcacacctctggagcgatgcccccctctgcaacggaaaagacccatgccactttcgccacaaactcttgcaaacctggatcaagtctgtgtgcccgacgttgaactgtgggatggccctgggccacacagtgacgttcacagtgtgtggggactctgcgtcgcttcggatcagcatcttccgtagatccttgtccacctgggaggggggttggatggcagggaggggagaggtggttttcatgagcaggagtgggcatgccttcagccccaagacttgcagaagtggtagggcccatcaaagaccgatgcgagtgaagctccatggcagtccagctcacaaaccccaaccttttcacctgggacacaatctcttcgtgcggcatggtcgccacttgggtgttggtggctcccccaaagtagctgagcagcaggaccttgccctccgggaccctcccggggaagaggctgctggcataaatggtgccgagggtggtgacaccctgagtcctggggtgcagctgcccgaaacctgcaggacgatgtggcgagctcctgagtggatgctggtgccgaggagtgtggccnnnnnnnnnngccctgagtccgggggtgcagctgcccgaaacctgcaggatgatgtggcgagctcccgagtggatgctggtgccgaggagtgtggcctctccagaccagcaccctaccaggcgcacccctttcctatgcatacctgcgaggtggccgtcagagcccaagcgctcgggcaggatggcagtctcagggtaggaaagcgccaccgaggccacgggtggatagtagatgctgctcagcgccttgcctagcttgggaaagcgcgactccagcaggctggcggcggtgtatgcgggcacggtcagtgccacgctgcgtgtgctcactttcttcctgccctgcggcgtgtcgtacgtcagtctgtgcgaagaaggggagtgggggcagctggggtttggacggggtgatcgccatgagcctgcacatggtaatgaggtgttgcgctgattgaacaagagatcatgccttcgatccacctgtcagaaaaaccccaaaatgacactacccaccagcaaacctccctctggcactcactggaatcgatcgccgctgcgatcgatgctctccagcttccaccccgtcaccacccggtctcccaactcctctgcgatggcgctcggcagcgtgaccaagcccttgtcaaaggagcccacggtttggccctgtcaaaaggtgtggaagggtgttatgctgggaggacaggtttgtgtttggtagtacgggaggggcacctcatcctcactgatgacagaatcatctcgccgagcgctcagcgcatgccacggccagtcccgacggctccgcgtccaccgtagactccagctgcgggcatagctttgactttctcccttgcccagggaggggctggcctggccccacaccacaagcaatccatcgacatgcgcatccgccctcaaacttaagctcaccttgggcttgggcggcaggtctgcgggccggggctccggcggcttttgctttcgtgccttcatcagcgccagcaccccccccacaatggacccgccccccttctccaggtcgtagaccttgccaaaggcggccttcatggagagctttgcgggatcgccggcgtagaccccggagcagaagggctcgatgaggcgctggaacacttcctcccccaggttgcgagtcacaaactccttcaccgactcctcccgctccggcaggggggccttgaacccagccgcgcccagccccgcgcgcagcttgccccacaggctgagcaggtcgaaggtgaggacgtccgggccggagggcgtggcgcgcaggcgcccgccccagtacacgtagcgcggggccttggggtcgcccagcaccaggcggtccgccacgccggcatccaccgccgcgcgcagcacggcgtcggagggctggaaggagttggggccctcctcccactggtacccgccgtcgcgccgagtgatgatgttgccgccaacgcagtctcgcgcttccgtcaccagcaggcggggcacggcgtcggagtactgctttgccagggcctgtgtgtacggtatggggacgtgcataggtcgtgggcatgccgggggggctgaatatggggcgtgtggggcgtgtgggcgatcaacctcctaccaaaaaatcccggaagatccctgtttaccgaccaaaagtctggcacctgcgcggtggtgaggccggagatgcccgctcccacgatgactacatcgtactccgcgtcgcctgggatccctggcgcggagctcctgccgcccgggcgcgtggtgctcgtgttggtgacggagacggcctggggtgcgacatgcggatgccgagccctggggctacctagcagccggttcaagggttttaagtgcgtgaagggcatggtcctgttgtgcattgcctgtcgaaccagcatcgcggcccccatgcccagggatgggcatgcaggggccggagtgagctccatgtgcacaagcatgggacctcagtgccagatctgaatggaccactctgcttcaatatgcctctgataccccacaagtcagatctttttcaacatgaatgtcaaagcttgggaggcgtggccgcagaggaattgcgctccaggtcacggggcgctctatcttcggcttggatcgaatattacgtcatgctcggatcagatcaacgttcgatttacacagctgccttcagtacaacgggaagtcggggtcaacatctcgcgcccaggcctccactcctcccacaacatccaccacactctgcatgcccagctcaagcatgcgggcggtggccctctgcgagtcattcccacgccggcacatgaccacgatgggccggtcgccggcggccaggtccaagaggcgctgctcgaagcgcgcaaagcgcgcccagggcatgtgctccgcgcccggcaggtggcagatggcaaactgctcgggcgggcgcacgtcgatcactagagggggggcggaagggtcggttgaagcggtggatggtccctgctcagacgacagcctgtggagtagggaggggaggggaagtttacctcagttgggcaggtatgaatcccacacgaacaatctcaatgggaaagattggcctgaagcaagatacaggccgacaagctctgtgcttggattagggcatccatgcccgagcgcaggcaccgccactcccaaactgtccagcaccaacctgtctcgcagctgctgcnnnnnnnnnntggggcgggaaggttcggttgaagcggtggctgtaccctgctcagacgacaacctgtggagtagggagggaaggggaagtttacctgagttgggcaggtatgaatccaacacgaactatctcaatgggaaagattggcctgaagcaagatccaggccgacaagctctgtgctcggattagggcatccatgcccgaccacaggcaccgccactcccaaactctccagcaccaacctgtctcgcagctgctgcacagtgatgcgctgctccgggttcaaaaggcgcagcgggcgcggcggcccatcattgggagcctggccagtgaatgccgcatagtcatagtccgccagggtctcggccgtgatgctgggcgcgtcgccgcaagccacacagccagcagacctgccaaggacgacgaatggaaggcgctgggggtgaaggcttgcggcgtgatgcattctgaggccagggcaattgccgagcgacatgtaacacggccgaccagctttgtgtgtcaccatgttgcccaaatttacccccatcaaacccctacattctttacctggcacgcagcttcaccgactggaacctgccggcccatgcatcctggaggagcagcttcctactgagtggctggccgacacccgagatcagcttgatggtttccagggccttgcgagtgcagaagaaaggggggtgaggtcagggggtgagtattgaattcggggacttgcagcgccagcaacaacgtcagcctcatgctgctgcctcnnnnnnnnnngtcacccccatcaaacccctacgctccttacctggcacgcagcttcaccgactggaannnnnnnnnngtagataaaccgagcacacgccaccgcccccctcacgaacccacttgcagcgtcccgatgatgccgggcacgacacccaggnnnnnnnnnnctccagggccttgcgagtgcagaagaagggggggtgaggtcagggggtgcgtattgaattcggggactcgcagcgccggcaacaacgtcagcctcatgctgctgcctcctcaagcacctcgcccatagatacaccgagcacacgccaccgcccccctcacaaacccacttgcagggtcccgatgatgccgggcacgacacccaggacccctgcgtcggagcagcgggagcagctctggggcaggggcgcctcggagaagaggcaccggtagcagggcgaatcatccccggcgcagtacacggtcagctggccctccaggccgatggccgcgcccgagactaaaggcttgcgagccacgcaacaggcgtcgctgcagaggaggggccagggcatgggatggatggatgtaggcacgttgatatgcggtgcatagaggttggagttgtgtgtggcgcatgcaagtggagcaacaatcgagagagaaacccaccatgggcaaccaagcacccccacgcagccacttgccaggcatgccccagtgcacctgatgnnnnnnnnnntgtgggcaaccaagcaacctccacgcagccgcttgccaggcatgccccagtgcacctgatgaggtagcgggtgggggcgttgtctgacgcgtcaacgacgacgtcgtagcgggtgacgatgccgacggcgttttccggggtcaagccatccctgtgcagctccacttggacccgggagttcaggccggcaatggactgagcggccgagtcgcacttgtgctggcccaccgtcccctccctgcgcatggcggagaggagcggcgtcaggataacttggtctcctgccgcgccaccagaccttacgcaggctcgcactggcacccgagcgcactacctggcgaaacagtcatccccataagcacccacctatggatgatctgacggtggatgttgctcagctccaccgtgtccnnnnnnnnnngttggtctcctgccgcgtcaccagaccttgcgcaggctcgcactggcacctgagcgcaccacctggcgaaacattcatccccacaagcactcacctatggatgatctggcggtggatgttgctcagctccaccgtgtccttgtccacgaggccgatgcgtcccacgccagctgccgccaagtacagcgctgcgggagatcccaggcccccggcccccacgatcagcaccgagcctcggcacagcttcccctgagctgcaggttcagacggggatgtgggagggaggggttgttcagagtcggctggctaagaattggcggtaggaggcgaatcctgcccattcccttcatcataagaagcgggacaagggatgctggtagatgtccataggaacttcaccaaaacaacaactcagcgcaccttgggcgccaaagctggggaggatgatctgccggctgtacctggcgatgtcgtcccggctcaggccatgccccaggccatcccaggagtgggttgagggagtctctaattcattctgagatctgggttcgggcagggaggagctctgcgcctggcgcaggcgctggacctccaccttcagggcctcattctctgcgcggagttgttcaagctcatcatcgaatgggactcccatggcgaatcgacatggaaggagtgatatatgagtgatagtttgagtatatgtcagaagcagaatggccatacttcggcagtgtcgcaagcctgcccgtttgccaggaggggcctcgtcatcgggggtaccaatatgtgggtaccgtgccccagtcactcagttcaccatcttctttctgtgggaatgacagagcaagtcagtcccgcctaaaaataataagaagcatcaaaagagctccagacgcaatgtccctgcagctcctgaggaaactgggggaggccgctctcaagccgcagaacgtcggtggcgtgtggcacaaagcacaaatctcggccaagaacgtcgcaaagctgcgccgagaggcgctccttgccactgggtgagttttgattgatacggtgcacggatactctctgccgcgaggagagccctggggttggtcatcacccttgccatcgtcgcctccccccgcagcaagtgggagtttgagcccgagccaaaggaggagaagccccgcaagccaaacaagggccacaaacacgatcgccagaagcctgcgaggtgagcatcgtgtgttccagacggtataaaccctgccggttttgcactgcagtcctatgattgcagcatatcagcatggtcctggcccatccagatgaccnnnnnnnnnntgtgtgtttcagacggcataaaccctgccggttttgcactgcagccccatgattgcagcatgtcagcatggtcctggcccatccagatgaccatccaatccacaggatgagggtcatcgctgagaatctggctggcatggacgagcgcattgagaagcacagggtgcgagatggatattgctggagcttgagggttttgtcgtatgcgtcggtcactcaatgccatgggttgccatgtactccggtccagccagatcactagtggatgcctcctcatccctggacccaccataataccgcaggccgccaagcgcgagatcaaggcctccctcatcgaccgcctgaccatgacccctaagcagctgcggcagaaggccaagagcggttagggaggttgggtgtgcggccacgaggaattcgtggctcggcaaggccgcatctaggtgcctgccgaggagtgctttcccttctagagagcctgtttccttgccagcatcgcctggcgcttggtacctggctgcgggcctttcccatcgagtctcccatcccctggatccagccccgcccgcccaatgtcgtgttctgtatcgggtgacgtccgcgacaaggctgcgtcgggatcccccgccggcaannnnnnnnnnagatccagccccccccgcccaatgtcgtgttctgtgtcgcgtgacgtccgcggcaaggctgcgtcgggatcccccgccggcaaggagaccggacccccacaggcgcaaaacccagaaagccccttcacccacgccggcctttctttcaccctcatcccgcgccacgcgacgtcctggaccccggcgtgcctcccccgccccacgctctccctgtccctggacgcctgcatcgtgccctcccccgccagccccgacggcgcgcgcctcgccgcctccaacgtcctcgtgctggacgattttgtggacgaggccacgcgtgcggggttattggaggcgatgatcggccccgcggccgccgtcgacctggccgcggggcgcctgagccggccgccggcgggctcgtgggagcggcgtaccaccgacgccgcaggcggggcgcccagctggggcatgcggggcacggcgctgcgcgcgctgcggcgcggcacgctgggcgcgctgcgtgaggtgggcgcgcgcctggccgcgctgtacccggacgcccacgtagcctggctgcccagcgacgccatccagggcgggggcgggggggccctcgtgtctgctgccgcccacggcggcgacgatggcgccacggagacctgctggcccgaggagtgcaaccaggggaacgccagcgctgccaagcgcgccaagatcgggccggaggcggcggatggcgccacgcgctgcccccccgacggcgctaccccccagggtccatatgccaccgacccgtgcgcccccgacagcagtgccggcgaagcccaggcggccaccaccgccccggcagcagactgcgtgccgctgctggccaatgcggcggtggccggcgacgaatttgcctaccaccaggacgccgaccccacctccttccccgaatcctcgccctgggtggcggccctgggcgactacttcaacggcgagccgggccagccgctcctggcctccctggtgctgtacctgaacccggactggcgccgcgactggggcggcgacacgctctgcctcgactccgactccggggtcggcgtgggcgtggccccccggccccgccgcgccctgctgatgcaccaggacgtggtgcaccggctcagcgcgcccagcgccgccgcgggcggcaggccgcgcttctccctggtctggaagctggcgctggtgccgcggcgcgcgggccggggcgtcgacctggcccgcgccgcggcctgggggctgcccacgccctttggctccgcggcgcgcatggcggcggtgaagcgccagctggcgcgcgaggcgagggggtgatgtgcacatcgtcaccgggctgccagtgtgtgcccatgcttggtacaacactgaaatgggatgtggcggtgagggtacttcctgggcagcatgctgggcagctcgtggcagcctgacaatggatcacatgagcttggaagaggtaccgcctgttcaaaattggaatgcaacacagagtacaggattgccgcagcagactnnnnnnnnnncgcgtgcccatgcttgtacagcactgaaatggggtggggcggtgagggtacttcctgggcagcatgcnnnnnnnnnnaggggggggggggatgaggctcgacaccctagcctattggcctaacctattaatacatgtgccaggccagcgatggcgcagagtgcggctgaacctcctccaagctcnnnnnnnnnntggcagctcgtggcagcctggcaatggatcacatgagcttggaagacgtatcgcctgttcgaaattggaatgttacacagagtacaggattgccgcagcagactgaggccgggatttgcgcctgggctcgccgcggcgcggtgcgctcggtcctgatcaccacgggatgtattggcccgtgtagtagtggaagctgccctgaaggtccttattctcctccaggaccttgagcatgccgttgacagaggtctgggtgtcgatgtggccgctgtgtccattcatgtctggagatgtgacaagcgggggggggggggggggggggggggggagggggggggggggggggggggggggggggttaggtgaggctcgattccctagcctattggcctaacctattaacacatgtgcccggccagcgatggtgcagagtgcggctgaacctcctccaagctcactgcaccccatggcccggcaatcactgttctcagcgcacctgtggccacgtagccggggcacaggagtgtgacggtgatgtcctggtctgccaggtcgtgggacaggctcttcatgatggagttcacggctgacttgctggatcggtagggaatggccccccccggcttcaggccaatggtgatgggcagaccatctgcccggttctcgctgatgctccccatctgggggatgtagggtggggacaggtgaggtgaagggtatagctggggggccatgttggggtggggttgatagcagcgcactgcatgcacgactcacatactggccccatcctcttgtcagcccagcacctcaccgtgctggaaacggtggcgaccagggtgtggccgccgctgccgccgatcaggccttgggcgtggagtgattgcaccaccaggaaggggccgatggcgttggtctggaaaatggagtggaagagcttgcccttcaggctcccaaagggctccatgtcggcgatgccagcattgttgatgacgacctgcatggtttgaagaacgagagcagaggttggcgcaggcgacggcgacggggaggcagatcaggattgttccctgacccagtcagccaccgggaccaccgctgcacggtcatcacccctcccaaccaacccccaactgacatcgatgtgagcgaaatccttcttcagggaggctgcccatgcctcgatggaggcctcgtcggacacatcgagctgggtcactaccacgttgggtcccaggctggccaggtctttcgcctggctggggtcgcgcaccccggcgatgatggtgtttcctggccgctccagaagctggttcaccagctggcaggaggagtggagagtgcgggggaggagcatgagatcagcacagctccatgcaggcactgggttcattttctgcaaggctgcagttgcccggattttcactcacctcccgtccgaggccccggttggcgccggtgacgaccactgtcttgccttcgatgatggacatggcgagagggcggcaaagtgaggcaacaagtgtcttgtatgtgtgagagaaaccagagttgggttgcttgaaaggccgagcctacgagtctatatagatggcagatgagttgacatcatccgtgagggaatccaccctgagagtacgagagtatgacgcaacgggtgcataattaccacggaatgtatactaatcgatcaagtaagcgatacatacattacaaggatgtaggtcgcccagtcaccgacgagacgcagccgtctgaggcccaggccatggtcagggctcgggacaactgccggggcaagtccctgcctggagatcactctgaggttataatcgagcccaaaaacgagggttctcacagggtttcagcttattgttatttgtccacagataggcttcctggcagtggtnnnnnnnnnngtaccacggaatgtagactaatcgatcaattaagcgatacatacactacaaggatgtaggtcgcccagtcaccgaggagacgcaaccgtctgaggcccaggccatggtcagggctcgggacaaactgccggggcacgtcccggcctggagatcactctgaggctataatcgcgcccagaaacgaggtttctcacagggtttcagcttattgttacttgtccacagataggcttcctggcagtggttttaatggtacgctcatgaccatgtacccagcaccccagccattcacagggctgccgctgccatgactatgtcggccatattaacatgtacgccaagcacagatgagaggagaggcatgttcatcaccagggcaccaccttcttgtcccatgcaaggaacttgccgtggatgtcgtccccgccctccagcaccgacagcatgccccccacggaggtggcggtgtcaatcaggcccctcccctccgtcatgtcggtgatgacatagcccgggtggagcagggtgacggtgacccccttgggccccagctcgttggccagggccttgcacacaatgttcacgcccgccttgctggcacggtacgcgtacgaccccgtgctggtgtcctccacgctccccatctgcgcgccacggtgtgatgagcatgtgacgggatgaagtgggacaaacgtatcgctgaaaagggcgtgaagtgccatggagctcatgtcccagctccttaacacgacccaagtcagccttgagcactatacttggtgaacaaggacagaaggacagcacccccagaatcccagtcactagtagcacaggcatacccaacccactacaaccaccagacccttcccaccttgctggaaacggtggccaccagcgtcgggcccgctgagcctcccaggagacctcgggaggcgagggcttgcacgatgaggagggggccgacagtgtttgcgacaaaggtgctcaccatgttctcggacgtgacactgcccaggtcctgacgctctccgtacaccccggcattgttgatgacgacctggtgcatgccagccaggccagagggagcgagcatgagagggaggaggacctcaggtcgagatggaggctgcatctcccgtcgagagtcatgacgtatggtatcctggcccccatatcaagaatctgccctccaagccacctacatcaacgtgggccgtggaggccttgatctcgtccgcccatgactcgatggaagtggagctggagacgtccaggggtaggatctggactcgagatccgcccagcgccttgaggtctgcggccttgtcgggctgacgaacaccggcgatgatcctattccctggtctggccaggagctgcctcgcccactgcatggcggagtgaatgaggacgcccgtgaatgccaccgtgattgcaccccattggaccacacatgcacgtgcagcgaatgggcggtcctgttgctcgccgtcgaagccacaataccgtagcgtcgcacctcgagcccaatgccccgattcgcgcccgtcaggacgattgtcttgttcgcgatcgacatctccctctaccggatcaatagcagaatgcgttgttgagcaaacgaggaaggtcacccagctgtgaatggccttgcatcgctgggttaggtgatctgaatgtcaccgagagcacggaggccatagcttccccccccttggccatttaagcatccacccggtcaggtaggagtagctgtcatattacacacgaaggtacacaggaggagtgggtgagaatgtactctgccatgatatacggcatgcaattggtctgccaaggagggcaaaaaggcaggggagaggaggggtggcccccactggggtgacatcgataatactacaccttatgatgatactacaacaatgacttcggcaaaactcctnnnnnnnnnnaagtgggtgagaatgtactctgccgtgatatacggcatgcagttggtgtgccaaggagggcaaaagggcaggggagaggggtggcccacactggggtgacatcgatgatactacaccttatgatactactacaacaatgacttcggcaaaactcctggtcaagtcttccaggtctccgagtaatatatttgtttattggattttttaggaagttttttcaccatcacctgcacagtctggaagatgaaattgcaattggccagctagcccttcgcctgctatgccacatctgcttgaagggagattggggacctcggtcacaagctgtagagacatgcacgtgcaccctctttcagcagtaccctgcagatctgacgtgccatgaccacgccacacgcctgccatcacactgatggtagaagcccaagaatcccctcaccttgactgcacactcttgccaggagcgtcctgcctgccatgcctcctaaaagactcctgctgtgcagagcttgcacgattggcgttgtgctctccgagccagaggacaaatcccccacagtgaagtcggaggtgttcaaccttatgtttgggagggacgttgccacaccagcattatgtatcaggacctgaaggaaatccacatgagaggggatgcttactgtctatcgtcgtgctatttcggtcaagcacatggagaagttggggatggcaggagcttgcctctcccgttctttcctcacttacgtcgatgtgcggagtctttttggccacttcatcggcccaggcgttgagggaaccggcgtcgccagcctccagggggagcacttcgatgcccgggaccatcttctgtacgtcctgcgactcattctggcccgacactcccgccagcacgcgattgcccgggcgcaccagaagctggcggacccactgcgacaacaacacggtggggccgcggggtcagggcaccggggacattacagatgtaacttcggatacccgaagtgtcactttacatatggatcgacaatttcccacagctcgtttggatgaccatctgactcaagccacagccaaacaccgcgacactaggcgccactcacttcaagctcgatggcgcggttagcgcccgtaaccacgaatgttctaattgcctgcatcgccaagccagaggaagcgctcgatacctcctgatcgatagcaatagccattaaatgtgtggtataattgtttgctgttgatctcgtcgctcagaacttaattccagtgccgaagttgtcccgaatcgtgctgtgcgtgtctcgaaggtgatcatgtgatgacataagcatcgtcgtaaacattcacgacccttggttggggggatttcccatcaagaaggttataatattgattattgaactcaatggcgtcacctgcgggtggtgaagaccgctgtgacgggcatcttgggaaccgtgtttggaggcgtcggaaggtgtcaagtccggcgccaaataccaacaggaatccagcccctggttcacgtttcgaccaggaaaccgctttgatccgctcccggcattcgtagcgtcgaattctgatgatgacgcttatgaaggcgcgcatttttggcggaggctcgggacgagcactctcctggccactagtggctgccgaaaccctagtggcgacgcgatgactgtgtagccatgaaccatacgcgtgaagcgggtcacacagcatatccaggatgtggcacgtacttataccatcgggatatgactaaatttgatgcccgcatccttgagttagatcttggagatgtgggggcgcaggcgcgaaccaggcagtcgtctcgccccaaagccacggccagtctgaggaataaacacatctccgtggagtactgcaaatatcttcctgattctctcaaggcttcggtactaccgtcgcagtattagagggcgagactcggcgcctcgcccgccctgtcgatggcggaggacacgggtgagggggtcccgggtatggcacggttcgagagcatcaagctttgcacccgagagacgatgtattggagtggaattgggtctcgaaggccactccacctgctcacacgtcccatgactttcccaggggctgccttgctcgctgccgccggaggaggggatgcctcccaggtgcatgccctcctgcaccagggagctgaccctgggcaccagggtcagggcggccagacccccctgatggccgctgctgccgctggagatgcagagtccgtcgctgcgctgctgtgtgagtggcacggtcggggtggggaggcattctcagcgtgaagatccggggtcccagctgggcttctcacgggacattcccccctgcatcgcctgccgcagccgccggcgcgccctggcacgagctggacgaggacggctgctgcgcgggggagtacgcctccgggtccgggcacgtggaagtcgtgcggcagctgctggactgggcggtgcgtgccgagctggtgctgggcgcggcgtcgcgccgcgccagcgccgcccccgcccccggcccgcaggggtacctgcaggaaagagcgacataccgcgacggccagctggtggacgccgagggcgaggcggtgatgatgacgtgggaggcgccgctgatgagggagcatgcccgcatcctctgcgcggccaaggtcggccttgcatggatctgcccgtgttccagggatgaagtcgagtgcggagggccggaggtcggggctgtcagccggnnnnnnnnnngatggatctgcccgtgttgcagggatggagttgagtgtggagggccggaggtcggggctgtcagccggctcccagggcctcaagccggcagcacgaccaccgttgccgggcccagcgcacacaccccacgcctgtgcttgaagcgcggcccagactccccaaatctgccccttccagggcacccaaccaccccccaccccccccggcgcagggcagggcggcacgggtgctgaacgtgggctttggcctcggcatcatcgacggctacatcgccgagctggcgccggcccggcacaccatcgtcgaggcccacccagacgtcctggcgcacatggcggcgcggggctggacccaccgccccggggtgtccgtggtcccaggtcggtggcaggatgtgatcgccgacctgggcccctttgacggcgtcttcttcgacacctacggcgagtacgcggaggacatgagggagtttcacgcccacctgccgaggtgagtagcccggggaggggctgtgtgggggggctgctgctgatccgcgggccaggctttccccaagtggaggaaacgaggaaacctcacagcgaagccgggggcggtcgcctggttggtgagctgtgaggtccacgcccgagaagcatggtgttcaggcgtggcactgtgaccagccggcagtggtgaccaaggaggggccgttcgagttgccctaccatgcgcctgaaccccacgtccnnnnnnnnnngagccggcagtggtgatcaaggaggggccactcgtgccctaccatgcgcctgaaccccacgtccctgattaggctgctgagtccggggggcgtctactccttcttcaacggcctctgcccggacaacatcttcttcaacatggtgcagggggaggtcgtcaagctcgagctggcaaggcgagtccagggtggggaggggtggcctgcgttggcgtactgccccgcaccgcttgggcaggggtaaacgacgcggctgtattcgccccaccccctagaatcacccagcgctccaccacgtaggctggggctggagacgcagtatagggccatgcctatggacacctcagacggcagcatctggaaaggaatcaggaataggtactggcacctgccggtatatatggtgcccacctgcacactgaaggcctgatgcactgcactgttcaacagcgtaacaatatgtgtaatgctggtaccagcagagagtaggatggaggatgcatcaggagggcatgggcggaagttgagtagatagacgtgtaaaggatgcaaggtgctggaaaagggttcgatctctgtctacggctcgatgcagcggggttcaaggnnnnnnnnnnggagtaggatggaggatgtagcaggagggcgtgagcgagagttgagtagatagaagtgtaaaggatgcaaggtgctggaaatgggttcgatctcggtctacggctcgatgcagcggggttcaaggggtgggaaggcttcggctgtccttgtggccagggctagcaagtcgcagaacgtccctacggaggcccgtagcgtcctggcgtccactgccgcaaaatctctggattggatgccggggttttggaggagtggagcagcgggagctgcagtgcagcaagagtaatctctgcacctccctgttgcaaatcccagtacgccccactccaccacacacccctcacaaagaacaaacggctgctctaaacctacaggacaaggtcgttcccgacgaccgtcagctctcgcgtggcaacgtccggtcttagctgcacagatgggtgtcacgagagctgagcgatataggcaagctcgatgccagggtagacacactgacgccagaccgtatacaatcccacatccacatctggcacgtgaacatacnnnnnnnnnnagtgtcaggagagctgagcgatataggcaagctcggtgccagggtagacacactgacgcctggccgtatacaaccccacatccacatctggcacgtgaacatacctctggatctacagcgagggcatcccgtaccattcgcgcaacgtcagggctgccgtacgtcacggccgcatggctgggtgagtgcaaggggtgggactgaactgagattccagcacaactcgacaggaaggtctctggttggattcataaactcttaatttcctgttataactcacaaggtgaatgnnnnnnnnnntgactgaagtgagattccagcacaagtcgacaggcaggtttctggttgtattcataaattctaaatttcctgttataactcacaaggtgaatggtttgcctgtatcctggtccctttgggcacccgaatgtggaacagcggggtttgccggtgctgtggtggccatggccgcacaagattcaaccgaaacaccaaacagnnnnnnnnnnttttgggcacccgaatgtggaagagtggggtttgccggtgctgtggtcgccatggtcgcacaagattcaaccgaaacaccaaacagtcactaaaaagccatactcgtgagaattacaccagaaaacacgtggttaccgagcattgatgaccccgtccaaccgtgtcgagtgcgatgtgcatgcttgcgtggcaccacagcgtaggagacggcacgagcccgtgggggtcgtggcatcgaaacccgagtagggaagggttgcacctcactaacgaaacattcagctggtccttttcgtcgcgatcacnnnnnnnnnnggtaggagacggcacaagcccgtgggggtcgtggcatcgagacccgagtaaggaagggttgcacctcaataacgaatcattcagctggtccttttcgtcgcgatcacttgaatcggaaggcaagcgttatggtatgatgggacttctgctcctgagaccacgtatattatccttccagcatagcatgtaccttgaaaacaagcatggttttgctggacaatcctatacttgatgcaaggatctccaatgtcccccaacatgggaatccctcggacataggcttcttggggggtggttgacagatcagattccgtgcaaaactgacggtggcttcaaaacatatgcgtaatgggtgcagaactcacacatccacactccgtacagccgattcccaagcagagcaatttcttcttgtttttagcacgaacatagagttttttagtgtattcaatcttgccattcagactctagggctgtccctcatcttcaccaaggttacgtgccgcccgtcattttccacttttccgaggtcaggtcgccctggggctcgtcgaggacctccctcccacaccgtcgtcaaactggggctgtttcgacctcttctcggcggggctgggtgggccagcgcccccgacatgccgggggcactggcgactagcctagacgagccagaccggccacagcgttcggtgagcaagacattgaagcgcgccgtgtcttcttactttgttccccgtggccggttcaaaaaactactggagagcgcggagaatgacaacgaggcggatgtctaccggcggaatgtgagtggggtgtgcaatccgtcgcgtcggctgccatccgggaccaggggtgatgtcggtgtcggccgtcctgtgaagttggcgtcctgaggcccacggcacgtgcgctctcccatgcccccgacctaccgggactcccccatgctgccatgcacagagtgggcacagggtgttcacccatgctgactgggcggtgcacaggaagccatcccgctatgcccggcacctggccctcatcttcgccagccgcatcttcaggtccctcatcccccccatcacggccgtcaccctcatctccacgctggtcggggtgtatgagacgcttctcaaggtgtgaaggttggagcatgctgggaggctgaggggtgggtgggtggtgggcttgcccaccctggatctcccggagggttgtgggtcgacgggggaggaagggacatgcaacacactggggtgcttgatgactacagctcaggcacctgtctcacctgtacttgttgccctgtgcctctcgcgtgtgcatcaccctcaccctcccgcctgccaacaggagcaccgcctccctgcacaatggccccacgtgaccctggcgctgggccagggcttccagctgacggcgtttgcgctgtccctgctgctcgtcttccgcaccaactcggcctatggtcgctggtgggaggtgaggctcgacagagtgctcgtgctggtgtgggtggacacgccgctggtccagtcgcgagcaggcaggcggggtgggggcccaggcaactccaggggggtacctccagcccctcgtaggcacccagtgcgcccttgctgcnnnnnnnnnnaacagagtgctcgggctggtgtgggtggacatgccgctggtccagccgcgagcaggcagctggcggtggggcccaggcaactccaagggggtacctccagctcctcgtaggcacccagtgcgcccttgctgcggggctgccacgtgccttgtcccttttggttccccgggacgaacgaggcctcgctgcctgttgtcgcctgagccccccctccacacaaccccatgccaccctcacatcacccccccccgccaggcgcgcatgctgtggggctccctgaccaaccgcacccgtgnnnnnnnnnnttccacacaatcccatgccgccctcacatccacccccccgccaggcgcgtatgttgtggggctccctgaccaaccgcacccgtgacttcgtgcgccagtgcctcgccttcttccccgaagacgccaagcgcttgcgcgaggcggcggtgctctggaccatcgcgctgccgtacgtggtcaaggcccacctgcgggagggcaaccgcctggagtcggagctggagggcatcctgacgcgggacgaggtggatgcgctgacgggcgccacacaccgcccctgcttcgtcctcgccgcgctttcccaggtggtggccgccgcagggctggacccgcagctgcgccagcgcctggacaccaacctcaccgccttcgaggactgcatcggcggctgcgagcgcatcctgcgcacccccatcccccagtcctatacgaggtgaggggccggctgggttggaggaggaggaaggggtggaactcggggtgaaggaaggagagaagggacctgacccccgacctcctctgaccggggtcctggccctggctggcgctccctccgggtcatgcactgccggccggccccatgtgccttcctgagcaggnnnnnnnnnntggctgggttggaggaggaggaagggatggaacttggggtgagggaaggagaggagggacctgaccccctacctactctgaccggggtcctggccttggctggcgctccctccgggtcatgcattgtcggccggccccatgtgccttcctgagcaggcacacgcctgcctgggcgaacgccgtccctgccctcagcggaagtcggcaaggtttctgccctgacagcccagttcgccgcctttgcatgacccccacctcctccattcccccctcacnnnnnnnnnnaaacgccgtccctgctctcagcggcagttggcaaggtttctgccctgatagcccattctgccccctttgcgtgacccccacctcctccattcccccctcacacctacccacccccaaacctcacaaacctacacaggcacacctcccgcttcctcatgatctggctgatcatgatgcccttcaccctctgggccgcctactcctgggtctccatcctgctgtcaggcctgtttgcctacctcatgttgggcatcgacgagatcggggtgcagatcgaggagcccttcggggtgctgcccctgggcagcttctgcgcaaccatcgagcgcaacctgagggagctgcactacagcaacccggaggcgcgcttcgcggccctgccctggctggtgccggcctcgcccacctgttcccgtgcctcgggcagctgcgacggcgcggacatggccgctggcatggatggtgggcatgtgggagggtgtgcgtgcgtgtgtgtgcagaggtggccggcgatggagacgagtggggagaagttcgcatgcagcgcccggagtctcgatgtcgcacacagcgggccctctggacaggggctccctactacgtcgcactgcaccctttcctgatggattgccgannnnnnnnnnacacacagcgggccctctggacaggggctcctcaccacgttgcactgcaccctttcctgatggattgccgagactgaccccacactcccactcctcaacatgcccccattcccttcccccacaccaacaaccgacagacatagaccctgtggctgggaagctgccgcacttgaacggggcgccccaggccggccagcctcgggtgtacaagcacacgtcggacgccgctgagctggcggcggggcacgtccgctttgcgcaccgctggctggagcctcacccgcacctcatccactcccccgtacaccctcaccaccccaaccaccaccacgggcatgggcacgggcacggcgcccaggagcatgggcgcggcgccttccaccagacctccacgctgcacgcggacgtggaggaccaggtggtgcgccccgccagctacccgaccgcggcgcgccatacgcccccgcatcgcagctggtttggggggaggtgggtggaggaggactgaaccagggcccgcgctgtcgagctggcaccctgatcatgctcaggtccgttgattcatcaatgaccgaaacccaccccgttcctgtgatcaagcactgatttccccctgtgatcggtctgtttgtgaacttcatgttgtctgtttggatgggtggtggtggtgtacaggggaggggnnnnnnnnnnnnnnnnnnnnnnnnnnnnnnncccgattgccgattccggaaggacagcatccgaatcgcatggccatcacattcctccggcacggtgggtcaagagtcttgcaccgacgaatcttgtataatatttttatcccaccctctgatatagccttgggctattcgagggatgagggtcctggcctcgacgaagacccccaaccacccgcnnnnnnnnnncgtcttgcacccacgaatattgtataataattttattccaccctctgatatagccttgggctattaagggatgagggtcttggcctcgacgaagacccccaaccacccgccgagcagcagtgggagcggcgcggcgcaggagacattccacctcaaagtgtgcacgaatacaacgtgtcggcgccagggtagtcttcagatagtgcagatggcccgggagcttcaaaatgtgggcctgcgggttacggaatccgggtgtctcggtgagtgagtgcatgggcaaaagggggtgatgcggcaaggagcaacctctctgggcgtgaggcacgcactcgccgaggagcatttccagatcgtcaacttcccttctcaccctctgcatccacgagcatatcgaccagactcctgaacccctgatgcctgtaccatgtcctctccaggcaagtgcggcgccggcccaaacgcggtgctaatgcagatcgccccccgggcgccgcctcgggtgctgagccacctggcttcccccgcccgcttattggacgccctgcagggcttcaccaccctgcccatggaccgggcctccctccgcgcggtggagctgcgctgcgcgggcaacgccgcggcgcgcgcgggccagcccggcagggcggtgcgcctttactcccaggccctggacctgcccgccagccgcgccactgcgcacctccttctcagcaatcgggcaggggcgcggctggcggcgggggacgcggcgggtgcggccgaggatgctcgcgcggctgtggcctgtgcgccctcggatttcaccactgccagcgtgaggctggcagaggcgctgcgcgcgctgggccaagcgcgggaggcggcggcggtggtggcggcggcgggcgtggcctggccggccttcggggagggggaggagtgccgggcgctccttgcgcagctggaggcggaggtggggcgggaactggcccgcgcggcctgagcattatgagtggttgcaagagccgatcgggcactcaggcgctcagttttggaccgcagttggtcaggactctcaagtagagacccgcacggccatgtataacctttttgtaccattcaagtgtttgcgtgacgccctcgtgatgcttgccaccctcccagatctctggaaggtgaatgtacagcgatatgatagtaaaacaagcgtgatcctgcatgctctgcgtcgcgcgtctcaccactggccccccgcctcgtcaaagtggcggccggcgaagcgcatgaccatggcgtggccgtaaggaatgtacgaaaggcagtacctgggttggatggaggggggatttttgtgtttgacagctggacagtgggactggaaggccccatctgcatgcacacctcgccacagccacaaccgccaggcaggaatcgcagtcatacattcccctcgccgcatcggccagctccgccaggacacacacacgcggcgcaccagagcagcgcgcaggtttggagcacgatgaacaggatgcagaggagggcgctgtgcagagccagggcagaggcgagcgtgccgaagatgctcaccaggtacaggagcgtggccagcctccgcttgctgtgccactgcacggaggggagaaagcagggcgggctgcgatacaagaccagggccatcctcgtccccgcaggctcaggcaccaggccctgggtcatgccatgatgatgtcaccaaagctctgccctctggccggcgcccatatgtgaaccctccacccttcttatggtcccgcacaccgcaccatgttggcccactgcttggagggtcctgccaagaacaaggagctgcgggagggaagggagggggggaggaagaactggcgtgctgcctctgctctcagcagaatccagactccctgaagggccgagccatcgtttgcatccatcctccccatactaggggggtgttaacctagcttccagcccccgccagccgctgccacccggtcctggcgcttacctcccaatggcgagcaggtttccaagggtgtacaccatcgcgaatttgacggggcggagcacgaagagcggggccaggaatgagaggaggaggcccagccccgcacagagtgcaaagcccaccgccctctgggtgcgcgtgagcgtggtggcctcatccagctgcgacagcagggtctggttgcccacctcgggaggctccggctcctccacctccatgcccagcccggtcctgagccggtcaaaccagtttgacgccatgctcgctgtccaggcccgcccggcaaaaaaacgcctgatcacatgcaaactgtgcaccggagaagtaatcgcacagggacgaggggcatcgtggtgctggctacatcatgcatgcatagattcgaccgatctacaactggccagggtgattcgtcaggcgcgtgtgtccgtccttgcacatggaatgtctaaaaggtacatacttttgatcatcacgctcagaagggggtttcaatgcaggaatacattactgctttcaaaatttggatgtgcttggcctggcacgcatctccccagcgctgtcacgcctgccgaaggcctgccacccagcgctgcagctctgggatgacgaggtctggcgtgtcatcatgcgggcagtgcccgctcggcagatccacccgttctgcctcggggtacagggccatgatgcgtgaagcattggcgggcacgcaccaggggtcctgcaccagaaggggatttgagaagggtgcagtgagccgcgatctgactggacgcagcagctgggtggcctgctgagtcgcatggcaggcaaaacgcctcacaaacttcagctctcagcagcccatggccctcccagcctgcaccttggatccccagagcaggagcacccgcgtccccttgtgcaggcggcccagcagactgttcatgctctccccagaggcggtgatgacgcggtagaacacctcggcggcgttggggttctgggcaggggtggcaatggacgtcaccagatcagcgtcgatgctgtcctggcccacatacacctgcgtcggagggggagcaggggtgtgagacccacgaaaaggcaggatcttctgggaggagtttgtcgagggcgtgctgtgcccagaacaaagtggtctgggagtgtcccgaagggatccctcacaccccccctccctgccaaggcacacctgcttgaggacggagcggatgcgtcgcgggtcccgcgccactaggaaggagaggtagatggcgcggcgcttgaggaacgtgcccgccgtgtcctgcagcccggcccacaacgagcgctgagctggcgtcgccacgggcgtcaccgacgcagacccggcatcgaagcggcccgctgcgttcatcagcaccacgccactgcagaaatgggaagaaagtagggtggggggaaggaggtggggtggacagtacatcagatggaatgggatgggagtgtcctctccctgtgaccgcaaaggaaacataaacttggcaccttcactgagacaccaggaattcatcctggattgctccctccccacccctgcctannnnnnnnnntggaggaaaggagggtggggggggaaggtggggtggacagtgcatcagatggaatgggatgggagtgtcctctccctgtgaccgcagaggaaacataaactgggcaccttcactaagaaaccaggagttcaccctggattgctccctccccacccctgcctacacctttcctccacactcgccacaactcaagtccctcccttcccccctccctctcatcaaggccccccacctgacaaggtccggggtgcgggcggccatgttgagggcattgaagccgcccatggagttgcccaccaccaccgccggcccgcctaccacctcctgcaggaaagcggcgcactggtcggcccaaacgttgtacccggagtagtcgaccaggggcttgtcggaccagccgaagcccagcaggtcgatggcgaacacgcggcagctgcgcgccagctgcggcacgacgtagcgccagtggtaggcgctggccccaaacccatgaaccagcaggaccgccgggccctcagtgcctgggtggatttttgagggagcggtactcccacgagggcgagggaagaccgagaagggggcagcaggcacggcgggtctaccaatgcatcaggacattgtttcgtcgctgctgtgagccacaatgctgacataaccaaatcattcggatgatcatgagcaactgtatgcacagtgtnnnnnnnnnncactcccacgagggcgagggaagatcgagaagggggcagcaggcacggcaagtctaccaatgcatcaggacattgttttgctgctgctgtgagtcacaatgctgacataaccaaatcatttggatgatcatgagaaactgtatgcacagtgtaccccagccacatcgtctcctcccccatgccgccacctgcagagaggtaattgatgctatgaccgttccacttccaggtgtcccagccgtcaaggcggagggccagcctttctcggccatgggcgtcaatctcatacgataccttgctgctgggagcatgctctgcagcattcctactgtcgctggcaggctcctgagtgcaggtaagcagggcatgagaggtaaagagatatggtagatgcaggcaatgagaagtgcccagcagccttcctattcccgacacggaccaagggagcccaggcctcacaaggccccacccacctcagcgacggaggggcggatgnnnnnnnnnnttgcccagcagccttcctactcccgacacggcccaagggagcccaggcctcacaaggctccacccacctcagcgacggaggggcggatgccggaggtcagggctgagaccgtggtgatgatgcccaagtcccgccgggacagggagcgcgagggcatgaagccgcggtgcattgcgagggccgatggtgccctcgagccaggcagggctggaatccatgccggacacctcggcgttgtgccggcatgcatggcgtacatgctggctctacgcgcgacaactgtacgatgtgcaccacctcgatgagcaaggtttgacaatcgaatgtgacaaaatttgctctgaggaatcggggtggctgctgccgcgcatgtcatgtgccccctggggaccccactttgtatggacgggacgggtcgtggtttggacctgaggcgcactttccacttctcggaagtcatggtccagcgacacacccaccattaccggtgtcggtaagagcatgcatacactgctccaggatgattcgaggccgccagagttttactttgtaatgaaggacagttcgtgatctccctcgtgcctgtccggatgaagggcaggaccgcaagatggggttaagaatatccacaatcttgacatgctgattattaatcgcggggaaatttttcgctcagcaaccttttaatggccttaactagccattggttagagcctgtcaacaagnnnnnnnnnnttttcactttttaacgaaagccacttcatgatctccctcgtgactgtccggatgaaggtcaggaccgcacgatggggttaaaaatatccacaatcttgacatgctgattattaatcgcgggggaatttttcgctcagcaagcttataatggccttgactagccattggttagagcctgtcaacaagtagtggctgagcacgcacgggtcacccacctctaccggcacactatccaggcaagtacactcggatgcacttgctgtctcgttggtatggatgatgaggattcactcccttacggttagtcccagcatgatgagacacagagtaacttggtgaattctgcctgacataccgaccggcgattctgagatagctggaggtggatggtccacccactgcacgcacggtccaggctctcaatcggagctcgtttcccaaaggcccctgcaggatgtgcagctgacctcatgaatgctgaaaattggtggatgggagtcatgccctccagtgcacgaagctagagttcgagcacattatgatctgggtactgcgggtatgttggaaaggaaagctgagcttgaggggatgtgcacctcccctggctttctaggaaatgtatctgaagaatgatgattgtcccaaggcaacccatcagagtgcaggcttctgcctccacaatgccgactctatctgggaacctgacttcatgttcgcgtggttttctcctgggtgggcgtcaagagtttccttgtgctccatactggtatgcaagtatgagccctcacctgtccccctcgcctccccttgttgcagtccttggtgctggcctcagattgcaatctggacaagaagagtccaccccacccactcctatccctgtttgaagtgcaccacatacccctgcacactccccagctcacaccacttttcaagtgcatgcgataccgacagctgctgcctcacatgcccacnnnnnnnnnntaccactcttcaagtgcatgcgataccgatagctgctgcctcacaggcccacacctgccacacatcaatttaggcccaggccgcccagattcgccgcaagcgcatcgtcctccccatccgccatgccctcgtcctcgtcctcctcgtcctcctcctcagtctcatcctcatcgtccgagggctccatattttcctccagggtccccagcaccctagactgctcatgctgcgccaggatgccctgcaccatgtgcatggatggggtccgtgacgaccgttgttgtgatccaggaggtccctcgcccagcccagcatgggtgagaggcggggtcctcagcgccacgcccgcccgccatgcaagcctcgcccgccgccccaagcacccctcccaccaaccccgcacatcgatctcagcgatggcctcttcgctgaattcgttttcatccagccccaggaaggtcagggacttgagggaggaaaccgcgtcggcgaccgccagggccccactacgccgcgactggttggcgctcaggtccagcctttccaggcttgccaggcgggggatgccctgtgcgaggagggtaacgaacagtgaggaggcggacagggggcaggtgatctggggtgggcaggccggcacccctcccaggtcaggccggatcatccccctcacgatccccaggatccttgccagccagcccctgccaagaccgaccagggctgcctggaccaggccgcggctgcccagctcattctcacgcaggtccagctccctcagggaggtcaggcgcggcaggacctccgccagcgcgcccgcactcctcctggccagctcgttcagggccaggtgcagcgactggggagattggtgaggggtggcggggcgagaggaattgagactgccaggattcaggcgatgaccgctaccagttcctgtatggccacgccatgccccgagaggcagcacaaggctgggcgcnnnnnnnnnntggaggcggacggggggcaggtgatctggggcgggcagaccggcaccccttccaggtcaggccggatcatccccctcacgannnnnnnnnnnnnnnnnnnnnnnnnnnnnnnnnnnnnnnnnnnnnaccctcgatgtccaggccccagagaccctccaaaaaggatgactcacctccagcgnnnnnnnnnntggagaaatgagactgccaggattcaggcgatgaccgccaccaatccctgcatggccacgccgtgccccgagaggcagcacaaggctgggcgcacgacaatcgaagccaatgatgtgggaacctgaacggccagtgatctgttggtcgcagcttcagaccatgtcccaggacgtccacccctgcatcatcctcccgcccccgtctcttgggtgctggccaccccgcccttgatgtgcaggccccagagacccctccaaaaaggatgactcacctccagcggcggctggaccttgcccagggtgcggaggaccgcggccgtgccagcgtcgcccaggccggtgtcggtgaggttgagcacgcgcagcttgggcgcggctgccagcaggttcagcagctggggcagggcctcgtgggtgatggggttgtcgtgcaggtccaaagacaggagggtgtcgccccggcctgccagcgcggcaaacagcgcggcgccgccgtcggtgccaacgcgggaggaaaccatggagaactcctgcagggcgggggcgcggcgcagcagcgcggcgatgtgccgcgctccctcgtccccgctcatgttgttgtacaggcgcagcgcgcgcagagcggcgggggccggcagcagctcgtccagcgccgcgcagccgtgcacggagcagcccacgtttccaaaggccaggcgctccagggtggtctgacatgaggagttgggaggggggcacgggaaagagagggagaggtttggtgtggaaaggagcgaagagcgtgggatccgcgaatcggcggtgaggtccaaatgcgcagagggcatgctcacccccccccacccccccccgcgatcatgccttaccctgcgcaagcatacccggctgccacccactcacctggttggcaaaggcggcggcggctgcccggatgcccttctctcccagtgcgttgtcagagaggtccagctccaccagcggggcgcgggacagcgcctcggcgatggtgcgcaacgagcgcagcgcctcctcctctgcggggggtggagtggtgtgggagcgtgtgaggcactgtccatgatgtgcaggtctgcgcggaggccagccacatgagtctgcgcccccagccagcgttgcctgccgaccccgccatggtaggctccgcccgctcatccttgcggcgtgcaaggctgcccagcgggccacccacctggccggccggcaatgatgtccgccatgtcagcgtgcgtcagcgtctcggcaacacgggcgatggcccgcgccgccaccgccgaggcgtcggcgccaaagctcttggtgctgaacttgatctgcgccattgatttgggaacggggtgccgtgggaagaggcggacagcgggcatggccgccatacacggtgatcgaacatgaccgcaacacactctctggcatccctgtgagggtctccaatcatgcgtgtcccactcgctccgaggccttgtccagcagcagcctcacccgggtgatgggctctgtgcccgtcagcatgggggccagggcctcttcagcgccctctgccgtcaggaactcgcgcgtccccgtcaggtccacatgctgcagcataggaaagcgaggccagggtactctgagtgtgcatggggagcctgctgaggcagacgagtctgacagcatttcctgccctggtgggactacgatggtctccctactgcgtacatggcgtctccctcatcaccctcccnnnnnnnnnntgccagggtactctgagggtgcatggggagcctgctgaggcagacaagtctggcagcatttcctgccctggtgggactacaatggtccccctactacgtacatggcgtctccctcatcaccctcccagcactttcaacccccaagcccacgcacgccagtgggctgggcggcggcctgcgaggcatcggtagagctgtcactgcccaaagccagtcgctccagcaccagctggctcagcttgctgatgtaggcctgcgggtttcatcagagggagggaagtgtgcagtttccaacctcttcatgccccttccgaaaaccaagcacagagctgcgcttgcctgcagtgtctcggcatggggcctgtggcaattggtgaccgtgccctgcactccggccacagcgtaggccttggcctccagcttggctgcctccgcgctcagttccgcatcgttgaggggcgtcttggcaaagaacgccatgctggccatgtttgcgcggatgcgggccacggtgtccgcccgctgctccgcagtcaggctccagggggtgtccatggccgctcgcgcgaaggtcgagcaatgctaaatcaagtatttcttgtaggagaaggattgcggagccttttattgaagcagatcaggagcctggtcccggcattatctcgcgaaggctatggcgagggcgcgagggttgttgaggctgcccaacttgccatgtttttgggaccccacttcacagccaggatggacacagaatgcatgtgcgcggcctggtaaaagagaacaatttagtaatttatggctatgcaccatgcccacagaagggtggtggggggtctctcagcacaaaacctccccacctacaccagggacagggtgcaagggtgggtgggggcgtcactgcattcaaaagagggtggcgttgcagctggcctgcacgcccttnnnnnnnnnngtgccaggacagggtgccatgggggcgggggcgtcactgcattcaaaagaaggtggcgttgcagctggcctgcacgcccttgggggtcaggtagttgatgccggtgaacaggctctggggcaggagtccaggctccagcatgccgcactcccccgacctcgcgtcgagccaggcgaggccgctgggcctccaggggcaggcctcctcctgccccgcctcctccacctgcgcctccaggtcggccacggggcggagcacggcgtcgtagttcctgcgccccaccgagcagcggggcaccgccagcacgcactcggtctccaggcccacggtcagccagccgacgtacccctcgtcgggcgtccagcccgcgacgaagcggaaggtgcggccccatgccgggctgggcacgttggtgtccacgacagtcacgttgcttgggcctgggtagaagaaggtcgggggggggggggggggggaaagggtgcgcnnnnnnnnnnctggtgtccacgacagtcacgttgctcgggcctgggtggaagaaggtcgaggggggggggaggggacaaggtttgatcacaaggaggaggggttccgcaatgtgccagaagcccaaatggcgatagcagtggtgaagctatgggctcctgcacttaaaggcgcccattgagtaagcaaaggaactgtcgtgtcaggggcaaaaagcctgcgacgccatcgaaaccnnnnnnnnnngaggactcctgcactcaaaggcgcccattgaggaagcaaaggaactgccgtctcagtgggcaaaaagcctgcgacgccatcgaaaccaccacacaccccttaacaagggatcagtcagcccgtacccaccctcgaccctgatgcaggaggcggggatgatggtgggcgccgtgcaatacacggcgatcgaggcccagggcgtgttcagggtcagtccggtctcagcgcagcannnnnnnnnnggccgtgcaatatacggcgatcgaggcccaggccgagttcagggtcagtccggtctcagcgcagcaggtggcctgctccaggaagagcttgcactgcggtctcacattctccgggcaggcagggggaggtggaggggggctgcaggggttgtggtgtttgtcacgatcatccagggctcaggaagagtccggcaggggggtactggcattgccggcagcatcggcaaaaaatcagcaagcactnnnnnnnnnntcagggctcaggaagagtccggcaggggatactggcattgcgggcagcatcggcaaaaaatcagcaagcactgctaagacaggatatctcagctaatctgccaacacgtcaatgcaaaccggacctgggcggaggagggctgggcggaggaggg

SEQ ID NO: 43216 - DNA, 61 bp, Chlorella protothecoides
cggcgtgtccaggaaggtcagcgcggtgccggaggcggggagcgggaagctgaaggcgccg

SEQ ID NO: 43217 - DNA, 61 bp, Chlorella protothecoides
actccctgctgggaccgagccacggcggcgccgcggccctcgtccaggccgtcgatccggg

SEQ ID NO: 43218 - DNA, 73 bp, Chlorella protothecoides
gctgggtgggccccgcaacggggcaggcgagggccccggtccccccagcgctgtgcgcgcagcgccttgcagt

SEQ ID NO: 43219 - DNA, 115 bp, Chlorella protothecoides
tggagcggagaaaggaagggtctggcctgtagtagtagtaggagtgaagagtgctggtctgtgtgcccatgaagatgaggtgctactccccgcatcatccagcaccctccgcccc

SEQ ID NO: 43220 - DNA, 61 bp, Chlorella protothecoides
cagcgagcatggctcgctgcaagccagagggccagcacccgacgcagcacatgcctttatg

SEQ ID NO: 43221 - DNA, 64 bp, Chlorella protothecoides
ctcatgcccgagaggcggtagaggcgggggggggggggcaaactctgttgctccagaaggacct

SEQ ID NO: 43222 - DNA, 74 bp, Chlorella protothecoides
ccagccccagccgccagcaacgtcgcagtgccccccccagccctggccgccgctcccgaccagccgcccccagc

SEQ ID NO: 43223 - DNA, 71 bp, Chlorella protothecoides
cagcggctgggggcgctgggcggacgtgtatgtcaggcggttgggaatgccgagcgggcgcggatgctggg

SEQ ID NO: 43224 - DNA, 61 bp, Chlorella protothecoides
tgatcggcaatgtgatggtgaggctgggggggcacaattgtcaagcgtggggagtaccata

SEQ ID NO: 43225 - DNA, 75 bp, Chlorella protothecoides
ccctccaccagaacaccctgaacaagcccctctccaagccccccggcgcccgcacacgacgcagcacgcactctg

SEQ ID NO: 43226 - DNA, 524 bp, Chlorella protothecoides
  modified_base (134)..(169): a, c, t, g, unknown or other
  modified_base (302)..(399): a, c, t, g, unknown or other
gggggccgggcggcggagcggtcggccgggcccagccccgcccccgtcgatgccccacaggtctcccagcccgccgcgggggatgccgcaggcgcgccggagctagccggcagggagccgagcgacggccgggnnnnnnnnnnnnnnnnnnnnnnnnnnnnnnnnnnnncctccttcccgccatgcacggcgccccctccggccccgaggcctgcagaccggcacagcggcccggcgagggggggcccacggccgcggcggcccccgacacccatgcgcagggcggcgcagtggcgctgcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagacaggcgttgaggctggacctggagcactcaaatccccccttctttgcgcgactggccgcgctggctccgagcctggagggcagcaggggtgaggagccggggcgggggggggcgatcactgg

SEQ ID NO: 43227 - DNA, 63 bp, Chlorella protothecoides
cctgccattgcagagcctcgaccacgccccaccctcaaacacacacacgacgcacaggagtcc

SEQ ID NO: 43228 - DNA, 467 bp, Chlorella protothecoides
  modified_base (97)..(110): a, c, t, g, unknown or other
ctcggcgctgccgccgtccatggtgcccacggggtgggaggtgcccttcggcgcggcgcagccgcccgacgacgccgccgccgcggggcggttgggnnnnnnnnnnnnnnagggtgggaggtgcccttcggcgcggcgcacccgccggacgacgccgccgccgcggggcgcgtgggcgtggacgagtcgctggccccgctgccccagatcatggccgtcttctccgcggtggcctggaacatcgtgggcgaggagcagccggcgcgcgtgacgctgcgcctctggtccttcgaccccgctcgccccacggcctcgctggaggacctgcgcctgcaggtccccgacgccgtgctgtgctcggagatgggcgtctccttctcgccctgcggccggtacctggccgccgcggtggcctgccgcgcggggacgcggcgcggggcccccgcgccgttgggcacgcccggcca

SEQ ID NO: 43229 - DNA, 155 bp, Chlorella protothecoides
cgatgcggagcccacactaccgctgagctcatctgtgaaagcgggttgcaggggggggtgggagtggggtggcaaagcttactatctgatgttggcagaacagctgtggcaacacaggcgttttgggacagagcacctcacattgaccctccatg

SEQ ID NO: 43230 - DNA, 100 bp, Chlorella protothecoides
ccccgggctggggtgggcgaagaggcgcagcgcggccgggagcagggtgtcgttgggcgcggcgccggcgtcgccggggcctcgctcctccagggcgcgt

SEQ ID NO: 43231 - DNA, 90 bp, Chlorella protothecoides
tgagcacgccgtggcgccctcgccacccccgccgccggcgtcgcgcggccagcccgggagcacccccctcgacctctcccggggtctggc

SEQ ID NO: 43232 - DNA, 61 bp, Chlorella protothecoides
ccatgtgaacagcaattggacatgggtgagccgatcctaagagatggggtaggcctgtgtc

SEQ ID NO: 43233 - DNA, 61 bp, Chlorella protothecoides
cccctccgcaacctgccctcgaccgcccatacccccccctgtaccatcctatgtagctgtg

SEQ ID NO: 43234 - DNA, 61 bp, Chlorella protothecoides
ccctatcttggggcatcgcagtggctgccccgggcactttcaaaggtgccctgctcatctc

SEQ ID NO: 43235 - DNA, 76 bp, Chlorella protothecoides
ggcctgcctcctcttccaacctccaccctctcctccccaccccccccatcaaacccccaggaccacctgcgggcca

SEQ ID NO: 43236 - DNA, 72 bp, Chlorella protothecoides
gcgtcccctccttcaactcgatggtgtgtttgatgccgcgctggggcggcagctccgtcgggagctctgcta

SEQ ID NO: 43237 - DNA, 63 bp, Chlorella protothecoides
gtcgcccagttcgcgggtgcgctgaggggttggaagggggggagccgcgacggagacgagcgt

SEQ ID NO: 43238 - DNA, 73 bp, Chlorella protothecoides
tgggtcttgtcacgcatgtgtgggatgggattgggacgcagctactcggccggggggtgaaaggggattgtca

SEQ ID NO: 43239 - DNA, 77 bp, Chlorella protothecoides
tccgggggccatggcgccatggcccccggacaagaaggcgccgtgtcggcggccatgagcggcgcaaaggggggccc

SEQ ID NO: 43240 - DNA, 102 bp, Chlorella protothecoides
gggccgggcccggcgcgccgcctctggcgccaggtggctggcctgctgtgcgcgctggcgcgcgacgcggagggcggccgcagcgcggcgggggcggccgcc

SEQ ID NO: 43241 - DNA, 61 bp, Chlorella protothecoides
cagtccacagggtgggatgatgccgatctcaaacagctggacgccctctgggcaggtccct

SEQ ID NO: 43242 - DNA, 78 bp, Chlorella protothecoides
cccaggtttggggaggactgcgagaccggcgagcctgtggccttcaagttcttcgccagggtgagggaccgcgagctg

SEQ ID NO: 43243 - DNA, 62 bp, Chlorella protothecoides
ccgctcccttccccgtgcacgtcgaactggccgtggacggctttgccctgcgcttcgcccac

SEQ ID NO: 43244 - DNA, 407 bp, Chlorella protothecoides
  modified_base (113)..(244): a, c, t, g, unknown or other
ggccgcggcggcggaggcggccgaggtgcggaagctgcgccaggcggagaagaaggcgacgcagaaggagcgcgcggcgctgcgccgggtctgggccgcgcagaccgatctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggggttggccctggcgcagctgcgtgacctgaacgcggagctctcccgggtgggcgcggagctggaggagcgcctggcggcgctggacgcgcgcctggcgaccgtgcagacggacgcccagcgcgaggaggcggcgcgcggcgcggcggcgcgcgcggcggcc

SEQ ID NO: 43245 - DNA, 73 bp, Chlorella protothecoides
cccccagaggtggcacggcaggtgcgtgaagggaggaacccagcaagctgcttgagctcctgcgatctgatgc

SEQ ID NO: 43246 - DNA, 61 bp, Chlorella protothecoides
ccgcgctcgggggagaccaggtgcggctgggacccgtccgcctcgcggcagatctcgcgca

SEQ ID NO: 43247 - DNA, 61 bp, Chlorella protothecoides
ggcacggtgacgtgcaaacattggtatcgatgggaaaattggcactacccccgccactgtt

SEQ ID NO: 43248 - DNA, 61 bp, Chlorella protothecoides
ggcgagacacggggcgggggacggcgacggtggcgacggcggcgacggcgggagcgggagc

SEQ ID NO: 43249 - DNA, 1586 bp, Chlorella protothecoides
  modified_base (480)..(489): a, c, t, g, unknown or other
  modified_base (631)..(640): a, c, t, g, unknown or other
  modified_base (938)..(947): a, c, t, g, unknown or other
  modified_base (1015)..(1024): a, c, t, g, unknown or other
  modified_base (1081)..(1090): a, c, t, g, unknown or other
  modified_base (1264)..(1273): a, c, t, g, unknown or other
ggtcagctggctcagcatggacccgcaggccgcctcgaacccgggcaccagctgggtggagaaggcggaggtgaaggcccccgccagggccggtgccagcgaggccgacaccgccgacgcgacctggggcgccagcaaggcggccgaggacgccagcgcctgcacgggtgtggttggcgcgattccgcatgacgtttcctggtggaaaggcttggagcctgcggcagaggctgtggatggcctggcctctctggcccccgaaagacgtcaggctcccgcacactttgatcattggggcccagaagcctgtcggctgcacggagcagatgcacgccaccacatgacctcccccgcacctctgggagggccgtggcaaccgcggcctggacggccagggtcgtggacgcggagacgctgcgcatgtgctcccgaaactcggcctgtgagtgggagtcgtttggggggggggggggggggggnnnnnnnnnncgggcccggcctctctggcccccgaaagacatcaggcccccgcacactttgatcattggggcccactagcctgtcggctgcacagagcagatgcacgccatcacgcgacctccccgcacctctgggagggccgtggcaaccnnnnnnnnnntggggtggtggcctggagaggcgggtggcaagggcatcacagggatgactcatgcaagcgcgctgcgatggccctcgccgtccccagacagtcctctccctgcggcccatgcataccctgctccacaccatgccccctccatctcccaagacccttctccccatctccctccaccctgccagagccgcacctgctgggcccgcaccacctcctgcacgatgcgggagatggaggccagcgccgctgcctcggcctgcgcccggtgctcctccagcgccgccgcccgctccgccgcgannnnnnnnnntctgcggcccaggcatgccctacgttccacaccatggcccctccatctcccaagacccttctccccannnnnnnnnncctggggtggagtgaggggtgggtcgggggctgaacaggctggtgagcaacagcccnnnnnnnnnntctggggtggggtgaggggggggtccggggctgaacaggctggtgagcaacagcccctgcgcttccacgcaagcattcccagcccctcctcacaacatgtgttccctctccggctcccctttcctgcctgagccccccctttcccccctccagcctcgtaccatgtcacgcagnnnnnnnnnnccatgtgttccctctccggcttcccttccctgcctgagccccccattccccctccagcctcgtaccatgtcacgcagctcccgcagggtcaggcgcagcgtggcctggtggtcatcgtgctgcgtggccgcggccgccgccatctcggcgcgcaggctcttgaccagctcgcggaacatgagggtgacgtgccccacaaacttgcggtgcgagccgtccagcgcggaggccacggcggccgccaccgcgccgtccaggctctccgccgccgtggcggaggccggcgcggcgccgggggccgcgccggggtgct

SEQ ID NO: 43250 - DNA, 70 bp, Chlorella protothecoides
catggcccctgagggcatgtgcagggcgcaaagcccgcttggcgcaccttgagggcatccaggtacctta

SEQ ID NO: 43251 - DNA, 118 bp, Chlorella protothecoides
ctggcgggggttcgcgctgcgcctcgggcagcacccactgctgccagttctcccgcgcgcgcagcgacagcaggtcggcgctcacctccaccaccgtggaagactgcaggggcgtgcg

SEQ ID NO: 43252 - DNA, 61 bp, Chlorella protothecoides
tccaggaccagcggctcggcgttggggggggtgaacacgcccatgaactcctccaccgtcc

SEQ ID NO: 43253 - DNA, 2489 bp, Chlorella protothecoides
  modified_base (1082)..(1091): a, c, t, g, unknown or other
  modified_base (1617)..(1626): a, c, t, g, unknown or other
  modified_base (1736)..(1909): a, c, t, g, unknown or other
gggcacgcccagcgcgcgcaccgcgcgcagctcggcctcgctggcgcagtcgaagcgcgcgcccagcgcggccagcgtggccagcaccgcggcgtccggcagggccttgaccgcgtagcagggcgcgacgcgcggcagcgccgcgcgccagtccagcgccagccgcgccagcagccccaggtcgatgacgtagaaggtgtcctccaggccgcgcgaggcgatcagggccgccgcgtgcgcgtccagcgaggcacgcgaaccgtcgggcagcgggtgggcgccgtgcagggccaggacctcgcccagggggcgaggccccacgggccgcgcgtcctccgaggcggtggaggaaggcgtggcgcggccgccgccccactcgcccgcgccctcgcccagcgagtcgaggtcggtgaggacggaggagagggggtcccgagacaccacgccgcgcggcgacccgccgtcggagctgcccgcgccggcgtcgcaggcggccaccgcgtgccctcccagcacgccggccgtggcctccagcgccagctccatggctttggcggcgcagtcggcctgcagctggccggcggcgcccagggcctcgccggcggcgtgcgggaggtcctcggcctggccgtcaaacgcctccccttcctccaggtccaggccgaagaaggcgacgtgcccgcccgcgcgcagctcctggaaggaccccgcgtggcaggcatagccggccggcagcgagcgccgtgcgcgccaggtggcgccgtccacgtcgccgacgcaggcgccagctggggcgtccaccgacagtgccaccgccatgtggcgggggcggaagacggccgccacgcgcgccaccaggtcgggcacgtccatggtggcggggtcgtagccgcaaagctcgaaggaggcgtaggagaagccgtcctcgggcgtgatgtggatggtagagaaggaccccgcctccactgcgttcatggagtagccgcagggctcgaacacatagtcatcgatctctgcgagtggggaggagggcggaagctcaggtgtcaaaaaatgggtgtgaggggggtgtaggacgtggnnnnnnnnnngtcgatctctgcgggtggggaggagggcggaagcttaggtgtcaacaaatgggtgtgaggggggtgtaggacgtggccaggctggcaggcaggcagccgggacagtgtgcccagcgagtggtcatcccttttcaaaggccagccaggcccggccgggcaggcgtgacgaggcaggtttcagtggatccagacataacagagcaatccacacacggcccgcaaaggcatagacctgcaattccacgcacagcacaacctcaagcagcccataccattgtctcaccggccttggggaggaggtcctggatgcccgagtcgcatgtcacgcggcggctgttcacaaatgcctcggtgcggaagaagttggcggccttgcgcgggcacaggccggtcatgcacagctccagggtgtgcagcgggggcggagggggggcctgcgccactgcggccgcgccgcgcgcaacgcccgcggcgaagacgtgccactgcaggcccgccagcgcgtcgcccaggacgtaggcggagnnnnnnnnnncgacgtaacagagcaatccacacacggcccgcgaaggcatagacctgcaattcaatgcacagcacaacctcaagcaccccccataccattgtctcaccggccttggggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgcggccgcgccgcgcgccacgcccgcggcaaagacatgccactgcaggcctgccagcgcgtcgcccaggacgtaggcggaggctaggggcagcgcggcaaaagcggcgcgcaggacggcggtctcggcctcgaagctggcgtgctcctcgggctgggcggcagggaagaggaaactggcgcgggagtacttgaccgcggccggctccaggcccagaccggcagcgaggcggaggagcagggggacgcaggccagcaggcgggtggtgccgcaggtcttgaccacgatgcggtcagggtagacgaagcaggaggactcagacaggacgtaggcgtcgtggctggcgtggtggcgcgccgacacgatgaggcaggcggcgctgtccatcagcgcgtccagctcggcgcgggtcagcgcgcgcaggccggcgccaacggcgcccgcacgggaggagaagctgacgctgatgcgcttctcagacccctcgaaggcggggcagggcagggcggcgacgcacatggctgccagggggggcaaaggtagacggtggggaccgaggaaggggggggtaggggcaggg

SEQ ID NO: 43254 - DNA, 80 bp, Chlorella protothecoides
ctccgttcgtaggcggcctgggtcggcgggtgctgggcggggacgggggcctggtctttgacccacaggtccatcttcag

SEQ ID NO: 43255 - DNA, 61 bp, Chlorella protothecoides
agcccacaacaggcgcccagccctagcccgtaggagtctccctctccgagccctgaggagt

SEQ ID NO: 43256 - DNA, 83 bp, Chlorella protothecoides
gcccctgctcccggcatcatctgttcccccccatcaacatacaaaaccctaatccacccaggcaccgacctggtcatcgtctc

SEQ ID NO: 43257 - DNA, 71 bp, Chlorella protothecoides
gctcgtcaggagtcagagagccggcggtccaacagctgcaagtcggcaccccacgcccgacctgcaggcct

SEQ ID NO: 43258 - DNA, 62 bp, Chlorella protothecoides
ttgtcagaggtatggctggactgggaggtattgctggactgggaggtaggcaggggcgggaa

SEQ ID NO: 43259 - DNA, 61 bp, Chlorella protothecoides
agcgcacctccagggtggcgttggaacccaggcccaggtgccccggctcgcccggcggcgc

SEQ ID NO: 43260 - DNA, 64 bp, Chlorella protothecoides
ggaggtcaggcgtgcgggcaggcgggtgggggggagcacggaccctgtgcagccgggggtgaag

SEQ ID NO: 43261 - DNA, 61 bp, Chlorella protothecoides
ctacctgcagcaggtggcgctggcgcacactgtgcgccagctgtcccacgtctactccgtc

SEQ ID NO: 43262 - DNA, 74 bp, Chlorella protothecoides
ctcctacgccaagcgcgccgcggagacgtttggcgccgtcatcggcctgatcgaggcggagctcatcccgctgc

SEQ ID NO: 43263 - DNA, 61 bp, Chlorella protothecoides
tcatcatggcggccatctcctactggatggggggcttcgaccctgtggcctggaagttctt

SEQ ID NO: 43264 - DNA, 109 bp, Chlorella protothecoides
cctcgctccggcgaggggtcctgggccaggcgcggcgccgagggctgaaaggccggggaatgaccagaggggggcaggagtgccagggggaaactctgcagcggcgggg

SEQ ID NO: 43265 - DNA, 61 bp, Chlorella protothecoides
ggtcgccgagctggggggcgtggacgtggtactcaacagcctcacctcctccggcatggtg

SEQ ID NO: 43266 - DNA, 69 bp, Chlorella protothecoides
ctattgccggccggccactgcctgtcctcgggaccccccccccacaaaaatctcctcatccaagtgccc

SEQ ID NO: 43267 - DNA, 61 bp, Chlorella protothecoides
aggtctgacccgggtttctgccgcagacgggggctggcacggcctggaagccagcatgcgc

SEQ ID NO: 43268 - DNA, 61 bp, Chlorella protothecoides
cgctggccggccccggcggcggcgcgcccctggccggcgcacccctgccggacgccctgcc

SEQ ID NO: 43269 - DNA, 61 bp, Chlorella protothecoides
tggattgggcgggaatagtactgcggtgggggaccacgtgggaagtccccgtgacgaactg

SEQ ID NO: 43270 - DNA, 61 bp, Chlorella protothecoides
caggagcagggggtcgaagcggtcggtgccgccatccgtgaacacgccgctggccccactc

SEQ ID NO: 43271 - DNA, 67 bp, Chlorella protothecoides
ccctccatcttggcatcgcccgccaccctcaacccctccctccatcttggcatcgcccgccaccctc

SEQ ID NO: 43272 - DNA, 135 bp, Chlorella protothecoides
actgggcggcagttcatgtcgtggttttgtcacgtaggagactgcgctcctaccaggcccagcaatcgcggtggtactctttcgtgcaccccatcctagatagggcctccagcttctaaacccacctggtacgcc

SEQ ID NO: 43273 - DNA, 105 bp, Chlorella protothecoides
caagcggtgggtgccgcgggggtggggggggttgtgggaagagcggggcggggaggcagaatggctctggatgcggtgggtctctagggcgcatgaggaagggtg

SEQ ID NO: 43274 - DNA, 61 bp, Chlorella protothecoides
aaggtactggcacccatagcgagaggctggggaaaggtacatgattcactcgtgtgcggct

SEQ ID NO: 43275 - DNA, 77 bp, Chlorella protothecoides
tgcggctgcggtgtggctcatggatgtcacctgatatgcacccggggaccagcggaaccccactggccagcttcagg

SEQ ID NO: 43276 - DNA, 61 bp, Chlorella protothecoides
ggttgctgggggagagttcaggggcggggggccagacactcatggctggaacccccgaccg

SEQ ID NO: 43277 - DNA, 61 bp, Chlorella protothecoides
tgatggcaacagctgccactcggaaccccaacccaccacacccacccaccccctcactcac

SEQ ID NO: 43278 - DNA, 61 bp, Chlorella protothecoides
cccagccccagccccgaggcgtcgcccagcaccagccccgaggcgtcgcccagccccagcc

SEQ ID NO: 43279 - DNA, 112 bp, Chlorella protothecoides
cctggccgacgccatcgtgtccttctccgacgcgccgccgccgccgcgcgccgctgccgccttccgcgcagacctgggcggtctgttcgacgggctggacgccgaggccctg

SEQ ID NO: 43280 - DNA, 61 bp, Chlorella protothecoides
caggtctgcctcaatccttgcaatggcagggggaaacttatgaatgttggatcctgccact

SEQ ID NO: 43281 - DNA, 61 bp, Chlorella protothecoides
tggtgggtctggtggattggtgggggagggggggggtatgtgaatggtgtggagaggggag

SEQ ID NO: 43282 - DNA, 61 bp, Chlorella protothecoides
ggggggggagggggagggggggcgaggagggaagatgcttggtcaattgagtgttttactc

SEQ ID NO: 43283 - DNA, 93 bp, Chlorella protothecoides
ggtggcagcaccctgcggaatgttttggtgtgggaaggggctggaggcagggggacccagtgacaaatgttggggtgaggtgccatgtctgcg

SEQ ID NO: 43284 - DNA, 61 bp, Chlorella protothecoides
gcagcgcttcctggacgcgttccggggggaaggctaccccgaggccttcatgtaccgccag

SEQ ID NO: 43285 - DNA, 78 bp, Chlorella protothecoides
accttcatggtgtgtttgcagggggggggggggggggattgggggggggggggggggggggaattgcgatagcaaggc

SEQ ID NO: 43286 - DNA, 61 bp, Chlorella protothecoides
gggtgtcacagaggtggacagggcggcgggagtcacagaggtggacaagacgaccggcgcc

SEQ ID NO: 43287 - DNA, 61 bp, Chlorella protothecoides
catgatcaccttgacgtccgacagcgcgtcaaagccgtccagctggttcagcagctccagc

SEQ ID NO: 43288 - DNA, 61 bp, Chlorella protothecoides
gagctcggtgagcgttgccaggggtgggggggagcctggtcgggacaccgcgcaaatgttc

SEQ ID NO: 43289 - DNA, 61 bp, Chlorella protothecoides
caatgaactggatgccaatctcacggcaggggcttatgaatccgcatggtgtccccggatc

SEQ ID NO: 43290 - DNA, 113 bp, Chlorella protothecoides
cctggttcaacatcccctacacacctttacacacccctgcaatctgcccattcctccctggggtttaggccccttctcaatttgccccccaacctctcccttatccccctcaa

SEQ ID NO: 43291 - DNA, 147 bp, Chlorella protothecoides
cgccagctccttctcgtcggccagcaggtccgcctccagcgcctcgtcggcctcctgggtggcgccacgcgggcgtgtgcccgccagcgggctggtggccgaggggggggccgtgtacgacgtgagtgggagggagtcctcgatcgt

SEQ ID NO: 43292 - DNA, 68 bp, Chlorella protothecoides
cattgctgcccggcacggaggagtcagcgggagacctcacacgccaaccccataccccaactaacaaa

SEQ ID NO: 43293 - DNA, 61 bp, Chlorella protothecoides
gctgcagtggtggtaccagagctactacgcagcctcggggggagggcggttcatgccgccc

SEQ ID NO: 43294 - DNA, 61 bp, Chlorella protothecoides
ttggcgtggcgcaggcgggcctcggctcgggccctccgctccttggggtcctccatcctcc

SEQ ID NO: 43295 - DNA, 103 bp, Chlorella protothecoides
ctggccctggatccggctggcggagtgcgcgatgagggaggaggtgtctcgccgccccctcctggatgcgctcgctctgccgccgcgccgcccgtgggcatgg

SEQ ID NO: 43296 - DNA, 121 bp, Chlorella protothecoides
cgtgcgcgcagatcgcgcccgggcgcgtcctgggacgacaggctttggccagggaggcagcagtcggtacccgcctcgcgagcatcactccacccgtacccgtcagtgcgttgcccacaaa

SEQ ID NO: 43297 - DNA, 61 bp, Chlorella protothecoides
gaggctccgggagggtcagcatgtcaggggggctgtctgccgtaccagcaccctgtggagt

SEQ ID NO: 43298 - DNA, 73 bp, Chlorella protothecoides
gacatcgtgaaaatggaggcggggtgatccgtctacactgcaccggcatggagggtggccatctagtcaaccc

SEQ ID NO: 43299 - DNA, 61 bp, Chlorella protothecoides
aggccatggcaattggaggggcgcagcttggtagactccggcctttggataagatgtggtc

SEQ ID NO: 43300 - DNA, 98 bp, Chlorella protothecoides
gcgtgagcgcggcgcgtgtggtggggcgtgcgtgtgcatgcgctgttgggaaggaaagtggtggtctggatcgcacgcctgccgcccacagacctgca

SEQ ID NO: 43301 - DNA, 61 bp, Chlorella protothecoides
tcatcaaaggtctctgagttccacggcaggggcatgcacgcctgtatgtaagatccagtgc

SEQ ID NO: 43302 - DNA, 95 bp, Chlorella protothecoides
tccggtttggggccagcagccgcagctaccgtgtggtccggctcccgcatgcgccgtgaggaaggcctgcctgcttcatctggcactgtgtctgt

SEQ ID NO: 43303 - DNA, 27564 bp, Chlorella protothecoides
  modified_base (474)..(483): a, c, t, g, unknown or other
  modified_base (1219)..(1228): a, c, t, g, unknown or other
  modified_base (1370)..(1379): a, c, t, g, unknown or other
  modified_base (2186)..(2195): a, c, t, g, unknown or other
  modified_base (2739)..(2967): a, c, t, g, unknown or other
  modified_base (3091)..(3100): a, c, t, g, unknown or other
  modified_base (3219)..(3228): a, c, t, g, unknown or other
  modified_base (3782)..(3791): a, c, t, g, unknown or other
  modified_base (4229)..(4238): a, c, t, g, unknown or other
  modified_base (4714)..(4723): a, c, t, g, unknown or other
  modified_base (5237)..(5246): a, c, t, g, unknown or other
  modified_base (6198)..(6301): a, c, t, g, unknown or other
  modified_base (6543)..(6552): a, c, t, g, unknown or other
  modified_base (6622)..(6631): a, c, t, g, unknown or other
  modified_base (7175)..(7184): a, c, t, g, unknown or other
  modified_base (8108)..(8117): a, c, t, g, unknown or other
  modified_base (9209)..(9218): a, c, t, g, unknown or other
  modified_base (9775)..(9784): a, c, t, g, unknown or other
  modified_base (11158)..(11167): a, c, t, g, unknown or other
  modified_base (12159)..(12168): a, c, t, g, unknown or other
  modified_base (12706)..(12715): a, c, t, g, unknown or other
  modified_base (13350)..(13359): a, c, t, g, unknown or other
  modified_base (13848)..(13857): a, c, t, g, unknown or other
  modified_base (15238)..(15247): a, c, t, g, unknown or other
  modified_base (16247)..(16256): a, c, t, g, unknown or other
  modified_base (17086)..(17095): a, c, t, g, unknown or other
  modified_base (17799)..(17808): a, c, t, g, unknown or other
  modified_base (18394)..(18403): a, c, t, g, unknown or other
  modified_base (18500)..(18509): a, c, t, g, unknown or other
  modified_base (18736)..(18745): a, c, t, g, unknown or other
  modified_base (19198)..(19207): a, c, t, g, unknown or other
  modified_base (19440)..(19449): a, c, t, g, unknown or other
  modified_base (20699)..(20708): a, c, t, g, unknown or other
  modified_base (20946)..(20955): a, c, t, g, unknown or other
  modified_base (21678)..(21687): a, c, t, g, unknown or other
  modified_base (21995)..(22004): a, c, t, g, unknown or other
  modified_base (22428)..(22658): a, c, t, g, unknown or other
  modified_base (22869)..(22878): a, c, t, g, unknown or other
  modified_base (23635)..(23644): a, c, t, g, unknown or other
  modified_base (23866)..(23875): a, c, t, g, unknown or other
  modified_base (24158)..(24167): a, c, t, g, unknown or other
  modified_base (24964)..(24973): a, c, t, g, unknown or other
  modified_base (25578)..(25601): a, c, t, g, unknown or other
  modified_base (25893)..(25902): a, c, t, g, unknown or other
  modified_base (26334)..(26394): a, c, t, g, unknown or other
  modified_base (26743)..(26752): a, c, t, g, unknown or other
ggcggcgaggacagcgacggcgcctccagctccgtgggcaccgcggaaggctccttctcctcgcgacgcccgctgctgggcgcgcgcgcgctcaacagcggcgaagccggcgccccgcgcgcacgggggagtgggtcgggcgagggcacgctgcgcgcgcgggctcgggccgcggtgcgcaaggcccccgtgcacggcgacgaggtgctggaggccatgcgcaggagcctgcccagcgcggtggtcctgttcctgccccccggccgcgagatggtgcagaccagccatatggtgctgatcgggggcagcctgcaccacgccaagccgcgcggcggcggcgggctgccggactcgggccacgtcgccaccaccgccaccaacaccgggtgggttctgcgggggagggtgatgtgtgggtgggtgcgcaagggggctgagaaatatcatgcaacacgagcttcaaccccaatacgnnnnnnnnnncgcgcaagggggctgagaaatctcatgcaacacgagcttcaaccccaatccgtcggccttcacccacgaccagggagaggtggggcgtggtgatcgcgccgcggcccctgccctggctggccaacccggggctgaggtgcaaccgccacgtgccgcggtacatgctcctgtcccagcgatgggtgggagggaaccagggtgcgctcatcgtcgccggcctgacctcgggaggtgcggcgacgggatttgtacctgggattggagggggaggggaagcgcaaagggggccaagccacggcgcgttctggtgacgggaggagattgtcgctgagccgccaaggtgatcatgcccaccaatccccacactcctttgaccccggcaggcgagcggcccatcgccgcgcagcactttgacatgtacggcgccggggcgggcgcggccgcctcggtctcggcgccctacctcaccaggagcgccacgctcgactggcaggatgccacgccggcgaccgagaacggggcggcgggggccgcagggcccacgcgtcgcgtctcagccactcccaggtgaggcgaggcagggtgggcgtcgggcatggttggctccgaggctgcttgggggctgcaggtgcaggggagcgtgcgtgcgttgcagtgcagcgtcctccagtttaagctgctcccaaccctcttggcagggcccgtccgcctgggctgctgacacggatcaggaggnnnnnnnnnnagaaagactgcaggactttgcagcgggcgctgcccataccctcgtttacagccctggctggccactgctccatactaaaccagcagaaccagcctactttgggccatcagtgccatgccttggtagctctttcttaatcatnnnnnnnnnnacccagtctaagctgctcccaaccctctcggcagggcccgcccgcctgggctgctgacacggatcaggaggatacgcacatcgtctacgaactgaggctggtggtgtgtggcaggcggaacatggcaatcatgtggcctggaaatacaacaggactttgcagttggcgctgcccataccctcgtgtacagccctggccggccactgctccatactaaattagcagaaccagcctactttgggccatcagggccatgccttggtagctctttcttaatcatgaatgtgtcagacgggacaattgatacatgtacagcccggcactggaccgatgcatgcttccaacacaaggtgtataacaattgctggagaactggcagagccaggcaacctggcccaagcttggaacagggttcacagatcctttctcggctcctcgaggatgacctcctcgatgaggactggtgccaccttctcaaccacaagctcctcctgcctgtcctgcacgggctgaagcacacacagaaacaatgtgaatctcaggtgggaattatcaaagcatgcagtcagaggagtcttgtaagcagcacaagtcgtgcgacgccctgcctcacctctgccggcagccggtcctcaagctcaggctcagtgacgttgttcactgtgtcacgcttgtaaggtccacgtgtgctcaagccgtacttctgtgtgccagcgaatgggtggagggagcattacgtgagaagaaagaccccgacttatgacaatcacgattggtcctcaggctcatcgaaccttcagcacaccnnnnnnnnnnatgaggagaaggacccctacttacgacaaccgcgattgttcctcaggctcatcgaaccttcagcaccccctgcctcggcataccccaccagccacccccctcaccgtctgtaggtcggagaggtctcccattacgcgtcccaagcagcgcaggaagaaaaggttgccaagcgaccccagcatcagcaccatgctcaactgggtcttggcctcctggtcactgcagaacagacgatgatattgaagagtcaactcgacagccataataccgactgcagagcagtccacatctcgctgcagcttgatggcatggtaccctctcccgcgctttgcaatgatatttctagttctgtgcagccctcattcccttcggctacacatacctgacttgcacattggtcgcagcagatgcaatctgaggctgagcctctgtggacaagcgatacgcatcccagacggggctgaccagagccaggacaaggatggcggctattgtgtgcaccactgtccttccctgcaatgagaggggaatggagggggttgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcctccaatgcgtcgaggaataattaaatctgtccagagatgcgcatcacagcgtgcatcgattgggaattttgctgtcttgggaaaagttcggcaattgccgagagcatgcagggcaacttnnnnnnnnnncggtgcgtagccgtaacccggttaaaccgagcagccagcaatgacagcctggcgcatgtagcagcagcatcgctgcactctgctcacgtatggggtgtatgtcagacgtgcgagtaggnnnnnnnnnntggtgcgtagccgtaacccagttaacccgaacagccagcgatgacagcctggcgcgtgtagcagcatcatcgctgcaatctgctcacatatggggtgtatgtcagacgtgcgagtaggatgccgggctggttcagagggaatgggagcagaaggttgaagccccagatgaattctgaaccaaggccgatgagcagggggatggtgaaaccttgcaacatgataccgatgcgtcctccaatgcgtcgagaaataattaaatctgtccagagatgcgcttcacagcgtgcatcgattgaggattttgctgtcttgggaaaagtttggcaattgccgagagcatgcagggcaacttctacatccaacagctcctggtattcgacccaggcacactgacaatgacaacaccgactgagttctcgcgctgcgtgcccccgcgaaacggaggaacgaaccccgggcggagatcacctagacgggctcgcaactaattaaatccatcactcaaatccggaaacctcagggatattctaggatgattggggctctgcgtgcnnnnnnnnnnggggcggagatcccctagacgggctcgcaactgattaaattcatcactcaaatccggaaacctcaggaatattctaggatgattggggctctgcgtgccgcgacccgtgtggcccgtgtggccaagcagacccggcagttctcgggcaaggtcaacattgaggaggaaatcaaggtcaggagagaagtttgtatgctggtgtggcctggaggcactcttgaacatgtgcctgcagcctctcagtgccctcggcactcttcacacccaccttcaggaaatgaacaagtggaagatcatcacctatgtcgccatccccgtgtgcatcggtgcgtcctaatttggaattgagactcaaaacgaaactagtgtactcgtgttgccgtcatctccattgcatccccgctcctcctcctcgtcccgtgcagccaagggtgcttnnnnnnnnnncactgcacgtgttgccgtcatcttcattgcatccccgctccccctcctcgtcccgtgcagccaagggtgcttacgacctgtcccaccccgcccaccatgacgctgagaagcccgactacccgttcctccacagtaagtggtagatggggtgggagtgcgtcagaaaatgtgttggcatgtagggattgggcaggcacgacaaccttcttctgcatgcctcaagtgcctccaccctggccatcctgtgcagtccggaacaaggagtttccatggggccctgatggcctgttcgaggtcaagcacgagcattagatggacagcattcccttgtagagtacgccctgggtacagcagcgcagccccgatgtggcgcctgggtatgccagcggcgcgtggcactcaatcatgttcattgccagcacagtgggtcgctcatggcaggcctgttgtgtaaaactgcaccctaggaaattctnnnnnnnnnnctatgccagcggcgcgtggcacccaatcatgttcattgcaagcacagtgggtcgctcatggtaggcccgttgtgtaaaactgcaccctaggaaattctggagcgaacaagtgcacaaagggggggatgagaggtagagagtggcactgatctgttgcagcgagaggttaagcttgcagaggtcaggttgtttcagccagcctatctctctcgcactctgaaaacaagatacgtggccaggcgtattgtcatcgtggattggctggggggttgcacagtgcccatcttgaagaggcagttctccttatttctaaggaattggatcctcgcagttcatctgctggacgattgccctccaaattcagcaccgacagcgacgtggggaggcagcgccattgcaactccgactgatcattcccccatcacgaccttagtcctgcacctcgagatctcacccctgtgttgccctcctcctcttgatcgtcgctccaccagcgtcatcaagatgcgcaggnnnnnnnnnntcgacagcgacgtgggaggcagcgccattgcaactctgaatgatcatttccccatcacgaccttagtcctgcacctcgagattcactcctgtgttgccctcctcgtcttgatcgccgctccaccagcgtcatcaagatgcgcagggtgctcggcctcagcaccggcaccttgctcgcccggatctggatcgcagggcgcccgatgtgaggctacgatacgcatacataatgtcggatatacggtgcacgctagagagtgtgccttcctcgggtgcgcgggtgccgaggtggctgtcgctgcctgttgtgcggggtgcaccagggtgagcagccaggtttcgacctgctcacggacgtgatagcccccatgtatctcacagaggcagaattgcacgctctgggcctacccctggcgctgtgcatcactcccttgggcaccagccggtccctgcccacagcccagccagcgccccggcaggggaatgagggcgacgggcagccccacgcccccggccgctgcggctgctgcggcgcatacgtctgcgccgcggtgggcttccgccccgagggctgggtctgcgccctgtgcggggaggtgaacgacttttcccgtggcgacaactggcggtacatgccgggcccggactccaccagcccagttccgctcccagggctggatgcctccccggccgccatggacctggagcacacgggcgccggcgcggtggaggtcgactgccggcccatgctcctcgcgctggtggacgtgggcggcccggcgccctgcgtcgccgcatcgtgcgcagcgctgctggcggggggggaggccgccccagccggcaccctctttgtgctgatgacctacgcgggggaggagcaggaggcggtgttctgcgctgacaattctgcaggccaggaggcgctcaggccggcgcccctgcgccagctggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggaggagctggagctggcgcactcggcgcctgcctccccaggtgcctgccggggttacctggtgaaccctgctgagagaggacggacaaggggacggggttgcccatgcccgctccgggtcctcgtgggatcagcagcggtgtgacggcccgcacagcacagccgcccggcagaccaaatgctcccccctactcctcatccgcccgcaactccgctgccatcgcgcagggcggcaggaggcnnnnnnnnnnagccggcgtgcccccagcccgctggctcctggatcttgagcaggacaaggagatcgtggtggctaccttnnnnnnnnnnccctggtgaaccctgctgagaggggacggactagtggacggggttgcccatgcccgatcggggtcctcgtgggatcagcagcgctgtgacggcccgcacagcacggccgctcggcagaccaaatactcccccctcctcctcatccgcccgcaaccccgctgccatcgcgcagggcggcaggaggcccctgctcctgctgacgtggcgggcacgctgtccctggtcatgcgcgccctcgaagcccatgcccccaccatcgccgcgctaaggagcacagacccggccgcactgctggacacgcggcctggcgcgctggcctgcagccgcctgctcctcttcgctgcgcgggtgcccacctccggcgccggcgccgtgatcggggtggtccagccgcccttgatgatgcccttggatcgggaggacttggatgacgacacctccaccagggcctccgcaacccctccccccgcccagtcgctgccgggactggacgcggggcaccccgaactcacggcctggggcgacgcaggggacgaggagaccnnnnnnnnnncgacgacacctccaccagggcctctgcacccccaccccccacccagtcgctgccgggtttggacgcggggcaccccgaactcaccgcctggggcgacgcaggggacgaggagaccccgccccccacccccgtggcggtggaccccggcgtgcccctcgcgcccggcctgcgcgaggtctgccccggggtcgcgctggcctacgcccccgcccactccctaccctacgccgggcttggcgctgagctggcagcgctgggcgtcgtgctggacctctttgctctggggccgcacttcctgggcctctacgccctggcgccggcggcggaggtcaccgggggggcggtgtaccgctaccccgacccgctggcctcgcgcctggcgcaggtggaaaaggaggagtggggggggggatgaggaagggagtgcaggaggggcccccccgaagaagctctctcgacctccacatctcatgactttatctggaccgcactgcggggagtcccggaccctgagacacgcccactccaccacctctgccacaggacgtgtgcaagcgtatcgcctcgcgctcggcgtccgactgcctgctgaggctgcgctgctctccggggctgtgcgccgcggcgtccctgaacgcagccctgactcccgtcgataggtgtgcggggctggtcaaagagggggtggtcgggggggtcctcttgcagcgctgaggcgcctggaggcgatgcaaggctcggcctcctgtcctccgatgactctgcgctgatcaggcattgaaggccgtgcatgccgtttgtcaaaccggcatggtccagcaccaccgtgaacctggagaggttggctggtgctggaaacccctacttcttgactgcccccattcccacactcaccagggactcggacgggctgtggcaggcagnnnnnnnnnnagcattgaagcccgtgcatgccgtttgtcaaaccggcaaggtccagcaccaccgtgaatctggagaggttggctggtgctggaaaccctacaccttgactgcccccatcccacgcaccccagggactcggacgggctgtggcaggcagcggccgcccaccccggcaccacctgggcagtggaactggggttccagggcggaaaaatgcgccagcccgcggccttccagacggcgttccagtacctggcgctggtggcgcaggagcctggcgcaggctgcgacggcaggcgagcgggagtttgtgcgtgagcacgacagggcggggatgagctgcatgggttgccatggatacacctgctgggctctttcgttgatgcctgctctcgccccgtctaagcgccctgtttgtcacctgctttcatccccctccttcgccgcaggtggtcgtggcgcctccagcgccggctccgcatctgcacgctggtctgcagcgactcggctggggtgtcacttggcccaggccgcccatccccgcctcacgccctccccgacgtcgaccccgcggccgtcgcggcggtgctgacgcagcaggcagtacgcgcgctgccgggtgttgggcgcgaggcgctggaagcggcgctggcggactggctgagggccctggctgccagcctctggaagcgcggcctggggcccgcctcccacgacggcccgtcctggctccaggccctcctgcagggcctgcacgccctgctgagggccctgcacgggctccagccgcatggcgatgccgacgccgtgcggcgcgcgctctgggcctccctctggcccccccatctcctcgccgcgctctacccccgcctctccagctgggacagccacgaggccgaggcctttgagcggcactccctctctcgggtgagctgggggtgggccgggctttgagagggtggccctgccatctttgtgcaccctccctagctcccagcctccaccgacaaagtcagcccatgcctggagcatcgtagcctctccttcccatcacccccttcctcccttttgaaacaggctgcgctggagctgagcggggcnnnnnnnnnngggtctggagcatcgtagcctctccttcccaccacccccttcctccctttcgaaacaggctgcgctggagctgagcggggccagcctcttcctcatggacgccccgcacgccgtccttatcgtcagcaccgccgccgcgcccgacgccgccacctcgccgccggacgcctggcggccgccgaggggcagcgcgctgcgccgtgccgccgaggcggccgtcgcagcgcggctgccgacgcccgagctggcaatggtttgcggcaccgccgcgctggagcccttcctccaggacgacgaggggctgcgcagcgacgaccccggcgtgcctctggccgctctgtgccacgtgtcgttcctgcgggcgctgcagcgggttgctgcgcatgcctaggagccccgcccccgggatgagtcatcgtgacagtttacctattcccccgacacactgatgttgactgaaagatccgtcgagaagctgctcttacaggacgtgagtgcaccgcacgcggtgtgcaggtcatggccgagcccagtgtggttctgtaatcactgtgagnnnnnnnnnnggtcatcgtgacagtttaccttttcccctgacacactgatgttgattgaaagatccgttgagaagctgctcttacaggacgtgagtgtaccgcacgcggtgtgcaggtcatggccaagcccagtgtggttctgtaatcactgtgagaccaccttcactggcccacctcattgccccgcctcagcggccccgggctgcagcaggtggtgcagcaggatgcccgtggcgacgctgacgttcaggctttccacctgcgccgcccccgccccgccggggatgcgcaccagcgcctcgcaggcccggcgcacgttggtgcgcaggcccgcgccctcgctgcccatgaccaggagggtgggcgcgccgggcgcgaccccggtgcaggcctgcgcctcggccccgccgtcggcgcccagcacgcgccagcccgccccccgcgccgccgccagcgtggccggcaggttgcggcaggagtgcacggggaagagctccatggcgccggcggaggccttgctcacaacgccggagaggggtgaggagttgcgcgcgcaggtcagcacgcctgccgcgcccagaaagaaggcggagcgcagcgccgccccgaagttttgctgcgagggcgggcaggatttggagtggggcgtccgagaagcgagcagtccggcgcgggggggggcacaccgcagagggaatcagcctggctgcgcctcctcgcataccgagggggacatggtgatgcggcacgctcccggggtgctgtgtgcagcactgcgcgggcacgatgtcgacaccgacgagcaacaccaaacctcatctccaggcactcacgggatcggtgacctcgtccagacacagccacacaggtccggcatctacaaaaggggcatgggaggagcagtgtcctcagacagagcagtgaagccatcactgccgcaaccctcctcgtcagatctgcgccacggctgttgggcagtcgacccaggttgcctgcacaagcccgcaaacccaccctgcgctgaggggggcgggggcaagtctgcgatgtcgatgaactccaggggcgagcagtccagtatcaagccctggcgcagggaaacagctgggggaggaggttgaagggggctccctgcagagcatcctcagcaggcaacccattggagggaatctttgccaaacaatgactcatcctggcacctggtgcggcctgttgtctgccagcaggttgagatcgtgcttggaagccaggaagacaggacacccgatggcctgtgctgcttctctggcccgattcagcaccaccgagtcctgtcagattgatgtggcggggtgggtgtagtggaactcactaaagagggtgccgtcggttgccctgtcaatnnnnnnnnnnaattgatgtggcggggtaggtttagtggaactcaccaaagagggtgccgtcggttgccctgtcaatgctaagccacctctccctatcccggccacagccagccacccaatgagcacgctgcccaccttgcgtgccgatccatcaatgtcctgttgtacgtgcagggcatggatctcccgcctgcccgccgtgagcgccgccagcacaggagagacaccatacagcacctcgccttgccaaccctccttgaggagggcgccgctggacggcggcatgccctgtcgagcctcctccttcctctcccgccagtttatccctgctatggggaggaaacctgctttgtgacgaatgcaggtctgtgcaggctcaaaggaagaaattcaccgccctccagatccagctcaccaccgggtgacgattgccgggctcccgagtaaccattggagcgacgggggggccgatccgtgtacctattatcccgactgcctcgtttgtatctggaaggtgggccgtcgttcctctctcctttgtatccttggcccctgtcccggtaggtatcgggtggaccagggcgagagcccctccagtctgagcgctcatcatatggctccactggcgaatcgaaatacgacgaccgtctcctgaagccctcgctatgaggagcagcggtggtcaggtggcgcgaccatggtatgcgttggaaagcaacaacctgcaacactccccggccgagcaacccagaaacggccatggcatggttcattcaaacaggtcaaagtatttgcatatgctcatgggcagtgcgtgtctcaaaatcaaagtggcatgcacgtgcactatcgtgggaggctggcctccggcacgggcacttactctgggcgcaaccttatcaatcatccccaaaggcaagatttcgatgttcccctgatccatggtctttaccctgtcaacagcagcctgtcgccctgagtgtccaccatctgatggtttgnnnnnnnnnnccatccccaacggcaagatttcgatattcccctgatccgtggtctttcccctgtcaacggcagcctgccgccctgagtgtccaccatctgatggtttggggactggcattcgagttacccgccacttggggattgggattgcgaccctgggattgggaaagcggggactcgccccctagccccaacggcatacttgaacccggacaccctgcttcctccccctgaattgtccttagttaagaatcaatcttgcaggtgtttgacactttgttccagcaactcctctgcagtaggccttcgtggcctcctagcgcactgatcacatctttaaatggcttcgacgaagtccgtcccggtgaccatgctgtccggcttcttgggagcaggtaggcgttttagtgtattctttattgattgcatatgtatgtgcatgcatgaagcgtccatgtgacgggaggaaccgatggctgtgaggggtgacggggtcagcatccgcgcggggcaccatggcactcgacaagacgttacattgcgattnnnnnnnnnnagtccatgtgacgggagggaccgatggctgcgaggggtgacagggtcagcacccgcgcagggtaccgtggcactcgacaagacgttacattgcgattgctcacgtcgagaatgcacaacgtagagtatttgagcccttttgacactcccccctccccctccggcaggcaagacctcgctcttgaggtatgtgctgcagagcagcggcctcaaggtggcctgcatcgtcaacgatgtggcagcagtgaacatcgacgccaagctcattcgcggcgatgctacccgcgaccccaacagcaccaccgccgacctcacggacaccatcgagctcgccaacggatgtgcctgtgagtctgggctggtgtccttgacgggtgggatgtgctgtcttgtcaaagttcagtgctcagctgaccattcactcggcactgcacaggctgcagcattgccgatgagctgatggcgagcttcgctaacttgctagagctctcagacaagcgcgggacctcgtatgataggtgtgccgaagcttgatagtgattcagtgcatgggccccaaaaccagggtacacaagtgaaacgttgtagaggaagcatccgtggatgtatgcccctccgtctcaaaagcacagttgnnnnnnnnnnctgattcagtgcatggggccagaaaccagggtgcacaagtggaatgttgtataggaagcatccgtggacgtatgcccctccgtctcaaaagcacagttgatgcatggcttggccaatgactgcttcaactcccctcaaagacccccccctccatacacactctcttggcagaatcatcctagagaacagtggggtcgccgagccccaaaacatccgggaccagttcaatgacgccatcgccgaggggcacccactcatgcagcgctgccatttggacaccctcatcacaggcacggctggtcggagttggtgggtggagaggcagcgcatgcgagcagcgcatgtgtctcagggccctgtgttttgtcgggctggccaaggccatgtgctcttgcttggccccagcagcttccccctgactctcaaccttgaagtctggggcctgactgacccatgcattcccctcctccctccataccagtcgtggannnnnnnnnnactggtcggagttggtgggtgcagaggcagcgcatgcgagcagcgcatgtgcctctgggccctgtgtttcgtcgggctggccaaggccatgtgctcttgcttggccccaggagcttccccctgactcccaaccttgaattctggggcctgactgacccatgcgttcccctcctccctccataccagtcgtggactccggcaccttcatcaatgactactccagtagagccccactcatgtcgcgacccgatctgggggagggcggcggactacgccccgtggtagacctcctggtggagcagatcgagtgcgtagttgttacaattccttcttcatagggggtctgggtgctgaggttgaagaacgaggcaagcagccactgtgctcgggctccatgtgatgtgaagggtcccggctctgcatcctgctacctgctcagcctcgtgcggtccaagtcatacaccttcattctctgcctctccagggtcgccgactacattgttctgaacaagattgacctgctggacactgccaccgtggagtccctgacagccatcatggcgtccctgaatccgctggcccaggcaaggcttgaagaaggggaggaatatggagagtctgacagtattgttatcaggcactgcatccatgcaagtatcaaggcttatgagttgaaaggcatcgtgtggggattgggcccagtcgcttcaaagtgtgaacaagggagggttgtcaacgtcttgagcgcagcagggcaggcaccttcaagtagttcccgcccatgctgccatgcccacgcctcctgcgcttgctcacatcgcccaggtggtctcctgcgagcacggcaagatccctgcagacatgctgtttggaaaggacgcacaggcgcttgtcgcgcacctgaacaccgaaggccagcatcgcggcgcggtggcggcggcccacagcctccgcgctgaggcagcgcaggaggcggaggagggggaggaggaggcaggtcatgcgaacaagcgcgagcaccatgagcatgggcatgagcatgggcatgacggccacgagcacaagcatgaccatgctcatggccatcacgaccatggtgccaagcacgaccatggtgccaagcacgacgagcatgggcatgatcatcacgaccatggtgccaagcacgacgagcatgggcatgatcacgggcacaagcacgggcacaagcacgatcgccagaccaccaccgccgccaagcgctttggcatcacctcctttgtgtacgcgcggcgcctgcccttccacccccagaggcaagcatggcttgggcgggattgctggttgacaggatgcttggacggcgcccagacctgctggagaccccctggacctggcgtcnnnnnnnnnngcaggatgcatggatggcgcccaaacctgctggagaccccctggacctggcgtcaatgtcagcctggcaccttgcatttctgtcgggatctcgtgatgagtttccacgcagagatatcgatcccctaccccatctcacacacacgcatacagaaacccctccccctcacaacacaagcaggctgaaggacctggtgctgaagtggatgccggtgtcccacaacaagacgctggagcagggccaggaacccgagctgggcgactcccccatcaagacggtgctccgctccaagggcttcatgtgggtagccaattcccacaccaccgccttctactggagccacgcggggcagtactttgagatccgggacgagggcgagtggtggtcggcggtggccgacgacatgtggcccgaggcccggccccagcgcgacgtcatcctggccgactttgacgcggagggcgagtggggcgaccgccgccaggagatcgtcttcatcggcgccagcatggacgaggcggccatcaccgcgcagctggacagcgcgctgctcaccgaggaaggtgggtgggcagggtttggtgacgcagaggcctgtattttgtacactggggtcgcctgctgggcatgggatgttgcctgccgcccagtcgggcatcgcttgcgatcgcgggccatgactattcgcatcgcccattgccatacttgagtccattcagccctcggccaccctgtaatcaccctcccgatcacaccccaaccaacccctggtccgcagagatgagcgactaccgcgcaaactttgatgagccagacccagtgcaccccgatgctctcaagctggcggcagtgcccaagaaggccaagcactgagctgggcgctggagggggagagagtgatcaggtgcaggccagcttgcttgtgcgcgcaggaaggtggggcaatgatcccgtgcattcccatcccccagatcctgctgctcagaccttggcagcctgnnnnnnnnnnatgcaggccagcttgcttgtgcttgcaggaaggtggggcaacgatcccgtgcattcctatcccctagatcctgctgctcagaccttggcagcctgggaagcatggcctgtccctgcctcattcgcccctccactgatcaacattgtaataagcacgagcatacagtcctgtacattgggggagtcctggagttacacatggggtgcaagggcttgatacgaacagtgattggccatggaagtgtggtcagccgagtgcacgcagaccgtgcatgcacaagcctgctgagagccgggtggccaagatgatggaattcaagagtggcaacagaaactggatgattggagcagggaggtccatttcaaatgtgcaggtcccccagagtggcaagggggagcaaaaatgcatgatgatgactggcgcagtgccttccaagaacagcttcattcgggacggcacacggtctgggctgggcggaggatgaccgcagggccaccccagggtctacctgaactccaggttccacttctgctgcacggtggtcatgatcaccgggctcacccagtctggcagctgcgccaggaactcctgggttgccggggtcgcgtccaggtgtgccacgtgggtggtgagactcagcacctggcctggagcggcgtcaatccagaacctcagagctttggatccccacgccgttgagaatcgggtcaggtgggcagggaagccctgtgttgattgggtgggtgggaggatgggtgtggggtgatgtacaaggtcgggctgtgggtgcatgggtgatattggtggccaggtcagcttgcagggaaccnnnnnnnnnncgtttgggtgggtgggaggatgggtgtgggggtgatgtacaaggtcaggctgtgggtgcatgggtgacattggtggccaggtcagcttgcagggaacctgttcgagggccacactcgacactcagactctcaccaagcgcgatcacggaacaatcacagcagagagcctctccctctcataatccccatcaccgtcccgtttctctcccccttccctcccggctcaccccctgggtctggaccggcgcaagctcctcgccaaaggaccaggcgctggcggcgccggtgcagttgaccatgcccagccccgcctccaccagccccagctccagctcccagcgcaggagcgaggcgtcggcgggggatgcgccgtaggccaccgtggtgagggttggcagggcggtgtcgttttccaggggcggtgcgggcatgtccagcccctgcatcagccggttcagggggtagactgtctgcagcggtggggggtgggggttgaagggggttgaggggttgagggttgggtgggtggggagtgggtcccatgaagctgtccagtgctttattcaaggcagcaaagtttgagcggtagtagcctgctcagcctccatgcttccccgctctcactagttcaacttccttcccacctaccgctcgatatcctcgcgccacccctccccacccctcacctcccagtacggctccgnnnnnnnnnngtgggtgggggaaaagtgggtcccatgaagctggccagtgctttattcaaggcagcagagattgagcggtggtagcctgctcagcctccatgcttcccccctctcaccagttcaacttccttcccacctaccgctcaatatcctcgcgccacccctcccccacccctcacctcccagtacggctccgtggtgggccgcgcgtgctgcagcaggtgcggcggcagcgtggaagccaccgggaagccgtcaatggccgacacggtccaccgcgcctccagcccctggcccggtgcagacgccggcgcgtggtggtgctgcacgaacaggcgcttgggcgcccatggcgtgtagggtgccgcgccgccggcggcgctggaccagccgccggcggcggccgagagggccagcagaccgagcagggctgggcgccccgccctccccagccgcgcggccaggtgcggggtcagcgtgcccgcgcagaggtagaccgctacgcccgcaagggtgccgatggccacgtcgccgatgactaatcccagcaggcccggggcggcgcccgccagtccaatcttctccgtcacgtacnnnnnnnnnngggaagttgggggccaggagtgggggaaggtatgggggaaagtgggtggaaaggagtgggtggaaggggggaaaaggagcggagggagggcgggcannnnnnnnnngcaaggagtgggggaagttatggggggaagttatgggggaaagtgggtgggaaggagtggatggaagggggaaaaggagcggagggagggcgggcacgaggggtgcaatcgccgggggtccgcatgccaagccaggctgtgttgcgtgtatcaaacagctggaccccccccatccacacacaccatgcccctgcttcccccagccgccgaaacccagctccgcaccnnnnnnnnnnacccccccatccacgcaccccatgcccctgcttcccccagccgccgaaatccagctccgcaccgagcaggggaagagccatgagcgcggcggcgagcaggctggtcacgggccccggcctggcccaaaccaggaccaccgccaggatggtgcccgtcgcccagagggcgttcaggtagccggcgtagatgccgtgggcagccaggatggaggccacggcggcgtggaaggtcgcggagccaagcgactggaccatcgcgtcgggctggaaagagcggcgcgtgcacagcacgtagggcagcaggaggccggccagggcggccgggaagaaggtgcagtacacctgccagtaccggccgtaccaggcgatgggagcgcctgcaggaagggaagtgtgtcagttttgtggggtgggtgggggtagtcgaaaagggtttcaggcacgaaccttggnnnnnnnnnnggtgtgttagttttgtggggtggatggggtttgtcgaaaagggtttcaggcacgaaccttggagcgcatgcctgacatgtgcgggttgcccagtcggcccaatggacagaatcccaggaaagggggaggttcccgacaacccaggcctcgaccagagcgccagcaccacggactctatgccccagaccccacggcaggcatgggtgactctcgcgccatcgcactcccgccannnnnnnnnnttcaggccccgcggcaggcatcggtgactctcgcgccatcgcactcccgccatgccacttcgcctcccaatcccctcgcacccgtgactagggccctggttgcgcccagcagggcaggcaccaccaacgccagcaggacggaaaagaaagcgcggagcgtgccacccgcggcggccttcagcccaaagccgcgcagcgcccgcggctgtggaggcggggacagagtgctggagttgagatggacggtggggaaggcgaagtttgtcgctggcggcagcgtacacgcatggcccagcaacccctcagacggtgaggcgggcgggctgactcatcaattacttacgtttgcagcaggaaggagcaggctgctgaggagcacctggaacaggatcaccagcggcacatggtgcagcctgcttgcaagggcgtaggaatataccacctgcagaatgttggggtgggagtatgaagctggggatacctgcaaatactagcctgaagaaggctgctcacctccagactgtcatcggtgagggtgccgagtcaaaaggagtcgccaccgaggatccccctctcaccccagtctagagctagcctggacccagggcacagcccatccgtaccattttgagccctgcgaggtcaaaggcaacgtagccgtcgccaggtgctgacgccggcgggggctgcccggaccccagcaccctcgcaaactccaacgtcgcggccagcgtgttttcccccatggactgcgtgggtgtggatggagcagcgtggtgtagaaggggaagactgagtgtcctggtttttccgacggccatccagcccccaccccatccggtcacacctcccacaaagcgccccctcccacctcacctggagggtccctgggcgcacacggtcagcgacgtcctggttggtgtggtatgccagtccgtcaaatacctgcgccacgtcgatgcccggcagcgagcctgcccgcctgtaggagaagagccggtagtctgtgtcggcggggatcaggcctgcacacggcaaggggtggaagctgtggtcgggggacggggtgttttgtcgcaaagctggtggggcttgggatgaggaggatgcggatgcggcagtgatcggagggcagggaagggtgtctgccaggctgggctgcatgccgatgaaaatcttcccattggccgagcactgattgtggatcagaagcaagaacaagcctccgagtctcatcaggctggctccannnnnnnnnnacgatgaaaatcttcccataggccaagcactggatgtggatcagaagcaagaataagcctccgagtctcatcaggctggctccatcaccagcatggccacaggcaccatccctccaggtcaggaccatgtgcacaagccgcccagccgtacgggcgcccgcgctccaaccgccaccccatcacccccggacccccgaccaaccccccgcgcgcacccaggtcaaaaaagtcctggaannnnnnnnnnactccaggtcaggaccatgtccacaagctgcccagctgtacgggcgcccgcgctccacccgccaccccatcacccccggacccccaaccaacccccagcgcgcacccaggtcaaaaaagtcctggaacacggtgttccctcgtgggtgaggggccgactgggcgtaggccggcagcgtccagtccaggctggactggaacaggacgtccgggccccaaggccccgtgctctccaggttgacaaaggcgcccaggcccggggcgtgggcgccgtggcgcatgaacccgtgggccgcctgcatcagcgtctcctccccgccgttgagcaggaggaccaggggcgcagccgggctccggccccgattcgccaccaccacgcgcgccacctccagcatcaccccaatgcaggtggccgcgtcggaggcgcccacgctgcccatggcactgtcaaagtggctgttgaccagcacagcgggggcgcgggcgccggggccccgggcgggggcgatgcgcaggaccacgttgctcagacccacgtaggcgttgccaaacgtgtgcccaaaggccttcagggtcatggagtcggtgacctgcggggagggggggtgggggttggttgtgaaagggcggggacgaaggacgcaggacaggcagcgggcgagccaggtgcacggcctgggggggatggcccaaaggagacaggcaccccaccagcaccaccagnnnnnnnnnnggacgcaggacaggcagtgggcgagccagatgcacggcctggagaggatggcccagaggagacaggcaccccaccagcaccaccagcgcgctcctgccaccttttcgatggacgcctccacgaccaggtctggccggctccgagcagcctcctcggcgaggccattgaagacggacagcaggtaccgggcagcctcctccaggccgggagtgctcacctgataggggagcgggttgtaaaggttgcttgtctgatgagcacatgaactttgtctggcaagcttgacagcaactcaactcttcaggagnnnnnnnnnngggggagcgggttgtacaggttgcttgtctgatgagcacatgaactctgtctggaaagcttgacagcaactcaactcttcaggagccccctcattcctgcagttgacgctccttcccattcccacacctgtcgatccccaatgacgtctgccagatggcggacatggagcatcgctcgctcctcagaaaagacattggccggggcggtgctgggcaggggcgccggcacccggcgcatggagtaccagttggcggctgcctgcggggtgtgttggccacctgggttttcagcagggtggcctggagacgaccagctggtgtgtgttggcatcgtgtcgtacaactgacctctgataaacattcgaatctctcgtgatgggttgacctcgtaattcccctctcagctcaccacaagggcaaacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtttgttgggaaggaggcggtaggtcaaagttggcctcgacgagtacatgcgtatcgaagggagctggaggattaccgatgtagacaccatcgatgctgggaagggagcatgagatgcatgagatgctttacgttgaccctcctcaaatggaatcactcggaccccagggtctcatcgatcccactttccaggatcagcccatcggcctcnnnnnnnnnnagcatcgtgtcgtacaactgccctccgatgaaacattcgaacctctcgtgatgggttgacctcataactcccctctcagctcaccacaagggcaaacatggtcgagtacaccccgaacaggtgccgaggagtgtttcgccggtggctcttggcagccgcgtccgatgccatgctgtcccccaaggcggaccagggtatcctttgcccagggatggcaagggagccctatcttgctttgtgcgtttctcagcaagatctgtcctttgtgtccgtcacgccttggggcgcttgggcctgacgaagcccacgtcgtccggcgaggcgatcaacaaaacatttgttgggaaggaggcggtaggtcaaagtcggcctcgacgagtacatgtgtatcgaagggagctggaggatgaccgatctagacatcatcgatgcgcggaagggagcatgaggtgcatgagatgctttacgttgaccatcctcgaatggaatcactcggaccccagggtctcatggaccccactttccaggatcagcccatcggcctccagtctcgccacgatggcttctgctatggcctcaagctgggggtatggatcgccgccgatgtggaggtaccactcggactcggcgtactggagggtggccagctgggtggccaggagcgaggggggcatgaagtgggagccccgttgcgctcgccgcgcaacctgggcctccagcgtcgctgctccagggtccaagagcacgaagaggaggnnnnnnnnnnatgggagccctgttgcgcccgccgcgcaacctgggcctccagcgtcgccgctccagggtccaagagcacgaagaggaggggggcggcggcctcgcccagggctccggcaatgtactgcctgtactctggcgtgagggccgagcaggccaccaccaccctctccccactgccgtgtgcacatgccgcagggtgggggagagggatgctcaagaacgagacggnnnnnnnnnntcactaccgtgggcacatgccgcagggcgggggagagggatgctcaagaacgagacgggcggcacctcacgagcgccgcaggatcaggaaggcatgcatggcgccgggcgccggtcgacaacctggtggcctcggcaagtcacaggccccccgccattccaagtgctccagcatgctccagggaagggaccgggcatcggccgggcacctggctccagaattgtcgcacagggccccaaatcaaccacttcctcggatggaatcgcacctgctgaggtggcgnnnnnnnnnngtgcatggcgccgggcgtcggtcgacaacctggtggcctcggcgagtcacaggccccctgccatatccaagtgctccagcatgctccaggggaggcaccgggcatcggccggccacctggctccagaatcgccgcacagcgccccaaatcaaccactttttcggatggaatcgcacctgctgaggtggcgccgagcgcagctggccaggctctcgagccacggccaccggtcctcgtcggtcaagggcaccccggccgacatcgtggctgcatgagggggtggaggtctcgtcgtggcagggtgataatcgggtcgacggactctgccccggcgctcgacagctccagagtgacacgtcgggcttgggcattgaaaagcgcgtcatcccatcgcctggctcaccaatgttggctggggggtgaaagtcgtccccctccaggaaggtacagcacagccgctcggacagcatgcttcccaaggtactgcgaagggtgcaaagggtgtaggggcattgtttggggctatgtttggggcattgtatagggcattgtttggggcattgtttggggcattgtttgggggcattgtttggggcattgtttggggcattgttgggggcaatgtttggggcaatgtttggggcattgtttggggcaatgtttggggcattgttgtttggggcattgtttggggcattgttggggcatgcaagagcatcgctcatctcgcttaggggtgcattccacacacaagccttcctctttcaggtgtgcaggcaacgcaatgtgcagctggnnnnnnnnnngcaagagcatggctgatctcgcttaggggtgcattccacaaagaagccttcctcttttaggtgtgcaggcaacgcaatgtgcagctggcagctgcaaaggcctgaacaagtgatgccgagtccacaccatgtacatgccaacactcccaggcacggtttcaggttcaccttttgccgcagcctgacacgccgcagagaacgagcgcgggtttgatcagctcctgtctgacatggaatggggtggagcccgagggctcgccagctctcatgctggggcgacgagcggttgcccttcttgccggtggtgcgggtcggacagatgctgtgaaacccattcagggtgtcgaggctcgcggggttagggttcggccatcgcaggggattgggcaccgtcgtcggtcacgagctggccctttggggccacataatagcgtcgccgatcgggcgcgagagaggtagcgatttctttgtgccgtggcaaggcagcgcatcccagggcacaaggttgtaggggacgagggagcggtgcataccatgactacatgtcaaaggaagagcggaccgaccggggtgttgcaacgggagctcgcccgtcatgcacagcnnnnnnnnnnnnnnnnnnnnnnnncttcctggagaggtggtcgggaggcttgtgatgttgcggggtactactgtcactgcctgttccctcttactcctcctcacgtctccgtacctggtcaatcccgaggcacctcaacctaaaccacccgtctcccagggagatcggagacagttgtaggaactctatttcagtaagtacgacaactgctcccgttgcggaggcatataggctgccccgcaacatgtttcctgggcggggggggcgggcaaatgctccaccacttgtggcgagttctcccccggcatctcggtgnnnnnnnnnnttgcgttgtaatggccttattctcgacagtctgtaggttgcgttgcacattgacagagtaaggtcattaaggaccattgagaccggagactgagtgccctaaaaacgttacctctcccggcccctctgggcgacctcgtagcaggtgttgacgagcgaggtccaggtacaccaattgtggccgtccacagaccccaacctcaactaaaactgattctctgcaatacgatgactgtggacacctgggggagttgtttggcagtccccctttacattacaccctgttctcagctcaagcctggtgtcgagttgaacaactgttgtgtgggcgggctagcccccacaacggtggaccgctgtagagacctacacaagttggcatggtacagacgagaccccgagtgcagtgtgatggtcgggtttcataggcgtnnnnnnnnnnnnnnnnnnnnnnnnnnnnnnnnnnnnnnnnnnnnnnnnnnnnnnnnnnnnncgtgcgcaggtggaaagggtgtagggcgccggagagggtgggcccacaacagagcggcatgggaggatgctcaccatgcacagcatcccgcggttggtccaccgcgccggattgggcaggcgattgttcagtcagctggggcctttctgagaagatgggctgcactcctgcgccaagcacctatgacacaagtaggacgggtttctgttgcatgcagcccacgagggtgcgggcatgctcggcacgggatgagtgtgggatcggttcggacgaggctggcttgtctcggtgggcaaagcggaacgggaggatgcgcagcatgcacagcaccccgcggttggcccagatnnnnnnnnnntgtgcgcaggtggaaggggcgtagggtgccggagagggtgggcccacaacagagcggcatgggaggatgctcaccatgcacagcaccccgcggttggcccagatcggtcaggcgattgtcctgccagccgggggttggacatggtattgtggtaggctgtcttctggacagtctgtgactgttgacgggccaaggggccggccatggaggcgcaacgggagcagatgagcgcctgacaggctgtgaataatcaccatgtcagcaccaaatctcggagttgagaattcgagaatgtgaattccccgagtaattcgcgccggcttcctcggaatacgcagtttcggcaacccactattggagggcggactgtggtgaaggggtggactgcgggggcacgccgcgcatcgtttgcgagggattcgatgctggaggtgtggggaaagatgcagtctatttcgtttttgggggtgtgtgtgtgggaagacctgcaatctgtcccaaggtcgcatcgaatggatagcgcgcgcgcgcgacgcctggaagtgcaccccccggcataggggggcgatgcgcagcatgcacagcatcccgtggtgggtcgagatcggtcgagaactcccgctgttagccggggattggacattttttatggcaagctttttcctcgttggtctgtgagttttgtgttgcacctcggcggggcaagggcccggccaaggaggcgcagcgggagcagatgggggcctgacaagctctgcatacttaccatgtcagcgtgaaatttcggagtcgaaagtcgaaaatgtgagttc

SEQ ID NO: 43304 - DNA, 99 bp, Chlorella protothecoides
aaggtagccaccacgatctccttgtcctgcccaagatccaggagccagcgggccgggggcgcgccggccgccagctggcgcaggggcgccggcctgagc

SEQ ID NO: 43305 - DNA, 114 bp, Chlorella protothecoides
tggtggcgacagcaactggccatccctctgccaaagccagacacgggcacctcaaccacccctgggcacagatccaccccacgccaagcacttcaaccagtcatttgcctgctt

SEQ ID NO: 43306 - DNA, 61 bp, Chlorella protothecoides
ctctgtgagctcggttgggggagtggaggggcctccacactctcaatgtgtcggtagagtc

SEQ ID NO: 43307 - DNA, 61 bp, Chlorella protothecoides
aagcatgtgccgctggtccatgcaggagagcggcattcctgtgccgcggcacatcatcgtg

SEQ ID NO: 43308 - DNA, 132 bp, Chlorella protothecoides
tgtcagccaagtgccgcgcgtctcctcaatccgagcacagcaaagctgcttaacagcactggcacatcgcagccgctctccctccaccgcgtcgctcacagtccccttgccgcccagagctccaggactgcc

SEQ ID NO: 43309 - DNA, 67 bp, Chlorella protothecoides
cgccgccagcttgtcgccctggatgcccgcgtggtgtgcggccgcggccggggactcgagttcgcgg

SEQ ID NO: 43310 - DNA, 8406 bp, Chlorella protothecoides
  modified_base (875)..(884): a, c, t, g, unknown or other
  modified_base (1046)..(1055): a, c, t, g, unknown or other
  modified_base (1681)..(1690): a, c, t, g, unknown or other
  modified_base (2057)..(2066): a, c, t, g, unknown or other
  modified_base (2887)..(2896): a, c, t, g, unknown or other
  modified_base (3303)..(3312): a, c, t, g, unknown or other
  modified_base (3926)..(3935): a, c, t, g, unknown or other
  modified_base (4502)..(4511): a, c, t, g, unknown or other
  modified_base (4859)..(4868): a, c, t, g, unknown or other
  modified_base (5192)..(5201): a, c, t, g, unknown or other
  modified_base (5607)..(5616): a, c, t, g, unknown or other
  modified_base (6259)..(6268): a, c, t, g, unknown or other
  modified_base (6811)..(6820): a, c, t, g, unknown or other
  modified_base (7530)..(7539): a, c, t, g, unknown or other
  modified_base (8281)..(8290): a, c, t, g, unknown or other
aggaacgaggccgcggagggggcgggcccgggcacggggtgcggcgcgcccgggcccaggccaggggccgggccgtcggcgctggcgcgctgcagggcgtgcgctgcggagttcggtccggagccgcccctgaagcccgctgcagcacactgcagcgtggcacggggccccgacccttcccccggcgtgtgggtgggctggcgcaggtcgcgcacggcgtgggcgaagaagcagacggggcggcggcaggcagggccctccttgcacagctgggtgcggtacttggcggggtgcagccagcactcatacacgccgtgggagtaggggcaggcgtctccgcgcaggcagatgccgcgcttgtagtcggggcaggggacgggcaggtactccaccaggcgagggtcgcgccgccgcgcgttctcggtggggtgggcgaaggggcagcagcgccagtcgtgcacgcaccgctttccacaccgctccacctgtcgtgtggcagggggggggaggaggaggacagtggggcacagatgtcagggtgatatggcagcgggcctgagattgtgcatgggccattgctccttggccacccggcatggccaaaggtacaaaacaagcatgctcaacagcagccctcaccttgaactgaaacattcgaaactcgtctgtggagtactctggggcattgagctcgtcgctcacgctctcctcgccctcggtggggagggctgccgcaaggatctgctggccgaaggggtcctgtcgagggagggaggtggggtggggatcacaggacggaaacacaccggtggggcccggtgggtacctgggcgacaaagagattaaaacgagaggaaacatcgggagcatcaatnnnnnnnnnnagaaacacaccgatggggcccggtgggtacctggtcgacaaaaagataaaaacgagaggaaacatcgggagcatcaatacaaagccatgtcggacagccaggagcagtggggtctaccgcgggtggtgaggcttggttcaagaccatctcgcgcgggagtgnnnnnnnnnntagtggggtccaccgcgggtggtgaaccttggttcaagaccatctcgcgcgggagtggctaggatgccatgaggggtccctagccctcgctgctgcacccccacaccacagcacacatccaggatgccaacctggtcgaagcatgacgtgaggttgtggtacatgaggctcgtcatgatgtcgagcggctcacgcgcgggctacaagggaagagcaggcgcgagaggcccgcttagcgtagaacagcaggattctaggagaaatctcagagtgaaagttgcatggtgacgcttggagcagccgctcgcaataccagggcctgccaccgcttctggggacgccaaactcgggagagcagaacgtgtgactccatagggccgtatattttgcccaggccagtccggcgctggacaagggacgcgcatcagggtttaaaaaccctgattccgtatcacgtgggagggggttacgctccagaagtcccagatcgcgcgggatctaaatttgtaaaaatcccacgacagatcgccgacccccaacccagactgtttattcgcatcttaaaatctcaaatcggttgcaaacaatgcgcggtgtgccccagctcttcgaaccctcggagcgcnnnnnnnnnnaataagatataaaaatgcaaataattgcttgatggggatccgagagggcccccgtccggcggggcccattttcgccccttcgggagaccccgtggtggccagtagggctgcgaacgcatcgcaagaggcactttttaatttgttaatatcatatgaacgcaagagtatcgagtacagcgcgatagaacgccgtcacccacacatcggtcgtgcccgatgggcccctggtggcctaggggcctcgctcctccttagcccttagaggggccagataccccccttctcatgcactgcccttctggatgctggtccactcgtttacaaaaatgggatccccaccaggtgcaaagtcatcttggccctcatnnnnnnnnnnccccagccctcctcaagagaccttccccagaggtgccccacctgtaagacagcgagcacagaggtgctcctgtcgcgggtcgcgtgaatcgtccccaccttgcgacgcggcctggcctggcacatgcacgagaagccgttccggaagctgcgccatcaggcatacgtcggcaggcagcgggcaatcaaccggctggcggagcagttccgcgcgccccccttgcatgaccacaattgtcggcgttggcaactggtcggcccaggaccggggggacatcatacagggggccccggcggggccctgggtatgcttcttgcggcgcctgcggcgagtgtgcaggatggtggtggttgacgagcacaggtcatcaaagctgtgttgcgcctggcacgccaccctgcatgcccaccagtatgagcgggtgcgcagcggtgaggagaagctgttggacgtgtgggacaccaagcggtgcgtcaacagaggctgcagagttcacgtcgtcaaccgcgacgtcaatggggctgccaacatgctcatgctgaccaagtgtttttttgcgaatgcacttcgtcccacagcatttggtggcacccctgcttccccttcctttcctcccaccccccaccccccggttcgccattagaggcaaccaactgcgccagcgatatcccgttgcgggaagaagctgctagcaaccggcgcaagcccggtagggggggtaatggtattccgtgctttcccgggtgccactcctcgatgctctaaccccattggctggggtggatgggggccatcggcagggcgccaactcagcaagcctnnnnnnnnnnacacctcgatgctctaaccccattggctggggtagatggggcccatcggcagggcgccaactcagcaagcctgtgtcctgacgctggggtcccacccaaaaccgcccgattctccatccagcccggtatacctacagagcgctgttcaccgcctaggctcgactagaagcattacccgagatttgttccgatggcgagaggcaggggcagaggcagaggcgggcgatcccggcagcccggccgggaggacgagcaggatgtcttcgactaccagcctgagagtgcgtgtgatgggttgctaccctggatgggaaccgagcatcgtctccggaatccctgcgtggcctgccgtaaccttgcggtgtcttccatattgtctccatggttctgtgtctgcactgctcctnnnnnnnnnncaaccttgcgctgtcttccatataatctccatggttctgtgtctgcactgctcctcccaatgctccgcgcaggaggccagtcgtccaacgtcggcctcttgccaccgagtgacagcgatgacagcgacagcgaggacgagaagcccaagctgaagcaggtggggggagctgggatctgctgaatgatgggtggacaatatccacaacttcacgccgcctgtggagccttcgcccaactctcacactttccttccaacagaacgctcgcgtcggggagctgccctccagctctagcgacgaggacgacagcagcagcagcagcggtgtgtgatttgtcgcagtcctgagtgccccttgaccaggatcgtgggaggaacggcggcatgccttgcagctggtgtgggcactgtgtacttggcgggacggtaaagctcatgtccccaattccctcacgtgctcatttcctcatccatcacagagagcgagccggaggtggaggccccgcgccagccacgcaagcggtgagcagcagcagcgattgtgcaaggaatttcctttgttcagatgactggtctcatttgccccctctcatcgtcaatatgcaagctcgacgnnnnnnnnnnggcggcggcagggagtgtgcaaggaacttcgtatctttagaagactggtctcatttgcaccctctcatcgtcaatatgcaagctcgacgccccttcccccccacaccctcccttctcccagtcccgaggacgaggtggatccggcccagatcgaggcagacatggcccggttgaggctcatcaaggagaagcgggaggccgaccggctgaagcgcattgccgaggagggcttcgaccgctatgcgccccccggctctgacaaggccaagtgagtggggttgcgggggtgggagggagaggtgggggatctgtctgcggcctcgcctggctaggagcacctgcatccctgatctaccctctgcatgcatgtgtcctcaggcaacctcattcacgccacccgaccctccttgcctcctgcaggcccgaaactgtgctgcccaaggaccacccttcactgaggaaagcgtgaaaccggtggtgtgccaggatccgaggagagattgcccgcccaacacgctgcccagacctgcctcgttcgccgagctcccgtttcgctgaccccagtgnnnnnnnnnngtctaccctctgcatgcatgcgtcctcaggcaacctcattcacgccacccaaccctccttgcctcctgcaggcccgaagctgtgctgcccaaggaccacccttctctgaggaaagcgtgaaaccggtggtgtgccaggatccgtggagagatcgcccgcccaacacgctgcccagacctgccacgtgcgccgagctcccgtttcgctgaccccagtgctcgccgtgtggcatgcggcggcctgttcgatgcagcaataaagcgcagcacagatgtcaggggtgtgatggggtgcaggcccgggaggtcttgaggcgttttgcagcgccaccctgcccctcaaatgtannnnnnnnnnttatgcagcaagaaagcgcagcacagatgtcaggggtgtgacggggtgcaggccagggaggtattggggcggtttgcagcgccaccctgcccctcaaatgtatgcatggtggggaagcacggggaggcatgggcccagaccaaggacatgtgcacccccggcaggcgcgcactgcagcatccccccgctgtggcccctgtctgtgtcgccctagctcgcagagctcaggagtcatgcatgccacgcccggcaccgctcgcggcccgatgtgcggcccatccctctcctgtaatgctcatcgctacgacgccagccgggcccctnnnnnnnnnngggggaggcatgggcccagaccaagggcatgtgcacccctggcaggcgtgcactgcagcatccccccgctgtggcccctgtctgtgtcgccctagctcgcagagctcgggagtcatgcatgccttgcccggcaccgctcgcggcccgatgcgcggcccgtccctctcctgtaatgctcatgggtgcgacgccagacgggcccctccagccacttctctgccgctcatcgctacgacgccagccgggcccctccagcctcttctctgccactcatcgctacgatgccagccgggcccctccagcctcttctctgccactcatcgctacgacgccagccgggccccaccagcctctcatccgccgcccgccgccgcaacgctgggcagacccatgggcaggatttccnnnnnnnnnncatccgccacccgccgccgcgacgctgggcagacccatgggcaggatttccgcagcccatgcgcacgctcaccggcagctgcgccggccggccatgtagggccagagcgccgcaaagtactgggccagggaccagagggtgaggaacgctgcaagcgccagcagcgccgcacccgcgtcggccagggtggcgggcgcggcgcgcgtccgcgccgcgcacagcgcgaccagcgctgcgagctgcacgctggtcttcagcttcccggcggtgctgacgaccacggcgccacgcgccgcgggccccgcgcccgccgcccactcccgcagcgctgacatggcgatttcgcgccccacgatggcggcggcggccagcgggcacagcagcgcgtcgccggccaggcgcccggcgacaatgggcgcggtgctgagcaggaccagggccgtggagaccatgagcttgtccgccacgggatccaggaaggccccgaactcggaggccacgttctgtttgtgtgttttggggggaagagtggagggttggcggtttgggaggagtgtcaccttgccatgcagctggtgccattcccacagcaggcgccggcgtgtgcagctgcccgatgccggcgcccaagcagccacgcacnnnnnnnnnnattttggggggaagggtggagggttggcggtcggggaggagtgtcaccttgccatgcagccggtgccgtccccgcagcaggcgccggcgtgtgcagctacccgatgccggcgcccaagcagccacgcacaggcacgcccggccaactccaacccctgctcctcgcaccaacttgcgggccaggtagccatccaggaagtcggtgacggaggcggccagcaggagccaggtggcggccgccggtgcccagggcgcgggagagtaccacagggcaacgaaggcggggatggccgccacgcgggccagcgtcagggcggtaggcagggtccagatgcgctcctgcgttgttgggtgcgaggggtccgggttgtctatgttggaagggtgcatcaaagagcacagggcgggccctgaggccagagaatcctgggcatccagcctgcgtgacttcatgcttgtatccatctgctggctcaggggagacaccgtgccattcaactgattaaagcaacaggtatggcccccgccagagaatggcgctccnnnnnnnnnnagcttgcgtccatctgccggctcaggggagacaccgtcccatgcaactgatttaagcaacgggtatggcccccgccagagaatggcgctcctgcatcgctcataccacaccttccgctccagctgcgggtcatcctccataggagcggcatgcggtgtgagcaccgaggaacgtcgacgccatccccaggcccctcttgacccatgcgctgcatgcatgaaatttacatcacggtgtaatctccccggctcccagcggctctgtgtccgggtgagatgggggagtactgcctggccggggtgggagtcgagccgggttcccaccggtgggaggagcaaccgcagcgacatgagtgatcatgatctcatctttacagaaccaggaataccgaatctaaagccgggagcgggagcagagtgtcaattcatgcaccagaggcgccgttgcgcgccaagcatggttcactctgtacatggccgacatctgtctttttaccaaaaagaacaagcttcagggaggggcaggagatggtgtaggaaaagccatgtagcagtatttcaggacatagagccaggggggagagtaataagtataggggcagggcaaagggcaggactgcgtgagaagagtagcatggtttagggtgaggacctgagaaagtacctgggatgctgttcaaagtggcaacaacgtgcatctgtatggggaannnnnnnnnnagaaagctatgtagcaatatttcaggacacagagccaggggggagagtgataagtataggggcagggcaaagggcatgactgagtgagaagagtagcatggtttagggtgagaccctgaaaaacatacctgggatgctgttcacagtggcaacaacgtgcatctgtatggggaagggtatgcaagggaagtacttgtgctgcgttactggcatgaaacggaggggctgctgatacgtgaaacgggcgcagggtctctctttgccttccgccggcgggcggatgaggacaccccaggttgccgctgctggcgtgggagcgaggggtgttggtgggcatgatccgggcaccccaccacggcgctgatgccctgcctggggagcatcaccagtgcaactggacggccggctgctgcagcaggacggcgttccacctttgacccagggaggagaaggggttgcggggcagggcggccagggccatgcatgcgagccaggccaggccgagcagggcggggaggaggagcatgttgcggtccagggagtgggacaggccggactgcgcggtctgcagccccctgcgggctaggaagctggaccgctgccgcgtctctgccggggtggttgtgggtggagggttggatagatggaggacgggccaaaggtgtgtgtgtggggagtacaatacggccatgtaatgcaggtctttcgagagccaggcgcccgccacccccacccccctaannnnnnnnnntgtggagggttggatggatgtaggacgggccaaaggtgtgtgtggggggggtaacagtacgaccatgtaatgcaggtctttcaagtgccaggcgcccgccacccccacccccctaa

SEQ ID NO: 43311 - DNA, 135 bp, Chlorella protothecoides
ccccccacccccccccttcccccagtcggagtgccccagccctccctccagccctgtgggcggccaggccgtccaggttccagtccccatcctgttgcccgccggcgcggacgccaccgcctcgttcgcagatgc

SEQ ID NO: 43312 - DNA, 61 bp, Chlorella protothecoides
attggtgcttgagcgcgtatgataggcggggggtaaggggtacgtcccgctccacgccggg

SEQ ID NO: 43313 - DNA, 70 bp, Chlorella protothecoides
caggcccagggggtcggacagcgaggcgatttgggcacgggcggggcctgtgattggtgggcagggacgg

SEQ ID NO: 43314 - DNA, 61 bp, Chlorella protothecoides
gggctccaggcgcaggatctgggagccggcgtggggcgccacctccagccgcgccaccacc

SEQ ID NO: 43315 - DNA, 61 bp, Chlorella protothecoides
caggaccaggtcgacggccctggcgggggggggcggaaggaggtgggatgcaggatggggc

SEQ ID NO: 43316 - DNA, 61 bp, Chlorella protothecoides
aggtcattgtattggcaggggctttatgaggttcccaaccacaaccccttctacacccctc

SEQ ID NO: 43317 - DNA, 84 bp, Chlorella protothecoides
ctgcaggtcacaggagaccgtcagcgaggcacaggcaaacccctcctcagtcctcccacaccgcgacccaccgctcgccgaagc

SEQ ID NO: 43318 - DNA, 63 bp, Chlorella protothecoides
gcctgagggagagggagctggactgggtggggttgtgcttgagggggagggagtgagactggg

SEQ ID NO: 43319 - DNA, 61 bp, Chlorella protothecoides
tttttattagttttgggtgaggggggggggggggggcagttgttctggaatggagtcgacg

SEQ ID NO: 43320 - DNA, 2467 bp, Chlorella protothecoides
  modified_base (103)..(112): a, c, t, g, unknown or other
  modified_base (1098)..(1107): a, c, t, g, unknown or other
cacgacgtgccccggaaggtcgccggccaggaggggggcggcacccaggccgcgcggcagcgaggcccacacgcccacgcccagcccggcgcgcaggcccgcnnnnnnnnnncagtggggcggcgcccaggccgcgcggcagcgaagcccacatgcccacgcccagcccggcgcgcaggcccgccaccagcccagctagcgaggcccaggcgccgcgcgcgcagtcctcgcccatggaccccagcgcggccagcatgctgctgacctggcgggtgagagtcaccagctcgctggccgcagccatgcagacccgggtcaggaggggggcggggtaggcggagggggcaggctcgacagaggggatgggctggacaggctggatctcggggtcagccccggcctcactggcggccggggaggcgccctgggagagcatgggggtgacggggctctcctccggctcccccgccgcgatcagctcgttggtgaagtgggaatccgagtcggaggcctgctcggaggcggcgccgtcctgtgggatcagggtggaggcagctcagcgtgggacaggcgggagggacttgagagggagcgggcgggacgagggcgggaggaattgtacagtcagcacgagcagcagcgcacagtagcacgcccgccccacccctcaacagcagggcctgcacaggccgcccaccgccacccttgatgaggtccagcaccgcacggcggtatgattaccacattgacccaccgttgccaggctgctaatgcatggggagacctctaccatggagcgcccgctctcgccgtcttcaggctccgctgcgatgaggctgtccatgctgggagtggaggcgtggtcctcggggttcacaggcacgacggtgtccgacccctcgccgtccacagagcctgccagcacgacagaggtgctcagtggcagctcacgcgccgcctcaccctcctggaagtcgtcctcgcgcaggaactcccaagaatttgtggagtgggcggggctggatgggtgctcgggctcgggggaggcctgccgggggctcacgaaggcccggtcctcgttgccctgcaggggtcagnnnnnnnnnnaaactcccaagaattcgtggagtgagcggggctggatgggtgctcgggctcggaggaggcctgccgggggctcatgaaagcccggtcctcgttgccctgcaggggtcagcaaaggccgggaccgcgtcggtcacggagagcggggcggtggggctctcacacacgcatgagccagcattacgtatatcagcagggagcgcaccgtcatgagggccggggaggtggcatgcgcctcgtgcacgggctccatggtgttcaaatcctcggcacccgacatggatccagaatgacctgtcggtaactcctgtgcgggggccggaaggggttgcagggtagtaaaactcagctgccgagatacatgttgcgagcccgcgtgggccagcgatggccagactgcgaacttgagccgggtctacgcgtccggcttgagaccatgaacaaccctccgacagtcgggatcgcagcctgatccgttccgatgcagtccttgggctacaaaacataatctgagcagctctccagtggctgactcgcgcaaggggcagctcctgcccacacctggcactagggatgtcggtcgcggtgtttccctgccccgggccagcgctctcgacactccccttttccactgaacgcacagtcaccaccgtctggtggaatgaggagggacggatctgcttgtacatggcgcagatgaggggagtgcgctttgcttcatcttagcgctagcgcgagcagctgtcggaattgacccgggggtatagcaaaacagggagaacctggatccttgagcgtgggagggatgcacatgtcggttgtaggggcgaagaggccacctttcaaggcagagaggcccacctggagagtctatatcttgatcccatgggcctgtatcacatacttgattcttgatggggtctgaggggtacgtcagtgggaatggggctccttgccctgcgccatacccaaagtctgaacgacatccggctcgctcggagcatgctcatggtcaacctcggtgctctccagcagcgccacaccatgcccgcgtcaggcgcggcccacgggcgggcgctcctctcccatccctgctgccggcgcgctttccagctgctgcagcaccgcctccagcgtctcggtgcgcagcgccacctgcttcccgcgcatgacgtccaccaggtcgcccagctcccgcgccggtgtggcgcccaggagcagcgccactccgtccagccacagcgccttggaccaggggcaagccgcgacggcacggaggaaagcgcggcgcacggcctccggccccgccccggcccgcgcctcgccgcggaccagcgcgcgccaggcgcccggcgccagcgcc

SEQ ID NO: 43321 - DNA, 62 bp, Chlorella protothecoides
gggcggcaggggttggggcgggtggggttgtgagcaggaggggagacgtcgaggtgattacg

SEQ ID NO: 43322 - DNA, 61 bp, Chlorella protothecoides
gcttcttcccctcccatccctaccccccccaccccccttcctccacttccccttccctccc

SEQ ID NO: 43323 - DNA, 150 bp, Chlorella protothecoides
tccaggcgcagccggcgcctctgccccgtctctgttggccaccggcccactctcctcgtctgcggccagggcctcctccgcgcccacccctccatcctgtcctgccgccgcagcgcccggcctgtcttcgctgtgcatgctgccatcgcc

SEQ ID NO: 43324 - DNA, 61 bp, Chlorella protothecoides
gcgggcgtgagggattgatcgacacggcggggaagaccgccagcacgggttacatccagcg

SEQ ID NO: 43325 - DNA, 61 bp, Chlorella protothecoides
ggatcgctggcctcgctgggcgagaccctggcctgcctggagatgctgctgggcagggtgg

SEQ ID NO: 43326 - DNA, 88 bp, Chlorella protothecoides
cccccccccccccccccccccccaaaccaatacgttaaaggccacggagaacagcgcactgtcgctggaggccggcgcgcatctgcac

SEQ ID NO: 43327 - DNA, 148 bp, Chlorella protothecoides
cagcttggtgacgtagacggccagaggcccacgcggattgcaggcgcgcatgtggcccgcggcctccgagtcctggggccccgtgtaccagcgcgcgaccttggcggccgtgccggcacgtgcggagggcaggctgcgcaccagcact

SEQ ID NO: 43328 - DNA, 17670 bp, Chlorella protothecoides
  modified_base (1322)..(1331): a, c, t, g, unknown or other
  modified_base (1704)..(1713): a, c, t, g, unknown or other
  modified_base (3293)..(3371): a, c, t, g, unknown or other
  modified_base (3628)..(3637): a, c, t, g, unknown or other
  modified_base (3819)..(3828): a, c, t, g, unknown or other
  modified_base (4599)..(4608): a, c, t, g, unknown or other
  modified_base (4859)..(4868): a, c, t, g, unknown or other
  modified_base (5870)..(6106): a, c, t, g, unknown or other
  modified_base (6171)..(6180): a, c, t, g, unknown or other
  modified_base (6978)..(6987): a, c, t, g, unknown or other
  modified_base (7219)..(7228): a, c, t, g, unknown or other
  modified_base (7722)..(7731): a, c, t, g, unknown or other
  modified_base (8227)..(8236): a, c, t, g, unknown or other
  modified_base (9383)..(9392): a, c, t, g, unknown or other
  modified_base (11056)..(11065): a, c, t, g, unknown or other
  modified_base (11297)..(11306): a, c, t, g, unknown or other
  modified_base (12443)..(12452): a, c, t, g, unknown or other
  modified_base (15523)..(15532): a, c, t, g, unknown or other
  modified_base (15711)..(15720): a, c, t, g, unknown or other
  modified_base (16546)..(16555): a, c, t, g, unknown or other
  modified_base (16790)..(16799): a, c, t, g, unknown or other
  modified_base (17031)..(17040): a, c, t, g, unknown or other
ggggggggggcgctggcctggccctcgacctcgcaggcccagagctgggcggagacggggagccggggcccccgcgccagggcgtccagcaccgccgcgccacgcccgcccagcccgacgatcttgatctccaagtccggcccggggccggggggcgcggcatctgcgccaggcggcgcggcgcggggggcgagggggctgcggcccgaggggcgaggcacggcgtcgtgcgtggatggtcgaccgtgacccccgccgcacagggaagccgccgggaagccagctcgctgcgatgatctcgggtcgctcccacgggcgtcccttgaggaccgtgctgggcagcatgggcgctggctggtgccagaggccttcttatgccctgcaccgcagcgacctcgaagcccatccaggcccagttggccacgggtggcgagtcgcggacgtggaggtccgagcgcaaggggcgagctcgctgcggccatggacgcctgtgtcgtcagcatgctcctactcgagggtccacaatgaacccgatggtctagtggcctggcaggtccttcaagaaggtggaggggtcggggactacgccgttgaactcggcctgggagaagtcgaagccgggatgctgcgatcaaaggggagggagggatgaggggtgatttgagggggatagtacggcggggctcgggggggctgctggaccaggaaagagcgcgctgacattgccagggatctctcgcatgtgacgctacacacccgactggtccctccagtcactgatgcaggtcagcggcacaacgtgcccgcctgccaccagcccgccctcacctctgcctggaagcgctccaacatcaaccgtttctggtcagtggtctggacgtcgggcgaaacctcgtgccctgcgatggcagccggccacgtgacccccgtctgtgccttcaccagctgcagcaccaagattccgtcctctgaggggatggcagattggattggggtgtcaatcatgtgggtgcgatatgccgcccagagcaagcacgagtgaatatcacacactgccccctccccctttccaccacgcctgagccagcaaagccaataatcagcggctcaccgactgtccacaaggagtcggagaccttgatagcgccagccaggtccttctgttggacacaggcaatgggctgtgatgagtcgtctgcatgtatgcatcattattccacgaaacagaatctacatcgccgaccatcgctcccacatgaggccgcgtcacagtatataatcgataagatttgattcaaacgagaagctcattaccccagagnnnnnnnnnntatcatcattcctcgaaacagattctacatcgctgaccatcgctcccacacgaggccgcgtcgcagtatataatcgagaaggttcgattcaaacgagaagctcattaccccagagcgatggactcacatcaaggtagggcggggtgtttgctaatcccaccgtgagcctggcggttgtgaaagagactgccaggtccttggcacgagctccgggaggtagatcgatgaagatgttgatgtcactgcgtgcgtgtgtcggcgggatgcttgccttcaagcgtgaatggcaagcttgggcattgaggctgccacactaagctgaagacctgatcagccggcgaacacatcaggccactcataggtctcatacagnnnnnnnnnngggcgcgatgcttgccttcgatcgtgaatggcaagcttgggtactgaagctgccacactaagctgaagacctggttagccggccagcacatcaggccactcataggtctcatacaggatcgcacgcgcacctcagtgtctggttccactcgtatactttctggcagttgtgcacgtacgcgtgtgtctcagtcggtgcgaccctgtccattcctcgggctggggatcctaggcccagctcccacccgatcctggggtcgcgctgcaccccgtccaatcgtaaatgagcttccgcgaacaatgcatatacggggtggactctcagcagtgtagctaggcgcacatgtcacagctctgttttcaaactcatgctcatctgcgcgcccgactggattggctccgctcgacttgatcgcagccctcgatctgggggtagctcggcaccagcggccaaacggctggccccccgacatggagtgagaggtctatttcgctcacagaaatgtatcaatctaagagtgcgagtgcctgctgacgcatatttcacaaacgccgagtacttgcttgagaaggaggccgggctcgtcggcaggtggctgcgacgtgaggtaggcacccagccctcccttcgccacagccctgaatcctggcgtcggtgtgagagggagggcgaggtccatgccgccctccctccccctcctgggtccggcttccggcaccaaccccagcctcctgcgcgcctcctcgccggcgtggcggtgctggccgaagcagggcacgcacggaggcctgtgccgtgccccctgcgtggcccacccatccgctgtggggaggaatatgttggggcctgaccaggccacacgcgctgaggatgccgacggcatgccctgcctcgcccatgcctcgcctccccacccgccagagccttctgccgccctcacacctgctcaacacgacatcgcatcaacacccagaaaccctgcgcccctggatgccctggccgacgcagcgggggaaactgcccgggccacaggtgcccagccccaggcggcagctgcggctagaccccggcggaagggtagtgccatgagtcccacccagcgcgccgcgctttcagagagtctggaggtcctcaaggccgacatcgaccacctgcgggccctggtacgccccgactccgtgccgggccccgccgctgaggatccgggcgggctggaggacagccagccgccggaggtggggctggggccctccgtgagcctggggcggctggcagacgccgatgtcaagaaggagcggcggcgggacaagccgaggaaggccgacaagcggcggctggcggagcgcgaccccaacccctccgccgggcccggcgtggggtcgacagacgccacggcctcggggggcccggcgctgctggcgcactcgccccagccctccgccgcgctggccatgccggggtcgctggccggcgctgatgcgggggcagggcacgtgggccatcgcagcagggcctccgtgcgggcggagtggaagaacatcatgcgctggtcgcgcttgttcaagtgcgcaggcgtgcgnnnnnnnnnnnnnnnnnnnnnnnnnnnnnnnnnnnnnnnnnnnnnnnnnnnnnnnnnnnnnnnnnnnnnnnnnnnnnnntcggcacgctcccctcgatcccatccactcttgcctcgtgccacctcctcatcccaaccccaaactccccatgaacactcgcaggctgcgccgcatccgccggcgcggcaccgccctgcgcctgcgcaaggtggtcgtcttcggcggcggctccttcggcaccgcgctggccaccgccctggcgcgccagcaccccgacgccgtggtctacatgctcctgcgcgacccctacctggcctgcgagatgaacgagggcnnnnnnnnnngagccggggcgcagggggaggggccccggaccacggccgcgctctgagccgggtctgcgctgtcggcggctggcctcgggaaggcggttgcatgggcagcgagcatctgcaccgccagtcgtggacccgcccatgtccaacctctgcagcgctcgacagcaccccctcacccacacgcaccnnnnnnnnnncgccaccgccctggcgcgtcagcaccccgacgccgtggtctacatgctgctgcgcgatccctacctggcctgcgagatgaacgagggccatgtcaacacgcgctacctccccgcctgggtgctgccgccaaacattgtggccacaacctccgcgcgggaggccatcgagggttcgcaatatgccatccacgccgtccccgtgcagcagacgcgctccttcctgcagtccatcaaggtggggcggagctggtgggatggaagccggggcgcagggggggggggcccgcaccacggccgcgctctgagctgggtctgcgctgtcggcggctgccctagggaagttggttgcatgggcagtggggatctgcaccgccagttgtggacccgcccatgttcaacctctgcaacactcgacagcaccccctcacccacacgcaccgtgcagacgctcctgccccccaccctgccgctggtgtcggtgagcaaggggctggaggtgtccagcgggcacgtgctgtcggatgtcatcccgtcggccctgggccgcaagcagcccaccgtctacctgtcggggcccagcttcgcggcggagctcatggactccaagcccacgggcgtggtggctgcctccaaggtgggcgggcgggtggtggtgtggtcaaggcgcagggaggcttgctgggggggctcggctccgtggcggcctcgaggttggctttgggcaggtgcccacacacgctccggccacggcgtgtgcgcctccagcagcgnnnnnnnnnngggttgctgggtgggctcggctccgtggcggcctcgaggtcggcttcgggcaggtacccatgcacgcgccggccacggcgtgtgcgcctccagcagcgagcgcgctgcattgctgtcgacccgtcttatcccgggtctcgaccagaccagccatgtccggcgacggcaattgcaggcctcacacatctccgcacccctcacccccccgcccttcccctttccccaggacaaggccctggctgaggcggtgnnnnnnnnnnacgacccgtctggttccgggtctccaccagaccagcaatgtccggcgacggcaattgcaggcctcgcacacctccgcacccctccccccccccttcccctttcccccaggacaaggccctggctgaggcggtgcagcacgtctttgcctcgcccaccttccgcgtcaacacctccaccgacgtcgtcggcgtggaggtgtgcggcgccctgaagaacgtgctggccatcgccgccgggatcgtggaggggctggacctggggcacaatgccatggccgccctcgtggctcaggtgccctgaggaggggtgggggggagggggaagggggttctcggggacgcaggacggcgtcgacgagtgcgggctctgcggcggccatgcacatgctgggcgcccacgccgcctgcgtagcaggccccgcacgccgacgccaccccacgactccacccacgtcaccccactgcctcacgcaccgcccccgccgcccaccctacacaaagggctgcgccgagatccggtggctggcggagaagatgggcgcgcgcggcgcaacgctgtccggccccgccggcctgggcgacatcatcctcacctgctacggctccttgtcccgtaaccgctcggtgggcgtgcggctggggcggggcgagcccctggccgacatcctggggtccagccaccaggtggcggagggcgtggccaccgccggggtggtggtgggcctggccaggaagtaccgcgtccagctgccggtgctcaccgccgtggcccagatcctggacggccacatcagcgcgcgggaggcggtgttcgaactcatgaacctgccccagatcgacgagtagcgacgagggggccgggggcgaccctgggcgccgacctccgcggggcggcgctggcgggcgtagagtccgctcggcgccctgccgtcccccccgcggatggggagggcgcggttcaccaccgccccccgcccccggagctcggcgccggaggcttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgacgtgcgtgggcagtctgacaacaagaaaatcgagtgctgccgatcaggcccctcactccttnnnnnnnnnngtcgacgagtagcgacgagggggcctggggcgaccccgggcgccgaccaccgcggggcggcgctggcgggcgcagagtccgctcggcgccccgccggtccccccgcggatggggggtgcgcagttcaccaccgacccccgccctccgcccccggagctcggcgccggaggcttgcagcccccgagaacaacccacccagccccaacctccgacggcgtcctgtgcaggacgccgttgttttcgaccctctgtgcagtagctctgtagcgaattgacagctttctttgtcacgtgcattcccccgcttcctctgtttgacttctcgccctgcgcgcgataccccctaaaatcctgtggacgcttattttcgacgcttgcagccgagggatgaagggggatctcagagggaaagcaaggcaaacagggggacatgcgtaggcagtctgacaacaagaaaactgagtgctgccgatcaggcccctcactccttcattgactcggccagctcgcgcagggcctcctgctgctccatacgcagcacggcctggatgctgtcctccagccccccctccaggatcttgttcaggtcgtagttgttcttggtccggtggtctggcggggatgtggacaggggaggctttggattgaaggaggaaggattgagatttgcacatggtggtggatagagcaaagggtttctcgagtgttcacatattcaagggattgatctgcatcaagcctacagactcgtacaggcaccaccacccaaatgcacctgacatccgactgtctttaaannnnnnnnnngacagactcgtacaggcaccaccaccaccacaaaaatgcacctgacatccgactgtctttaaagttgtacgtcttgatcttctccgatcggctgccggtcccaatctacatgcacagacggccgtttgtcggcatggaggtttactgcctggaactcactttgtttgattgaggcaatgcatcgtgccacgcccgggcatatggggccagcggggtggatgcacggcgcagnnnnnnnnnngcatgcacagacggccgattgtcggcatggaggtttgttgcctggaacttactttgtttgattgaggcgatgcatcgtgccacgccgggcatctggggccagcggggtggatgcacggcgcagcccctgtcctgtacccatcatcccattatccgaatgcccctgaatctacacagacaagcccgcatccacctggctcctgcgtcgcgcggccacctccccccgctgcttctccagctccagctcgaagagcttggcacgcaacagctgcatagcccgctcccggttgcgcagctgggtgcggtcctcctggcagaagatgcggatgcccgtgggtttgtgcatgaggtcgatggcggtctccaccttgttcacattctggccgcccgcgcccgaggcacgagcagtggagatgtcgatgtcctacggacgtgggtgaggggtgggggaagatggagggtttgatgtggcgtgcaggaggggccgaggccgcnnnnnnnnnnggtggagatgtcgatgtcctacggacatgggcgaggggtgggggaaggtggagggttcgatgtggcgtgcaggaggggccgaggccgcgccgaatcccctgacacccccgagaagggatgcaagcctcatctttgccgcacatgactccgcatccaaaacccctgcccacccttacacccccctattctcccatacacaccccaagtacacaccttggggtcgatctggacgtccacctcgtccacctccggcatgatggccatggtggctgtgctggtgtgcacccggccagaggtctcggtgctgggcacgcgttgcacgcgatgcacgccggactcatgcttcagcttgctgtacaccctgcggggatgggatgcggatggtggcccacctcagggcccaggtgctggcttcgccctgctgtcgacacccgtcccagccctcggcccgtccaccctgtccaaccccccagcgcccgggctcacttgtcccccnnnnnnnnnntctgctgtggacacccgtcccagccctcagcccatccacctagatcgcccccccagcgcccgggctcacttgtcccccgtgatgcgcagcaccgcctccttgtacccgccgccctccgccaggctctccgacaccaggctcacgcgccagccctgcagctcggcgtagcgctggtacatgcgcaccagctcggcggcccacagcgcggcctcgtcaccccccgtacccgcccgcacctccagcatgatgttgcgctcgtccagcgggtcgcgggggaggagcagcaggcgcagcgcctccgcctgcgcgcccagccgctccgccaggccctccacctcctcgcgcgccatggcctccatgtcggcgtcgccctccgactcgcgcagcacgtcccgcgccgaggccagctccgcctccagcgcgcggtaccgctcgtacccgctcacccgctcctgcatctccgccgcggcgcgggccaggcgctggtactcggtggggtcgcccgccaccgcgggcgtggccatgccggcctgcagctccgcgtggctgcgggccaggtcctccagcttggccagcacgtaagggtcctttgttttttggggggggggtgttaggaggtaggtgctgtaaagaatgacgcaaggtgaggggatgccgcctgccggcccatgggagagaacaggcgatccaccaccccaacccgattgctacccaccgctgcggccctggcgacgatgtaatgccggggcgcgacgcgaggtggattggcggggcatgcggtgctgggagtgaatggccgaggccctgcacaggatcgagaggggcgcagggagggcatggccgcggcgccccaggccagggcacccgacggcagtgccgggctcatgatgggcgtcgagacgcctgattaacaatcctggtcgcgctggcggcagacacccatgcgttctcggctatagataaacacagtttgatgcacatatgaaatgtatcgtggcgagcagtcagtcgctcccaattgcatgactggcgatagctcggtcgcacgttatctggccggtcttcgcgcgcgcacgggtgttgactctggcatgtgccccactactctgcataaatttcagcgggagcccctcttcgtcgtattccnnnnnnnnnnactggcatgtgccccactacactgcatgaacttcagcgggagcccctcttcgtcgtattccttgattcacgactgcttgcattgctttaacacagatactgccacggcagcggccaggtatacgagttggggcatcagggacggaatgccatgcactcctctcctctcccccgagctgggctgagctcagccggcgagcgcggtggcgcccgagatgatctcgatcagctcggtggtgatggtggcctggcgcgtgcggttgtaggtcagcgtcagcttgcccagcatctcctccgcgttcttggtggaggactccatggccgccatgcgcgacgcctgctcgctgcagttgttctccatcagcgcgttgtacagcgtggaggccaggttgaactcggacaggttctgcagcagctccgcgcggtcggggccctcaatctcgtactggtccagcaggccgccggcctcggcctccttctccagggactgcaggggtgatggggagttggagggtggttagacgagcccaggcggggccaagtgcggggtacatatgcgccagtgccgcacaagacctccccaccagccatgctcacttggtgtcttccacatagacccacccagcagccatcccccccgcccccctccccccatctttgctcccctccacctcccgctcacgtctggggagagcacggtggcgatggtgggcttgtaggagatggcgctgtggaagcggttgaagatgaggcgcgccacgtcgaactcggtggtgttgatgccgtcggcgatggcggcggcctgggcaaaggtcacgcgcactttccccgtgtccgccaccgtggagtggatggaggcgcgcaggtcacgctggagctggctgcgccccttctcccccagcaccacgatggagtgctccttgtcctcgccgtcctcggccttgatgctggcgcgcgtgtacttgcacaccgtggtgttgatgccgccgcacagccccttgtcggaggtgatgggcacgtacacgttcttcttgccctgggcatcgggcaggtcgcccagcagcttcaggaggggctcagcgataccccgggagttcatggtgttcacctgcgccgatcgcatcttggaggcggccaccatcttcatggccttggtgatcttgccgatgttggccaccgacttcatgcgctgcttcactgcacggaggtggcgtgggaaggggaagggagatgacaaacccgggcccgatcgcgcggggggtggagtcgacgtaattcttgctttatactacctccaggccagcataccgagcagagtggaggcatcgcgagctccctcgacggcctccctgcacggcacggggatgggacagaggtgactcgaccggggggtagcgggcacgcacacccacgctgccgggcaggcacactccaaacttactctgcgacagcgaagctgggcttcagtccctgcaccgcaggctcgagctggccctgcctctggcagagcctgctgccgaggctgtgacccgcccgccgcagcatccttcctgattccccaggctctcgggggggttgctaggagtgaaccgtgcgtgttaggggctggggtttggcacgggaattgaaggggggggggtgtcacatgtcgctgcgcccgtgtcnnnnnnnnnntttgctaggagtgaaccgtgcgtgtaaggggctggggtttggcacgagaattgaagggtgggggggtcacatgtcgctgcgcccgtgtctctgaaaattgtttgccggggtctaagtagcgcgggaaggatggttgcctggtgagcatgagcaaccgacgactcgcatcaggttcctctgactgagaatctcgaatgtaatatcttacagggaggcaggtatcaggctccgnnnnnnnnnnagagcaaccgatgactcgcatcaggttcctctgactgggaatctcgaatgtaagatcttacagggaggcaggtatcaggctccggtcgatgagtgtacacagggcggggaacctggctgcaggcgggtctctgcaccccaggggtcccccaacccaccctaccgcttgcgctccgccttccacttaaacacgcccttctgcccgccggcctccgccggcgtcagcttgcgtttcctgcccttccctgcgacctccttggcgtacgccatgcgcgccgccagtgcgctcagcttctcgccccgcgcctgccgctgcagcagctccttgtacgccgtcgcccgccgtcgctcgctgcgcgccgccacgcccgccagcgtgtcgccctccgccacggggggagggttggccagctgttccgtcctgggacggttaaaggcgcgccctaccaagtcagggtgggtgtcgaagtaggctgcagggtcaaaggcggccgcctcctcctcgccatccacgaacacggtgtgccgtggcttagccatgccaatcatgtgcagggagctcctcagcctctccactttctgaggcaagggatgggcgaagggtgtggttttgtgtggacgtgtgtgagattcagagggagaggtaacgatgaggaggggactgactgcggcttgtcagtgtgtacgacaggaccccacaacagcatcgtcctcccaccacctacccatccgccccaccaaatcacctttgcctcggcctgggccttgagggtcaggtagcccacgtcctgggtcttcatcagtcgcagctcctcctgggagtacctgttgggctcgctggtgctaaccacatgcacgccgtccttggtccgtgccttctccatcgcaaagtagaactcatctgggttgcgggcctccgccttgccgcgcagaacctgaacgaaggaggagggagggagggagggcggtcgtgcgctggtgtccatcgcggaggcttggcggtgaaggtgtcatgcctgcaggactggcagtgactgcagactgacggtcctgctgcaatcacgcagcctcccaagcctcactgaaacagagacaccacactccgcccacccggatggcatcctcctttttgtgaaannnnnnnnnncggaggaggaagggagggagggtggtcgtgcgctggtggtcatcgcggaggtttggcggtgaagctgtcatgcctgcaggactggcagtgactgcagactgacggccctgctgcactcacacagcctcccaagccttactgaaacagagacaccacactccgcgcacccggatggcatcctcctttttgtgaaagtccttggcacgaagtaggtagtcctttttcttctcaaggagcccaaacttccggcgtgcagtcctgcggtgggtgcagggttgccgtccagtgcgctgcgcacaacgtagcgacgcgcacaacgtatgcacaatgtcacacaacaacaaattgcgttcactcacggctgtgcacgctccttatgcgttttacgcttcacggcattcttcagagacgcgctcatcgcgcctggccacgggcgtccccctcgccagcaacactgcccagctccaccgctgaactgtgggttatatgaaactagcggtttggagatttatatgttgttccaatggatcagggggcgctgagggatgcttggtgctctccgctcgtcgacttcttcatgctgtgctgtggtggccaggtcacccccccctcccccttccaatgcgtccgactttaaggggatgtttgtaccaataagcttgcccgtggcaacctcgcgatacagaggattacatgggtagccagcataaggaaccatgccatgccaaaacatactgagagagggggggcacccttctactaggacaactctattaaatcgacacatgtgctgcaagcggccgcctacctagcgaaacagggaaaagtgtgcaggagctttgaggaattcatttcttgtgagctccattcctggacttggctttcttgctgcccttgtaagcagctgctgcggggagctctggcgtgcgaacagcctgcggggtcttgccagcatctaccaggttagcctttgctgcgaaggggaagggcttatttggattagaccccgtggtaacctgaccagaagtattggtgtgctgcatgaatgtacagttccccagcgagagcaactcacatcctcaatgcccctgcatccctgccacagcaggagagccagttgtgggttccttctccacactcttgggtgttgcgacatcagggatagccgccgggggctcggtgtcgtctgaagcgtgcttcaggggcgagggagggtcggatgctgcatcctcctcgatggcatgctcgattctggcagcaggttccactcttgctgcaaccttgggtggcggagcggacccctctatctcaggcgaggtaactgtctcagaactggccgaaggcttcccagtggaaggaaccacctggtataggatgggatcgtgtgattggtgcgatgctagccagtccagatcaccggcgcccgtcacccactcaccccgcaccttgtccagcttcagcttggtcgcgatgtcggggtagtgactcgcaagcgtgacgatcgcgccctggatcaggccgacaatggctcccgccagggtgaagaccgcggccgtggcctgatcgaggtacacctggggtagctttgcggacgtcgccatggtgcccgaatcaagctcgcaaggcggtcctgtgacaaagatttgggcttgctcatgcgcgagccatcataacggtattggtcagcattctgcgggggggttcctggagctgagggtgctgctgacgtggcaggcctgcaaatctttacagcgtttggatgcaaggagtcggggttggcaccagtcgcccagacgagaagcgggagcctgggtctttggtccgtgtactggacgggtgcatggccagagcacgcccagtcactggctaccgtcctcccacgccccgccccggcgatccgaggcggccggggcacgtcgggaccccacccgctgcagggaggcagtgcgagccgacgatgccactcgccgcagctccctgctcctgtcccgtgccagcgagccgcctgaccctgcgaggtcgtgcccccgcgcctcgcctcccagcgtctcgcctcgctgcgccgcctgcaccgcctcccacgcctcctcctgcgtcaggaccggggggtcccagccggggtcggcggcccgcgagccccccgcctcgcctcgcacggcccgccccggcccgccagactcccctgggccgcgcagggactgggagcgggccaggccgcgccgcggaggatcctgctgcacgacgtcttccagctccagctcgtagtacctggcaccacggggcgcctgcagggactctgcgtgcgccagctcctcctggtacaccacaggccgccgcggcgccggcagcgaggtctgcggccgcaacctggcggctggggctcgcgccgcgggcaccgctgcgatggctgggaagcggtcccgggcttcctcctcctcctcgtcgtcggcgtcggctgccggctcggcatcagtggagccaccgggggccggcggcggggccggtttcgccggcagcctccgtgcccgcgactcccgccgctccatgctgcccgctgcaggcgcggcgggggcagggacagccttcttgctcatgctcagcgatgcagcctgtccggaagaggggtgttacattatggagatgattgcatggtcagctgcggtgacacaatctctgacaagtatggaggcatatgcagtccgagtaaaacatgctctacctctttgaatgactgttgagctcaacatcaggcagcaacaggtccaacccccaatgagtccccatgccaagctctctggtagcctcaccttggcgagcgtcctgacggtcgccgtcaccccctcccccgagtcatcctcatcatcagcgccggctgctgccgaggcgtcagccgcctccgcagtgggggaggccttggtgcacgagaacaacttgaagcagaggccgcccaggcccagggagcagcaggcgtacttgaggagcaaggccaccagcgccactgcagcagtggaaatgtgtggaggtggccgaatgttgcgcttattcccatgctccagacagatgtccgcctnnnnnnnnnnatggaaatgggtggaggtggccgaacgttgcgcatattcccatgctccagacagatgtccgcctgccaggggcgcttttgtgtgcgaggccagcagattgtaggtcgcctggtgctgaaacgatcccaccctgctgccttagcttgcatgggaccccccgggaataaatgacgcccccnnnnnnnnnncaccttgctgtcttaagttgtgtgggaccccccgggaataaatgacgccccccctaagaaacccgtgcgcacctatggccagcccgcccgctcctatgccagcaatggcagacacgctcagcgaggacgcgacggccgtgtcctctgggctgtctggcacgggatgtgctgtgtagggtggtgggaaggggggcgggctcagtggggcccggatgttgagcgcctttacccaggcgtctgccccgccctccgacgcacctgcgggggatgggcttgggggcgggaagggggacagcgttggactctggcgcggcgacggtggcggggaagacgtcctcccgcctcctcccggtggcggggagggcgctggtggcgaggagggtgcagtgggcgggggtggcggcggcgcgctcccggaggacagcgcgcagtagacgacgctgccggggtcgaaggggtcaaacggaccggtttgccacccgacgtcgcaggtacagaagcatgctgccattcctgcatcggtcagcgtgccatggcttccacagctggctatcaggcaagagccctgcagtgtctagggaagggtcaggggattgggcgtgccggaggattttcaaggagctggaagggaattcgtcctgcatgggcccggaacacccccagcacctgcgctcgtaccgaggcagaggggctgggagcacctgcacaggtggggagaagggttcatgcaatgtttgattgggcaggcgctgaactggtggtagcaatgccagaatggagagcacagcaccagaagcatcgtccacggcgatcagattgccagggnnnnnnnnnnctgggcaggcgctgaactggtggtggcaatgccagcatggagagcacagcaccagaggcatcgtccacggcgatcagattgccagggtccaacatcccatcgcgcattcaaggctgaagggcatgcacctgatggtgagttgattgcaggagggggtggagggtccggggtggatggggaccccgtggaagggggaggaggggagggactgccgggaggaggcggtggggagggnnnnnnnnnntgcattcaaggctgaagggcacgcacctgatggtgaggtgattgcaggagggggtggggagttcggggtggatggggacctcgtggaagggggaggaggggggggactgccgggaggaggcggtggggagggactggtggtgggaggaggaggataaggagggaagggggggaggaaggagggagggggaggcttcacgaagggggatctgaagctcgaaggcgatgatggnnnnnnnnnnaaagggagggagcaatgagggagggggaggcttcacgaggggggatctgaagctcgaaggcgatgatggaggcggggaggcagggtctgggggcggtgcatcaactggcgagggaggtgggggtgcaggagctggtgggggcggggatggctgcgatggtggggagctgggtggaggagggacagctggaggagattgtgggggaggggaatccagtggaggaggtggcgagggctcggagggggcaggaaccggcggcgtggaggcttgaggacttggaggttgactcattggtagaagggatggtgctggactctggaacgtggagtatgtgggactggcttcaggcggcgaagcaggggtaggggatggagccgtgggaaaaggacttgcgcctgcctccgatggcgaaagcacaggggccgatggcgaaggcacagaggctgatggctgcagtgtgggtggcggaggcagaggggagggcggaggggggtgtggcgggggcgaggacggaggagggtgcagtgacggcggtggcggtggcggtggcagccacgggggcggaggggatggtggcgaggggatggtcggtggggatggagggggtggagggggtgatggcgggggcgc

SEQ ID NO: 43329 - DNA, 89 bp, Chlorella protothecoides
tggttgatcaccaccttgttcatgcctggaggggggttcatggggagggacatcggatcggcagccggagtgttcatgcacctttaaat

SEQ ID NO: 43330 - DNA, 61 bp, Chlorella protothecoides
atcctggctgaccagtggcaggatgggggggtcgagtaggtcactaggggtctgtgacgca

SEQ ID NO: 43331 - DNA, 70 bp, Chlorella protothecoides
cctcccccacccacccacattcccaacccctcccgcgaccccccctgaacgcggcgccccagcacatgcc

SEQ ID NO: 43332 - DNA, 61 bp, Chlorella protothecoides
tggacacgccccgcctgacgtgcaggggggggagcagcttgggatcctcgcacaccaactc

SEQ ID NO: 43333 - DNA, 61 bp, Chlorella protothecoides
gtacctggggaagaagggcatctgccgggttgatgagacgcccaaagggtggttcatgtcc

SEQ ID NO: 43334 - DNA, 94 bp, Chlorella protothecoides
gcaccccctctcatccctcgacgacacccagagcccccaccccccacccgctccacactacaagaacactcaaaccttgtcctcccccgcgcgg

SEQ ID NO: 43335 - DNA, 61 bp, Chlorella protothecoides
cgcggtgtggctgagttgacacagtggctgggggagcagcaagcttagcagcgcttcacgt

SEQ ID NO: 43336 - DNA, 2872 bp, Chlorella protothecoides
  modified_base (349)..(358): a, c, t, g, unknown or other
  modified_base (717)..(792): a, c, t, g, unknown or other
  modified_base (886)..(895): a, c, t, g, unknown or other
  modified_base (1709)..(1718): a, c, t, g, unknown or other
  modified_base (2117)..(2126): a, c, t, g, unknown or other
gcgcagggccagcgccgccgcttcggcagcggcgactggggaggcctgctgggcggcggcggcagcgctcggcacggcggcgcggatgcggggccgggaccggcgaggatgctgtctggcgtgggcgggttgcaccaccgcaccgtctcgggcgggtccagcgagcggggcggcgcgtcgacgccggtgtcgccgggaggcggcggggggaggcccggtacggcctctgagggggaccgcgccatcgtcgccggtgagggtctggggaatggaggggggctgcggggtgctgcggggccccacttgagtcgggtgctggagggtgcgcgcggatccgacgctgtgcagnnnnnnnnnnaattggagggggggaggggcgctgcggggtcccacttgagtcaggtgcttgagggtgcgcgcggatccgacgctgtgcaggcacttggcgacgagcgtttcggtgtgcccgggactgggatgctcgcccaagagcagctgactttgcaagcagaccctcacggacccctgttcccatgccacccaccctgcaggcttcgcggcggagatggagggggagctgaccgtggcgccgggagacagggtgctggtgcacaacgacgccgacggctgggcgcgcgtgatgaggctgtcggacggcaggtcgggcctggtgccctcctgggcggtggcgggcggggcttgaggtggcgggcgggnnnnnnnnnnnnnnnnnnnnnnnnnnnnnnnnnnnnnnnnnnnnnnnnnnnnnnnnnnnnnnnnnnnnnnnnnnnnagtcccatggctgcggtgcgcctgggcgcacaggaaagataccacgtcgcgtcagcatgtggccccccgactattgtgatctccggttacagcnnnnnnnnnnaggcgatccaggtgggcgagagaagtcgaccaggggagcctcggcctggcctgactcatggctgcggtgcgcctgggcgcacagggaagatatcacgccgcgtcagcatgtggcccccgactattgtgatctccggttacagcgcagagcaggtctcaggccatgcactgcaatgaaagcatgggcaaacgaaagggtgtggagggcccgggggcgcctcaagaaatgggaaatagggtcaccgcacacgctgtgcggccaggggaagggggtaggggaaagagggactcgactccgcggctctggcgagcgtgctgctggagggggggtggatctcaagggcaatggcgcccagcagggcgcatggggggtgggagccccgcatcggacacgccagcacctgcgctctgatgcaagtatcgaaacaagagaaggtgcaccaatggtgggaaggggtgcttctgaaccttcttcgggggctgcaaaggcgggcgggggcgggggcagcgagcaggggagggtgcaagcatggaagtggggtatcgtcatcgtctcggcacgtctcggcacggggtcgacaatgcttctcgaaaagggcgtcaaaggaggtatgcatgtgtgctcatggctctacaccgtgcgacgaatgtccactgcgcctaggtcgcgggaagaaagtgagaatgggaggggcacctgcatgtcgctgatgcttcttcggcacgcgggcgcggacccggtcgtggctgggtgggatggggtggcgcctcgcggttccggtttcccgtccagcagcaggagtctgcacccaggnnnnnnnnnntgatggggtggtgcctcacggttccactttccccgtccagcagcaggagtctgcacccagggccgctcgcaggcaaactcctcgatgttctctcagaacaggcacgcagtgcgcccaaactccgcagagtggcgagggacgccgttgcgggcatcgaagaagacgcgatcctgttgcgcagtcgcctgctgctgcagggagggaattgggttttttctttgttagtaggggggggctgtttggcacaggtgtaaggcaaggacaagcaaaatggtgcttccctgggcacgtcgctgggcaattgcttcccaatggccagcgagggatgcttggggcgctcacatcggagaacatcgtcgcccccggatccgcaccgacactgcacgttctggaacagcnnnnnnnnnngttggtttttttttttgtgtgtgggggggtgtttatcacaggtgtaaggcaaggacaaccaagatggtgcttccctgggcacgtcgctgggcaattgctttcaatggccagcttggatgcttggggcactcacatcggagaacatcgccgccctcggaaccgcaccgacactgcacgttctggaacagcctacagagtacacgcacacacaccttggccaggaaggcggtgtcgaaggaggccgcccgcgaggcggcgcccgcggcctgcgtctgggcagggggcccccaggcagcgccgccggcaggccccaggaagccgcccgaaggcgccgaggagaagagggcgaagctctccaggggcggctggtcatggccatggcgcggccccggcgcaccgccgctgccgtccaggctgcaggagcccaggccagcgaggagggcactgagggaggccgagtcggcgctagcgcccgcgctggccaccgcggcgggggcgaacgccgacccgcccaggccggagtcgatgagggagaggagggcggggtggatgcccagcgcaccctcggccggcgccggcgcgccaaagggcgagtccagggacgcggcacgcgggttgtacgcagcgcggatggtggcgtgcgccgggcccgccccactctcaaagctgggccgggccgaccgccccgcgccgcgcgagggcgacttgccggcggagggcggcgtgccacccagaccgccgcatcc

SEQ ID NO: 43337 - DNA, 61 bp, Chlorella protothecoides
ctgccctcggtgcggagggagtacggctgggggtatcttggtgtgggttcctgccctcccc

SEQ ID NO: 43338 - DNA, 90 bp, Chlorella protothecoides
tccctcccttcctgcccctgcatggaccaagcacaagaagagttgtgatgccccccccttcccccatcacacacgcgcctgccaccaggt

SEQ ID NO: 43339 - DNA, 19443 bp, Chlorella protothecoides
  modified_base (900)..(977): a, c, t, g, unknown or other
  modified_base (17736)..(17745): a, c, t, g, unknown or other
  modified_base (18267)..(18276): a, c, t, g, unknown or other
  modified_base (18400)..(18409): a, c, t, g, unknown or other
gggagggggcggggatatcttcttgggagggagaggaggggaccttgcgggaggcggggagggctttacgggatggggagaagggctcgagcgtggcgggggagggggtgattttgatggtggcggcggggatggggaaggaggcaatggggatggggaaggtggggggggagatggggaaggtgggagggggagtggaagaggaggtggtggggatggagatggaggtgacggggatggggacgagggtgatggagccacaggggaaggaactggagcgggcgcgggtggcaacacggggctcggtggaggagcgctcgatgggcttggggctggactcggcgggggtgtgctcggtggagaaagggttggactcggtggaggagcgctcgatgggcttggggctggactcggtgggggggtgtttggtggaggtgttggggaaggtgggggagcgcctgatggggagggtactggaggtgtcggtggggatgtaggtgctggggctggggccggcatgggtgttggtgagggcacaagcggagatggaactggactcggcaggggcgccggtgagggcaccggaggcagaggtggaaggggaggaggcggtgggagtgcggtgattgggatcggtgatacactcagctgctgtccgtcattgtcctggccgactgccgacacagaccccaccatggagttcgtggtgacggtgacggtgctcatcgtgatcaggtcatcgggcgcataggtctgggaggcatccaccccgccgaccttgtacttgacgatgatgagcgccagcagcctatcactggccacctggacctggcacctgtagagctcgtcctcctgctgcttgcacattgcatcgctcagcacgatggcaatggggggggnnnnnnnnnnnnnnnnnnnnnnnnnnnnnnnnnnnnnnnnnnnnnnnnnnnnnnnnnnnnnnnnnnnnnnnnnnnnnnagagggaatcgtcgctgattgggtagggcccgacaatgataggatcgcccgccatgacggtggctgttactgttcccaggggcgaaaaggcaatgaagattgcagtgtacgtcattttggtagatctgctcacatactgctgctgatagtttgagccgtccgacatgttgaaggtgagcgccaccactgtcggcagctgttgcaaggtcatgccaacggtgcaggagatcctttctgagtacaccttgtggcaatcagcagtgtcgaagacagctagatcggggggtggaggcgatggagggggcgggggcgatggtggtggcgggggggcagggtgtggagggggggggctcctaaatggggcaatgggaattcttgaggaatgaatgtacgtgccgtctgaggtctgataccatgcgaacgcagacccctcaatggaggtcccaacatcgctccaggtaacgaagctggtgagctgtttggctggaacctcgaccgagccctgagcactaccccacacgtagtcgatccagtaagagttgagaggcatatcggacgccgtcacactagcagtgcatgtgatgaagcttgtaggcttgccctcgctggagggatgaatgcactcgatgaaattcagggtgatggtcgccgtatcctgcgcggagcaaccggggcaaggatgggaaggaaacaggccgaggttcagcactgggttggatcgttgcgttcaagtacatcaggctttattttctcaccgccgcagcaaggctcgcgtgccaaataatgaagagcgcccaacgcagggtggtggggcgggacccgaacatgccaaggttgcagtggctgctttacggaatcaaatctaggcagtgcacatcgctagagaatgtttgcggtatctatcgggcgtcttcaggccttaatatttgcagtgatttgtagtggatgaggagagcccctgcatttttcttgctgcgatagccggatgttgaagcggacttgtgggagtccggacgtagatggcaagcggccggcgacccttccgtaggctgagtcgtacgggagagagtgacaggtggaataatctgcatgaagcgtgcggagacaatgcaacgtggctctcgctctcgatcttgcgcatagatttccatctctgcctcgaagaaccttttcaccgagaacttggcaatgcaaacttggtacgaaagagttctgcgaggctggacctgcgttaagacagccggtgcatcgagtcgtgttccatcatttaagaggacagaagtgcgttactgagtcttcgccgcttgagttcttggagccatgcggttattagtcgggtaaagcatctgacagatggggcatgtggagtgtgctgagctcatgttgtgatcgtgacagtagtacagctgtgttgaacgtgtgccttgctgtgcgcccctaccctggcctcgcaacaggcaagctgcatgtcccggcgccttctctgaaggcgcctggggggcgaggtagcgctcgattgcactctggcccccaattttcacgaggctccagggtccctgatccagctacatgcgtcgttggcatgatcagttgagggtgatgctgtcgcaatggaaatgtgctgcgtgcctgtgcctcagacaaattggcatattacggtccatacacaagaagcagagcgatcgcgtttctcgtttgaggtgctgtgaccaggctgcaataccccatatccacagtggccagggtctgtggcaacgaccatggtttaaagaggtacagcaggaagagtggactaataggaccgtacactgcatgtgaagctggactcgcattgcaccttgcgcaatctctgcaagactgccaacacttgccgtgcttgtcctatggttgagagaagctcaaccatcaccacaacgagctgcctagtgttgccaatggcatcaaggtgagggcatcgcgccaaacggctgccagaggtggcagaagggaacagaggacaggggcagtgcaaggccgttgtgcaattctgatgtagatagtcacacacagacaaataaactgatccaggtggctagcttatcgctcctgcagagcaaaatgcggggtcatgtctctgccagcgcccacagcaagcggatcatttgatccagggtcagcctctctgccctaatgccggcatccagtcccaggcgcaagagggccgcctcggtccggtttgggggaaagagcggcgccagggtgttcttcagcatcttgcggcgctggtggaaggcgaatcgcacctgcagccggccggcgtccagagagggcgggtgtgatgtgaggggtggggatatggtaccccgttctctcggccggaacttgaggacagctgggcatcagacagcttggtggggtcggtgcaacggcatccgccacttgccgcaccgtgacctccggccccgtcagggttccctggggcaccgaccctgtcacaggtcatggatggggtaagggtgtgacctcaccagagtcaggaaggctgcctcagaggggacgggcggccgatcctcaggcgccagcagctcaaggtggactacagcgccattcacttttggggctggcgagaaggcccacctcggcaccttgaacctggcatcaagcagtaaaagggggaaaggggtttgtggaggtgctgcatcttggcttcctggaggaactggggttgcagatagacctcgctgagcaggggccatgccaccctggcggcatggcagactctcacagagtatgatccagccccgcccacgcatccagtcggcccggagccgtgacactgcctgcaatgagcactgcgccacgtccttctgatcctccccctctccctcaaatctcacctgatgctgggccggctatagtattggagcaggaggttggcccccctccagtccacgtccccgggccgggcactgaccagccgctctgcggcctcctcctgcaacaggagcgtggctgaggcgagcgggccccccagcggaaggatccgctccagaaagggctgggtgatgttgtaaggaaggttggccagcacccgaatgcaagccccaggggcgccaggtggcggtgcggcctgcatggccatgctttccaccagagtgccaagatccagctgcagagcatcgccatgaatcaaggtcacatcgccctgccgaggttggtccaagggactgggtacctctcaatgtatcccaccagtgtgcagcctttggtggagctcccatacgtgcggggtccaacaggtgtgggggtccctggttcctcttgcacagcagcgtcgccaacagatgtgcttgccccccaatgggcgatctccctccctgggctcccacagcagccgcacctcggtcagagtattcaccaggcgtgaatacaatgcgtcatccttctccactgcagtcacgctggcggccacggcggcgaggtgccgcgtcaaggagcccaggccgggccccacctccagcgctgagtcagcgggggtcaggccagaggcctccacgatgcgttgcaggatggcgtcgtccaacaggaagttctggcccagggacctgaggcgggagcgaggggtaattcaatgtgcggcagtgggtgcaggctggaccaaggtgaaacagccacaaaaggcacggatcagaacggagtcttcatgccgcttcctcctcaccgctttgcccgcgcaacataacgagccacggattccctggccaagggtttcatgggaccttctgtcgggccatcgcggcaccgcgtgcatcctctgtgtcggaaagggcctggtgggaggggcggcgggcctgcctggctgtgatgcagcctgatgctcggtcccggccccgcacccggcagatgcatcacactgctcctcattgacaaatataacgtcatgattcagacagcgaggcaaggtcgtggtgtcatgccacggtattggtgaggggtttgtggtgaggaggtggcgcctccaccatcaaccgaccatgactccatgcacacccatcggcaggttgatttcgatgtaatttgagaattaatgaagcaagaccttgtcagcaggccatgctggtcgagtcctagctttttgctcggattgggagcctccggcatggacatggtcaccctttgacaagatgctgccctcaggcctcctgctccgtcagccccgccctccgcagcacgttgacaaactcctcctcattgtcgtacggcacctcggggatgggatgcttgaagtacgcctctatctcgtcgatcacgcgacgctcctggttggcgtgtgttattgtggagttaaggtgacgactctggtgggcatggggagttgcgagccgccaaaaatcagggactgatcaatccccaggtgcatgccccctccacagtcccatgacgccggcgtgcaccctttctcttccctcttcccacacactcaccgtgtcccctgtgaccaggttgaaggccacgcccttgcgcccaaaccgcccgctgcgcccgatgcggtgcaggtacgtctcgaaggcggggatgcgcacgtccttctccacgggaaggtccaggttgatcaccagcgtgacctgtgaagagtgggcagaggggaatgcgaggtgggcaagccaggtggcgaggaggggaatctactggagcctgggggcggcaagggaggttggcccatgaggccgtgccacacagccggaggtgcgaggccgggactaacagttcaggggcgtatcaatgtgactgccgagcgggcgtcacggcgcactgcaaatgggcacggcaagcggcaaacttcccttccctccccctgcatacttgagtgacatcgaatccgcgagaaagcacgtctgtgctgatcaggattttggtggtgccatccctggtcagtggagaggaggtgcagggggattggtagtcttcgagcattccgggaagaacacagcacgagtccctacccttcatggcttcccactttgcagctcagaccctgcccccccccgtagcagggcggactgtgggtgccgtcttgactcccctcgccccacgtcaatccccaaaccctgcacctgaactcccggatgacgcggtcgcgagcggtgtggtccatgccgccctgaatggaggtgcatttatgcccctcgctctccatctgtgcgggagggaagggcggcggggcgaggcgctgtaagtgcctgtccacagccggcgaggctaggtaatggggagcaaggggcggcgcctacattgctcattagaggatctttcttggacgccgcgcaagcacacgaacaatcagagtggatcactgtgggacgccggccgtgttacccatgccattgatactctgccagcccaccagcctgtgcacgtcacgtgccgtctcccgcgtccgcacaaagatgatggtctgacccaggcgctcgcactgcgggaaaatcatgtcacgcaggaccttgaccttgtcggcggaggtaggacagtactgcgggaggaggggcggggcccgtggataaacgactgtgataccagaggatcgcgacgagatgctcacagtcgaggtgggagcgttcctatctgtctgcaatccaattgcagtgtgctgcctgagcctattcaggccgccccgggatcatgatactcttggtctccgcaataactacccaaacatgacttatcgctgactcaccacccgatactgcttgatgacgtccagggataagtcctccttggggacaaacacctgccaagggaggttcagagatggaaaggttgcgcaggggaagagcttggcggtgacgcacctcccctccctgccgttccatgcagacagggtgttcagagggcatggcgccgattcccaggcatggcggcacgtgattgattcaggtgcaaaacttcatacatcccctgctcccctcagtctcgcacctggttggcatccttgaccgccttctgcgcaaaggtcttcacgcgctcgttgaaggtggcggagaagagcaggatctgcaggtccttgttggccgcctgcagctgccgcatcatgcgcaccgagtcgtccaggaagccctcttgctgcaagagggtggaaagcagggaatgcatgtggcctaccacaatggcaccgtgcccaatgctgtctgctgagaacccgcctgggctggtgggatcagtggccaaaccaggggaccccatcccgaggggtgcggcccaacggtggtcctggtgggacgagagaaaggccggctcaccccgttcgatgtcaccacccgccgccgggttccgcgcaccttgagcatctcgtccgcctcgtcgaagaccaggaccttcatggccgcgacgctgagcacccgcttgctcatccaatcgcgcagcttgccgtgcgtccccaccacgatctgctcgttgatgcgcgcgcggcgcgtggtggcgtagtctgccgcggcggtggaggtcatggtgatgccggagtacttgcccagccgctccagcacagcggcgttctggatgaccaactcgcgggtgggacagacgcagagggcctgcggtgcgtgcagggccgggtccacccgggacagcatggccagggtgaagcaggtggtcttcccgctcccattgtgggcttgcgcaatgagggagcggtgcggcggggtgaggatcaggggcagcgtctcggcctggatcttggagggccgctcaaacttcatctcgatgtacaggccctgcaggagctcgggggagaggcccagctcctcgaaggtttttgctgcagaggtgggggagggggagtttgagggggggccctgttcctgttgcaggctgaggatctggtcccgagactggcggtgcacaaacgggtccacgagctggtcggtgggcaagggggcggcactctggacggaacagacaccactgcatgagcttcagtatcccaggactgacaggctggccccaccaaggaatcaggcccagcaggcaccccacctgatgtgtacagggtgtcgtcggccaggacctttttgacctctgtatcccgctccaccagggagtcggtcttcaggcttgtgtcaggctcatcccctgcatcaggagctgcctcgctgacctgtttcgaggaaggtggaggggactcagtcgagaacgaggatcgcgctgcgagcgccccctcccctgcactggcatggtggatggcatccatgactctgcccacctgcacggaggacagcttggctgcagcctcattcacctctacatcttcgaacccagggggaactgcacgccacggtaacatgggggaggaagaaggaggaagtgccggtgtactctcgtctgatggagggccgaccgccgggtgggcaatgcgagggagaccagcatgggcacctccctctcctgagataccgtatgacagcgccagtctcaccatcattgtcggccggagactcactcctcgtcgtcagctcagccggcttctgcatcgccgccaggacagggaccttgtccgagccccctgccaggacacggcttgcgaggcacacggtagatcagaagtaagagttacttcgattccagcctatattttgggtaaatatgcaaatcaggcttgatgtgatcgttaacgagcatggaacaagctccatatttcgagagttccgcatggttgcccagcaagcgcagcaggccgtgtgtacgattctgcagtggggacctcgcgatgttcccatgtatagcacgacgccggtcggtacgttcttcatcagtactatatatggatgctgtgaatcgtaatccatgcgaactgtgccagtgggaatggcgagctctcagccagtgtgatattacttcaatctttgcgagctcttcagcaacgcgatgagtatcacacgagccacttgttgcatccgcaacagtatataacctaccttacactttgttctcaacatccgtgcctgctctgtatggtcttgagtgaggatgtgcatcccatggagtccgtcgtcgccgccatggccattgccgtccgggctggggacattgcaggggcagcccaacttgccagtcaggcctccttcccgcttgcaatctctccatcagatatcagcatagtatcggctctgacccatggaggccaggctactgtgtggagcgccgtgtttcgggatccctctgcctcccaagaccagccaccctcccttgtggccctcaagcgtcccagcctccgcaccaccaccgacctcgacgccttccgacgcgaggtccagctgctgggcagcctcccccaccccaacctcgtcacccttgtgggggctcgcctgctgcctcccggctacttcatgctgacggcgctggaagccgggggcgacgctgccaggctgctgcacagagagggctggcgcccctccctggccctgctgtgccacctggggtcacaagcagcgagcgctctgtcgcacctgcacgcgcacggcatcgtccacaggttgctttcggtggcgcaggggatgactttggacatgtgtgtcgcgtggggctgggtccctcatgacacccatggcagagccggggggggggcctccctctgccatggcaacgcgaaacgctctgctccaccacatttccccagcacccgtctcccaaccctgctcagggatgtcaagccggcaaacatgctgctggacgccggccgtgccttcctcaagctggctgacctgggcatcgctctgtgctcggggtcgaggcatcatgaggaggccccacgggcccctggcaccggccagccctccggcggcttccacaagctgcacatggtgggcaccctggagtacctggcaccggaggtgctgttgggggcccggcacacccccgccagcgacatctactcgctgggcatctgcctgaacgagctggctaccgcacagcttccctacagcgacgcggagcgggacgacccgctcatgcagacctgcctggagatggggtacagcaggtgtgagaagatgagggagaaaggaataaagtggggtggggaggggacaggggtggtcaggctggatggcacagcaagaccagggctgttggcttcccttactggggatgccctgcactctcagctccacactgggccaggcaatgaagtacacccaggctgtccgtgctgtttgggagccactgtggagcagcagccgctgctctctctgggctccctccccttacaccacctcgtgtccctctttcctgggcctcatggcaatgccgccccacacgcacaggcaggacctgcgcgttgcgattgccagcggcggcctcaggcccagcgtggccccagatgccccgcccgagctcacccggctcatcagccagtgctgggtggcaggcgcgggcgagaggcccggcgcggcgcaggtggcccaggatctcgcccgcctcgccattgagctggcaggcaagggggaggaggcaggggccccgcggggcggctcgccaggtcctcccgtacttgtggccggggagaaggccgagtcgttcaggcacactccctctccactggaaagagggactgacgagatcgctaccccagaaaacggcggcctgggtctcgtcccgccatgggtccaggcctacgatcgcgatgggccagggcacgctcagccaggggcgccgctggggctgggagccaaagccgtggccggccggaggggggaggaccggatggaggaccgccacttcatcctgcccgacgtcctgccgcgaggcgccccggggccgccgcagagaagccgacacgcgctgctgggcgtgtttgacgggcaccgggggccccaggcggcacagtacctggcggagcgcctgccgggcctgctggagggcgcgctgcccggcagcagcggcgcggcggcctggctggcggccggcctggccgccgccgatgcaggcttctgctccgagtggggtgcaggtcgtgagaggtctgcgagggggggcgggccttgcccggggtccaccgcgctgctggtcctgctttcctgccgccgcgcggcgctggcctgggtgggggacgggcgcgccgtgctgtgcaggggcgggcgcgcgctggcgctgaccgccgagcatacgccgggactggagggggagcgggcgcggatcgcgagggcgggcgggcggctgacggggcgggaaggaggcctcaggctgggcgcagcggggctcagcgtgtccaggtgggccaggactggacgggaatggagtcgctaggaagagtggatgggcgtccaagtcgtgatagatgccggcctgggtgcaaggctgtgcaccagaggccgtgggagcaccaaacccaccctattcccacctcgcccttcaatccccagggccatcggcgacctggacctccggcaggacggcctgatccccgatgccgacaagctggaagtggacctccgcccccaggatgacttcgtgatccttgccagcgacgggttgtgggacgtgatgacgaatcaggaggcggtctgcctggtgcaggacacggtgaagcaccccactatgtgcgcccaggtaagcaaggctatgttttggtggaaagggaggggttacatgtgcaggcaagctgtgttaagatgcacacggtggactgctagcctttacaccccttctacagcatgtccctacttaccagggacatggtgggtgccctgtctttcaagtgccaaaccagggatgtaacctcccgtccccatcccttccccctcaaccttggacagcggctggtggaggcggccctggcgcggggatcgggggacaacatcacctgcattgtggccatgctggggctcggggaggaaagcatgcatgaagtagcatacagcaggggcgcccacaagtatgctggcggcggcctcggcgccccggccccatgagcagactgccggcaggggtgccagtactgccggtggcaatgaccgtttgcacgtgcagagcacctctgccgaggttgttgtaagatctctccaagagaggggcacagtgcagtgaaaccatctagcatttgcattcgataccaggaatattgcaggccacccaaaaggatgtcagtgggatcacacaggacgagccttgcgcgagctttcctcaaatttaaactggctgtgcaggagtccattacatttacatggtgtgattgtgtgagggtcagtacagtgcttgggtggtatgtgctgcctttgtcggcttctcagcagcagctgggtgaggtcaggaatgtgctgtgcagccaccaagcagcgagcaagaacgcctcatgctggggcagcggccggcatgcgttgggccccgccaccactcatgcaggcttggccttcttggcatcattgccagccttttgcttggccagggagtacagaccggtgcccgcaattgccagcatcgacccgatccagttcagggctgtgtgcggtggttgcgagggggcagcatgattaactgtggtgtagtgcttggggatgtcattcccagcaggccagtggtgcctggtcatatcacagcaatcataccgcagaagagggcctaaggggcgtggtggctcttgcacacctcattccttccctccgagggaaacaccacatgaggcatgcatccactccaaaccatctccctgccatctcagcggcccccgcccccccaacacacaaacacacctgacactgggttccggaagaagagcacggaggaggccaccaccgccacccgcttcatggtgttgcccaccgagaaggtgacgggggagatgccctggtccagcaccatgtaggatgcctggttgtagaggtggtagaagatgcccgcccccgccatcagcttgtagaactggggtgcgcccagggtggccacggcctggctccacatcgtgccccactggaacacgccgcccttgaaacctgaatgaatggaatcaaggtgaggaaagcatggagtcaagggtcgacagggttggggaaggggggggggccttgcctcagctctttttgcacggcaagcaggagcgaggatggttggcatgggggagtgtgctcccctgcccctacagcctaccggctccgaagcacacgcttgcatgccatgctcccaaaccaagggtagcctgcaggacccagcatgcatgctattctgcactgtagcacccccacaccaccctgtcaaacgcagccaaccttccaccgccagggccacaggcacggtgtagacaagggagatgaaggagagcagggcaaagaggttggtgccgtccaatttgttctgaggccaagcttgggggagggtggggtggtttccaggggtggacaggaaggtttcagggtgacgtcgccccgcgcgtcatgtgctactactcctggacagcatggcaccactccgccgtccagaccaacaagcccgccagccccaacaaaaagccacacccaccgtggcgtcacccaggctcttcttggacagcacgttgcgcatgaccatgccaaagttggagatcatggcgttgttgaagccggcccaagcgaaggacacctccttcatggccgacaaggagcagccgccgatgatgggcagcaggctggcccagacgtaccacgggttgacctcccccaggatgagctgggagagggccaccgacagcacgggctccgcggccttgaccacgtgcgcaaaggacacggccatgagggagaaggagacgcaggccgacacgtggccgatggtgtgggccagcgccacgggggccagcgccttgatgaggggccaggtgacggtgggggcggggtagagtcgcgtgatccacagcgtgcccatgaagacggccgaggtggcgagctggagggcggagatgcaccagggcgcggggaaggcgttcagcgcggacttgttcaggatgttgaacacgatgttgaagccgtaccagaggccgatatacagggtgacgcgcaggcccttggcgggggaggaggcgggcgcggggccgggggaggcgggtgaggtggaggaggaggcggggcagcccggcacccgggccgggacgacggggtgcaggctgggacgacggacctgcaagcgtggagattgtgtgattcgcaaggctcgctgattttgtgaacatgagcacggcagggagccgagcggaggggtgcgcggatggcatggagcctcaccatcgacagacctaccaggggcgccgggtgcacgatggaggtgcgcagcaagggttgtgccgtgcgcagcgatgaacacatcacacgcggctgaatgaggcagagggcattactcctcccaacagccatgggtgctggtatcaggggcttggatgcggcgcacaaggagctcatcatggctgtcaactgactgcgggactgggcgaccctcggaacacccttctgattcacaacgtcttgaacctggaattccgaggccaaagatcagtcgatgccgtgtgagaagcccttcctcatccctggcatggacgtcctcctcggtgccaagatgcccacactggatacttagcgagcttcgtcgcgatcccccgcgcgcgcgcgatggttgcggttcaagtggatcccggcgaacgtcgtatacaaaggatcgcgcgaagtacacctggatgcccctgactagatgattgatattttgaggtactaatgtaggtgtgtcgtctggccattggctccggcagtctatccagacatggcgaccttgcctgtgagcagcggtgccgtggccgctgcgtgccaggcacacgcaacggtcttcgaaaactacatatctgtgagttatttaaatgacccatgacatcgagggatgcactcgagcgccttgtttgttacccagtaacaatgttcgcacggggcaaggcccaccgtaccgctaccaactgccctcacatgcagagattcgaggcggtggtggagagcatcgcagacgtagccacgtaccaccaggtggcccaggagcccagcaaggtggggcgaggtgtgaggatgctgtgagagggggcaaagcaggggctgcacaggctgtcggtggttgtggccggctacaggatcttggcggctcaatctagtggaagctggtgtgaccaggactgcttttgaagcccccaaagcatcactactctatgctagcaggtcgaggctcttcgccgagccgtccaccaactggcgcagggggagtttgaggcggcaggcgtcaaggcgaagcttcgcgatgtggcgtacaggctgccagccaacccagacttgctaaagcacctgagcaccgaactccagcccccgacctcgtctgaggggtgagtctagcctgcaggagcctgtgacccggccgacgcgttcccggcatgtcgggttggcagtcgtttgtttctcccccgcccacaggtctccacccatggtgcctgtccagctctacaccttgacaccccacctccagccctgctcaggtttgaggcatgctccagtcggtctgccggcttgtttgaggccgcgctgaattcgttgagaggtgctggcacagaggggcggacttttggtgtttggggcgatatgcctgcatgcatgtatcaagggagattgccacgaactcctgctccgcgaggcggctggtcgggtcggccgacccccttcctgagcaggaagcgcgcaagattagtgccgtccactgacactggctgagccactctgctcctcaccggccttcagttgcctcgtgcgcggtcaggctggacgatgacatcgaggtcgaggatgggaataccctggctctgaacaacatctgcccgctctcgggccgccaggtgtggatggtggggggaaggggtgagggaggggattggggggggcgctggagaaggcatgggccccgtcgcaggagttgccgggtgaggctgccggagcatggcgcggcgcgagcggcggctacaacagccattccctccccatccacccgccggccccgacgtgtctgcagttgatggacctgaagaggccagtccaggaccgcattggcgtggtttatgaggaggaggcggtgctgcggtacctctacgaccaaggtggctttgccaaagaggccctctgcccgctggcgggtgggtgctggcgccgctcgcacatggtggtggttgtgtgtgcttgggtggtcgggtgcttgctagatgcatgcgggggctgcaccacggatcgcctgcgcgtgacggcgtggggcttgcctgcgccccccaggctgccggccgttggcccagctggcacgacatccccattgagccgcgccaccccgtacaggcacgacgcacacgttgacaaaggagagcctgcagcctgcacgcaaggtactggacgtgcagcgagcggccgcgcgagccgcgacacgggcgagggcgccgacgcaggtccagacgcaagaggaggtgatcgtggaggtatgacgtctggattgctgtactcacgttggcatggctgcagcatattccctgttgcctggctctcagcaagggcctgcattccttctgctgctggacggccttccagagggaatgacacacagacacatggtcgcgactccatgtgcgcgcgtcgcgctcaacaaactttgcggcgagcgtatgtgggtgaggcacgcattccctttcttatttcttgtatctatcaaataggcttgaacaataaagatatcaggggaccggaagtatccactccatccacgccctcgaggaacaagtcaccgccaatcccctgcgaagttggactaatgggcctgtgcatgcgcgtaatgtgactccacccctccaaagaccacagcgcatctatgaacacctgatgctgtcgtcgcggagcgggccaaactcacctactgtgctcccctggtggtggcgatgctgacgtattcccgcaagaagcgggtgcacgccccagggggcaaccttcggcctgaaagcccgctatatagatctcaaaccaggtgtgaagccactctcccacttctgccgtggcccgaccgccgatggccctcgcccacacccaccaaccccaccccctcctccaccgttcaggcagagggccggctcacgcctctggcagtttgtgggattggtggccgccctcattgcagccaggttcctcctgtacacctactttttccagacaccgtcgaccctggttgtgtatgtggccgggtatgaagacccagaaaactttgtcaacgtcaacttcttcctgacccagggcattcggtgcgtcgggcgcggttgccctgcggcccatgcagaccggcgcaggctggtagcctgcgttacgggggcgctgggcggggtgtgatcccttgcatgcccgccctcaccatcatagggtccgctcactccttccaaaggtcgcctgtccaccccacccaacccaccgggaaacacgtgtcgctcatgcagggagggtgatggtgcgcactacgtcatagcggttgagcccgactactacctggagatcatggagctcttccccgcgaaactgcccagcaatgtgcagatcgtgcgggtggggctgcgctgctacaattttggcactgtgggctgggtgctgcagaacgccggcctggacctgacgcggttcaagtactttgtctggctggacagtagtgtccgcggccctttcctccccgtctatgctagccaggtgaggggtagacgggggtgtggcggcgcggtgggctccannnnnnnnnncagtgtccgcggccctttcctccccgtctatactagccaggtgaggggttgacgggggtgtggcggcgcgatgggctccaaggaagaaggggaaagtggaggaggggcggggagggcaatcacagtgctgcataatcatgactgggcgggcatggcaacgtcggtcgtgggcgagtgtgagtgctctccctggggctgcttcgtttggggctgctgctaccctccacgcttgtcgtcggccaagctaatcctcccctccccgggttcgtggcgcagaagccctggcacgcgcagctgacggggctgatcacccaggagaccaagctggtgggggccaccatctcctgcgctgggatcaaactgaacatcgagcaccccacgttgcacgtgccccatgttcaggtgtgtggctttcggagctgggtggaggggtacagtgcggcgggcggagggggggcggcctgggatgggggggtccgagtgcctgggacatgctcgcaggcgcccaccacatgcacgctnnnnnnnnnncctgtggacctccggcgctgtcccccatcggtggcgccccgtgcgtcgacaccagcgctccttcagtcaccaccacccctccacatccccctgcaccccggtttccccaccccccgcgtctccnnnnnnnnnnactttttggagctgggtggaggggtacagtgcagcgggcagaggggggggcggcctgggatggggggggttgagtgcctgggagatgctcgcaggcgcccaccacatgcacgcttgtcgatcgcgcctcactcgggcaatggcagcccatcgcagccccagcatgcaaatggtggatgtcactgtggacctccggcacagttccccccccggtggcgccacgtgcgtcgacacgagcgctccttcagtcaccgccccccctccacatccccctacaccccggtttccccaccccccgcgtctcccgctcctacagggctacctccaggccaccgaccacgtgggcctgaagatcctgcagggcacgccctttgcctcgggcgtgttctcctgccaccagaactggctggtgggcgtgcgctggtcggaggtgggcgccagcgaggcggtgttgcgcgccgggttcaacatcgggtcgctcatgctgcgctacgctggcgtggactggcgggacgagggcgtgtggacctgcaaccgcggcatgaacccgctgctggaccgcgggtacgacggcgccaatgcgcacccgctggaggtcatgtttgtgaaggtgcagcaccaccaggtggtcacccgcagccccgcggtggtccccgccctgcagtaccacgtctggcgcctggagaaccggaccgcgggcgcacgcgacgtggcacgcaacgccttccacgacatggcgggcgtgcacctggcgggcatcaccgccaaggggcccgcctgcttcgacgccgagatgtacatcgccgccgcgccggcggagtttgcggggtgagggggagggagtggagggggagggggaagggaactccccgcagggaacagacggtcaagcggaggggtgggcccttggatcggcgagcgggcgggcggggggaggaccaccataaaatgatcgggggggtggccccggcaaatgtcgttgtaaccatgatggcagcgaggccaggccacaaggtcgctttttggagtactccc

SEQ ID NO: 43340 - DNA, 128 bp, Chlorella protothecoides
gaggggatggattggtttggattcccaggggggaggcagcgatgggcggcgatgggaggagacaggatgggcggggcgcgatcgtcgggcgcgggcaggatgtacgctggcgcggaggggccggcgat

SEQ ID NO: 43341 - DNA, 35409 bp, Chlorella protothecoides
  modified_base (2080)..(2089): a, c, t, g, unknown or other
  modified_base (2323)..(2332): a, c, t, g, unknown or other
  modified_base (2494)..(2503): a, c, t, g, unknown or other
  modified_base (2786)..(2795): a, c, t, g, unknown or other
  modified_base (2914)..(2923): a, c, t, g, unknown or other
  modified_base (3239)..(3248): a, c, t, g, unknown or other
  modified_base (3816)..(3923): a, c, t, g, unknown or other
  modified_base (5118)..(5127): a, c, t, g, unknown or other
  modified_base (5657)..(5803): a, c, t, g, unknown or other
  modified_base (6020)..(6029): a, c, t, g, unknown or other
  modified_base (6909)..(6918): a, c, t, g, unknown or other
  modified_base (7049)..(7175): a, c, t, g, unknown or other
  modified_base (7417)..(7426): a, c, t, g, unknown or other
  modified_base (8531)..(8540): a, c, t, g, unknown or other
  modified_base (9165)..(9174): a, c, t, g, unknown or other
  modified_base (9247)..(9256): a, c, t, g, unknown or other
  modified_base (9853)..(9862): a, c, t, g, unknown or other
  modified_base (10923)..(10932): a, c, t, g, unknown or other
  modified_base (11344)..(11353): a, c, t, g, unknown or other
  modified_base (11800)..(11809): a, c, t, g, unknown or other
  modified_base (11904)..(11913): a, c, t, g, unknown or other
  modified_base (13772)..(13781): a, c, t, g, unknown or other
  modified_base (14221)..(14230): a, c, t, g, unknown or other
  modified_base (15047)..(15056): a, c, t, g, unknown or other
  modified_base (15458)..(15467): a, c, t, g, unknown or other
  modified_base (16355)..(16364): a, c, t, g, unknown or other
  modified_base (16773)..(16782): a, c, t, g, unknown or other
  modified_base (16887)..(16986): a, c, t, g, unknown or other
  modified_base (17079)..(17088): a, c, t, g, unknown or other
  modified_base (17664)..(17673): a, c, t, g, unknown or other
  modified_base (18253)..(18262): a, c, t, g, unknown or other
  modified_base (18705)..(18714): a, c, t, g, unknown or other
  modified_base (18907)..(18916): a, c, t, g, unknown or other
  modified_base (19501)..(19510): a, c, t, g, unknown or other
  modified_base (19953)..(19962): a, c, t, g, unknown or other
  modified_base (20262)..(20271): a, c, t, g, unknown or other
  modified_base (20397)..(20564): a, c, t, g, unknown or other
  modified_base (20631)..(20640): a, c, t, g, unknown or other
  modified_base (20696)..(20705): a, c, t, g, unknown or other
  modified_base (21020)..(21236): a, c, t, g, unknown or other
  modified_base (21370)..(21379): a, c, t, g, unknown or other
  modified_base (21787)..(21796): a, c, t, g, unknown or other
  modified_base (22437)..(22446): a, c, t, g, unknown or other
  modified_base (22949)..(22958): a, c, t, g, unknown or other
  modified_base (23130)..(23139): a, c, t, g, unknown or other
  modified_base (23386)..(23395): a, c, t, g, unknown or other
  modified_base (23628)..(23637): a, c, t, g, unknown or other
  modified_base (24132)..(24320): a, c, t, g, unknown or other
  modified_base (24414)..(24513): a, c, t, g, unknown or other
  modified_base (24581)..(24590): a, c, t, g, unknown or other
  modified_base (24813)..(24822): a, c, t, g, unknown or other
  modified_base (26768)..(26777): a, c, t, g, unknown or other
  modified_base (27411)..(27420): a, c, t, g, unknown or other
  modified_base (27993)..(28002): a, c, t, g, unknown or other
  modified_base (28841)..(28850): a, c, t, g, unknown or other
  modified_base (29418)..(29427): a, c, t, g, unknown or other
  modified_base (30876)..(30885): a, c, t, g, unknown or other
  modified_base (31132)..(31141): a, c, t, g, unknown or other
  modified_base (31716)..(31725): a, c, t, g, unknown or other
  modified_base (32413)..(32422): a, c, t, g, unknown or other
  modified_base (32617)..(32626): a, c, t, g, unknown or other
  modified_base (32769)..(32778): a, c, t, g, unknown or other
  modified_base (32841)..(32850): a, c, t, g, unknown or other
  modified_base (33642)..(33651): a, c, t, g, unknown or other
  modified_base (34483)..(34492): a, c, t, g, unknown or other
  modified_base (34645)..(34654): a, c, t, g, unknown or other
  modified_base (35305)..(35314): a, c, t, g, unknown or other
gctggccgcgggccggggcgcgcccgccaccttccccgcgttgctcgcgctgccggcggcgcagctgcgcgccgcgcgcgccgacctgccgccagccgtggcagagggcctggccgcgcacgcgctccgtgagacgcatgcgctgccccgggagacggtcgcgctgttccgggagggctgacgtggcggtcggtgcgggcgggaggctggcagtgctagatgcccgccctgtgagacccgacggcggcggcaaggtcgcatgcatttctcagaacatgcgccggcggttcttgctccagagcgcggcacaggcatggcactcccgtgtcttcaggccggctccggggcagcacatgtgagccactgcccaaaccactctattgagactgacaactgagattactctacagcgggtggccatgtgcagtgaccatgaggaaaggagcaggtgcagggtgccgtggcggcctcgtgtctgagcaggcaagggggaaactgttctcgagaagagtgcaagggactcgtgggatgaggtttccatccaaacatgggacctgcgcaccagagccccgtcctgcaggggtttgagcctgcggcgccacccacgcacgcacactcctcctactcgcccccacccccctccccttcgtcggcgcccggcgcgtcagctggccgcggccttctccctcgcctgctcgctgttcaccgcatccagcaccggctgcagctcggcagcggtgaacacccggtacacgagccggccggcgtcggtgcgggacagcgtggccaactctaccttgtcgggggtcagcgtggtgctgtccatggtcttgctcatcaccttgatcaccaggcgcacagcctgtgagagagggaggagtgggtgggtgagctttgtcatgtttggcaacgacatctgcaacatggccatgcatgggagtgttgatttgattctttgaataagccatgccaggctgcccaccccggaagggatctcgatgagagaccagtgccctgcaggtcccaggctgcagcgctgcctgcagaacaccctcgatggaccatcactggaccgaggatatggtcgacgttatcactgccccacccctaacccctgcggcctcaacaactcaaccaccaaccaaccctcacccgctccaggtcaacatcctcggcgtagtcgccctgcagcacgttggtagccgcctggtggtttgcgccgatgctggtggccttccagccgccatagttgccgctggggtcggactggtagagctggaagccgcggtgctcgtcccagccggcgtacagcagggacacgccaaaggggcgcaggccgccgtactgcgtgtacccctgcttggtgtcgcacagcgcgcgcaccagctggtccacggggatgggttcttggaactgcagtgtataccgttgggcgtgcagccggcacgtgttcaccaggatgttggcgtcggcggtgatccccgccaccgcgcaggccacatggtcgtccagctggtacagcttctcccgcttgacccccaccgcagtggtgtccagcagctgcgggtcgagggggggagtgcagggtgaggacgcggtcgcggctggtgtctgggtcgggagtagggtgaagcacagggacaccaacaccacacccccgcacgcaccttggaggtgatctttttctccgctgccaggaccacgccatccgtggccaggactcctacgcacgacccggcattggagatggcctccatcgcatacctgcacgcatacacggaagcaccgggcgatcaggagcgtgcgggcggtgatggtgatccacgggaccccggacacaggctccggctcactctacttggtatagacgcccctcgggactgaatatcgttgtgcgactgtcatatctccgagacatggcgccggaccggcagccaacttcagaatcgtggggtgatcctgggggagaacctgctcaggaaggacgcgcgatccgtagattgtgatcgccttcaccccgtgattccaagtgtttggaaaactttaaactgctcaaggtgttcgtgattccctcaccctnnnnnnnnnncccggcagccaccttcagaatcgtggggtgatcctggggcaggacctgctcaggaaggacgcgcgatccgtagattgtgatcgccttcaccccgtgatttcaagtgtttggaaagctttaaattgctcaaggtgttcgtgattccctcaccctcctgcatgggtggcgttacttagcagggtccccggagcccgggttctgatggggggcagcatgcccagcagcaggaccagnnnnnnnnnntgttacttggcagggtccccggagcccggatttttagggggggcagcatgcccagcagcaggaccaggttgccactttgggatgtgcacgctgcggtcccggggtccgaatccttacaacattgcatttattgtgcatgggccaagaagcttctgaattgcnnnnnnnnnnaaatccttacaacattgcatttactgtgcatgggccaagaagcttctgaattgcatcacgccccttcccagcggtcgccgtcgtcgtcgtcgccgcgcctcagtctcctgtcacggatgtccagcacctccctgggcgacatggggggagagcgttgccgctccctccttcttgggccgggcgaaccagggggtgagcgctgccgctccctcttcatccggtccctctcgcccctggagcgccgtttgctgggaccgctcccggccgccagcatggccggggnnnnnnnnnnggggggaatggggatgtagatttgtctgggcgtgcagtggggcccttgccaagctcacccatggcgccgcccccgggcaaaaccctcccctagaggccctggcacaggtcacagcaccnnnnnnnnnncatcttgccatgcctatcagcctgcacagtcaagtgccccagccggctcatgtgctgccaggcagggaaagggggaatggggatgtagatatgtctgggcgtgcagcggggcccttgccaagctcacccacggcgccgcccccgggcaaaaccctccccttcctagaggccctggcacaggtcacagcaccggtgcgtcctggtggacagctcctttgcagcgcccccccgccagcctaaggactcgtcacatccctgcgccccactccctcctccacgtgcctaacctcgcacagtgtggcaaatgtgtccccgnnnnnnnnnngctaaggactcgttacatccccgcgccccactccctcctccacgtgcctcacctcgcacagtgtggcaaatgtgtccccggtgtccctcttgacatcccagtcggggttccttttcctcaatgtatcggccaagaagctgaggttcatgggtaggggcttcacggccacagtctccttgagggccgccacaaactgctcttggatcctgtgcacgtaagggatttttgggcgcggggccacgctgggcggggggtgcgaaagagtggagccgggcgacacatcgcgtcgattttcgagtgccaccggttggatcccctcgctggcgtgccagatacaacacccttgccagccatggcgcacgccggagatcagcagcggcccagcgccggccgccaggcacctgctgtcggccactctgccattcgtgggccgtcttgagcggcactacaacatcccagcccagacgccgcctcacctgaccgaaaggtggcgctccccacgcggcactggggacagacgagacgggccaggcgaggcctggcgcgacggactggccctccgcccgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncggcggctctcgcagcacgtccagggggctccggctgcggctgcggcgccgcgacgggcccacgtcctccccgcccctcgacagcttgcgctcggggctgcgcggcgcgtccctctccgccccgcgccgctcacaccagccctgctgcgccgggggcccctcggcccgctcggcccgcgcctcgtcagcaacaccgcggcccgcccgctgccgacccgcgggctcctgcccgccgtcgcgatcccgggtccgccgcgcagcctccgccatatcctccctagcgccgcgcgggccagtggttgcggctgccttccgctcctcgcgcgcggggcgctcgctcaattcgccacgagggcgggcggccgccgcggcctcgcggtcctcgccagtggtgcgctccctcgacccgccacgcctcccccgcgtgcccgctcccgcccctcgcgcttccggtgacctgcgtccctccacctgccgcgccctcttcgcggcggccggcgaccggctgcgcccacgtgtcgggctgcggcccctcctcctctcctcctgcccgccgcgttcggcgggcctggcgcgtgcctgctgggactcgcggtcgtcggcggggcgactcgcgtccgcgcggtgacgttctgggtcggaagaccgcgcgccgctggccggggcgccgttgccggccggcgcctggggtccagcggcggccggctgcgctgcctgcagcgaggcagcggcgacctgctgcgccttctggacggcggccgtggctgccaggcgctcggcctgggctcgcagccgctcctgcgcagaaggtggcgggccgggtcggtgcggcgccgtggtcaaaggctccaggtgatctgctcatccgggggcaagctgcagcgcctgcgcccctcatgaatgagattcccgcagacgcttgggcatgcacgccaaggagacgctgcttctactgctcagggttgcgtccaggatcgtggcaccacacaaaccggcgacatcgttcaagtagcggtcttcaggtgcccactcagcctctacgccatctaccctacagccacacttattttccgagagtcctccaacctacccctgccccatgtgcgaaccctcctcctacctcctccacttcgtcctgaaacttcttcaggccgacactggccttggaccggaccttgccaatgacgcggctggnnnnnnnnnnaaaccctcatcctacctcctccacttcgtcctggaacttcttcaggccaacactggccttggaccggaccttgccgatgacgcggctggtggagaccagcttgtcgtcggccgcctcccgctcctccaccgccgtggccagcctgccctcggccacggcaatggccttgcgcgcgtcgcgctcctccccctccgcctcgtggatggcgcgcagggtctggggtagctgccgctcgcgggactcccacaccgcggcgaagtgggcggccaggaccttggcagcctggagcgcggcgtccacgtcgtcccggtgctcccgggcctgccggcactgagacgcgcaggtggtgaggtggagccgggcgaggtcgagccggtcctgagcggcctgcacctcccgggcagccctctgcgatgaaaagcggcgaaggttgaaaggtgcggccccgggacggacgagcagtacatttctacacatatctctctagagaccacgtctaacctcttgctgccgcctggcctcatcctccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagaatgttttcaaatgtggcacatcgcacacatcgaggatgatattcacaggctcgtagttcgcaactcccgtgcgatcatgcaccgcatgtacagcgcgcgcaaagtgacacagatcgagttccaccttgtcgaactctgtccagcaaggcgatgggacaattacggtctcgtatgaatgtaacctgtagtgctcatttgttgtccatggtggagnnnnnnnnnnggaaggttgaaaggtgcggccctgggacggacgagcagtacatttctacacatgtctctctagagaccacatcttacctcttgctgccgcctggcctcatcctccaacttcttgcatcggtccagttccgcctccagagctcccggagggagaaagcccaccgacatcgcgcgccctgctcctgcaggcccaaatcccagctattgagggcttcgaggggaatggtttcaactgtggcacatcacacacatcgaggatgatattcacaggctcgtaattcgcaactccagtgcgatcatgcaccgcatgtaaagcgcgcgcaaagtgacacacatcgagttccatcttgtcgaaccctgtccagcaaggtgatgggacaattacggtctcgtatgaatctaccctgtagcgctcatttgttgtccatggtggagacctgccgtcggctgctcgtcggctgaggagccacatgggcgatacatccccaggggagacgctccccagttctccagccggtttcgtcacctttcgattattggtggatgctgagaggtgagttggtgggaggtggacccaggcagcttggatgggaactctaaaagcttgaactacctcacaactgtgctgtcgctggattgaaacttcctcagcctgcaactcctcctcggtgatcaggatacccagcttcccctccgagaagaagctttccattgcctgtctggacaaccaagcccgcctggtgacggcagatggccaggtcagatgccgggatgcttgcagggcagggaaggtgtgtcctgcgcacagggactcgccgatgactacctttcgttgctcccccattcctaccccccacaggtggcagcctctggaagcctcnnnnnnnnnnattggtgggagatggacccagggagcttgggtaggaactctaaaagcttgaactaccgcacaactgtgctgtcgctggattgaaatctcctcagcctgccactcctcctcggtgatcaggatacccagctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctcgccaatgactacctttcgtaactcccccattcctaacccccacaggtggcagcctctggaagcctcaagctcaggcacggcctgaatgccgtcccacgtgccgtctcttggctggtgtgcgatgccagggtggagctgggaccgccctcgctggagtggtgcgatggtgccccgccacccaaccctgccaagcgcactaggagcggcggcagccaggctgcggcaggagcccgggacnnnnnnnnnntgccacccaaccccgccaagcgcgctaggagcggtggcagccaggctgcggcaggagcccgggacccgcgatcacagctggccctgctcgccacagtctccgtgaccctcctcccggccttcttcgaccctgcgccctgtccagaggtgggtcggccgcttgccgcttggcggcaagatgacggagggcgggagtttgggcgtgaacacccctgaatgcagcacgtggccatgagctacctgtgcctccaacccgaactgcgagttagacaaagcaacccgccccacgagcgaatcccccacctgtattacctttgctctcctgccaggcggcagaggccaccctggtgctaatggagcactggctcgcggacatggaggcagagcccgccgaggacggcgaggacggcaattcctgggccttcaaccccagggcccgcatcttccagctggcccacccaggggactggcaggccgagcaacctcagcccgagggtgaggcaaagggtggagtgaattgggcctgccttgacgtggcttgggtgggagaggatgtgggggggttggcactgcgaggtgcctgcccagcagggcattcagaggtctcccagcgctgcacatctgtgcttcctactcctgcatgtgaggctgcctcccacccaccccttccgaaattgccacgcaggcctcctgtgccacctgttccgataccagcggcgcgcgctgcgctggatgctgtggcgcgagagtttccgaccagggtcggagtcccgcagtcccgaccccgacagcgtgcgctccacggtgcagagcctgggccgcctataccagcccacccgcctgccaggcgggcaggaggtgcactacgacgccttggaggggtccgtcagcgccgcgccgtgtgatgatgcggcgccacaggtgccgggaggcctgctctgtgacgagatgggcctgggcaagacggtgcgctggtgtggggggtggggggggaggtggaagaggggctggcatggccgggggcctttgccagtggcttcatgcgtgctgcacaatacatgcaggggcaatggaccttgtgtgccggtcaccaccaccagtcgccnnnnnnnnnnacgtggggtggtgggatgggggttggaagaggggctggcatggccggggacctttgccagtggcttcatgcgtgctgcacgatacacgcaggggcaatggagcttgtgtgccggtcaccaccaccagtcgcccctgtgcaacacaggtggagatcatcgcgctcatcctggcgaatcctcgccccgccgcagctcctgatgccgagaagggcgtcctacccaacggcttctctcacaggcctgcagagtcagcgtcacctcccgtcgaccctggcgacccgccgcccgcccccctcgcgtccagtccccatgccgacaaccagcgcatgcccgggggcacgctggtcgtctgccccccggccctggtgcagcagtggcgtgctgagctggcagcccacgcggggccgggcgtggcggtggctgtgtacgacggcttgcggggactggcacccctgacccccgcggagtcgcgccagaccatggtgcgcctgggggttgtttgagaaggaaggggggttgcggggttgggggggtgcaactcttgacccaggggcgtgttcggcgtgcctcgcacctttccgtgctggccagattgccccgcacccaccttcttcctttcccatgnnnnnnnnnnccgtccaacgcccatgccgacaaccagcgcatgccgggggggacgctggtcgtctgccccccggccctggtgnnnnnnnnnnagattgggggggtgcaactctggacccaggggcgtgtgcggcgtgcctcgcacctttccgtgatggccagatcgccccgcacccaccttcttcctttcccatgccggactgtgctgacaccacctgtccccccactttcctccccggtgccaactccgcgcaggcgcagcgcgaggcggagctgtacagccggctggccgcaggcgaggcgccctggccctccttctcgccggaggccgaggcgggcgaggcggccgccaagctgcgcgccgcggacgtcgtgctgaccacctttgaggtgctgaagcaggaggtgcactactcgccggacaacaagctgctggggtcgctgcgctacgccaagcggtaccacgtgccggtctgccccctgctccaggttagagggtggggctgatgcgccaggtggcggcgcgtggcagggggtacatggagggtggagggggagggtgacagccagggcaagatgcaggctctcgaggtcgcggctgtgccatccacactcgcgacgctgcgtgttcacgtcccgacacctcgccgctctccccctgggcttcccctccaacgccattttctccnnnnnnnnnncgtgccacccacgctcgcgacgctgcgtgttcccgtcccgacacctcgccgctctccctctgggcttcccctccaacgccattttctccgtcgctcgtccccccaaccaccaccccccgccacaaaacaagcacagatccgctggtggcggctggtggtcgacgaggcgcagatggtgggcccgctgtcggcggcgggggccatggtggagcgcatgtccgcggcccaccgctggtgcgtcaccggcacgccgctgggcggcttccacgagctggacgacctgcacggcctgctgatcgcgctgggccacgacccgctgggcggctccgaggcctggcgccgcctggtgcgccgccgcctggccgcggggcgcggcgacctggcctggcgcgcgctgcgcgccgcgctgctgcccctgctctggcgcagcaccaaggcggtggtggcggaggagcacgcgctgccgccgcgcagcctggctgcctcgcgcctcgccttccagccgggcgaggccgagttctacggccaggtgctggagcgcacgcgcgacgcgcgcgcgcgcctgcgcttcctgcaggaggcggcgggcggggctggggagggtgtcgtggggcgcgcgggccaggcgcaggggcaccgcaagaaggccaagacggggctgagcagggcggaggaggaggcgctggcgggcgcgacgcagctgcgcctggcctgtacccacccgcagctgacgcggcactggaagaacctgcagagcgacctgcagctgactctgggcgggacgctcagcatggaggtgggggcgggcaggcattcactggggtcgaaggggtaccacaccaagggggtgggcctccggcagctgcacgagaataatacatctcaacgccagagcggcacctgtgccctgcttcgtccaattctagccatctttttgagcaattggtcgcaccatacaagtgcccgcctcccaatgctccagatacccttccaccccttacaaatgcacacaaaacacacacatacatacctgcaagcaggaaatcatgcagcgcctggtnnnnnnnnnntactggggtcaaaggggtaccacaccaggtgggggggcctccggcagctgcacgagggtaatacgtctcaacgccagggtggcacctgtgccctgcctcgtccagttctggccatatttttgagcaattggtcgcaccatataattgcctgcctcccaatgctccagatacacttccaccccttatacatgtacacaacacgcacacatacatatctgcaagcaggaaatcatgcagcgcctggtggacaaggcccagttcgagctgcagaacctggagcgcgccctgtgcgccaccctgaacaccctggccctggtgctggtggagagcgtggcgaccggagccggtgcagaggatgccagccccggagcggtggacggggaggtcagggtggaggtgaagagggaggtgnnnnnnnnnnagagccggcgcagaggacgccaaccccggagcggtggacggagaggtcagggtggaggtgaagagggaggtgaaggcgggccagttgcccccggagggccaccctccgccctccgcagcgctcgggtcggggactgcagagccaaagtcgcccacggccgcgggcggcacggtgtccacttcgacccaaaaacgcaggcgctcggtgccggggaggctgagcgccgacgaggcgaggagggaagccatcaagctgctggagcagtccttcaggtgtggaagggaggagtaaatggtgttctcgttctctgattgggtgtgtttttgcaattatgtttctgcctccaagggttgcagagtcgggttcactgtgtggcgggtgcctgccgtcgatgcagtgattgcaaattgtacaagaaagcattccacccgaccagattcccatgtnnnnnnnnnnatcgctgtacggcgccgagggacgcgccgaggacagtgcggccatggagcgcgacgcgcgggagaaggccgcctacgtccgcgccgcggcggagnnnnnnnnnntagtgattgcaatttgcacaagaaaagcattccacccgaccagattcccatgtcctacctcgtctatcctcgcaccatccagggtggcggagaagggcatcgaggccgcggaccggccaatggaggccctggccgcgatgcctgacatcccctccgacgcctcggccacggtgcacgcctggaaactgctccagctgaacaccgcggcccagctggcgtcgctgtacggcgccgagggccgcaccgaggacggcgcggccatggagcgcgacgcgcgggacaaggccgcctacgtccgcgccgcggcggagatggaggtgacgcaggtggagtcgcgcctggcccagaccgcggggcagtacgccggcgcggcgcgcgtcctggactcggggtggcgcgccgccgtggccgccggcttcccccgggcctggggcctggaccccgcgccggacccggctgcctggctggccggcgtgcgtgcggcctttgccgcggagcaggcggcggaggcggcggagctggagcaccaggcctccgcggtggagcacatgctgggcacgcgcgtgcagaagctgctggcgcacctggacaccggcctgcagggcgggctgggcgcgctggagcgccacgtcaacggcgcgctggcggaggcgcaggtggcgcggatgcagaggacgctggccagcctgacgggtgagcggtgttactgttgaatgtctgttggtgccagggaggaaagaagggaaatccgggatggaaaaggtgggaatggacttcgtcctggttgattccatagatggcagggtggcaaagcatgggtgttgggcgaagaggtctgtcgaggggctttcatgtgtcgcagctatactccgcctgccacacgcccctcaccccccgccccaacccctccacaaatgcagagctgtcgacggaggcggagctcaaggcggcatgtgagagcgccatgccggtcctctccctgctgcacgactaccagcgccgccgcatcatgtcgcagtggttctacctgctccccgcagaggcggtggaggggcgccgcggccgggcgcgccccggatcacgggctgggcccgaggccaggggagtcctgcaggaaactgacgacggaaatggagcggagcagcagtgcggcgagagacccagcaccggtgccggagacctgcccgcagtgctcgacggcgaggccgccgagctgcggcggctgctggcggagcaggcggcccccttccatgcggcatcagcttggatgggcgcggcggcagggtatgttttcaagctgggcgaggctgggctgggctactacgcggacactcccgtggaggctgccccgctgtacaccccaaccctggtgagaggcctctctgctttccaagaggcggtcgaccgcactgcgccctcgccaatggtcatggtataatgcagctgacgccatgatgaccacatcgcctagcctcccgcatcgccgatgcccaagcatccccccatcctggtcttcttatgctcctgagcaggtgaagtcgtgcctgcaggcggtcctgcgcgtcgccaccgagcacgtgaagaagctggcccggggtcaggctcccgaagacatgggcctgctgagtcggctccccctccccgcctgcgaggcccgcctcgaggccatgcgcagccaggtgcgtgctgcgtggtgctttgtgcatggtgagggggaggtgactgatggaaccagccgcacccccttcgtagaacaggtgtggggaatcagggtgcacaaggtctactgcattgtcagagcacccaactgcatccatcgcccggcgcccgccacccacacccaaccaggtgcacctgcnnnnnnnnnntcagccgcacctccttcgttgaacaggtgtggggaatcagcgtgcacaaggttcactgcatcgtcaggttacccaactgcttccatcacccggcgcacgccacccacacccaaccaggtgcacctgctgcgcctgctgcgcgaagagcacgtgcaggaggccgccctgcggctgcgcagggcccagctggcggacaccgatgccacgctggcggcggcagccgcggacccgccggagaagcgggcggggcccgaggtcttgcgccgccgggtggagagcctgaaggcggaggccctggagctggccgcgcggaggcggtacatggcgggacgcgcagaggaggccaagcaggcgctggaactcccgggattggccggcatgggtgcagctggaacgagcgccgacgccccggcggccgggccgacgtcgcagggcacctnnnnnnnnnnaaggcgctggagctcccgggattgtccggcacggatgcagctggaacgagcgccgacgcctcggcggccgggccgacgtcgcagggcacctctgcagccggtcaggccccagggcctcaggggcccgccggggcgcagacgtcggacgcccctccgccctcccaagcgcagcgcgcgccgaccgcgccggctctgcgtggcacggagtgccccatctgctacgaggtcatcggggagggcgaggacgtgtacgtcttcggcggctgcggccactccttctgcaaggagtgctcggcgcagcaggtgctgcagtccgggcgctgcgccgtctgccgcgcgcgcgtgacgggaaagcaggtcttcagggtggcggcctcctgcaccgccgacgtcagcgccaccgaggcatgcgaccccgacgctaggctgcaccccacggtgggcgcctgggtgtcgtgggcccagctccgccccgctggctgggcctcgaaggtgggccagccaaccgcacctcacacccacccacccctgcgatcccctgccctcccgcaggtggcgcccgtgcgcggggagtggagcatcaagatcacggccctgctgcgccgggtcctgcacctgcaggagactgcgccccaggagaagtccctcgtgttctcccaggtagtaggttgatgggaggggggggggaggagggtctggaatcaggagacaaacaccccccctgaatgaaacttcagcacaaggggtatcatgcaagcttgtgaaacacgtccacactcctgcagtagggttggaagaggtcggatagaccaacacnnnnnnnnnnacacctcccctgaatgaaacttcagcacaaggggtaccatgcaagcctgtgaaacacgtccacactcctgcaggagggttggaagaggtcggatagaccaacacccccttcacccagcacattcccgctttcctccaccacatccccagcatgtggcggcgctggacctggtggctctggccctgcagaccaacggcatcaagcacgtggccctggtcggaggccgaggggtgggtctggctgcctgggcgcgtggagagggagagggggggccggctgcatcgtcatgaggcaggtgcttttgcctgtgtcccagcaatggctcgaggacgctctgttcacaatcctggccccctctgagaacacctcctcctcacgctcccgggcctgcagaccgtgcgnnnnnnnnnntgaggacgctctgttcacgatcttggccccctctgagaacacacccccctcacgctcccgggcctgcagaccgtgcgcaaggccatcgctgatttcagggacgacgacgaggtccgcgtgttcctgctttctcaccgcgccggagcagcaggtgcgcggtgcggtcttgcgacgcaagccaggcgatgcgagtgttggcagggtcgattaggagagggaatggttgctcgagggaaggtggggccgcggtctggtgcgtcagacggctgacgtttctcctccctccggctcccgttggcactctctgcactgttcctacctctgtccccctgacaccttgaaactccatctacctcgacagatccttccccatccaccgcacccaccccctaccccaggcctgacgctggtgcgtgccaaccacgtcttcctgctggagccgtcgctggacccagccatcgagcagcaggccgtagctcgggtccaccgcattggccagatccgccccgtctgcgtgcatcgcctgctggtgggtgccagtatcgaggaggtggtgctggcgcggcaggaggccaagcaggcgctgttcgtccccggcgcggacccggcgggggacgccgaggaggccaccaccctggagaccgccgcccggccggagacggtgggcagggctgaggtggacaacctcctggacgaggtgctctgagcgggtactgcagggtgcggggaggaggcactgtcatccaaacgatgtgcgctgcgaggcggtgacgcccctggcttgaggagcgctgcgttgaagtgaggctccgccggggatgatgggccacgagagagcatggccatgcctggcgcaagaacaagtcaccaatcccagcccagccaccnnnnnnnnnnggatgggccacgagtgagcatggccatgcctagcgcaggaacaagtcaccaatcccagcccagccacccaaagagtcgcgctagacgcaccgcgcgcgaagggtgcttctccctccaactctgacgatcgccacaagaacgtcgcgaacccgcgacaagcaggcggctggacttgtatgtcatctgccaggccagcttctctcccgtcacctgacatgaaattgtacaatcaccggctgtactgcacctgctcagcctgttggcaatgactgaccacagctgtgaccccctgataagccaatgacggaatggttgttgaagtcacttggggacgtatacccaaggtacacctcaagggcacctcatcatctcgtctggcagccaggaaagccccagctgtttgggaccnnnnnnnnnnaggactggttgttgaagtcactaggggacgtatacccaagatacacctcaggggcacctcatcatctcgtcagacagccaggaaagccccagctgtttgggaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcaccttacacaattgagcatctacacagggggccgtctcaggtggtcaaaggagcaacgaagatttgaatcagctagatcacctctgggannnnnnnnnntctagaattgcacagccgtcgtgtcagtttgattctgttgagtaatagccttgcatgcgatggcaacatggatatcaccctacacaattgagcatctacacagggtgccgtctcaggtggtcaaaggagcgacgcagatttgaatcagctagatcacctctgggagcgggagctgggtaggcaccttctgaatttgagtgccccagaggtacgccagggcccaggatctgcaatagacaaaacggcgcgcacccacctcgcctgagcatgtcacccctccaacactttcgtttcctcattccatgcattgcattcctgtgcagccatgtaccttcaaagtccctggtcgtggttacagcccgatctagatgtttcagtgtcgcagcgacacgcccaccgtggcagcaggcttccgggggctgggttgaggtcgggagggatgatcatcaggcaagcaagagcatatggcgcagtacgactgggtaaggggtcggggagttgggggggggaggaggggagggtcgtggggtgtcgaggaggggggaagcgccgtgcgcctgcggcctccgcgcgcgnnnnnnnnnnccgcccccccccaccagtgcattgatccactccaggctgtgacaggcgtgcccgagcaggaaggtgcagggaaccgcgcggggcggtgggaacaagtggcgagcgagggtcgctggaacgcctgcgcatgcaggacgagacgcaggcaggagtggtcgggtcggcaggttggagaggggtggctgtcccctgcggcctgggcgacgaggagggtgagcctgtccaccagcgacaggaggggcatcgacagcatgcacaccctccgttgcagcccattcctgggcgcaccggacgccagcgcctgcactctcacggccccagctcgccatcagatggggttcaccaagggcgtgtggggctggggcggcgactggcccgtccccgcacgcagcctctccagcaccgccagcatgtcgggccgggctgcggggtccatggccgtgcagtccgccaccaggtcctgtgggtgtgaagggggttcgggaggggtgggaggggggcacacgtgcgtgtgcagagggatgccagggcgtgggggtgcggtgtcaaggcgcgcgccccagcgcatgcagcgaggcgnnnnnnnnnncgggtgtgaagagggttcgggggggtggggagggggtcacacgcgcgtgtgcagagggatgcccgggcgtgggggtgcggtaccagggcgcgcgccccagcgcatgcagcgaggcgtgcacgagccgacgggcaggagggcggtgggcgtggctgccgagcggctgccgcagggaatggcgctgaggacagcggtgcagactgctggcaggtggtgggcggggccgggcatgcgaccagggggatgcatggcgcagcacattcatcagcggcacccggcctccagcctcaggcccggaaggagtgttcgaggtcgctggcagcgatctgcatgctcgcctccacgagctcgaccccgtcggcggtggaatgcctggcgacgattcggcgcgagcagccaccagcctttttctccccccccccccccccggggggggccccccnnnnnnnnnnccgcctccacgagctcaaccccgtcggcggtggaatgcctggcgagagttcggcgcgagcagccaccagcctccccccctctcccccctcccccccggggacagcctgcctacccagagcagggccgcggcggggtccagctccgcgcgaccccggcccggtcccggcaggcgcatggcctccgggtccagcnnnnnnnnnnccctttttccccccccccccccccgagggggacagcctgcctacccagagcagggctgcggcggggcccagctccgcacgaccccggcccggccccggcaggcgcatggcctccgggtccagcatccaccgcgtctggatctggtacccgtccagcccctggtgcggcctgcgccgcgccagcgcctcccacaccgccacgccaaaggagtagacgtcggccttgagcgcggcgacgccggccgccggcgggccctgctccagcagctccggcgcggcgtaggcggcggtgccgatgacgtgccgctgcccagcctcgggcgcgcccaccagcaccgacatgccaaagtccgcgagcttgggcacgcctccggggcccagcagcacgttgctgggaaggggatgcgggagtgggtggatgcatgcgcggggggagggagggtcgtgtatgtgtggggggagaggggtcgtgtggggagcgcgacccaggctcgttccccgccagggggcgcggggtcgtggtcgaggagggaggctgcgcggggcggcgccgcggtcccccctcccccacccgccggcgagcgcnnnnnnnnnngcgtgtggggggagagggggtcgtgtggggagcgcgatccatgctcgttccccgccacgggggcgcggggtcgtggtggtcgaggaggggaggttgcgcggggcggcgccgcagtcccccctcccccacccgccggcgagcgcctgcccccagccggccgtctgcccagccggccgtctgcccggcgggccgtctgcccagcctgccccactcccctcgcctgcagtcaggtcagccatggctccgccacctgcaccacccaccaccctcccccctcgcaccacctgagcttgatgtcgcggtgctgcagggggggtgtgcgtgtgtgcaggtgcagcagcccgcgcgccatgccacgcaccaggggcagcaggcgcgccgcgtccggcgccgcgcagcgagaggccgcggggccgctcgcggccccgtccgcggcctccccnnnnnnnnnncgagtgggtcaatgcactggggggtggggggggcgagaggggggcgtgcaggagcgatacagcacgggccaaggtgcaggcggcgaggaggcgtcgcctatgcctcgtcgtcaaactcaccctcctcctcagccgacgcgtcctgcgaggggacatgggggccgtgtgttgggtgttggtttggagtgaggtgcgagggtgcccttcaacccagggtggatcatccctccctgcacgcaacgaggcgtggcaggaactgcactcgggtgcgccccagacccctcccccctcacacacacnnnnnnnnnntgacgtgcacccacctcgcctgagcatgacgcccctccaacactgttgtttcctcattccatgcactgcattcctgtgcagccatgtaccttcacagtccctggtcgtggttacagcccgatctannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagtaggggagggtcgtggggtgtcggggaggggggcagcgccgtgcgcctgcggcctccgcgcgcgnnnnnnnnnnagtgcgagggtgccattcaaccagagtggatcatccctccctgcacgcaacgaggnnnnnnnnnnccgcccccgcccctcccggcccacgcgccgctcagtagtcctcgtcgccctcggcgtcctcctcggcaatggcgtcctggtactgctggtactcggagaccaggtcgttcatgttggactcggcctcggtgaactccatctcgtccatgccctcgcccgtgtaccagtgcaggaaggccttgcgccggaacatggcggtgaactgctcgctgacgcgcttgaacatctcctggaccgccgtggagttgccgatgaaggtgccagacatgcgcaggcccttgggcgggatgtcgcagatggaggacttgacgttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccgagcgcattcgtgaccaggcgcatgactgctggtttggaaagggtgtgtgtatgtggtggacaagggcaggatgagtccccagggctggatgcgccgcgcatggcttgcaccgaccaatcggcaggttgagnnnnnnnnnntggcggtggagttgccgatgaaggtggcggacatcttcaggccgcggggggggatgtcgcagatggaggacttgacgttgttggggatccactccacaaagtagctgctgttcttgttctggacgttcagcatctgctcatccacctcctgcaatggtgtggcggcgatggggaaggttgggagtgggatggtgaagggggtgggcatgggatgggtggtggaatatcgctcaaggcccggccatcaggccgagttgagggctgggtcatgacaacgaccgcattcgtgaccaggcgcatgactggtggtttggaaaaagtgtgtgtatgtggtggacaagggcagggtaagtccccagggctggatgcgccacgcctggcttgcaccgaccaatcggcaggttgagnnnnnnnnnnacatctgctcgtcgacctcctgtgaacgagtgccagggttgggaatggtcagggggatggaggggtttgccatgcagtcagaggggtgaattttattaccggccgtagcagcagcttcaagtgagccgcaagccgccagcatgcatggggagcttctaatctgaagctcacctctcaacacgtgccgcccggtgcgcaaccccattgacccccccgcccaccaagaaaactacaaagtctgctcagtcgagcacatcccattcccccgcccaaaccgcccccctcccaccttggaggacatgcggccgcggaacatgaccgaggcggtgaggtagcgaccgtggcgagggtcggcggcgcacatcatgttcttggcatcccacatctgctgcgtcagctccggcacgctcagtgcgcggtactgctggctgccgcgggaggtgaggggcgtgaagcccaccatgaagaagtggaggcgggggaaggggatcaggttcaccgccagcttgcgcaggtcggagttcagctggcccgggaagcgcaggcagcaggtgatgccggacatgacgcccgagatgaggtggttcaggtcgccaaaggtggggttggccagcttcagggtgcggaagcagatgtcgtannnnnnnnnntgcaccatcacacgccctggtctcttggctcaagatcatgtgcacccctccccaaaccggcccctcccaccttggaggacatgcggccgcggaagagggccgaggcggtgaggtagcgcccgtgcctcgggtcggcggcgcacatcatgttcttggcgtcccacatctgctgcgtcagctccggcacgctcagtgcgcggtactgctggctgccgcgggaggtgaggggcgcgaagcccaccatgaagaagtggaggcgggggaagggcaccaggttgaccgccagcttacgcaggtcggcgttcagctggccagggaagcgcaggcagcaggtgatgcccgacatgacggcggagatgaggtggttcaggtcgccaaaggagggggtggtcagcttcagggtgcggaagcagatgtcgtacagcgcctcgttgtccaggatcatgcactcgtccgcattctccaccagctggtgcaccgacagcgtggcgttgtagggctcnnnnnnnnnncacgaagcactcgtcggcgttctccaccagctgatgcaccgacagcgtggcgttgtagggctccaccacggtgtcggacaccttgggggagggcaccaccgagtaggtgcacatcatgcggtcggggtactcctcgcgcaccttgctgatcagcagggtgcccatgccggannnnnnnnnnaccactgagaaggtcgccatcatgcggtcggggtactcctccctgatcttgctgatcagcagggtgcccatgccggagccggtgccgccgcccagggagtgggtgacctggaaacctggggcaggtgggtgggagggtgcggggcggtgaggggtggacagtcgaggggtcttggaggggcctgggcaactcggtcccgacttgggcgcggcctcatggctgtcgagatgcagccgacaaatgaacnnnnnnnnnnacccagggagtggcacagctggaagcctgagagtgggtggggaagggagagggaggatgcatgggtggggggaagcaacggatgtaatacaaactatggtggtggatgtggtgggggactgacatcacagagctcccacatgtcacacatactcccggtatgcaggggcatggagccctctcccacaccaccaccatgaacgcaccctgcaggcagtcgcagccctcggcctnnnnnnnnnncaccgaagaccatacattcatctatggaaaaccacccaactgacgcacgcattacatccaactacccctgcaacccacaacctcaccctgcaggcagtcgcagccctcggcctccttgcgcacgacgtccagcacggagtcgatcagctcggcgccctcggtgtagtggcccttggcccagttgttgccggcgccagactgcccaaacacaaagttgtcggggcggaagacctggccgatgggaccagcacggacggcatccatggtgccgggctcctgtggacagagggatgcagaggggtgcagggcttggcaacggcggggaccggggtagactagggcatggcatggctggcgccaagcaacagtagttgtgaggagtgcccggcgcctgctaaaccccggcagcagcaaatttgcgcttgggacagggtatcttacttcacactacaccacagtgctaggagctcaacaaagagacaacccctgccgcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagggaactggggattgtgagtcggccctggacccaggtgagcaggcgctgcctgcgcggtgagcctaaacaagcccaatgtgcgccattcgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacggcccggaaaccgcttcccgagcgacacacgaaatcagagggagatgcactggcgtcctatgcttnnnnnnnnnngacgctgctgcggcagcgggcggtgctgcactccggcacgccgggggacaacatcaccgtggccgtggtctcgctgcggcccctgccccaactcccgcgccactccagctcccggctgaatctgagggccgcgctgccggaggatgggcgagcgtcgccgcccagcgcccacacctgaccccattgtgtgtatccatttgggggggggggggggggggggggnnnnnnnnnnacccgcactggccggccctgcggaatggaggagcggtgtcatgagcggtgtgcagcaaggtgcaggggggcagatgaccacccggaccaccagatgggccccatggcccactgcaagcctcccaaggccacttactgcacgtgcacgatctctctcatggcgtcagaggttgtgtggggaccgcaaattcaaactgtggggtctcgcaggcgagatcagctgaggctccgcagcaacgaccgccggtgaaatggcgattcctgctgtgctgaaggtcacagagagcggtaatgtgagttcacggctaccagggagcggcaatgaacagattgggcccggccgggccagggcaactggcgggacggggcgcagctgtggtacctgcgtaccctcatcaggccacgggacgaggaagagggcgcgagtgtcatatgtcgagactgttgaaggggcttggggaccttccaaacgtgtggtgatgcatcagaaagtatctactacaaaacacagatgcctgcagcatgctgacaggccgctggtctgcagcgccatgaccccatgccggtgaccaaggggagcagtgccaaggttgtcgatgccggctccccgcacagcgtgctgggcgatgccggcatcgacgactgcgatcctgcgaagctcacccagccgatcaaggaggtgaaggacaagtaccagctgctgccggccttcttgagggtgcggggtctggtccgccagcacatcgactccttcaactacttcatcaaccatgagatgaagaagatcatacatgccaagggcaacgagcgcgtgacctgcgataccgaccccaacttctacctcaagtgggttgctttctactgggttgctgaggaggatgctcaagggctgcactcctcccctaaggggggggttcttagtcttcctcacctgtttctcctacccttctcccaccctcattttctgcccccaaaccaccaccaggtacctgaacatctacgtgggcaagcccagcatcgaggaggagtacatcgtcacagacatctcgccccagcagtgccgcttgcgcgacatgacctactccgcccccatctccgtggacgtggagtacacgcggggcaaggagatcgtgatgaagcgagggaagaacggacagggcgccctcttcctgggccgcatgccgctcatgctgcgcagcgaccgctgcgtgctgaagggcaagtcggaggcggagctggccaagctgggcgagtgtccgctggaccccggcggctactttgtggtcaagggaaccgagaaggtgatcctgatccaggagcagctgtccaagaaccgcatcatcattgacacaggtcggttttggggtgtttgttgttgttataattgattgggtcgaggggaaatggagcagcggttggagagcaagtgcccatctgcgagcagaaaagggagcctgcacatcagggacctggacctgcagccttgcatatctaggccgtataaaccatggctcccctatgctcgccgcaaacagacagccacggcggcatcgtggcctccgtgacctcctccacgcatgagcgcaagtccaagaccaacatcgtgaccaagcatggccgcctgctgctgagacacaatgccttcacgtgaggcggacacgcggggatggtgtgatttgggggcctggagaaggagccggtgtccaccctcccgaatctgcagccgcaagcctgctcacctggtgcattgtctggttccatcgcttctgggctggcagtgaggtcagccgttggcagtatggccagctcttcttccctggctcatgtttgtcctcatctgaactcatgccgtgaaccacttgcacacgggccgtgtttccccttgccagcctgtccttgcatcagctgactccaagccccctgttccgtcccccttcctcctccaannnnnnnnnncccccctcgccagcctgtccctgcatcagctgactccaaaccccctgttccgtcccccttcctcctccaaccactgaacagggaggacatcaacatcctggccgtcctgcgtgccatgggcgtggagagcgaccaggagtttgtgcagcttgtggggtcggagccggcctttggcagcctgctggcgcccaccttgcagcactgccgggaggagagcacgggcgtgttcacccaggcgcaggcgctggagttcctggcggcgcgcgtcaagtccagccgcccgcctggcggcttccagcgccggggccgctcgcgcgtcgacgaggcacgtgacatcctgtcgggcgtggtgctctgccacgtccccgtcccgcgctacaacttccaggccaaggtggtttacctggcggtcatggtgcggcgcatgctctgcgccatgctggacccgggcttcgtggatgaccgcgactactacggcaacaagcgcctggagctggcgggggggctgctggccctcctcttcgaggacctgttcaagaagtgagcgtaggttcataccctccttggtgggaaaggggggtggggggtacagggcggaactgcacaggtgacgcaggggatggtgagtacaggnnnnnnnnnnataggtttataccttctttggtgggaaatgggggtgggggtaaaagggcggaactgtacaggtgacgcaggggatggtgagtacaggtgcttgttgttgctctgagtacaagccatcgcattcctgcgtggcatgacgacggcaccggggccctactccatgcctcgcacgcaccatcaatcgtgctcaacgccgacctttcaggctgaacgcggacctgaagcaccacacagacgccacgctgtccaaggctaatcgcgcgacgcaatacgacatcgccaagtgcctgggcacccacaccatcaccgccggcctggagaacgccatcagctcggggaactggaccatcaagcgcttccgcatggagcgcaagggcgtgacccaggcaagggtgatggagaggacaaggggtgactcctttgtgtgcactggacagtcacacgcggcactcccctggctacctggcgatgttgaggaagcaggcgtggtgcactgggccaggggtgtccccatgcgctcggcgggctgaatggatgccgtcgtacctgcaccttgagatctccagtccgcagnnnnnnnnnncgtccccatgcgctcagcgggctgaatggatgccgttttacctgcaccttgagatctccagtccgcagccgccagcagcccgctcctcaacccactcgaaaacttccatgcgacggccccctccgattaaccggccaccaaaccccttccccccttccctgaaccccaggtcctgtcccgcctgtccttcatctcggcggtgggcatgatgacgcgcatcacctcccagttcgagaagacgcgcaaggtgagcggcccacgcgcgctgcagcccagccagtggggcatgctgtgccccgccgacacgcctgagggcgagtcctgcggcctggtcaagaacctggccctgatgacgcacgtgaccacggacgaggaccccgcgccgctggcgcgcctggccgccgcgctgggcacgcagccgctgtccctggtccccggcgcggagctgcaccacgccgacgccgcgctggtgttcctggacggctgcatcctgggcacgcaccgccgcccacgcgcgctggtggccgcactgcgcacgctgcgccgcgccgcacgcctcggcgagttcgtctccgtgcacgtgcagcacgacgcggtgcacatcgcggccgacggcggccgcgtctgccgcccgctcatcatctgcgacgcgggcgtgccgcgcgtgacgggcgcgcacctggcgcgcctgaaagcgggggagtggagcttcaacgactttctgaccgcggggctcgtggagtacctgggtgggtacggtggcagtcgggggggagggaaggggggccgagcccagcgctccagggctatgagtgtcgaccagcactggacggcgtggnnnnnnnnnnagagtacctgggtgggtacggtggcagtccgggggggagggatggcgggccgagcccagcgctccagggcaatgagtgtcgaccagcactggacggcgtggcattccccttccatcaacggcaagccccctcacacagaatcatgccccctccccccccattcagacgtaaacgaggagaacaacgcgctggtggcgctgtacgagtgcttctgcaaccccgccaccacgcaccttgagatcgagcctttcaccgtgctgggcgtggtggcggggctcatcccctacccgcaccacaaccagtcgccgcgcaacacctaccagtgcgccatggggaagcaggccatgggcaacatcgccttcaaccagctgcagcgcatcgacacgctcatgtacctgctgcagtacccgcagcgccccctgctcaccaccaagaccatcgagctggtgggcttcgaccgcctgggcgcgggtcagaacgccaccgtcgccgtcatgtcgtactcggggtgagcaatggggtttggtgtgtgtgtgagtgtgtgtagggtgtgtgtattgtagtgtcnnnnnnnnnnccagaacgccatcgtcgccgtcatgtcgtactcagggtgagcaaggggtttggtgtgtgtgtgtgtgtgtgtagggtgtgtgtattgtagtgtcgctcccctgccaccgtcgcccctccccagccacgcaaccccacccaatcacaggtacgacatcgaggacgcgatcgtgatgaacaaggccagcctggaccggggcttcgggcgctgtgtggtgatgcgcaagtatgcgaccacgctcaaaaagtacggcaaccgcacgcaggaccgcatcacgcggccggcggaggcagcggcgccagccggcgccagcagcaccaccaccacccgccccggcggccgcttctcggtgctggacgcggacggcatcgcgggggcgggccgcgtgctgacccagggcgagtgcctggtgcacaagcaggtgccgctgaacacgcgcgatgccgcgggccccggcggcggcgcgctgcccgagtcggggtaccgcgccgcgccggtgatgtggaagggcttcccgggggagcgctgcgcggtggaccgcgtgatggtgaccagcaacgacgactcggcctgcgtggtcaaggtgctggtgcggcacacacgccgccccgagctgggcgacaagttctcctcccgccacggccagaagggcgtggttgggtgcatcgtgcccgaggccgacctccccttctccgagcgcggggtggtgcccgacctgatcatgaacccgcacggcttcccctcccgcatgaccgtgggcaagatgatcgagctgctggggtccaaggcgggggcggtgtccggccgcctgcactacggcaccgcctttggcgagggcagcgggctggcggaccgtgtggacgcgctgtccgcggagctggtggcggcggggttctcctattcgggcaaggacctgctccactccggcatcacgggggaggcgctggaggcatacgtcttcatggggcccgtgtactaccagaagttgaagcacatggtgatggacaagatgcacgcgcgcgcgcgagggccgcgcgtcgtgctcaccaggcagcccaccgagggccgatcgcgcgacggcgggctgcgcctgggggagatggagcgcgactgcctcatcgggtacggcgcgtccgcgctcctcctggagcggctcatgatctcctctgaccagttcgaggtccacgtctgcacccactgcggcctgctgggctactgggacgcggcggcgcgccgcgcgcgctgcccgggcaccggtcgagccgacgccatggccaccatgaagctgccctacgccgccaagctcctgttccaggagatgcaggccatgaacatcgtgccccgcctggtgctggccgaggcctgagagccgcgccggggagagccagggccgagacccttcagcgctgtgagcttgcgaggcccccagcgcgccagcccccaaccccnnnnnnnnnnaccggggagagatagggccgagacccttcagcgctgtgagctcctgaggcccccagcgcgccagcccccaaccccttgctgccgccctgtatctattcgagcactgccatctgaccttgggcgagcgccgcctctgccacttgctgtaggaacatctgacacagcgcttggctggcagtgcatgcttaaagcattcagtcttgttacaatagagatatccccacagagctgctggtgagtcttggtnnnnnnnnnnactggcagtgcatgcttaaagcattcaatcgtgttacactagagaaatccccacagagctgctggtgagtcttggtagagaacggctccggggtgccaagaacaaacatttgccttgtcaaaccgcagcagcgctggcttgctcggccttcatgagtgtgatcatggcttcctgagtccgccggtcgagcttggctagctgcggggcgatggctcttcgaagctcccagttggccttcttgggggcaacgttgatcagcacctcctgttgagccaggggggtgtggggcggagtttggtgcagacacagcggcatgcacttgtgaagtccactccatgaccagggctggtttacaagacgcctcagccatcagcagagcgtttcgcacctctgggtcgttgcccatcaccgcctcggggtctgccacgatctcctccacctctggtaccttggcagcctccacctgcgcgtgttacatgtctcgatcaggagctaggattgaaagctcactctgcaacgggcacatggaacgccatcgattaggctcaccatgttggctcaagactccaggccannnnnnnnnnatgttgcatgtctcgatcaggagctagggttgaaagctcactgtgcaacgcgcacatggaacgccatcgattatcctcaccatgttggctcaagactccaggccactgcatgcactccagtcccatcgctcccaggcagcccaccttgacgtgctggatggactcggcatccttgacgttataatttcggaatttgaggacggggtctgccgaggtggacggcgcggcttccggggcgccatcccctgcctctgctgtgctcgtcggcccctcctctcccaggtctccctccttctctgcagcctctcgcatggccttcaaccgagccttgcgttctgcagccgattcagacatgacgaagtcttgctaccccaggctggacgtatgtctgggtttggtgaatgtgcgatgtgctcagtgagccagggtccccagtcttcgatgttacttctgtttccagggatatttattgagcggagcgcttgcggctgtcaaaggtgcgcgagcatcaatgcgttggaagtcgcattccctggtttgccgcatgtgagagcgcgcggaatgtcaggcctcgagataggactgaattaattccatgccatttcaccccccccccccctttttagatcctacagacctgcaccagtccgcggcgatctatatatcaacggccttacagccggcgtgnnnnnnnnnntccagtcttcgatgttactttctgtttccagggatatttatcgagcggagcgcttgcggctgtcaacggtgcgcgagcatcaatgcgttggaagtcacattccttggtttgccgcatgggagagcgcgcggaatgttgggcctcgagagataggactgaactgatctcatgccgtttcacccccccccccccccnnnnnnnnnnccgggcattgccctgagagcacgcagtcagcacactgcagaggggctgggccatggtcggccacgccgcgtgtggcatgcccggccctccccccgcaccgctcccgcccgcacctcaggccttgatcttgagctggcgctccnnnnnnnnnngatcctacagacctgcagcagtccgcggcgagctatatatcaacggccttacagccggcgtgnnnnnnnnnngtggtcggccacgccgcgtgtggcacgtgcggccctgcccccgcaccgctcccgcccgcccctcaggccttgatcttgagctggcgctcctgcccgtaccaggccgcgttgcggttgaggtgtgcgtgcgtcttgcgcgggttccggttctcgtgctcccacccgatgcaggcgcggtcgtggtgtccgtacaggcgctccaggtctgtgcgcgccaggcgcgcggtcaccacctcctcgtcctccagcggctccggggccgacagcggcgggcacagcagcgcgcgccagcccgcaaactcctcatcgccgacccccagcgcgacctgcacgcggcgccgcagctcgcccacggtctcgccctcccgcacgcgcatgatgaaggggtcgctgaaggcaaaggcgcggttgtgggcctcctccgtcacctgcaggcagtgcacgtgcaggccctcctcgccccccgccccccgctggtcggggggcaccacctcagcacgcaggtgccacagcgcgtcgccggacatggaccccaccgcctggtccgggtcgaagagctgccagacgcgccactggtagacctccatcaggcgcagcggcgcgtcgcccacgccggctccggccgggagctgcgcacgcagctcctccagcagctggctcacgcgcgcgtcgcgtggcagccgcacgctgtgcgcgctgacctcctccgccttggcgttgtggaacgacacctggcatgggggggttgggtggtgcatgggagccttgagaacgctctgccttgtgcagacnnnnnnnnnngggggggggtcggtggtgcatggcagccttgagaacgctctgccttgtgcagaccgccgacggtgaccggggctgttcctcacccccaccctcggcatcctttctccacccccccgaccccccgactcccgcgctggtaccttgaaggtcaccagcttctcgtactcgggcaggggcaggtcgatgacctcgtagtagagcgtgctgcccgccgccgcgccgtactgccccgcccgcagcatctcctccagcatggccccaggcgcgtacttgagcggcgcggggcgcggcagcgcgctgtacgggttctgccccgtcagcgccaggcgcagcgggtggtccaggcccagccgcgccgccagcgcgccggaaacctcctcgtaccccatgtccttgcgcaggtccaggagcaggccctcctccccgggggactccagcggccggaaggcgacgcgcacgcggttgcgcacgtgcgacatgtaggccggcgcggagaggtgctcccgcgggcagtcgggcggggcctggaggctcgccgccgcggcctggaacaccagcacgtccccgttctccagctgcgcggcggcggcggtcagcgccgggcgcagcgcctccaccatgacgctgggctcgaacttgacctcctcgtacacctccagcgcggcatcgggggcgaggccgcccagcgcgcgcagcgcgggcgccagctccccgatccggctgtggcggtgcacctggagcgagcccgcgtagcgcagcgcgggcgcctcggggtcgggcacaaactgcttgaagaagagcaggatgtcgttcgcgccgcgcggccgcgggnnnnnnnnnntgcgtagcgcagcgcaggctcctcggggtcgggcaggaactgcttgaagaagagtaggatgtcgttcgcgccgcgcggccgcggggtggcggctggcgacgtagacggggtattcgtggccttgctcgcatcgccagcgccgtcctgggcgcnnnnnnnnnnggacgtggacgaggtgttcgtggccctgctcgcatcgccagcgccgtcctgggcgccgggcgagccgccgtcgggcgccgccccgtcggctccggccccgacgccccccgccgcgcccccgacaccaccgcccccgtcgggcgccgtctccaggtacaggttcagcgtgctcatcgtgccggggcgcaggtcgcggcggccgtcacgcaggctgctgatgggcacctcgtccgactctggctccagcggcagcgaggggcggtaggtcccgttctggcgcgcggcccagcgccagaagcgctgcgcggcggggggcacgcccagcgcgcgcgccgcctcggcgcgcagcgcggagaagggcgcgcgcttgctcagcttgaaggtggccacgccctcgtggtctaccaggtcgaaccagcgctcgcgcccaatctgggacgccatgtcggcgtcggtggagacgcggaccagggtgtacaggtgggcctccgccttctccttgcgccgccgctccttctcatcctgctccgcctgggtgtttgggtgggggttggttgtgggctgggttgtttggtagggggaacacatcggtgggatcgcctggccagggaggagacggtgctacggcccgggccgggggctggctgacgnnnnnnnnnnggtgggctgagttgtttggtagggggaacacatcggtggggtcgcctggccagggaggagacggggctacggcccgggccgggggctggctgacg

SEQ ID NO: 43342 - DNA, 92 bp, Chlorella protothecoides
ttgccctgctggctctcgattgaacgcaatacaacaatgcccccccctttcccccattcctgcccccacccaggcacttcactgtgtgggag

SEQ ID NO: 43343 - DNA, 73 bp, Chlorella protothecoides
ggacgtgctcaacgtgctgggcatgtacccaggcgaccccggaccccccggcggcgactgcgccggcatcgtg

SEQ ID NO: 43344 - DNA, 61 bp, Chlorella protothecoides
aggccctggcctagttccgagtagtggctggggggaacactgtgcctgggaagctgacggc

SEQ ID NO: 43345 - DNA, 68 bp, Chlorella protothecoides
cccccccccccccccccccctccctcacacaccaggatgaccccaagtacaagatgctgctgcgcatc

SEQ ID NO: 43346 - DNA, 62 bp, Chlorella protothecoides
ggtggggtacggcggcgcggacctcaaggcactgtgcacggaggccagcctggccgcgctgc

SEQ ID NO: 43347 - DNA, 439 bp, Chlorella protothecoides
  modified_base (306)..(315): a, c, t, g, unknown or other
gcgagggtggcgaaggggggggtggtgggctagggggcggcgcggtggggggctggtggaagggtagcgtcaccgtgaccgccgggaactggtggcccgtgccgtccgtgtaccacacccatccctcggtcaggtctcccaggtggaacatgttcctgcgggtgtaggatgtggtgggtccggccaccgcgacggtagcggtgtcgggtgtctgcctgccctcccacttgaacccgatgtccaggctgcccacgcccgtcaccaggttgccggccaccaccatgctgcaggccgcgtagtcgccgnnnnnnnnnnagccaccgcgacggtagcggtctcgggcaactgcctcgactcccacttgaacccaatgtccaggctgcccacgcccgccaccaggttgccggcaaccaccatgctgcaggccgcgtagtcgccg

SEQ ID NO: 43348 - DNA, 62 bp, Chlorella protothecoides
ccccggaacccctgcgcatgcatgcctgtgcccccctgcaggatgtcgtgcgagaggtgctg

SEQ ID NO: 43349 - DNA, 61 bp, Chlorella protothecoides
aggcggtggtggagacttcttggcaggggggggtggagacttcttggcaggtgacggcggg

SEQ ID NO: 43350 - DNA, 436 bp, Chlorella protothecoides
  modified_base (187)..(285): a, c, t, g, unknown or other
gcgccgtgtgtgtgtgtgtgtgtgtgtgtgacgggcagcaggcggcttgacctcttcctgtgagggggctgtcagggcgctgtgccctccagacccctcgctggctggccctcccccgacccgaccaccccccgttcccgccccgccctccaaaacgcagctgagggacgacctgctgagcatgctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggcatgggacgggactgccattgacccaacgagacccgatgcccagccgcaggattggggatctcgatcggcgctgctcaaccgcaggccaggagcacggagtggtctcgcctgagttccttttcccgccctccccccccccctgcacag

SEQ ID NO: 43351 - DNA, 61 bp, Chlorella protothecoides
aagattgacgagctcgaccaaaggaagtgctccctgccacacccctcctcggcgcgcgcca

SEQ ID NO: 43352 - DNA, 61 bp, Chlorella protothecoides
ggattccggggtgtcggtggagggcgggggggacccccgaatttgccagtgtgccaccgtg

SEQ ID NO: 43353 - DNA, 74 bp, Chlorella protothecoides
tcaccacggtatgcaggaccgctgggaccacgctatgccgtggcaaggccggtgctctggcatgcaaggcgcag

SEQ ID NO: 43354 - DNA, 61 bp, Chlorella protothecoides
ggcctcagtgtgtaaacacaacggctaccgggcaagccagtctgctccatcgggtcagatg

SEQ ID NO: 43355 - DNA, 112 bp, Chlorella protothecoides
ggggccccgccgagccagggccgtcctccatgtgctcctgcttggggggtggcggcgggcagcccgccgcgccctcgccgacccccaccaccgcccgcacggcggcctcctc

SEQ ID NO: 43356 - DNA, 74 bp, Chlorella protothecoides
ttcgcccccctcagcacccagcccccccattccctcggcccccaaacccccactccctctcagacgctgatgac

SEQ ID NO: 43357 - DNA, 71 bp, Chlorella protothecoides
ggacgctgctgggcgtatcaatggctgtcgttgatgctgcgcaagacggtgcgggtgacggagagctctgg

SEQ ID NO: 43358 - DNA, 80 bp, Chlorella protothecoides
gtgaagtccgggaggctggcctggccagcaggacgaccatccaccagccgccgctgcccattccttatggcacgcaccac

SEQ ID NO: 43359 - DNA, 61 bp, Chlorella protothecoides
tccccgccctcgccagatgctcaagtcccagcgcgaggaggtgctgcgcaagaaggaggag

SEQ ID NO: 43360 - DNA, 61 bp, Chlorella protothecoides
catcccatcatcatcatcgccaccaagcggagctgccacggccctcgcacctggtggtcga

SEQ ID NO: 43361 - DNA, 61 bp, Chlorella protothecoides
tgacgaggacgccaaacccctcgaggcgggggttgtatgcctccagcgtgacttgcttgcc

SEQ ID NO: 43362 - DNA, 61 bp, Chlorella protothecoides
tcctacctgtggcagaccccatgaccaggggggacacaaccacaatgaagagcgtggcggt

SEQ ID NO: 43363 - DNA, 64 bp, Chlorella protothecoides
ccataatactttcgcttcaacgcagggccacgtttaccgcagcaggaccgggaagctggagcga

SEQ ID NO: 43364 - DNA, 61 bp, Chlorella protothecoides
cgtgtctttgtggtatccacttgagaaaggggcagctcatagggcacaagatgggggcact

SEQ ID NO: 43365 - DNA, 61 bp, Chlorella protothecoides
gctggagggcgcggcgtcgcgcttcctcgcagcccagaacctgaccgccagcctgacggac

SEQ ID NO: 43366 - DNA, 70 bp, Chlorella protothecoides
tccctcctgcccacccccgactccctcctcctcagcatcgcccacctgtgccggtcgtcctccggtcggt

SEQ ID NO: 43367 - DNA, 76 bp, Chlorella protothecoides
ccccatccacctacccatccgcccccctactcccacacccgccacgatgcacaggtgaagcgcaacctgcagcgga

SEQ ID NO: 43368 - DNA, 1010 bp, Chlorella protothecoides
  modified_base (152)..(321): a, c, t, g, unknown or other
  modified_base (543)..(552): a, c, t, g, unknown or other
ggcgcagccagtcgtcgggcgcgtgggcggggtcgccgaccgcgcggcgcacggcctcggcgtgcgcgcccagcgccgcgccggcgcaggccagctcctgctcgacctcggacaccgccatgagcccgcgcgcctccaccgcggcgctcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctcgctgtgttgggaggggagggggggaggggggtttgaggctcgagacctgggggtggggacggcgagggaggccgctctcccccgtgacggcgcctggcgcatcacagcaagttccacgcatcgtcccttcctcgcgggagcctggcgcagcggaactccagctcccctcccagcctcggccgagccagtcgcagtcccgccccccgcccgaagccctnnnnnnnnnnggggggggaccggcgagggaggccgctctccctggtgacggcgcctggcgcatcacagcgagtaccacgggtcgccccttccttgcgggagcctggcgcagcacaactccggctcccctcccagcctcggccgagccggtcgcagtcccgccccccgcccgaagccctccacccctgccctctgaaggctcaccccgccaggtcgtccaccagctgcttgatggcgacgcccacctccccaaagttgctgcccgcgtgcttggcaaagaaggggtccgcggcggtggacagcacggcctgcgcaaactcgggcttgaccccggggacgtggcgaaggtccacgcaccctccgacgatgcccagcacctcgtgcagcatggcctggtaggtccactgcagcatgtggatgtgtaggtgggggggaggtgggtgagggggaggtgagggggaggtgaggg

SEQ ID NO: 43369 - DNA, 61 bp, Chlorella protothecoides
cgagacctgggtggcgtcccgtggcgagggggggggggataaagctggcgccgcagacgag

SEQ ID NO: 43370 - DNA, 10543 bp, Chlorella protothecoides
  modified_base (105)..(114): a, c, t, g, unknown or other
  modified_base (700)..(709): a, c, t, g, unknown or other
  modified_base (908)..(917): a, c, t, g, unknown or other
  modified_base (1470)..(1479): a, c, t, g, unknown or other
  modified_base (2288)..(2297): a, c, t, g, unknown or other
  modified_base (3221)..(3230): a, c, t, g, unknown or other
  modified_base (4194)..(4203): a, c, t, g, unknown or other
  modified_base (4501)..(4510): a, c, t, g, unknown or other
  modified_base (5005)..(5014): a, c, t, g, unknown or other
  modified_base (6620)..(6629): a, c, t, g, unknown or other
  modified_base (6736)..(6839): a, c, t, g, unknown or other
  modified_base (8131)..(8140): a, c, t, g, unknown or other
  modified_base (8464)..(8517): a, c, t, g, unknown or other
  modified_base (8646)..(8655): a, c, t, g, unknown or other
  modified_base (8837)..(8846): a, c, t, g, unknown or other
  modified_base (9758)..(9767): a, c, t, g, unknown or other
  modified_base (10103)..(10112): a, c, t, g, unknown or other
gtgcgggagccctgagggccctactagggcatcaacttggcctccaccagtggcccaccccgctgtccctcagaccctcccccccccccccccccaaaaaaaccnnnnnnnnnnggtataggtgcaggtgtggaatgtggcgctggggatggtgcagggctggcgatgaggacagccaagtcagggagtgcgggagccctgagggccctactagggcctcaacttggcctccaccagtggcccatcccactgcccctcagaccctttcccccacccgcaaaatgatacgcctgagaccccagggtccaacaaccccctcgaatgcggccgctcacgttgttcagcagcttctccagggccaccccgtcctcgctgatggaccagatcctgaggaagtcagaggtggtggccagcaggtctggctggttggggtccttcacgggcaggaacatgagcttggtggccgggaatgggtgcacaaaagacagccgcgggtcggcctggaactgctcccgcgcctcatccactgaggggtgggttgggcggaggggagttgtgagactcaaagagagggtgtcattgaggcggacgtctgggcgagggtcaacaaaccctcgtcccgctgcgcatgctgtgcgccgcacagcatgccagaccaggggaggcctacggctgccggctggccctggaccgatacagnnnnnnnnnncagctgcgcgccgcacagcatgccagcccaggggaggcctccggctgccggctggccctggaccgatacaggacggctccccatgtagaagatgcaggcaggagcggcaccgtgtgcctactcagatccaccccctagcgcagaagtgggggctctgccaggatttcccccacccccaccccggattcagcaccctggnnnnnnnnnnagcaccgtgtgcccactcagatccacccccaagcgcagaagctggggctctgccaggatgtcacccacccccaccccggattcagcaccctggcgcccgcgactcacagactatgatgtcgatgtggttgttctggtcctcgacatagctcccggtggccaggcggaagggcttgtcagtgcgcacctacagaaccgggagggaatccgggctgggcaagcctgtgaaccctggtgcgcgccggcaccagcacgcgccccggggacccccccccgcccatactcacgctccaattgagggcgtagatggggtccgcggactcatgcgtgtagatctcggcccgcttgtctccgctgggcccagacatgaacatttttgggcgggtccgacccggtctggacaaccgcctgctccctctgtgtgcttgtctcgaggggatgttcaattacttggaaggccagcgctggacgggcgttcgggagtgtctcaggtattgcgcgactcgtgtggagcttacggtgttgcggtcgacgtcgcggcctgcaaactggtnnnnnnnnnncgtctcaagtatggcgcgactcgtgtggagcttacggtggtgcggtcgacgtcgcggcctgcaaactggtcacgaatttgtgccggcccctccgacagcaggcgcaaaggatctctggtgtgtgctggagagccacccgtattgcacaggttgtgcggggcctgcctgtgccccggccggccctgagctgttcccctttgggaagaaaccgcgtggccggcggattgagaggggtcacagaccaccccggccatacccagccccaaaggcatatagtcggtacattagggcaagatggagcgtgttatggccaccatgaacgcacacacaatcgtgtcgggatgctctgcccctggacgggtttcccacccccgggccgtcgcgccccacgcccccacagcgaatcgacgcgcattactgggcatgctgggggtggcaccacttgcattgagcatccctcgtcccgccttggctctcatccctgatgacgacgatgaggagcttgttgccaaggccaaggccagccgggccgagcgactggctagggataaacgccagatcgggcagtttgtagccacgtgagtcatacccaccgctggggtgttgcatgcacttaatggagcacacgggaggatggcagcggttctgaggcaagtagattatggcttcctgactcttctgtcccgccgttgcttccccataacaacaggaagccatgcatgtgcactcccagaccggcgaggcctccccatgtaacccctgctgacatgtaacccctaccttccatttgcagggccgatcccgttgcnnnnnnnnnntgtagattatggcttcctgacttttctgtcccgccgttgcttccccacaacaacagcaagccatgcatgcgcactcccagaccggcgaggcctccacatgtcacccctgctgacatgtaaccccaaccttccatttgcagggccgatcccgttgccgctccagcccagagcgccatcaatgccctggcagaagtgggtgagcagctggaggccggtcgcctggagggcctgggtgatctgctgggagactctctgctctccggcgtgaatggcgcgaccagcggtgagtcttggctgtgaatggccgcaggatttgggggatgtagacctctctccgtgcatggtgaaggcctggctccgatgaagggattgaagcgtccttcacgggtttccatgccgttgggacctgtgcctgtatggcaatgattgccatcgtcaccccacccaccctccccccacatcctccttcatcgggcatctcacacctgcagtgactgacagcctcgacagacttaggtccacggccgcctctggatccctgagggagaccaagatgcggtacatcgaagccgtggagaagttggagagctgggcgagggactctggatccgtcaagaccctgaagggattttgatagatggcagcagtgctcttgacccttcagattgcgactgatgtgcctcctttgtcctctcctcaaatattggctgccaaagttcccagccgtattggtaaagatacacaggttgtgaaaattcaatgatcggctgtgctcgatctcctcaagcagagaagcgtgtaaatggtgggcatgggtgacatgccactgtcacttgtgatgtccttcttgctgcatcagggggggtactgctcccctcattcatttggaatgtggccttcgggtgagcccctcccgccgcctcnnnnnnnnnnaatgggctgccaaagttcccagccgcatcggtaaagatacacaggttgtgaaaaatcaataattggctacgctcgatctcctcaagcagagatgcgtgtaaatggtgggcatgggtgacatgccacagtcacttgtgatgtccttctagctgcatcaggggggtaactgctcccctcattcatttggaatgcggccttcgggtgagcccctcccgccgcctcggcatgcaacctcgtgctgggccgtgctgagcatgcaagcctctgtgcatacgtctgctcaggctataccgtgcagcttcatgacgagctcccaagaaccaagcttctgctctataacaagatcaaggttgtatccatccaatggctccgaagaacaggtctgctcgatcggcggaggaggctgctgatccctcgtttgaagtgaccccaggtacggggagggcgggaaataggcccacaattaacccctccccgtttgcatatctaacagtcaaagtcgtgacatgcagatacgctgcagcagctaatggccagtgggaacaccgaactggtcggagctctccaggtgtgtccctggcgctggcaagaccgtcacagggggacgcccccgcgaatttttgtccttacagctgcctcacatgatcctattatttctccctgccttcccagaaagcattgggaaagatggtcgggtcttcgagcggctacatcgagtccctgcccgaggctgtgcagaggcggattgaatacctgggtgacatcgatgagcagcggtccgacctcgaggcggagttcgatgccaaggtcaagcagctggaggaggaatacagcgagaagtatggtgcgcagattgagctgtggtgcaaccaggcgttgccatgcctgcatggggttcaacaccagggaggtccattgcctccgtgggcctgacagacaccatcatgatccaccagccgagatnnnnnnnnnngtacagcgagaagtatggtgcgcaggttgagctgtgatgccaccaggcgtgccatgcctgcatggggttcaacaccggggaggtcccttgcctccgtgggcctggcagacaccatcatgatccaccagccgagattggccctgtccctgccacgcagcccccttggacaaggagctgcgtgatatcgtgaatggcgtcaccgaggccccaggtggtgacagggaaagagattgtgtcgtggttcgcttggaccactcgattgagcacactgtgggagccaggactggcgctgcatgcnnnnnnnnnngtgtgtcctgggtcgcttgggccactcggttgaacatactgtgggagccaggactggcgctgcatgcatggaggccgcatgcccagtctcctgcctgcagctgcagactctgtgtcgtctgcgtccaacacaggcgtggtgaccgaggagggcgctgacaatgtccccaagggcatccccgacttctggatgattgcgcttcggaacgaaccccacctggagactctggtgagggcggtgctgtgctccaagggggaggagctcccaaggcatctttggaggccctcaccctgcttgagtgggtgcaacgcttcagtgcagaacgtggtgctgcagtacagaaacgttttcagagtgcacagcccagcatttgttggtccacggcacccgctcaccatccatgcatgctgcctggactcttttggttccaggccgcctcagccagggcctcatcagtcctcacatgcctgacctgcagcaaacgctctttctctnnnnnnnnnngaacgtttttagagtgcacagcccagcatttgtgggtccgcggcacccgctcaccatccatgcgggctgcctggactcttttggttccgggccgcctctgccagggcctcatcagtcctcacgtgcctgacctgcagcaaacgctctttctcttgatgcagatcacggagcgggatgttgaggtcctgagctacctcaccgacatccacgaggagagcctgtcggaggaggaggaggaggaggtgtgtgccgctcggctggaagtttaaaggggtgcctgatgcttgggtccaagtctgtggattggggtcggtgtgtcatgctaggcagcccccagcgagcaggccggcctgcccgtggccttggggtgccaacggaaggacgatggtggctgcatgccctgcttatgggaaggcagtgaggggcattgccggactttccccaattccttgccttcaaggaaactccacttccagggcccccccctccccgatcactacccatgcagagcttcaccctggtgttcaagtttgctgagaaccccttcttcaagaatgagaccctctcgaagacctactttatgggcgatgacgaggatcttgtcatccgtgacatcaaaggtggattggggaggggactcgccaaagctcgctcatgcagctggctgcgctgccctccctcactctttcttcgcccatgcacgcggtcccctcctgcatagccccacctgcttccccccccccttctccacacacagccacgcccatcgagtggaagtcggccagcaagaacgtgacggtgaaggtgctgaagaagaagatgcgccccggccagaaggggaccccccccacaaagcagacccccaccgagtccttcttcaactggttcacgccaccgcccatccctgagaacgaggaggagatcgaggaggaggagctggagggcctgcaggccgccatggaggacgattacgaggtggccgagatcatccgcgagaagatcatcgaccacccctacctgtggttcacgggcgaggcgctgcaggatgacgagagcagcgaggaggactacgacagcgaggatgatggcgcaacccccccgggcgagaccgacgatgagtccccttccgatgacgaggtgggtcagggcagggcgcgcccgttggcgggatggaggcccggggggtgatggatgtgcacacgtcagaggatcacctcctggccatcgactcctgctgatccctccctccccaccaggacgacagtgaggacgacgatagcgagggagaaggggaggaggagaccaagcgatccaagtcgaccgggaagaccggccccaaggcgggggtgagcagacctggaagtgatggaagctggggtggaggaattgtgcacctcctttggtgactgaaggcttcatgacatggaggctcctttgtgcatgaaggtcaaggcgattcatccctcctaccctcgaatgccgtgcaggccgtggacagccaagcacagccgcaggagtgcaagcagcagtgatcactgatcgacccccccccgggaagcgtgttcggtcgccgaatcccacgcatgcccgtgtcgcgtacaatttnnnnnnnnnnaggggtgagcagacctggaagtgatggaacctggggtgggtgaatcgtgcaccttctttggtgactgaagccttcctgacatggaggctcctttgtgcatgaaggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcagcagtgatcactgatcggtcccccccgccggggaagcgtgttcggtcgccgactcccacgcatgcccgtgtcgcgtacaatttctgccatggatacgatcccccttgtacagtcgagtcacgtcgccgcatgccatcgagccaggagcccgcccgggccgtgttgcatatctgtcgtcccgtgctccgcctgcgatgccagtttggatctcctgtcgaatgcggggtgcgccaacgcaatgcgaccggttttggggccctggatgcgcgccagtatgccacccagccagactctgtattgggatcgagtcaggatcgggccggcctgcaccactcctctctgcgccgacgtggttccgctctgggcaccctcactctcctcgagcccaaacccacccacccccctcccccgcgggggtctgcttccctcgcggcccggaccctgcgcacccctgtctctcggtatggcgtcccacatggcccagatctccccggcctgcctgccggcccggcccggcccccgcctggcggtggcccgcaccccatccccccacccccgctccgtggccgcgggcgccggggttcgcttcgccggctccggctcctccacccccgccggggtgctgagcaacgccgatctggagcgccttgtggacacaaacgacgagtggatcgtgtcccgcaccggcatccggcgccggcacatcctggcccagggcgagtcgctggccgatcacgccctgctggcggcccagcgtgccctggcggccgcgggcgtccccgccgcggacgtggacctggtcctgctggccacctcctcccctgacgacggcttcggcaccgcctgcgcggtccaggcacggctgggcgcgggcaacgccgccgccttcgacctcaccgccgcctgctccggcttcgtcatgggcgtggtcaccgccgcacagttcctgcgcacgggggcataccgcaacgtgctggtcatcggcgccgacgcgctgtcgcgctacatcgactggcgcgacaggggtacctgcatcctgtttggcgacggcgcgggtgccgtgctcctgcaggcggggggggagggggagcgcgacaacctcctcgggcacgacctgagatcaggtgtgtgtgttggggggtgggtaggggagggtgacgtcgtgtgcggagtggggttgggagaccacgacaggctgggggaggaagggcttgagggcatgaacactcgatcccaaacccccaccgcctccctccaccccgcacagacggcaacgggcagcggcacnnnnnnnnnnatgacgtcgtgtgtggaggggggttgggagatgatgacaggctgggggaggaagggttcaagcacatgaacactcgatcccaaacacccaccgcctccctcccccccgcacagacggcaacgggcagcggcacctgcactccaggttcctgggcgccggggacaaagcgctgaacgacgacaccgcctcctcccaccccgcctttgccaacatcgccatgaacggcagcgaagtgttcaagtttgcggtgcgcgccgtgcccaagacggtggaggccgccctgggcgtggcgcagctggaggtcaaggacctcgattggctggnnnnnnnnnnnnnnnnnnnnnnnnnnnnnnnnnnnnnnnnnnnnnnnnnnnnnnatcctgaccgccgccgcagaccggctgggggtgccggcgggtgagccggcggtcgagggtggtgctggggggcgatgtatgtatgtgtgtctttgtgagcatgcctgaggaggtagggggaggggcacnnnnnnnnnngcgagggcggtgctggggggcggtgtatgcacatttgtctttgtgtgcatgcctgaggaggtagggggaggggcaccaatggggggctgttgaagggggcccatgcatggggagagatctcgtcggtggcgccactgctccgcttcctaccaacccctgccccggcagcaggcggggcaggnnnnnnnnnncaggtatctctcccaccgcccccccaaccctgccctcccttcactcctgctcagatcgggtgatcagcaacctggccgagtacggcaacacctcggcggcctccatcccactggctctggacgaggcggtgcgggcagggaccatcaagcagggggacgtagtggccatcgcggggttcggggcagggctgtcctgggccgcggcaatcctgcgctggggctgatgacagccgctgcaccctgtgagggacaggagcgggcccgtctcgtggcgcgggggacccatcttcccaacgcagtgcctgggctgctgcacacccccgacgcgctgctctgggacctgagcgccagccctgtgcccgcccctttccccctcgtacttgcttctccttattgttgctagctaaaaatacccaccgctcaggggcatgtcaggtctgggaatgggcgggttctggcagcgtggtttgtcttctatacaggctgacaaattctatacaatggcatgggtatatcaagcatgagcaaaagcccaggagagcgagagcccggtcacatacaagatatgagcagggatatatactactaaattagccatcctcccatggttcgttcataccatccagaacacatccgatcccattagacctcggcaattaagctggattgggcgggaatagtactgcggtgggtgaccacgtgggaagtccccgtgacgaactgttttttgctcttccgcctttcagctgttctgcaccttgcccacgaaaaggacgcctcctgttgtgttttgtgctaaattcccaagggcgatgcaagtgcctatgagaggaggaacaaaagttgcataaatgatcctgggagtagcaatgctaggctaatggagggacgcatacagacttgagtgtagannnnnnnnnnctccgcctttcagctgttctgctccttgcccacgaaaaggacgcctcgtgttgtgtattgtgctaaattcccaagggcgatgccgtgcaagtgcctatgagagtaggaacaagagttgcataaatgatgctgggagtagcactgctaggctagtggagggacgcatacagacttgagtgtagaactcgtaacgagccttttgtcttcaatctccttgaatgtctcgaaaggtattacagatacagcagttgtgtgcagtgatgttgtcaatgcaaacccttctccctctccatggcgcccgatatgaaaatcttgcacctgcgcccgattctgagnnnnnnnnnnccaatgcaaacccttctccctctccatggtgcccgatacgaaaatcttgcacctgcgcccgattctgagaatgggggactggaggaagaccgtagagcgggcatgacagaggagttgttcagccttgggacttggattatataacgtctccatctatctctacttgatcaagacgtgagatcggaggtttgtccacctcccttcccctcgcctccaccttcgatgcatggtcggttgcagctgcttccggccaggtcgatcaggcaggcgatcgcttgaggaaactgtatctccagatccacagactgtacctgaaagcaatccagctggcgcacaacctcctgcgatgctgggtcgcatcctggcaggtgtcgcctgggtcctggcagctcgtccctgttgtgcaccggtcccccgctccagcccccccc

SEQ ID NO: 43371 - DNA, 77 bp, Chlorella protothecoides
cctgcgccgcgatagctcggtggccaggccctgccgcacatcccgcgcgttctccacctccatcagcacctccaggc

SEQ ID NO: 43372 - DNA, 61 bp, Chlorella protothecoides
gctgttcagcagccggagcgctcgcagcaccccctccccctcggtggcggggccgcccacc

SEQ ID NO: 43373 - DNA, 61 bp, Chlorella protothecoides
tgaagggaccaggagatcagcggcaggaggggctgtgcaagggaaggcacgcacagcaggg

SEQ ID NO: 43374 - DNA, 117 bp, Chlorella protothecoides
gcatggatgccaaatcgtggatctccggtgttttcctgtgagcaacccacttcccctggcagccgcttcattgacaccccccccccccccccagggggggggggggggggggggggg

SEQ ID NO: 43375 - DNA, 65 bp, Chlorella protothecoides
ggaggtcttgtgcggcactggcgcatatgtaccccgcacttggccccgcctgggctcgtctaacc

SEQ ID NO: 43376 - DNA, 128 bp, Chlorella protothecoides
cctcctggacgccaagcccgtctggacccccgcgagcctgatggaaaaagtaaccaggggccaagggatgccccgaggtcggatgccctgagggcagcgggtgggggagcacctgccagctctcagca

SEQ ID NO: 43377 - DNA, 114 bp, Chlorella protothecoides
tcggtgcagagcttggggtggggtcggatggccaggtcatacagctcagccagcgaggcaaagacgccgctcctctccaggaggcgcacctgccgcagggtgccccgaggacgg

SEQ ID NO: 43378 - DNA, 99 bp, Chlorella protothecoides
ggaccccgccctcctcagacctggccgcctctcacgcaaggtagaggctggatagtttaaacgcagcgttgaacgctccgctcctcacgccactcctct

SEQ ID NO: 43379 - DNA, 61 bp, Chlorella protothecoides
cagcgggcgggccggagggcgacggcgggggggctgaatcgtccggacgagccgaaacccg

SEQ ID NO: 43380 - DNA, 61 bp, Chlorella protothecoides
tctgggtggttttgctggaaggccaagtgggcggccacactggtgtagacgggcgaactta

SEQ ID NO: 43381 - DNA, 61 bp, Chlorella protothecoides
tgggcatgctcattgaggggcggggggggggcagcacggcaccagcgtcagctgagatgta

SEQ ID NO: 43382 - DNA, 73 bp, Chlorella protothecoides
gctgagctttcaagatgataccgctcccatggacttgagcatgcttcctccccggcatgcctgcatggtgtga

SEQ ID NO: 43383 - DNA, 1764 bp, Chlorella protothecoides
  modified_base (216)..(351): a, c, t, g, unknown or other
gcctcgcccccctgcgcgccgccgcgctcccccgcaggcccccccgcgcgcccgccgccctcgtcgcccgccccgcccgccagcaggcgctgctgggcgaccacgtaccggctggccatgatgtgctggatgaggtaggccttgcgccccggctccagcccggcgtcggagctgacgcggcgcaccgccgcctccagctgcttctggttcatgcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccgcgcccagcaggccctgggaggagaggtagcccgccacctcggccagcgtgtcgcgcatctccgccgcctggcccgcgccgccgccgcagcgcggcgtggcgccctcgcccccggcgccgccccccgccccgccgctgggcgtgtctggcatggcctggcccatggccgcccccagccacgcgtcaaaggcggtggagctggccgcggagcggatgctcagcatcatggcgtcctcctcctcccgcgtcatggcaccgcgcacccaagagagcagcgaggtcagcacgtcggcgccggtgcgcccgatgatcaagcccaccaggtgctcctgctcggccacggggaagtgctcggcaaagaggggccagagctccagctcctcggcgcggatgtgggtctccagcgacccgcgcacgcccgagtagtagcaggccagctcggccaggcgctggcgccggctgtccagcgtgcccgtggccatcacccggtccaggcactggcgttggccaaagggtggcaagggggggggggggttgggcaaggtgctgggtgagcgggcgctgaagcccgaggggggccagcctccactcacagcgtcaaactcagctcaacctcactcccccacccatcccgcacctcgctgcaggtctggaactgcatctcctcctgctcgtggtccagggtgtaggcgtggctgacgttgcgcaggaccttctttccttccagtgcggggaataccacctcgtcctctgcaaggggagcaggaggagggggggggggacatgtgatagagggtcagcacgccagctggcgcatgggggaggggggggcggggaccacagcaagcctccaccttgcgtcggcgaccagccacgggactccacttgtggtacgcactgcgttgcatgcctgcctctccccatcctgcttccctcaccagacagggagtgggcgcggtagatcccacgtagaaactggaagcgggcggccaggcgctgcatgacctgcggatgggtgacacgggacaggcttcgacgtcttgttgggtggaaggggagaacgcggcgagcacagggggagggtggcgcgagtcgctgcgatcacgcaggtatgatgggtccctgccgcgtccctttcatcactgagccacttcaggaacaggcatcggccactccctaccagacaggaggccccctccctcccacacgccgacacacctctgtggtgtctgccagctcggccgccgtctccaggcgctgctggcaggtggcaatggtggcctccagctccgccagctccttccgcagcgcgttgtggaactggaagatgtggtcgatgggcgaggggcccgcccagccctgcgccgcggcgccgccgccgcgcggcgccgcctcgaaggcggccgccgtg

SEQ ID NO: 43384 - DNA, 80 bp, Chlorella protothecoides
cctcagcagagccttcccatcccacgcacagctttcccacccacacacagctttcccacccacaccagcagccaacccct

SEQ ID NO: 43385 - DNA, 5646 bp, Chlorella protothecoides
  modified_base (449)..(458): a, c, t, g, unknown or other
  modified_base (1143)..(1152): a, c, t, g, unknown or other
  modified_base (1210)..(1219): a, c, t, g, unknown or other
  modified_base (1415)..(1447): a, c, t, g, unknown or other
  modified_base (1641)..(1650): a, c, t, g, unknown or other
  modified_base (1708)..(1837): a, c, t, g, unknown or other
  modified_base (2175)..(2184): a, c, t, g, unknown or other
  modified_base (2434)..(2443): a, c, t, g, unknown or other
  modified_base (3337)..(3346): a, c, t, g, unknown or other
  modified_base (3807)..(3830): a, c, t, g, unknown or other
  modified_base (3972)..(3981): a, c, t, g, unknown or other
  modified_base (4541)..(4550): a, c, t, g, unknown or other
  modified_base (5023)..(5032): a, c, t, g, unknown or other
  modified_base (5376)..(5385): a, c, t, g, unknown or other
gcggcggcgcggggtcgggtgagacgccgtcgtccaagtcgacggcgccctgggcggaagctgccccggcgcgcgacccgctggcctgtgcgaggccgtgagtggctgggcgcagggtgctggatcctggcttcctacctgaccctcgactcgctctcccaaagtcctcggccctgcgcaccgcgtcccgcgctccctgattgcgcgcgcgcgcagggctcccacaccgtcctgtcctcctactaccaccaaccctttcctgactgagcggctcccactggtgtcgtgcaccatcatatcgtgtaccatgtgccacttttcgcccagtcagagggagtttgaggcgacgcagcgcgtccaggacctatacagaccctggcaggtgcccatctagtgccatgccctgtgtcgatcgcagcctccagttcccggcccctgctttggcagcnnnnnnnnnncccctctcctgactgagctgctcccactggtgtcgtgcactatcatatcatgtaccatgtgccattgttcgcccagtcagagggggtttaaggcgacgcagcgcgtccaggaccgatacagaccctggcaggtgccctcctagtgccctgccctgtgtcgcccgcaccctccagttcccggcccctgctttggcagcggtcgctcaggccggggcccgcttcggcgccggggtttgctccgcgacgcccacctcgcgcatgaacgccaccaggtgcgccatgatggccggcagggaggtccagtgcacgtagggcaagcccctcgccgccgcctcctcccgcacgatggcggtgatggccgggtacagggccgacggcagggtggggaagaggtggtgcgccacctgcaggttcaggcctcccgtcagcaggcaggcccggcgcccgccccagtccgcggacgtcgccagctggcgcaggccccagtccgatgcgtcctcgcccgccccagcgccctgggtcgagtctctcttggtggcggccacgttgtgcgacacgccgagcaggacggccagggtcaggccctggaccgccatgcaggcggcggcgccggccgccgccgcgccccagccctgcaggcgggcggggatcacaaggagcagggcccagtacagcgccttgcccnnnnnnnnnntgggtgggcggggtgaaaggacgtggggtgattgaggtggacagagggaccacacggnnnnnnnnnnggctgcgccccagccctgcaggcgggctgggatcgcgaggagcagggcccagtacagcgccttgcccgcccaggcgccagccagctcccaggctgccgcgcctgccagaggcctcccaggcatacgccgggccagcagggtggcgacgtcgcccgtctggaaggccagctggagcagggcaaatacgccccactgnnnnnnnnnnnnnnnnnnnnnnnnnnnnnnnnntgagcgcgagtcggtgcatgtcaggtggtgggtggaggacggtaccatgcagggccaatgtaggcggtgcacgaagccacccctgccaccccccacccccgcccctgaccgcagtcctgccagcacatgctgcaggcagtgttccgtgaccaagctcaccatatagatgtgctggtaggcatgaaaccagcgcnnnnnnnnnnagggtgggcagggtgaagggaactggagtgattgaggtggacagagggaccacacggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcccccgcccctgaccgcagtcctgccagcgcatgctgcatgcagtgttgcgtgaccaagctcaccatgtagatgtgctggtaggcatgaaaccagcgccgcggcagccttgcgtcgaagcggagcagggggtatgcgctgaccacgtcctcgtccagctcagcgtcgttgcagtgcacgtggtgggacacctggtggtggtacctgcagtggggggatggcagctgggttggtccagggtggcgggattgacattctcacacgatggacgcgtcaccagggacaaaatcccatcatccacgccgctccatgcctggcccgcagggcagggccaggcnnnnnnnnnncctcacacgatgccgtcgccggggacgcgtcaccagggacaaaaccccatcatccacgccgccccatgcctggcccgcagggcagggccaggccgccaccctcgacggacctccaggcgacggaggcgccaccgatgaggtctgccgccgcccccgcggccaggttgatcccggggcgtcggctcatggagccgtggttcccgccgtgctgcaccgccatgcccacccaggcccccgccatgcccagcannnnnnnnnngccgatgaggtctgccgccgcccccgccgccaggttgatcccgggacgttggctcatggagccgtggttgccgccgtgctgcaccgccgtgcccacccaggcccccgccatgcccagcaggcagccggaggccagcgagcaggcgcggcagtgccaggcgtaggcgccggccgcggccagcagcgccgcacccgctgccacgaggctctcttccgccccgggaagaaagagggaccggcctgggcccgggccgccccccgccgcctctgccccgaggggctgaagcacctcgcaccgcacacgagcccgcacggcggaaagaaagggggaatcaagcgggcggggcgtcaccggcacggcccaggccgggaagtcgggcaggcggggcagggaccccagggccgccgccgccctgtccacgcggacgtggttggactctagcagggcggtgcagtccctgtggacggccagcctcgccagccagccgccgcccgggtgacggccgaaccagggtgccaggtcgtacgcctggccgcgatacaccgtccactgccgtccttgccagcgtcggagggcatcggcggccagtgtggcaggggagtggagggtgccggggggctccttcccatgccgtgaggtgcaggccgttgatgcatggccagggcagggtgccgctcctgtgtccactctcgtggagacatgttgttgttgggcagctgcccaggggcatcgtctcaggtcgaggctttcgaaaggtgtggtcactgtcttcctcgacgctgtgaaggggcctggatctgctgagagtgcggggcctgtgaagtttccgaaaggaaggggcacacgtgtgtgatccgcgaacttgcaagtgccgattaaccctagcggcacctnnnnnnnnnnacccgtggagacatgatgttgttggacagctgcccaagggcatcgtctcaggtcgaggctttcaaaaggtgtggtcactgtcttcctcgacgctgtgaaggggcccggatctgctgagagtgcggagcctgtgaagtttccgaaaggaaggggcacgtgtgtgtgatccgcgaacctgcaagtgccgattaaccctagcggcacctgcatgaagccaccccccctcgcatcgccaggatgctgcacatgggacgacatgcatgtgttaccccatagatcagacctggtgcttcgccgtgattccctgaggctgcacagcgcgctcgtgcgacgggcacggggagcggagagggtctctgtgtgcgagggcacggccacatgcctcgccagagtcgtacgctcacagggttgagcccgcactcctctactcccttcttgccattagggagaatgtgccgggnnnnnnnnnnnnnnnnnnnnnnnnacctcagcgcccatgctgcagggcgatctcttcaccgatacttccatccctcacgaacactggaatcccattcaagcgcatgtcatgcatgcgggataatccccttgtagatgggactcaggctctgaccagggcgtacttnnnnnnnnnntcctcagcgcccatgctgcacggcgatctcttcaccgatacttccgtccctcacgaacactggaatccccttcaagcgcatgtcatgcatgcgtgataacccccttgtgggtgggactcaggctctgaccagggcgtactttgctgccagcttacacaacagttccccctttgaatcatcctgcgcacaggcagctggcccagtgcgtttaaaaaactgatacaaggtgcaccagaaagggatgaaatatgggttcagcgagaggtgtatcccctggctgcacgtgcccgccagggattctgtctgggatggcctaccaagggccactcaccagcgatgcttctggagagaagaaaatggcagccggctggtggggcgagacggcagacacttcagcgcaaggtgatggtgccggggtggcatccagggacgagggaggggggggtggaggcaatcttggagcagagagtgatgttgccgcaaacgtggggtttggagcactcagagaatagcattttggcgagggaggggaaaggtgagtgcgagaggtgcatttggcnnnnnnnnnngccgccaggggttctgtctgggatggcctaccaagggccagtcaccagcgatgcttctggagagaaaaaaatggcagccggctggtggggcaagacggcagacacttcagcgcaagggtatgatgccagggtggcatccagggacgagggagggggtggtggaggcaatcttggagcagagagtgatgttgccgcaaacgtgggattcggagcactcagaaaatagcattttggcgagggagaggaaaggtgagtgcgagaggtgcatttggccctgcgcatgaccagccgtcgcaggggccgagggaagggactcgggtttttgggttggaagggcgctccgcgcgcccgggggggtgggttgggtggggggtggggtgcgcgcgcgcaggcacgcgtggttcacctccaccaccgccccaacccgaccgctcaccgctggaagcagtctgtatcgccgatgtacagcttgnnnnnnnnnnacagctcacgcccggggccaggccggaagcgggccggccatcggtgtggaccctgctgggcggcgcgtggctgctgccccacagcatcaccctcagcatgacggtcatgcccctcctctgcatctccatgctcgcctgccacttctccgccgcctccgtgctgggcgtggagctgctgaccgccgtgctgcaggccatcacgtacttcaagctgtacatcggcgatacagactgcttgcagcggtgagcggccgggttggggcggtggtggaggtgggccatgcgtgcgtgcgcgcgcgcaccccaccgcccccccaacccacccccccgggcgcgcggagcgnnnnnnnnnngaatcgctgagagcagtctgaagaggctcaggaccagtacggggctgggtgctgagctgaggcgacagcaccggccctcacgcggcgccgatgccaggaaaacacgagaggtcccacggagggaggcactctgcgcctcagcgaggcatctgggaacgattcacgcccgtaacactcgttcccatagacacacacatgcgcacgacaaagcccgccgctgccaccgatgaagtcctgacccaccttgcgcaggaacttgaa

SEQ ID NO: 43386 - DNA, 64 bp, Chlorella protothecoides
gggcggggcacgctcgtggcagtgcacctccgggaacacacacacacacacacacacacacaca

SEQ ID NO: 43387 - DNA, 61 bp, Chlorella protothecoides
ggatgggcggggaggaaatgagcggcaggggggccgctgaagggggggggcaactgaggag

SEQ ID NO: 43388 - DNA, 76 bp, Chlorella protothecoides
ggcgcacagcatgaacggctcagcctcccgtctgtgggtatccgtgtttttgctggccgccaggccacagggtggc

SEQ ID NO: 43389 - DNA, 12627 bp, Chlorella protothecoides
  modified_base (1268)..(1277): a, c, t, g, unknown or other
  modified_base (1941)..(1950): a, c, t, g, unknown or other
  modified_base (2577)..(2586): a, c, t, g, unknown or other
  modified_base (2755)..(2764): a, c, t, g, unknown or other
  modified_base (2834)..(2849): a, c, t, g, unknown or other
  modified_base (3049)..(3058): a, c, t, g, unknown or other
  modified_base (4144)..(4296): a, c, t, g, unknown or other
  modified_base (4633)..(4642): a, c, t, g, unknown or other
  modified_base (4993)..(5002): a, c, t, g, unknown or other
  modified_base (5548)..(5557): a, c, t, g, unknown or other
  modified_base (5990)..(5999): a, c, t, g, unknown or other
  modified_base (6358)..(6367): a, c, t, g, unknown or other
  modified_base (8129)..(8182): a, c, t, g, unknown or other
  modified_base (8841)..(8850): a, c, t, g, unknown or other
  modified_base (9084)..(9093): a, c, t, g, unknown or other
  modified_base (10680)..(10689): a, c, t, g, unknown or other
  modified_base (10821)..(10998): a, c, t, g, unknown or other
  modified_base (11200)..(11209): a, c, t, g, unknown or other
  modified_base (11804)..(11813): a, c, t, g, unknown or other
  modified_base (12151)..(12160): a, c, t, g, unknown or other
  modified_base (12454)..(12544): a, c, t, g, unknown or other
cctccccacccccccccctgcacccacgcagctggaggcgctgcccggcatggtggcgggggttatgtcggaggacccggccgcccagctggaggccacaacccagttccgcaagctgctgagcatcgagcgcaacccgcccatcgaggaggtgatctcggcgggggtcatcccgcgcttcgtggccttcctccagcgcggcgacgcgccccagctccagttcgaggcggcctgggcgctgaccaacgtggcgtcggggaccagcgaccacacgcgcgtggtgatcgatgcaggggcggtgcccatcttcgtcgcgctgctggcctcgcccgtggacgacgtgcgggagcaggcggtgtgggcgctgggcaacattgcgggcgactccccgcgctgccgcgacctggtgctggcctgcgacgcgctgggcccgctgctcggccagcttcgcgaggacgccaagctgtccatgctgcgcaacgccacctggacgctgagcaacttctgccgcggcaagccgccgccggagttcgaggcggtgcgcgccgcgctgggcgcgctggcccgcctcattcactccccggatgaggaggtgctgaccgacgccagctgggcgctgtcctacctgtccgacggcaccaacgacaagatccagcacgtcattgatacgggagtcgtgcgccgcctggtggagctcctcctgtgggtttgagggggggtccgttcagggttctgaagtgcagagttaggactttcggggatgggtgggaggtgggtgagcgtggcggtcagagaaagcgtgaatgctgagtggggtctggactgtcgctgcggggccatgggctcgggtgactccactccaccccccccaccccccaatcaatcgactcgcagacaccaggtgccgtcggtgctggtgccggccctgcgcacagtgggcaacatcgtgaccggggacgactcccagacgcagacggtgatcaactcgggcgcgctgtcctgcctcctggtcctcctcacctctagtcagaagaagtccatcaagaaggaggcatgctggaccatcagcaacatcaccgccggcacgcgcgagcagatccaggcggtcatggatgcgggcatcatccctccgctcatcaacctgctggccaacgctggtgaggatgggagggggaggatcgggtgtgtttgtgagggaagggggggttgtctgagggttggtgggtgctcttcagtttggcctgtgctgtggtctgcacggtgcgaannnnnnnnnntgggtgtgtttgtgagggaaggggggcttgtctgagggttggtgggtgctcctcagtgtggcctgtgctgtggtctgcacggtgcgaagcaccaccccctgtcagacccagccacactcaacccacctcacgttcgaaacacacacatgcacacaccttgaccaccgcccactgctgcagagttcgacatcaagaaggaggcggcgtgggcggtgagcaatgccacgtctggcggctcgcacgaccagatccgggcgcttgtggcggcgggggccatcaagcccctctgcgacctcctcatctgctccgacgtgcgcatcgtgaccgtggcactcgagggcctggacaacatcctgcgcgtcggcgagggcctgcgggagatggcggggtcgggcggcgtcaacccctttgctacgctggtggacgaggcggagggcgtagaccacatagagcagctgcaaaaccactccaacgaggacgtgtacgagaaggcggtgaacctgctggagacctactttgacgtcgaggacggtgatgtcgaggggctggcccccgcggtggacgcagccgcaggtatgtaggagcgtttggaaagggagaacagcttttttttggtggttggggggatcatcggtctcttaggggaagggacggcatgaacagnnnnnnnnnngtgtggggggcgtttggaaagggagaacagctttttttggtggttggggggatcattagtctcttaggggaagggacggcatgaacagggccgaaattggaggtcttgcacaccgtctgcgggttctggaggagggaggttcccctgtaggtgatgttgggagggcatttggcattcacaccacctcggctgagaagtcgggccctctgcatgaagttgcctctggcgatgctgttgggcctggagcatgaatccagggtctgcaactgatagtttggcggtgtaattcctttgaacaccatcattcaccctgatcccatacaaccctcacgtgcacagggacgtacgctttcggaggcggcaacagcagcgctggcggcggcttcccggcacagggggccccccagggcggcttcaactttgcaaccatgcagtgaaggctctgtgcaggttcccctgtcttccctggtgcgtttttccacatgtgctgctgtgatatgcaaacgcagaatgaagcgtgagaatgaagagtggggagggttggggcctgaggtcgactcagtctgtgaggctgtgggttcctcagctggctggatagctggctggatcaacgaggcgggggacagnnnnnnnnnngtcggcctttgccttggactgacccggatcaagacatcgcgcgagtacccaagccgtgactctttcagacagcaacagcttacaccatatgtatcaacaaaagaaatcatgcctttccaccagtctgtgctgccacctcagctgcaaagtcagatgtctgcatgaaggnnnnnnnnnnatcggcctgtgccttggactgacccggatcaagacatcacgcgagtacccaagccgtgactctttcagannnnnnnnnnnnnnnnagcagtggtagttttggtctttgaggatagcattgcctgcgaaacaacacctcacacagggttttgttcctgaaatgcagtgattgttgttgcctcggaaaccacagatgaaggcgtcccatgtatactataagcccccaaacaacacctgctccccacctttttctcaagaccttcgccgaggttgaacctcgcgaatnnnnnnnnnnctcccgaaatgtagtgattgttagtccctcggaaaccacagatgatggcgtcccatgtataccagaaccccccaaacaacacctgctccccaccttcttctcgagaccttcgccgaggttgaacctcgcgaatcgacggatctggatgttctcccccagcttggacacatgctccttcaccacatctgtgtcagagacagtgggaaggggtagtggtgaggaggcagaggagctggccttgatagtaatggaggtgcttctggggcaaggcagtccttgcattgatggcagatacgcggcagtgttcaactcgccgaagcactgtaaaagatcccctgctcccaagaatcaagccactcctccctccagcgctcaccctcgactgtcttggtggggtccctaatgaaagtctggtgaagaagggtctgctgggtcagcagcttgtccacgcggccagccacaatcttggacctgtggtggggtggagcaaggagtgtagcaccgtgcacgcattcctgagaaccttgacatgcttagctgaagccttgccactgctttccctgatggagactgcattatcgccagagcctgccccagaaagctgattccctctcctcaaatacaattggcagagggcatccgatgctcccccttacatcccagcaccaacctgatggcttccggcttggaggccaggtcttccttggcggcctcaatctccgcctcgcgccgcctgacctcctcaggaatgtcggcgacggagacgtactgcaccgaccctgatgccaccagctgcgacacataaggtcgggggggccttgttgagttgcatgagcctcctgccttgcaccaggcaggtgatcaaaatgatagaatagtggccaaatgggcaaaccccccacgacaaaggagggccattttattcgtgccatgcccctgctcgctccctccctggttccatcatttctacacagggaaaagcaggcatacctggagggcaatgttctcgacgagctcggagaatgcctctcctcgtgccacaaagtcggactcgcaattcacctccaccatcacgccggtcctgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccctgcacctgttgccggagtggatgtaggcgccaatgacgccctcggccgccgccctccccgccttcttctcggcgctggccagccctttcttgcgcagcgcctctgaggccgcttgcgcgtcgccgttggcttcacgcagcgcggccttgcatgccatgataccggcccccgtctcggcacggagctccttgatggcctggggcgagatggtggtcacggctgtggctgcttcagagccggagctgccgtcagcagcagcggcctcgggcgccggcgcagcggctttgccggactgactggcgttggacatggcggccacctgggcatcgacctnnnnnnnnnngccggcccccgtctcggctcggagctccttgatggccaggggcgagatggtgatcacggctgtggctgcttcagagccggagccgccgtcggcagcagcggcctcgggcgccggcgcggcggctttgccggactggctggcgctggacatggcggccacctgggcatcgacctcggccgcgagattgttggtgcggcccaccagaccctcgcccaggttgtacctgcgggtagcgagggaggaaggtgcagctaaggttgagatggttgtccatgtggggaaacgaatgtacagctgacacatcgctgggctttgaaacgattggtgccatgatgccactgaagggccctnnnnnnnnnnggcaagggaggaaggtgcagttaagggtgagaaggttgtcaatgtggggaaacaaatgtacagctgacacgtccctgggctttgaaccaattggtgccatgatgccactgaagggccctcgaagaactgctgaccgttttgaacatgcaagtctcataatgggccctgttctcatccaatcccacctcagaccagctcaccggatgaagcgtcggacttggatgttctcccccagcttggcggcgacacccttcaggtgctccgccacgctgagatccgtgttgcgaatgaagggctgctccaggagcgcacggctggcggcgtacttctgcagacgcccgtccaccatcttgcccctgtgttgcgatgagtaaggtgaggggagagtgaggctgcatgccctaccaaatactatgcggcaatagtgaaacatgttgctttctttgctctccacctgagccaaccagtggatccttgcccaggcggttcaagaatgtctgcacattcctctattgacgccccaccccaaaacccaacccccaatgnnnnnnnnnnttgttacgcaacaatagcgaaacacgttgctttctttgctctccacctgggccaaccagtggatccttgcccaggcggtttaacaatgtctgcacattcctcgatcaacgccccaccccaaaacccaacccccaatggcacctgatggcctctggtttcttcagcaagtcctccttgcccatctcaatttcacgctcgcgctcaatctcagcggctggcacatcctccaggttcaccacatccacgcccgcgcaggctgccacctagtgcatccatgagagcgggggcagggaagctcgcaagctaatcattgctcagtagggtgcctacctccgacctctgtctctcttcaaaccaccatgcatggcaaggtggcaccatcacacccacccctcctccgcatccctttcctcccagcacctgcatggccaannnnnnnnnnatacctccgtcctctgtctctcttcaaaccaccatgcatagcaaggtgggcaccatcacacccacccctcctccgcctccctttcctcccagcacctgcatggccaagtcagcggccagatccttgaattcgtcgctcctggccacaaagtctgtttcgctgttcacctccaggagcacgccaatcctgataaaggggccacgggaaatgaggcgatgctaggcatggcgtgattgacatgcacggcgttgcctagcacactttggctccgtgtcagaactgcctgacgcctcacgatcatgcgctgcacatttcccaggcctgcctaacccaagcatccacccctcatactcccatcnnnnnnnnnnagcgttgcctcgcacactttggatccgtctcagaactgcctgatgcctcacgatcatgcactgcacatttcccaggcctgccttacccaagcatccacccctcatactcccatccctcacttgctgccgtgcacgaacgaccagatagccccctctgtggcagaccgccccgccttcttctcagcagaagccagaccctttttccggagccactgtgtgtgatacagcagagtaggtttctgtcggcgctgggacatgcacgcctgtggacaaggcaacgcttacaccgaggtggggctgccaaggcccagctggggcgggacccggcgtccatctgccaggatgagccgcacggacgccagctgcggcggcgcgacccgcgaccaagcagcgccgcgtcacccggagacaccgctcccaccccctacctcgcgggcgctctcctcgtcgccgccgttcttctgcagcgcctgcttgcagtccatgatccccgccccggtctcgccacgcagtcgcttgatggcatccaggctggccgcacccggcgtggcagcctcggtagcagcggggttggcgccttcattctcctgtcctgccccggtggagagggcgaccttgggggcagaagcctcctcgggctgtgcggcagcctgcacggcgcgcaggggtgacacctgctcggcgctctcggcctgctcagccatgtccgccaccaggctgtcggcgctggccaggccgacggacgcagcctccggggcggccgcctctgagacaggcggcgcggcttcttcctctacggctgcggggacgtgcgcgccctcgggggagccgtccggcacctcctcggcggcaggcccctcctcgggcgccgccgtctcggctgccgcaacatccagcggcttgtctttggccggggagccgatggcgtccgtggcgagggaggaggtatccaggttatcgacgacagagggggcatcgacctcggcagtggccagctcctccacagtttcctcctccttggtggtcaggggggagtcgtcgacaacgggggcgctgtcgacgaggggggaggacactgcctcggggctcgatgccgcgctctgcgactcctctgcagggccagagtcggagatcaagacgtcgtcagatacgagctggtcggcggcaggcacctcggaccccccaccgaccgacacagaggatgcctgttgcgatgtaaggaggggagtggagtgtgagaacgcgagcggcagaagcaggtctcgggacggcagagtgtgcagagcgataagggcagtgccatggccaacttctggcagtgcgcgttgctgtgttgtgctctgggcctcccaagcatgcccccgctcatcttttgcaactcgtccaacaccctctccacgacaaccccaccctaccttggggtaaagagagaggttcagcccagccatcttgagtgcctggcccatggcgtgaaactcctctgcgtcctcaggcgcgccgccggcaccctccgtccggagcccgccgctcttcagcttgcggtccagctccacctcggtcttggaccgcatggtcagcccgatcttggatccgcggttgccgcgcttgtccggcttcagtgaggtgatgagcacctggtgagtggaggcaaggaggcaaggggtcgggttgagctcgtcggatgaagggacactggggattcgacaaggaagacaagaacatgggaggccgggaggaatggagagggggggggggggggggnnnnnnnnnnnnnnnnnnnnnnnnnnnnnnnnnnnnnnnnnnnnnnnnnnnnnngctgcctagcagctgctcttgcatcatcttcaagcctgaaacaggatgcgtgacggtgaagcagcacaccagccacaacccttcgccacgcacctccacctcctggccaggcttgaatgcagaggtgacgtcggtgaccccctccggcagcttcatctcgctgtagtgcaggaggcccgtggtgccatcgcccacatccacgaacgctccaaaggtggccacgttggcgatcttgcccatcagaacgtcgcccaccttgacgttcagcttccgcctggcgggcgcgcccgagtcgcgccccgcagaagacttgcgcgccacggtggccgccgcgccgctgcccccgggggcggccccggttggaccccggccggagtacgacgaggaggacccctggcgcccgcccgcgcccctggcagcgccgccatcggacccgggcctggccccgccgccggcgctggggtcccgccgtggcgagtgggagggcttgggcttggccccctccgcgatcatggtcactgtgcgttgagagtttgtaagggtgggtggcgagaggatgtgaccggggttggttggacatgggacggttttgataagaagagcacagcaaggaaaagcattacatcaaccatcaagtgcatgggaccgagagtcacctnnnnnnnnnncgccccaatcttgatgatggccatctgcgcgattgcaagggcgggaaggcggatgtatggtcaaagggcatgcgtatcttacttggcccctgacagaatatggaaaatgtattctcaagagccacgcatcccacgcatcccacaccgccctgacagcagccaggtatgcaacggcagctcccaccagcacaatgagccaacatcagtgccggccacctaccactgtgcccgtgnnnnnnnnnnttgagtttgtgagggtgggtggcaagaggatgggcccggggttggttggacatgggatggtcttggtaaggagagcacagcaaggaaaagcattacatcagccatcaagtgcatgggaccgagagtcaccttcagacacaaaatgtagccaccacatccaaacccagcacatcaaagagcgctcacgtgcaaacttgaggccgtccggctcgatggtgagcacccgcacttccacctcctgcccgacttgcaggcggtcggtcacgctggagacatactctgtgctgatctgggagatgtgcagcaggccgtcggtcttggcgccgacgttgatgaatgccccaatcttgatgatggccatctgcgcggttgcaagggcgggaaggcggaagtatggtcaaagggcatgcatatcctacttggcccctgacaaaacatggaaaatacatcctcaagagcaaagcatcccacgcacaccacaccgccctggcagcagccaggtatgcaacggcggctcccaccagcacaatgagccaacaccagtgccggccacctaccactgtgcccgtgtacgtcttcccaacctccaggtcggtgaccgccagggtcctggccggtccctgcaccttgggcccgcgcgacgggtatccctggttgtagcgccgcgcagactgggggggagaggaggtcgcaggggatgcggccgtgggggcagcggcaccgccgctgacatcagcgggtgagctctcggtgggcgcctcggccgaaaaggatgcggtcgctgcggggcgacaacgacgccatgttggcgtcgatcgcgaaatcaccctgtgtacaggcaagggtggtggtcggctgggtccacgctccgacgacggaattcctgacaatcaaatgcttacaatgcgcctgtgcaaagtctgatatatcacgtaccgttgccgtaagaagacaggcctggagacgagcacaaagggagtctgcgcgtggcgtggggtgaggtagtcggtgctcggcgagccacaaacgcatgcaccccccgagccccttcgtcttcaatcaacacaccttgactgtgaactgcatggctgctaattgcttcccggcatgcaggcgtgaaagggccggagcggtcggatgtctggtcctcttcacggtgccatctcgcggatagggctctcgtctggtgacgtggaacactgagcggatgagggattttcgcgcgctttggacagcggtggtgggaaagaattaaaccccgccctgccagctgcaccgagtttgaaggggttttgcggtcacatatcattctctgaggaacatgtcatggcgaagcaggcgtcacgtgtatgtagcatggctcgacgtcgagcaggggcggcgctcggccgccatctgccgcttggtcagcgtcctcccagctgcaccccaggtcctccaccccgatccggtaccgcccaggggcggccaggcgcagggacacgctgtgtgtcaggggctctttgcctggactgagcagcagccggatgtctgcatgggaacggtgggttggagtttgtctgcgtgtacaaaggaggtgtcaggacnnnnnnnnnncacagcggtggtggggaagaatcaaaccccgccctgccagctgcaccgaatttgaaggggtttgcggtcacatatcaatctctgaggaacatgtcatggcaaagcaggcgtcacgtgtatgtagcatggctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctgagcagcagccggatgtctgcaagggaatggtgggttggagtgtgtctgcgtgtacaaaggaggtgtcaggacctttgcctcgatcccccagcagcgtgtacagaggatgaacctcactggacctctcgccggcgtgtcccccagttcttcttccctcaatcagcccccccaacgccgtctcccagctcaccctcgacnnnnnnnnnnaaccccccagcagcgtgcacagaggataaactacactggacctctcgccggcgtgtcccccagtcctccttccctcactcagccctcccaacgccgtctcccagctcaccctcgacctgccccgtccagaacgcggcggcccccccccccgccgcctcggcgggccaggcgccatccaccgcgccgcaggtcagcgctgcccgcgcccgcacagacgtgacaggcgccctcaatgacagtgtcagccgcacgctctcgcccacgccgcagaccagcgcggccaggctgtgccctggggacgacccatcccttcccgaagacaccatctcgaggagggcgtctgggggcaggtcgcaggcgtgcgccccggcgccgcccgtcgcgctcagcgtgcccttcaccgcccctccgccggccagacgcgcgagtacggagcgggcgagcgagacgcggagctcgcgctcgggcagcggcacacggccatcctgtgcagctgcgccgccgtctcctccctccgccggcgtgaagtgcagctccagggccgaggccagcgcgtgcgccgcgacagagcgcagcgcctccaggccgtcctctnnnnnnnnnngcaccgcccctccgccggccagacgcgcgagcacggggcgggcgagcgaggcgctgagctcgcgctcgggcagcggcacacggccatcctgtgcagcggcgccgccgcctcctccctccgccggcgtgaagcgcagctccagggccgaggccagtgcgtgcgccgcaacagagcgcagcgcctccaggccgtcctctggtacggtcgccgcggtcgcacccgggcggcgcatgatcgtggagcctgccgagcccgcctcccctcgagccaggacggccgatgccaccgcggcctcgtcggcgatggccagggcatgcgccacctcggcgctctccccnnnnnnnnnngcgagccaggacggtcgatgccaccgcggcctcgtcggcggtggacagggcatgcgccacctcggcgctctcccccggcgccagcgtcaccccggccgggcaccgaccggcgtcgggcccgccactcacgcgcgccagccgcacgtccaggtgccaggcgctgcggttggtcgcggccaccagcaggatgaaggtggtccgggcggtcgccgtcccgccgcccgccgcggcgtcgactccgggcacggcgcagaagcgcgcgcggccgaccgccacgctgcgcaggggagccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcacgctgcgccggcccagtgctggccccgcccccgcaccgccgtagtcgagggcgaagcgcagctcgcagggcggcgcgccg

SEQ ID NO: 43390 - DNA, 100 bp, Chlorella protothecoides
atgacctccttattggattcgggaactggtttgataactgctcctcgtatggttattggagggtggaaaggattacctcgagtaaaagtgactgtatggg

SEQ ID NO: 43391 - DNA, 61 bp, Chlorella protothecoides
ggcatgcccaccaggcccggcgcggcggcgcgcggcggcgagcctgcctctgctccagtgg

SEQ ID NO: 43392 - DNA, 111 bp, Chlorella protothecoides
agcccggaggcgtcgcccagccccagcccctcccctttgcccagccccagccccaacgtatcggccagccccttcccatggtccagcccggaggcgtcgcccagccccagc

SEQ ID NO: 43393 - DNA, 4275 bp, Chlorella protothecoides
  modified_base (126)..(135): a, c, t, g, unknown or other
  modified_base (224)..(292): a, c, t, g, unknown or other
  modified_base (520)..(592): a, c, t, g, unknown or other
  modified_base (774)..(813): a, c, t, g, unknown or other
gacgccggcgccgcgccggggcgcggcaccggcggcgcgctgtcggtgcgggtggacgtgacgggcctgctggcgggcatccccacgctgcaggcggcagggcaggcggcggcggcgggggagccnnnnnnnnnncccccgacgccgcactcacgccacaggacgcgcccgcgccgccgtaccccgcgctgagggtggccgtcggcggggcggggccgcccgcnnnnnnnnnnnnnnnnnnnnnnnnnnnnnnnnnnnnnnnnnnnnnnnnnnnnnnnnnnnnnnnnnnnnngccgctgatcgagcgcctgctggacctgcccctggacgtgtacgacggctgggtgagtgggcgaagagaaggggctgggtgtgtgagcgggggtgggtcgaggcctcgcgccatgccgacgcaggagcctggtcggggcctggaaccggggtcggccgcgctggcggggggagcacccccgtattattccatccagcgccaaccctcacgaagcggcgcccccccccnnnnnnnnnnnnnnnnnnnnnnnnnnnnnnnnnnnnnnnnnnnnnnnnnnnnnnnnnnnnnnnnnnnnnnnnncgatggcgagctgagcatcgttgcggacgatgctctctcatggcgcagcccgcgcttcgacggccgcgtccgcgtcaggtgagcggatgcatcgcgggcgggcggcaggggtgcggagcgcctgcccatatgcatgcgcatcgcttgccgggctgccccccccccccccccccccccccccnnnnnnnnnnnnnnnnnnnnnnnnnnnnnnnnnnnnnnnnggggctgatgcgtctcacccaatgcctggtgtgtaccctcccggccctctcctcctagcatgctgcacctcgggacacacgcctccatgcccaacccccacgctccaggcggggcgccttccacttctgggacgccatggacgcgctgacgggcgccgagctggatctggttttcgaggaacggcggctgttcctgtacggcgccgctgcgcgctttggcgccctgcccctggaagccaccggggacctcgacctggcgccccgggggggccagctgcgcctcacggcgcgcgtggcgcccacggaggtcaacgccctgcgcgccagcctgggcgtgcggccgctgccctttccactcgcgggcgcggctggcgggctggtccacgtgacgggcccgctggagaagcccgtgttctcaggtctgtgctgctgctcgagcggccatgtgcggggggtggacccacatgatggcggggctgcgggaaggggagggagcgggccatgcctgcgccggcgctgcagcatggaagatcgacagcatgctgcccgctccctgccgcgctccagcgatgcaaagttcacggcagaagaggcaatgctccaacagcatgccctgcctcccccgccgccgactgtcgcgcaggcacggtgcagctggtgccggcgggccccggcgcgctggaggacgccgaggaaagcgcagccatggacgccctgcaggccacgccgggggccctgggcgcctttgaccgcgtgccactgcgggtgggtgggaaggggagggcgacgcgggggctcgtgccggcatgcagcgcaaccctggggttgtaaggagggcggctggccggggtttcttgcactgtgtggctccatctcccccatccccccctcttctcgaacagtctgtcccctgttgacatcagacacgtcgcgcgcacatgcccctcatgtgatcacccctcccctctgccccccgcaccatgtcgacactcccaatcccaacccccttccctctcctccccagtccgccgaggcggtgttcagcctggacacggcgacgcagcggctggaggtgcatgctgtgcacgctgcgccctgcgacgccggcgccgtgcacggacatggccacctctcggtctcccctgatgcggaggccgacccggacgccctggacgtggacctgcgcggctccggcattgaggccgggcccctcctcaagcgcttcctgccaggtgacgcgcgcagggcgctgggctggggcgaggctggggtcatgtctggggcggggagaaggaagggcctgcttcatcgccgcagggggggcacaccaccctttcgacgcgcgtcgccatcggcacgtggcggcggagccagaagcggcgtgtccctcgattcgacctgtgcccccatccgcccttcctggtccacccatcccgccgcccgtccccctttcctcctccccactcccaggcgaggcctcgctgccgagcagcctgtccctgggcgccgccagcttcgaggcgcggatccggggctccgccctctcccccgccatgcacgccgacttccgcctgccggcgctggaggccagcggcagcctgcgcagcggcaagacctcctgcgcgctgaccctggcgtccccctacgccgacgtggcggcggaagtgggcctggtccctccgcccccggcggcctcggtggccgcggtgacgcagcgcgcggctgccgcgctggcctgccccgcgcccgacgccgcctcgctggcggtgacgctgcgcggcctggacctgctgccgctggtcagcgacgagctggcggcgcgccaggtggcgcgcgcgcagctgggcacgcccctgcgcctgcgcctgagcggggcggggagcctgaggggcgccgttcgggggggtgagtcggggcgcgccgcggccatggccgaggccggcctgggaggctgggctgctggcgcggatgatgccaaggatgagagtggcgacgcccagctcccgcaccccgcggccgagacgccggcctgggagttcacgggcggcctggggctggaggcgctgcgcctgaaccagctgcgcctgttcaagcgcctggacgcgcgggtggccttctcgccgcacggcgtgcggctggaggggcgtggcgcgcgcgccgacgaggcgctggacgtcgacctgagcctgccctccctgctccgccagctggcgcgccgccacggcgactcgggggcgaccggcgtggaggtcggacaggcggagggcggagggacgggcgcgggagcagatgacgggccgaacaccccagccctcaggccggaggaccccgtcaccgccccgaatgccgaggccggcgccgcctcggaactcctcgacgcagcaccggaccgcctggctaccgccgaccctcagtcggcgggcccggccatgccggcatcagcccccagcgctgcagctgtcggccccgggggcgcggccgctccccccccggccgcggaaaagccgcggggcggtcacttttacctgcgcggcggcccgctggtggtcagcggcgacgccgaggcggacgggtcccgcctggggttcaaggtccagggcctgaagctggacgagctggagatcgcctcgctcaggggggacctccaggaagcctctgcctcgctcaactttgccagccaggtgcaggcgtggtggcgacggagtggctggaaagggtgcctgggatgctcctggcctggggtgtggccggcgtcaggggcgaggggttgctcaggacccgaggggggaccgagcacttgcctctccttcctgggatgcatgccgctggcctgtgcgccactcctattgtgtcctgcaggcaattgcaaccctcagactcccgccgtcgcctgacctccagaccatcgaatgccccctcgcccccctcttcccccacatttcccccaaagaccgggagcgggaagctgcagctggcgggcccgcgcttcagcggcgtgcggggcgagtcgctagcctgcagcctgcgctgggagcgggacattgtgcagctggagcgagcctgcctggctcaggccgccagccggtacgaggtgcagggcgagtacatcctgccccccggcgcagcgctgccgcgctgcgcgggggacctgctggcacggcgcggcggccagggtgggactggcgcgggcgcgggcgcgggcgcctcccccgcgccgcgcggtctggcggggggcaagtggcgcgtgcaggtcaacgtccccgccgccgacatgcaggagatcctgcccgcggcgcgcgtgctgcagaacgccaccggcctgcgcccctccgactacgagcgctgcaaggccgacttcctggccgcgatggccagttcgggcctctccgcgcgtggcggcctgggcgccgcgctgcccggctggggcggcgcggcgggcggggaggacgggggtgtcgccgc

SEQ ID NO: 43394 - DNA, 61 bp, Chlorella protothecoides
agggggtacatggagggtggagggggagggggacagccagggcaagatgcaggctctcgag

SEQ ID NO: 43395 - DNA, 30450 bp, Chlorella protothecoides
  modified_base (107)..(299): a, c, t, g, unknown or other
  modified_base (3818)..(3827): a, c, t, g, unknown or other
  modified_base (4426)..(4435): a, c, t, g, unknown or other
  modified_base (8702)..(8711): a, c, t, g, unknown or other
  modified_base (9097)..(9106): a, c, t, g, unknown or other
  modified_base (9290)..(9299): a, c, t, g, unknown or other
  modified_base (9728)..(9737): a, c, t, g, unknown or other
  modified_base (10158)..(10167): a, c, t, g, unknown or other
  modified_base (10587)..(10596): a, c, t, g, unknown or other
  modified_base (11052)..(11061): a, c, t, g, unknown or other
  modified_base (12261)..(12270): a, c, t, g, unknown or other
  modified_base (16173)..(16182): a, c, t, g, unknown or other
  modified_base (16795)..(16804): a, c, t, g, unknown or other
  modified_base (17343)..(17352): a, c, t, g, unknown or other
  modified_base (18854)..(18863): a, c, t, g, unknown or other
  modified_base (18938)..(18947): a, c, t, g, unknown or other
  modified_base (19169)..(19182): a, c, t, g, unknown or other
  modified_base (19418)..(19427): a, c, t, g, unknown or other
  modified_base (21556)..(21565): a, c, t, g, unknown or other
  modified_base (22155)..(22164): a, c, t, g, unknown or other
  modified_base (22379)..(22418): a, c, t, g, unknown or other
  modified_base (23845)..(23854): a, c, t, g, unknown or other
  modified_base (24392)..(24401): a, c, t, g, unknown or other
  modified_base (25782)..(25791): a, c, t, g, unknown or other
  modified_base (27140)..(27149): a, c, t, g, unknown or other
  modified_base (27422)..(27431): a, c, t, g, unknown or other
  modified_base (27883)..(27892): a, c, t, g, unknown or other
  modified_base (30246)..(30294): a, c, t, g, unknown or other
cgccgcgccgggcggggccgccggccgcgcgccctcgtcctcgacatcctcgtcggtgcgggagcacctgaggtggcgccgcgcgctgtaccccgccggccgcatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgggcggcgagggcggcggtgagagcggcgacggcccggacccgacgccgcgcggccgggggcgagcgggggaaacagacgcgcgcgcgtcgcctgcggggccggacgacgccgatgccgcggcgcgctccccctcccccgaccccttctccgccggccctgccctggcctccaccagccccccaggttgcctcacccccccccggcccgaggacctccctcccaaaaccggcgccaccgccaccaaccccgccttccgcgccgtccagccgcgggagcccatgatgctgctggaggccgtgccccagaccatgtacggccgcatccggctgtgccgcgacgtgctcagcgaccacatcatcccaaactacctcgcttcgctggactccgcgctggagcgcctgcccccggccttccacccggagtgcgtggctcgggcagtgcacgcgccggcctgggatcctcccgtccaggagggggaaggatgtgggctgccggagacggtgggggtgccggagcccctgatggcatagtccagggccgggcggacgtgcccaggcgcgccgcaggaccctcggcaaccggtgcccctggccagtgtccacccgggacggggaagtggtggtcggcaccggccatgcatacatggagcgacgggctcgctcccctgctcttctctccacacctttgaccccccctgctgcttgcagtgaaatcatcccatgtgtcctcgcgccttctgtgcgtgctcccccgccgcagcacctccccctttcgtcacgtctctgtgcctctcaacccccaaacgctcgcttgcttggcccgcatggcctcccttccagggccctgtttctcgcgacaccgaccctggggttccccgcacgccccctcgatgggcgacactcctgtgaactccctgtaccatacccctgcggcggaccgcaccctcgcatgtaacaccgtcccctgtcgacccggagcgcgagcagcctggggcatggaggtggggggtccgtcgacgcatgcccgtcacccccatcacgcgacgggcaagcgcctgcgcttgcaccgcctgttcagcgccggcgccgcctctgcccgcgcctccctttcctcctcctcctcgctcagcgcggcgatgagctggggcgaggcgtcctccatgacgttgaacgcgtcggccgcggcccccacggcctgcagcacccccgacccgtcggcggagtggtgtgtgtcctgggccatgcccgccaggtccagtaccgctgcagtaccagagcgccgcgccgtgcccagctccagcgggcccaggtccagctcggtcaggcgcgcgccgcccagcttgcgcaggaagatctgctggccggaggtcagcaccgtgttggacaggtagtacagggacaggccggagggcacgcacagcgcaaagtagccaaccatgagcgggagcagcctgagggggtggggggaaggggccgagagcggaggtgacttggtaggatttggagggaggagagtgaggagtgaggagcaaggctagagttttggttgacaacgtcagatcggtcgtgcatggcgaccctcctgcccaggtcatgtcaaagcagcatgcagatggcagcccccaccaaacctcacccgatgatgatctgctgggtgcgcgcgttctcgttgttcgggtccaccggcggagagatgatggcagtggagatgtactgcatggaggtattgagccagagtggagggggcgggggtgggggggtgcggaggcgttgcagggattagccatgccgacagagtgagcatgcagccgaccggcaaagcataccacccgcgaggacgccgaggcagccgggcacaatcggcatgccatcctgaacactttatgtcccttgcgcgatgcactccgcccaatcacccccaaccaggcacctgtgcgatgaccatgagcacagggatgactaggtatcgtgaggcctcatcccagccgatgggcgggtgcccatccacaaacgggtagagccagctgatccccgtgcctgcaggcgagtggaaagagacggatggtggaggccagggtcagagagggaggaggggggggacaacacgccgggctcctgtaccccgcagcccagacccctcctgtatcccacgcccctggtcctgtgcaggggcatggactcccaaccctttcagcgcaggccttcagccctgagaactcaggagcacccacctgccctctgcgccgcaacggaggtgggccccgccagggagggcacccagtagaaaccctggttgtccagcaggcccagcgaggccacccccgtcagcgagcggtacagcccgatgaaaaccgggatggtggccaaggaggggaagcaccccgccagcgggttgatctccgccttcttatacagggcctgggtctcacgctgctgcgccttcttgtcctccttgtacttggccttgatggcgtccatggccggcttcaggcgctgcatggacagcgaggcctcgacctaagaatgcagggggggggaaggggtttgtcgggctgacagggggcgtagaggctggcggcagacgttgggggctctcgcgtacgtcatggcgcacgtgcgcaggcccatgcccctttgtcctggataatgcgcctcttgatagctcaaaaattcatgcatgcatggagctgggaggatgcctgcatcacttccccagaagcctcacagcccttcgtcttccattcccatgtgcaggagacctgagatcgctacgatacacctgatcccctggctccacccatcccccccaacacacaacccagcaaataatcacctgcttcttggtcaggggaaaggtgcacagcttgacgacggcggtcagggcgacaatggaccagccgaaggagtgggggacgtgcgcggcctccagcccagactggaaggtctgcaacaggtactccaggccctgcaccaggggctccagcaggccgttgtcctgcgccaccgcgcgagacgtggccgcagctgccaggtcctcggccgccccgctcaggccatgcacgcccactgaagcgcaggtggtgggcctctggggcagctgggaagggcaccaccgccctggtctgcgatggcgagtgaaggtgtcggggatcatggccccgactcgcgcaccttcaacatgagcatgcagaaaaggaaaatgggttaggtcgcttgagcgaatccgcctcaagctcaagccatacctgcaaactctttcgaggttgtatcggcgtatgcagatgcccaaagtgggtctggcggtgaggacaggctgcgggagcgagcccatgacgagccagcgatggagcgcagcagtcgggctttcaagctgggcagggagcggtacccatgagcaaagtccagcccgcctatatcttaacacattaatgcacttcaatgatgagatacaagcatgcaacaactatgcgtgctcctctgcctcattccgcctcagggcgcccatctcctgacgagnnnnnnnnnngtgatgagatacaagcatgcaacacctttgcgtgctcctctgcctcaatccgcctcagggcgcccatctcctgacgagttatcccgagtgcgcaatctccgagatcgaaaaccgatgccatgcaaagagcgatcaacgggaccaaaacggaagaaggagatcataacaccactccagtgagctcattggcgctgaggattccatgtatgcatgcattgctcctgcatcgcgaagtgtggtagcatgagggggtccagcattcccgctggggtgcaggcggggtgcctacccccggccacccgcccgatccccaaatcttcacggcgcagccacaccccgaggcctttccgcaacagatatacgtgtagggcagccctcggcgcctttggggtggctgagctcgagagtcctttggccgccctctcggctttggggctggcagtggcagggtgggatgggggtggaaagggtgcgatggatgtggtgtgagtcccctttggatcgagagaaagcactcttgtcctgttatagttccaattgcaatgcccaatgggctttcctgctctttaggcaatgtcctgacactgttcctccttgtnnnnnnnnnnggaaagcactcttgtcctgttataattccaagtgcaatgcccaatgggctttcctgctcttcaggcaatgtcctgacactgttcctccttgtttaacgcctctgcgcagcgtctccgctctgaagcttgtggcgcacctcaaatccgaagccgagatagccaggctgattgccaaggtccataaagtggggaatgatgaatctggacggcctggtcacctggtgcagatcggaggcaatgtccgcagcctctactactaccccagcaaagcttatgccgccatgactgttgttggcaagggcctggacccgggtgagggctgacaaaggtgcagagaccggtggtgtttccagagcctttggctgatgggttgggaagctgcattgctccactgcatgactgtttcaatgatagtcttccctgtccaatgcccacaaatagtctgtcacatagcctcccaatgcctgtggacaggcatttggacgacaacggctgcaaagaataagctgccactcaaggtcgagagccaggcctctgaggtgcctgacctcagcttcctgccagcatccagcatcgacagcgtggtgctgctgccaggctgtgcacccactcccgagctcgtcgcccaggtggggggtgtgtgcagggcatttcatgctgacgggactgatgattggcagtcaggacccacgataacggcttggcccatgaaataaatcctgctggtggaggttgccccctgaccttgtccagtgcccttaccccatcgctcatgaaaggccgcctgactcaccatccatcgttccctacctgtgatccctgttgctgctgtagattctgagggcgctgaagccagggggtcgtctgggcttggcccttagggccaaagggaagggtcccattccctctctcctccaggcacttcctctgggacctgggcccctcgaagcagacgagctggagcgctactttccggacactcagtgggaattcatggaggcagggaccgcgaatgcgggactggaccccctggttgtcgcactggcctccaaatccatgcaggtgggcagtgcgcctgaggcgctgtgatggtcagcgactgcgagggggactgagtgtggtgcctttcagttgctgagtctttttcgtaagggttgaaacttccccgcactaataattggacatggcgtccatggtgttcttgctgtgctcgtttgccaacacatctgccattctagacaatgggctctcctgtcctccctcaccttgagcacagactcgaactcctgtggttgaatccgtcgacgcgtcaaccttccgagaagctcagaagaggctgaagagagagcgtgccaaggctgcaaaaggcatgggataagtttaccatcgacatgctacatgccaaatagctttgatggatcatgatgagaccatgtcagcgcgtttcatttgcagcagtgtaccccttgtgtgctttacctgacaggaaagcgggcaccgtttagcacaatcatgtccctatgtcagagatgggtattgaaatcctcccctcataagcctgccctgctcacagggtagtcactgcgaacgtgaacactcgcagaatttgagactgtcgcgcttcgagccacggacagggagaccagggcatccctcgcatggtcgctagtgcccccgtgcgacttaacaaagattttgagactggtgatgggacccgaggaagttcagttggtggttccacgggcttagggactcgccgtccgccaggagcctgactccctgccaagttcttgcacagccaggggatccgacactggactcggagcgtttcaaccagcgtaatggctgcctgagatgcggtcacgactggcgaattgtttggaaggctgatttcgggccagccaggccgttgctgggcctgacggagggtgatgcagcgcgtcagggtgtaccacttgaatgaaaatggacactgggacgacaagggcacgggcgtcatcaaggtggagacagcagaggtgcgacatgcgctggggatccgatgtcgtgctccatcggctggcgaccagggtgatggttcatcggtgtgcaccttgaagctcgtctgtacgagtgcctctccccggcctcatcatcgaccaatgctccccccgcagcaccccacttccgatgtgcacctcatcatcgaggacgacaccgatgcatcccgcctgctcaaccacaccgtcacccagggcacctcctaccagcgacagaagggtgcgcattttgggatgtatggtcgcgcagggagatcagagggctgcaggcatgcgcgtcgaccccctgtgcatctctgcatgtggcttggatgctgcgacagggggcaatgtgactgtgggtggcacacatccgtgcaaacactatttgttcgcgcagcgtttgcatcctacaagcagctgctccagcgtcgccccgcccctcgctccgcagacgacagcatcatctcctggacagaggcgtccagcggcatcgagatcgcgctttctttccaggaggccttcacctgcacgcaggtgtgggccgagatccagagcgtccaggacgcgggcctgagtcctcgagctcaggctgcaaaactgcaaggtgtgtgtggggggggttgcaggaggggggctccctgtcgtctggccacagcacggtccctctgtgcaggttcacgctgggtcctggtccgtccatggcctcatgcccgcccgcagcgacatggtcttgagccgtgtgggttgtttcgtatgagtgctgcatcagctggagacttgggcccgtcggcagggtggtgctgctgtgcacagtgcagcaccagccctgcccagcttcccccacattcgtctgtcgcaccgtgtgctgccctcgcattcccgagcagatcggcagtggcggacggctggggggacggaggcttatgactcggtggcagcccaccacacctacgaaggcgaggcccgggggatgcactcgggcacagtcctaccctgtcttggtgatcgctttggccggcatgcttgcaggaggggcccctggctgcctgtgtgggcaagggcgctgtccgcaagggaggtcaccgttccttcaggctcgctggctccgcacccagcctggcctggccctcccacgtcatctcagcccccctccggcttcaccccctgtcgcgagcagagtctgcggggcttatgcacgggccccacctcccgctgggccccgggcagtcccctgcaggccaggactccccccccgagaccggccccttccccgcgcccggcgccgacctccctgccgcggagctgggcaacctgcccgccatcgctcggtccctgagcgaggcctcggtcttccagcgcgagcgcctggtgcaccagctctccgcgcccggctatctgggccgcctggtgggcctgtttcgcgtctgcgaggacctcgaggaggaggagtcgctggcgcagctgcacgtcgcgctgcgcgccgccatcatgctgaacgacgccggcctgatcgaggcgctgctgagcgagccgctggtcatggacgtggtgggcgcgctggagtacgagcccggggtcgcgccggcggcgcgcccccgccaccgcgagtggctgcgcgaccgcgcacacctgcgcgagccggtgcccatcgccgacccgggcgtgcgcgccaagatccacgacacctaccgcctgggctacgtgcgcgacgtggtgatgccgcgcttcctggacgacgcggtgctggccacgctgcgctccctggccctgttcaactcggtggaggtgctcatggccctggcggcggacgaccacgccttcccggccctcttcgacaagctgcgcggcgcggagccggggggcggcgactgggcggacggcgtcggcttcctccaggagctggcctccctggccaagcacctgcaggcctcacagcgcgccactctgtttggcaagctggctgacctcgggctgtttgaggtgggagtgcaggagggggggaggtgtgtgtgtgtgtgtgtagaggtattcagatgctgcgggagggtggcggcgtcgcggagtccaaggcatgcgggaagacccctcgcgatgaggcaaccccccccgctcctgtaccggctccatacgcatgcctgctcgcatgcagtgcccctccccacaccccctcaccattctacaactcccgccgaccagcatcgccgccccaaccctcgcaccccgcaggtcatgatccgggtgctggnnnnnnnnnntacaactcccgccagccagcatcgccgccccaacccttgcaccccgcaggtcatgatccgggtgctggagctgggcgagccggagctccacctgcgcgccaccgacatcctgctggtgggggcactacacgaccccaaccccctgcgctccttcctcctctcggaccagggcgggtgcctcttccgcctcctcatccaggcatgtgctggggcgccgcgttcagggggttccgcggggggttgggaatgtgggtgggtgggggaggggggtggacgtcgatgccttcccagtgctcccgaacatgcggcccgagcggcgaggtttgctgtggccctcctcgcccagccacctgcctgccctctgtcgccttgcacctcgtcatgannnnnnnnnngcgatgccttcccagtgctcctgaacatgcggcccgagcagcgaggtttgctgtggccatcctcgcccagccccctgcgtgccctctgtcgccttgcacctcgtcatgattgtccagcaccatcccgaatgccccccccgccacagccaaccgcccctccatgttcttgtacccacccctcccnnnnnnnnnncccagcaccaccccgaatgccccccccacgccacagccaaccacccctccatgttcttgtacccacccctccccctcccatccaccccctgcacacagtccttcatgcacggtcggggctgcggcatgcaggagcaggtgttggagctgctgcgcatcctgctggaccccgacaccatggatgcgtccgtggagcgcgacgccttcatcgactccttctatgaggcgcacgcggggaccctggtgggcgccctggtcgccgcgacgaggggcggcggcgtggcggcagagagcgcaggtgctggcgcggcgggcgcgggcggggaggtggccgggggtgccgccggcgcgcctgacaccgccgcaggggcggccgacaccggcgacgcgccgacgactagcgcacacacgctgggactgatcgtggagnnnnnnnnnnggggggtgccgccggcgcgcccgacgccgccgcaggggcggccgacgccggcgacgcgccgacgaccagcgcacacacgctgggactgatcgtggagctgctgtgctactgcgtgacgcagcactcctaccgcatcaagtactacatcctgcgcaacaacgtcgtcgagaaggtgtgtgtgttggtgtgagagtctgggaaaggggaatggtcaggtcagaggccgtcacctggggatggagcaggctcgcacgccgtacacggtgtgtgcactggcatgggtcgggaaccagcattgaatgggtgatgcgtcggtgctcgataatcgagtctgggaccccctcctgcatggggtgtgcggggggccgtagtcagggtgcaagccatgctggggaggcgattgacacaaagagtagggagnnnnnnnnnnctggggggtgctggcagccgtagtcagggtgcacgccatgccggggaggcgattgacacaaagagtagggaggggacccctttggatacagaacaggactggcatggaggcggtcatcgaaagggtgcaaagcccttcccagatccctgatcagcccccacctcaatggcctcgcaggtgctccggctgctgcacaggaaggaacgctggctggtcgtggctgccatccgcttcctacgcacctgcctgggaatgaaggtgcaggcgtggggtgggatggagggcaaggggtgtagggaagagcatccgtgattggggctcgtccagagcggacgcagccggtgtaggactgccaagcaggttgtccccccaaagcaccacctcggccatccctcgcccctcaggacgagttttacaacnnnnnnnnnncgtaggactgccaaacagggttgtcccccccaagcaccacctcggccctccctcgcccctcaggacgagttttacaaccggtacctggtgaaaaacgggttgctggaacctatcatcgctgtgttcctggaaaacggcaatcggtacaacctgctcaactctgtggtgctggagctctttgagttcatgtggagggtgagtggaccttgctgtgtcgggtgcatggtagcctgctgcgtgggtgtgagtatgcctggtgcacgacaaggtctcacctgcctgatcggggagaggttgacagagggtgagggatgctgtgcttcaggtccagcagcgtccatccacttggttgacacgaatccatgtggggtttggcaagccctgaggggcaggcactgccgtgagcccagatctgatcccccctatgtatcgccgaggcctcttcacccaagaaannnnnnnnnnggggtctcacctgcctgatcggggtgaggttgacagggggtgagggatgctgtgcttcaggtccagcagcgtgcatccacgtggttgacacgaatccacgtggggtttggcgagccctgaggggcaggcactgccgtgcgcccagatctgatcccccctgtgtatcgccgaggcctcttcacccaagaaacttcctcccttcttcccattcccaacaggagaacatgaagggcctgctggggtacgtggtggagagcccgaggtggccagagctccaggccctggactttgcgcccacattcaggaggctgtcgatgaagcatgaccagaaccaggtggtgtgccgcctggggcaggaggtcttgtgtacctgggctgcctgtcccatccctggctgtgtatgggctttgagccttggtcattgctcgaagaaactcaccttcgtaacctcacaccaacaggaacggagcaccggctctgcggctgcgccagcggggtcgggccctggcagcgaggccggggggggagtgttccttgggcatgcccgggcagcagccgccgctcagcagcggcgaatacgtgagtggggtcagggagagggggagggggaaaggtgatcagcccctgagcttctgcatggcatgtccgaaggactgacatctgtgccgcaggtgatccttggtcccaacagccgcatgttgatgtggtcgattggccttggcaggtcaagcctggcgtgttcctccaggcaatcctctcctcacacgctcccatcgacaacaggcggcgaaaaggaggaggacgaggacgaggagaactacttcaaggatgacgaggacgatgaccgggggggcagtgccgctgctgcagaagtctccgaggtgagagcgctcagggatgcgccggcctccgtctcgcccagccctggctctccgagggtggttggcgcttcccctcccagcaacggtctgccaccctttcccggccgcctggtggactatgacgacgatgacgacgatgccctgcctctgggaggtgagcgccatgcatgcgactgcctgtgtgatgcagggtgagcccagtgcagggacggattcaaagacgctcacaggggggggcggggggcaatgcagcggtgagggttttgtagagccctaatgcagcacagtatccgcaaatatctgtaccatggtcctcccnnnnnnnnnncagcggtgagggtttcgtagagccctaatgcagcacagcatccgcaaatatctgtaccatggtcctccctgccccgtcccccatagttgtgcaccgaggtgggcccggtggaaggcgcggctcatcgcccccgcttcagaagaggttccggccggccagcccctcccagtgacacccaaaccaagcttcctgaccacgcacaacgtgtcccctgcattgtttctggctcctcccgtctcatgctcttcgcccctgaacagctccacgctctgtgaacgacgtacgattacagcctgtgtgccgccccctgctcgggctcaggcagcaatgtcgggcacatgcacgttgcgcaggagccggaaggcaggtccgtactgcagcccgctctcccgcagctgggcgtagagctggacagtgtcgcggggcaccgtggcactcgccctctgggcatcgatggtccgctccgccatcgtacggttcagacgctcctgacgcttcttctccgtctacaggggcgcgatggtatgggattgggggatgcaaaagccgaccggaaaggagtgtgcccgcctcgagtgcccaccccggcactcacatggtagaccgacttgataagttcctggaaggcatgatcgtcgttgccgagcacgacctcggcaacctccggctccttctcaatggcctctagtttcgcggggtcggccttcagagctgcacggaaagctgcggggtccttggcagtcccatcgtcgttcaacgcatagggatccgacatcctgtgctgcagtacaggatgcactggaggggtggaatgaaggaggacgtactgactgtgatccacctgccaatgacgctcgcggagtggagttgcacggtgcaagggctcctgcccgaagcgcatcccgtgaggtctcggtcaaagcggtcaaagaagtaccccccacggtaccgcccagcaaaatttgaatagttgacatgtgttacaattcctgcctcactgcgtgcaaagcggtccagcttgcacccttcatgcctatctgccaccgctcttgtcatgcagcaagacatactcgcggctggagttccccgtccggatcatgtcctgctccagaagctcatagaagcgcttgtcatccaggcgctcgccattcagaaatgtgccgttggtggaccccaggtccatgagataggggcgcaccgcagccaccatcatgccatcagcgccctccttctccgttcgcctggtgatcgtggtcatggaggctttgtaaggaattatgttgaggatcgcgacatgccacccgtcatgaagcggagtccatccacagggattcaccctcctgtctcccgttcatgtatctggcttggaaatgattcaagagcagcccttacatcggccctggatccacacggtgcaccatgcagcaaaaacctatcccttcacctgtactgcagcacacagtgctgcttggagcaggaagggtggtcggtgggaatgtcgaccaccgtcctgtcacgtccaaagaggtagctgctctgcctgaacgcagggtgatgagaaacaccatgttgatggtgttctggcacaggctgtgccaagtcaaatctgaaagtttgaagctattggggacactcctggtccaaagactgccttggcagcttccactcatgccagccctccctgggcacagctcacgatgccgccccagccggacagccaccagcagcatgcgatgcaaccacacctgtgaagaaagaggggcttcccatgtggctccccgctcttgaaggtgtatagcctccactgttgtgtgggcatcgaggcctcaggtggctcctgatagagtagtaccacaccgctgtggagttggtcatgggtggaagggaatcagggatgcgcccaacggggtgcaaggcggagcaatgcccaatcactgccaacatggcgcaatgcagcaactcagcgggatccgccctgccacatagacactcctagaaaggcatgcccccgcacttgacagtgttggtctcggctgccagtgctcccgacaaaccgaaatccggcttcacttccttgtctggcagctcctcctgccagagtgcagaatgtggtgtcaagtggcctggcatctaatcactgggggatgcacccggtaagcactgggctgctgcagagggcggtgccatcagcacggattttgtagatccagctctactcgtctcaaggttgcaagaatgtggcaaatatcagggtgaaactcactgcattcgtgagacccaaagcaacctcggaactttcgctctgtagcatacctgaatctcccctggcctgccccaggacatgccattcccgtcgccctcaccgccttcccgccgcccacggcctctggcaccccccggcggcgcgctgggacactctctggcccagtgtccttcctccccgcatctatggcaggcccctctgggagcaaaggagccgctctggtgactggacctatggatgatcagagtgtctcgggatcatgctgccgggcggtgggcaggttgcagaggaacaggccgagagcaatgacagcaagcaccaaggaggtctgctcaccctgcaatgtctgcgtcgtcccgccgccgcctgtctcgaggctgtgaggggtgcggaccccaccgcccctccctgctgccccctgctctgtcaggcgacctgctcccctcctgccactggcgccgtactggagagcgactgggccgcctcttgtccgatgagtccctgtgacgtctcctgtcccgcgatctgctgcgatctccgggggggggggagcgactgcgtcgcctggcctctcgggacctgctccttcgtcggcgccctgggctcagagacctgcaaggcaagggatccacagagcaactcagcgagatgtgcagtaatgcatcccggggcgttcattttacggtgcacacctgtctctgtagcccatggtgcgttgtcggtcggttaaccggtcagggatgtcactatctgaacacctttctccgaaactgttcagccacttatttcgtacaaggacttcgtgaagtattgcaacgatattatcatctagtttcgacacgttgagacgtgtgcatgtcaggatcgccaccccacatgcctctccactgtcgcgcacggccctgtgtccggagcttggtctgaggagtctgtccacctggtggtcagctgcctaaggatccgggtcattcaacagtcgagggcaagagcaccacatgcaagctgcgcaacacgttttgtacagtggccgacaaaatttaccctgaccggcctgccggcagggctggggcggcgtctggtccgccgccgatcaaccgctggatgcccctcgacaatcgagatcccagcaccgacagaggcgtggcagcaccgccattgactccattcctgtgcaggggcgattggggaaggcaattctgatgcggttctgatgagcacatgtgtatgcggcatcgttactgacccatgccatcctcatgctgggtggattcgacggatttgggtggcagagacaaccctctcccagcgtttccactgcagctaccttgtcctatccacagccgccaccagctccggcaagtccactgcatcggcatcccggcgcgcagccagaaacgccgcctcgttcaccacgttcatcagctcagcgccgctcatgcctggcattggcggtgcaaggatgaggtagatagagttatgtgcgacgcacaactccacgcatttgccactcccagaccacatggctgtccagactgatgcaccaaggcccagaacaactttgccaaactcaagcttctggaatcacctcctcccacctggggtgagccgtgcgatcgcacggcacatggcactctgcatcnnnnnnnnnntggtagatagagtcatgtgcgacgcacaactccacgccttcgccactcccagaccatatggctgtccagactgacgcaccgaggcccagaacaactttgccaaactcaaggttctggaatcacctcctctcacctggggtgagccgcgcgatcgcacggcacatggcactctgcatctcaggactgcctgccagcttcaccgtcctgaggtggaccgccaagatcgccgcccgtccggtggcgtcggggaggggcaccgtgatctgtgaagaggagaggggcgccggcgtcattgcacgtacttgcggatggggcagaggagtggcatgaggagcggagcgttcaccgctgcatttaaactatccagcctctaccttgcgagacaggcggccaggtctgaggagggcggggtccagtgactccgggcgattggtggcggccaggaggagcacgcccggccttccatcaaagccgtctagctctgttgcaaaggatcagagggggtagctgtcggtctgacaccatgtcggcgtggtccctaacaagctgcatcaggcggggaagggcattgcgctgtcgacaccctctggggcatccacgatctctgctactnnnnnnnnnnatagctgtcggtgtgacaccaagtcggtatggtccctaacaagctgcatcaggaggggaagggcattgcgctgtcgacgccctctggggcatccacgatctctgctacttgcaatcacacgacgagttcagagtcagatgctgtgtccacaggcgctacctcactccaccactccccatcaccccatgcctgtgagcagctggttcaaggtctgctcccgctcatcgttcatgcccatgccgcgccgcccacctgtggcagtagtgttccatgtggtgggtgcacaaacgggggaatcacgcacgagccgtggcctgcccgctcattgggcatcccaggcgagccaggcctcccgcaggcagtcgccatgcgccaacaccagccccacaactcacccacagcatccagctcgtcaatgaacacgacgcagggcgccttcttccgtgcctcggagaacagttccctgtggtgtaagagcagaaatgttggtgcgcctccgacccacactgcgctcaccccgcagtactatgaatatcgtnnnnnnnnnnctccctgtcgtgtaagagcagaaatgttggtgcgcctacgacccacaccgcgctcaccccgcagtactatgaatatcgtccaagggcgccaagaccatcctccccctctttcacagtacctgatgcgtgccgcccctcgtcccacaaacagctccacgaactcggaggcagagaccacgaagaagggcacgcccgcctcccccgccacggcccttgctgcattgcggcatgagggccaggagcatgtgatgtcagatactgctgtcgggaataattggcgccagacccggggaatgatgtagctcatgccggccccgggtcatggggaggcatgaggtaaccgcaagcgcatgcacatgcgtcgacaagggcaggcacgagaatatgtggacccttcaccaccactcacctcgcccgccgcatcggccccagcatctggacgcaagctgcacggaccccccacccttcccccctcccccattctctcccttctaggcaccacccaagtctcacccagcagggtcttccccgtgccgggcggcccgcagagcagcacgcccgagggcagcttggcgcccagcgccgcaaagcgccccgcgtccttgaggcaggacaccacctcctgcagctcctgcttggccgcgtccacgcccgccacgtcctcgaaggtcgcggaggagagcgcggcgcccttgctgggcgtgcggctctgcttgccgcgctggttgccgcccagcgcgcggcggccgatgaagtacagcgggacaaggggcagccagagcgccagcgccgtggtcagcgcccgcgtggccacggaggacagagtcttctgcatggcgccaaaccggaccccggccttgagcaggatggggatcagctcgtggctcgccacctgcttggtgtagcacggcaccgggacggctggggcggcatctgcgtattggatcaggggggggaagaaagggtttgggtgggtgtgcgagctggtgctgggcgggagggcccgggcgcatgttggcacacgagaaggatgcgcatcaggggcggtggggtgacctaattgatgggcgcagacgcgtcactcatctacctctcgaaaccctctggcatcacccctccccgcacgacgacagccccgccctcctcatctctccccgcaccaccaccaccaactccacctgcgtcacgcatctccctgacttccgcaggggtgggcaccaggccaaacacgatgcgctgtgcgtcctcgtcaaacatgacgttctgcacggcgccacgctgtacgtgacccaggaagtccgagtacatcacctggcatttggagtggggagtgggagggatattgaggggatactgggtgagggacaatgttgccacacatcgggaagcgagtgcagggttggacaagtacgtaatgccaggcccctcgtccatttccagagggctgctcgggcgctggtctacagttcacgccgggcccacaggatgcgcagcggcggccnnnnnnnnnnagcgtgcgcccacctcgtgcatgcgggcgctgtgcagcgccgacgagagcagggcgccgcccaccaggtagaagnnnnnnnnnnaattggacaagtgcgtaatgccaggcccctcgtccatttcctgagagctgctcggacgctggtctacacttcatgccgggcccacaggatgcgcagcggcggccacggcaacactcagaccgttcagtatctgcacagctggggccccatcatggcacaacccattggcatagcaggccacccggagaatgagtgctcccatcccaatttgaaccttgcacnnnnnnnnnnnnnnaggatgaaggaggctgcgatgcgtcgcagcctgcctggggtcaggaacgcccgcatgcgctcggggacaagacctgcgcacatggatgtgcacaaggcatttcataatggtgggagaagctgtcgagaggaggactggatcacaccagattgcagcagcagtcgtcgccctccaagcagtattttcccgcaccccttcacccaccataaacatccccctctggccatggtggggcnnnnnnnnnntttgcagcggcagtcgtcgccccccaagcaggattctcctgcaccccttcacccactataaacatccccctctggccatggtggggcacatcattcaccaccaatccatagccacgcacgtgctaggaggaggagcagggaacgagcagcctgtctaatggcatagatgatcctgccaggcagccccctcctgtccctgcccggctcgggctccgactcatccgggtctctgccgctggaagagtcgttgggggtgcgaggactgctggacagacgtggactgtcattcaaagcggcgcaccacacggtcctggcacggatgggtccatgcaagccgtaagctcgtgaaggccaggccgaggagtcctgccactgacgtccaatcgatggtcggatgcgagtcgggcacacggatttgctggcaaagctacagctcttgaagggagcaggtgtggtgcggagaccctgcatgggtcccccctggaagcctccgctctccgctaccaacaattagctggctgtgtggggatgcaaggaacagagcgctattgcaaacaaataacaaattgagtaagcccagtgcgtggtgtcatgtgcatgtgtgacatgcgtttgacttccagagagccacgcgcctggtggactgtgcgaatgggagggagaggggtcctgatctgccccccgggctgcattgcgccctgactagttcaaaaagagaagcgtcagacgccgctggattgccacggtaggaccgcagacgaaaatacatctgtgttggtacagtttcgaggtgagatcacctttcgaagtatgccacccagaagggcgatgtcggagtcacccccccgagagcccgtggaaggcagcccggatgagggagccggtccatctcaaccggatcaatatcctgctggacttgcagcactgaaagtgagcgtctctgggatggttctccgtccggtgagctgcctggggtggcgacacacattcctgcaccctgctgccctgccatgcaggacggagactacgagcgcgctatcgagcttctgggcaacgccctgcaccagcgcacctccactcatggaggtaaggatcttgagtgagaatctctgggtcacggggccgttcagcgtcatgatcagctctgctgcaggcgtggtgaaccagcgcagtcaatggctcatgctgcctgatccgcggatcccagatctgagcctggaggcagctgcagtctacttccagcttggccgggccctgctcttccaggcccaggacaccagcgacttcctgtccggcgagcgggctgaggctgctgctccaggcaccctgcccgcggatgacatgggcaaggcgtctgtgacaaaggaggaaactgtttctggcagcaaccaagatgccggtacgttttctcgtgtgaagcagcatgggcttgggctcgcaccaaacaacaggctccacccctggtcccctgctgtggctttggctgagtggctgcctccgatttttgcacccgccgtgcaggtgacgacggcaaggatggtgatcaaagcgaggaggaagaggaggacagtggggaggcttcagatctgcagctggcctgggagcatctggaggccgccaaagtcatctgggccaaggatggcgcaaggaacgcggagcgattggcaggtggaggggggatggacgggcggtcgggggcatggagccatcatctgggcccctgcacagctcccaagcctcacctcgcctccccatcccacggagctgcatcatgcctggtcgcttctgtccatcgacagaggtgcactccctgctcggggacgtgggcttggagaatgaggattttgagggagcgctgtctgacttccaggaagctgctgagcacctggaggcggccacactggctcaggagcccaccatcgaccaggtgagtgggaggcggagcttgctggggagcagggaggtagctcaaggctgggcagggacaggcatgcatgtcaggaacctgcagtattctgcttccccctcggtccgagctactgagcagtccccaaccacgcagcaggggattgccttggcgcgtcagcgcgccgagattctgtacaagcaggggatggcctggcagtttnnnnnnnnnncgccttggcgcgtcagcgcgccgagatcctgtacaagcaggggatggcctggcagtttctcgacaatgccgcggaggcgctgtctgccacccgcgcggcagtggaggtgctgcgcggattggagactgagctggcgggcatggtgcgcagtggaagggggtggggggtggacttgccatgtagagtgtccaacgctggctgttgtacaggttgcctgggcgctttgcgacactaatctgcatgacccagaccggtgcgagtgccttgtcagacagcggctcgtgcccagagtacggcctgcaacccatgccacactctgcagggcgagggccgggcccgcgaggccgctgatgtggcagccctgcagtctgacctggcccagaaggtggaggagctgcaggaggcggtgcgcgagcaggcctccaccaaggacatggtgaaggtgaggtcgacgtaggccggggagcgtttgcgaccctacctcttccaaagggagaccgctgggttgtgtggtgtcatggcccacggatcccctccctccccccaaatcccggatgcgtaggcggcgctgcgacagctgacgggcgggnnnnnnnnnnctgtcatggcccacagatcccctccctccccccaatccccggatgcataggcggcgctgcgacagctgacgggcgggctgccgggccagaccctcgcaccccccacgccgtcctttccacagcccagcagcagctcggctccggtgcaggacctggggacgatcggccgggggaccaagcgcatcgtgctccaacccacccagcccggctcgggnnnnnnnnnnnnnnnnnnnnnnnnnnnnnnnnnnnnnnnnagattgtgaggagcggcccagagggtgcatcgatgagtacccctgtcctgctcaagaccactgtctgcgtgcctcagccaagtggtccacgcctgtcatgctcaacctgtcgtcagcctccctccgccacaggccccgctggcggggagacgtcgagtggattctgaggcgagcgggccttcctgcgcccggtcaagagtgctatgcacccgtgctgtctttgcgtctttctccccatgttacagcaccaagccccagcagggcaggcagacaaggtgttggggggagggagggtcccaaggtgtggatgacggatggcgttcatgcagaggtagtggcaccaggtgccgggggggggctccgacccggctgcagactggcttggacctcttgggagacagagtccagctcgcccggcagccagttgaagagcgggggcagcggtcggtctgtggaacgggtaagcagcggggtcaggcagagggtcagcaccattggtctacctgataactctgacgaggcaggagggctgcaatcaagcacgagcctcccgccatccccatcacctattcaatggcagcagcaggcccccctttggaatgcaacaagcaactcactgtttggcagccggcagccaggctcccgcaattcatcaaagaacgaatgtgtgagggctggcagggcatctatcctgtccaagggactgtacaccagcagcttgctgatctgcacatagggacacgatggggccaggtgagggtgaacggggcgagggtggcaagagaggccacacgggcggtcgctcacacaatcgacactcaagcgcacacagagcggcactccacatcaaactgggacaaaacaatgattgagtgtacgagttccagagccatgcttctctccaccaacccaccaagtcaacagcatctgatggcatgcgtttggaaaagatttttgaccaggggtgcgccttgatctgggaagtggatgagtggggaagcatgaggacacaccacgggcattgctggattgacggacgctggagcatggcgacccccctgggcacgagtcgcatgcaggttcttgaaagagcaattcattgacaaggtactaactaccaccagctcttgcacacagcagcggaaccgtcgcccaacatgtgcacaggggcccagcatgacatgatgtaccgtgcgacacagcacactgcatcctgctccgtgtcaagaccatccgatcaccccgccaacctacttgtgggaacttgaactcggtgtagtttgggttcatcgcatggatctcttcccgtgtgggtgtccccagtacctgaacgtggatggacaaggtccacaatggctgagcgaatcagaccatcatacgagccaccatccttcatgctccatagaatggcgccatggctggagcannnnnnnnnnccaaatcagaccatcacacgagccaccatccttcacgctccatagaatggcgccatggctggagcaccaaacacgccccctccgcaaatgctggtcggcgcagtgatctctcatgcggcagagagcctttcgttgggcagtttgcagcatgtacatctgccacaatgtgacacgggtgggctcccacgtcagccagggtagctcggtgctcccctcccctcccaccttgatgatttcgacgagttggtcgacaccgctctctccagggaaaaggggcgagccaagcaaaagctctgccatgacgcatcctacgctccacacctagagtgagatcatcaggtgggagcggtggacaggtggcagtgggactggtgcatggcatgagcgcaaaaacaacctccacaccagagccttccttgcagggtgcgcactgcgtcacagagtacagtggcgccaagcatgcttccccagatctaggagcctgccacctttccctgcatcacatccacagtcaccctccccaccccggtgcgcatcnnnnnnnnnntaacctccacacaagagccttccttgcagggtgcgcactgcgccagagagtacagtggcgccgagcatgcttccccagatctaggagcctgcgacctttccctgcatcacatcaacagtcaccctccccaccccggtgcgcatcaccgatcctcacatcgattgcacaggtgtagtctgtggccccgaagatgagctccggcgcccggtagtagcgcgagcagatgtaggagatgttgggctcgcccctgaccagcgtcttggcgctcccaaagtcgcacagcttgagggcgtgcgtggatacattcaccaacaagttctgtggcttgatgtccctggtcagagaggtcagggacacattgaaaggtgagggctgggtgtgacggcgatgacagtctgtgacgctggaatctccagtacatccagccggcgactgaaccaagccttcgataaaacaacactgttcgcggaactccctgtgccacccaccccccacccagtacctgtgacacactcccatggagtggatgtaccccagggctcgcagcatctgatatgtgtacagcttcaccagaatgagcggcatgcgctgctcattctttgtgtagtgcttgttgatgcggtacacagtatctggcacgaattcaaagacctgtgggcgtggaggtggatcgagggtcgatcgatcatagagcagagccttcggatgaggagcggtaggcaacgcctgttgtgcactccgccaacatcttcgcaatggcccacagaggaacgtgttttctctctacaagaacaggtccatgcatgtctggcagagcctgacttgctgtccaccacacaaactccaacccagcaccccgagactgggcgtcaacaccttcaagcctgcaccgcccgccagcctccaaccccaggctcaccaggttgagaaagacgtcgtccttctccgaggtggtatagaaacagtgcttgagcagaacaatgtttgggtgtgccatgagccggatgatctgcagctccctgttcttgaaccgcttgtcctgcaggaccttcttcaccgccaccgtctcgccggtctcgacgcagcgtgcctggaagaccacgccaaaggagccgttgcccacgacgcgctcggtcacatagcggatggtctgttttgcacttcccacgccaccagaggtggttatcacatggccgacggtggaggggtcgccctctgtcacatggccctcaaacacctggccatggggagggagcgaggttgcgctcacagggacgcgactcacggaggagttcaggccatgcacgaagctccgaaacacactgccaatgtgaaagaatgttaacaggacaagctgctggcgatgctttgttcccagggnnnnnnnnnnacgcctcacgaaggagttcaggccatgcacgaagctctgaaacacactgccagtgtgaaataatgttaacagggcaagctgctggcgatgctttgttcccagggtagaccctcgcatctcgaactcgctcgcccgcgcagccagtctgatcacaaaatccgcaagcatcaccacgcccctcaccggttcctttccctcccgctgctcggtggagagccgcagctccttgagatcctgtggaaggttctccagctctgctgcagccagccggccacggcgtcaggggtcaggagggcctggcactcaggcctcaggtgtaccctggctgacaggcaggggaatggaggacatggtgtcagatccaaggattttctggcagtggatgtaacgagacagtttgacacgcagacgcagggatctagcccgccccgtggtgcgcgcaacaacggacccggtgcctgccgggtcgttggaggactgtccgcctggatggagctgtccgcgtgtgtaatcttccgatccaaactcctcaattctccccacgcaagcctggcaaagtcgcgctggggtctcggccggtacgagggggcggaagagtggttcctaagctcagcctggcccaggggcacgcaggggcgagcgtaccgaaatccttacacggggtcaagctagggtcgataatcagcaggcagcggtcgtgcggtttctaagggcccgggagttttcctccgcgccacgtcctgatctgggagggtcaattttcctggcttctttgccgggtacagttcgagaatgcgcgctgcaacagaagagatccagggagccacggggacatgatcactcgtgtgtagcttctcgagaaaattctacgcgatcgagcgcagccccggcgaggagctgaggcccggtgctgtggcttttgccggagatggccaacccagcagagacggtgcaggctgcccttcaaaacatcgagaatgaggacgagtttgaggaattcgaggtcgaaggtgagaacctctcctacactcataatcgcatgtctgcagatgccattgatgggtcgctctgctcacgacacgcctgcgctccacagaatgggatgagtccaaggaggacccagcgaactcctgcttgtgggaacaagactgggacgacgacgacatcaacaacaactttgctgagagattgaaggccgagcttgccaagtctgcaagctgaaagggcagggatgaaggaggactccctccatgctggaccaaccagcgccagggaggtccgtgggcattgctgtggccttcaaacgcgagccatctggaccacatgtgctgccaggacttggtcaacannnnnnnnnnatttgtgggcattgccgtggccttcaaacgcgagcatctgaaccacatgtgctgccaggacttggtcaacacacgcatcgcgagtggtccagcaggaccgcggggagatgagctcggtgcagccagttgggatgggtgccagaccacagcaaatcggccgcgatgtggtcgcaaatagtgacactcccctcttcattttcctctgctggtcccttctagtctggttctgcacctcaccatgaatcgtttcttgtcaagaattacaggacaccnnnnnnnnnntgcatcgcgagtggtccagcaggaccgcgcggagatgagctcggtgcagcctgttgggaggggtgccagaccacagcaaatcggccgcgatgtgcttgcaaatagtgacactcccctcttcgttttcctctgctggtcacttctagtctggttctgcacctcaccatgcatcgtttcttgtcaagaattacaggacaccttgcaccagagacaggcagacacaatcacaaaggtagacataatccacctgaggctgcattggtcataccccacacgggtgtgtgctatcaaaccggggccagacgagggtgagtggttctgtgtgctcgctgtggagtcctgacccatgcattctgatgggatgcggggcgccggccggtggcagggggactactctgacctaagaggaggaccatgacagttccagaggtactaaagcaataatctcgagnnnnnnnnnnactactctgacctaggcggaggacaatgacaattccagaggtactaaagcaataatctcgaggtctgttgtacaagaaggggtctcactgcgctaggactgcaattggtgtgaaggaggggaggagtacaatgtgatgatgaatttttgtgatggtaggatttcctccaccttggccagattggcaaacctttaccgtcctcccggcaattgtgcagcacaggaggcctgtggatacttgtacagcgcgtttacgttttgaagacattgtatcgtgagcatacacagctctttcaaagtccaggcggccctgacgcgtgcccgacgcccgtcccctcctctcggcgctctgtgtctcttgcccgcgctgcacgcgacatgcacgtctcggcgccgtcgagagtgccggagtccaaccttcgatagcatgcgacccccaaagggcgctctgggcggtcgtgcagcacggagctggcacctcctggtcagctgcttgctcgtgctcctcctcggcctcagggctggcctcgccaaggaggtgaacctcgggtggtcgccggtacacttatgttgcgacgcctcaattttgcttcccgcagggtctcgcaggcttctagcacccggcaggatctccagcttctctgcacccccctggcacccacaggcactcgaagtgtcctttgcagcaggccagtcggtgcatgccccaggcgtgggacaggtccctctccgcctctccagcctgcccagcgaccccctggcggtgctgtgggaggtagagggcctgagcccctgcgaccccgccgatgtcctgccagccgcagccagggcgggggtggccctgttccagaacctcacctcgctcgacatcgccatccccatcgcctggagcgccatgcacagcaacgagacgtgcagccttggtaaggggacaggtgggggatgatgtgctgccaggggaagcctggcgtctgtaatgtcgtccgtgtcgggggggactcgccctggcgtcgtctcgcaggcgcatgtgcatgttggccagccccccgaccatcccccccccctgattcttacggacccacccgacccctcccctccctgcaggcctcaggctcacccccctctccggctccgcgtctgtgcggccccagctgggcacagcggcgctcatcgcctttccccttccccctggcacatgcccccccggcacggcggtggcgggggcctcgcaggctgtgcgcgcagtgctcggcagcgccagcgacgtcaactcgacggcggacggcacggtgagcggtgccgtgctcctctcccgcaccagccgcctgctggccctggcggtgcggggccaagggaacagctccctgacgctgtcggcccgccagcagggggaccaggaggtctacgctgccatggtggaaaacggcgtggagaacgtcacactctgtgcagtccctgcagaggtgcatgcgtgtgtggttggggaagtgggggggggggcccaacaagtgtgggaatgtgggctgtccagacgcctgaggcctgtgaggccgcagcgcggcctgcttcatacaaggctcctcgggccaacatcatcagaccacccattccatgcaccgaccatttcctcgctcccactgtacgcaggactacgagctccgggtcaggctcaacaccggcggggactgggtgcccgcgcagggcggtgcctgcccctgccgcctgcccggcggcgagggcctggtggaggccagctcggccggcgcgggggcgaacgagactgcgctgctgggggcggggccgtgctcgagctggcggctggacctgggtgtggggcccaaccagtttgacatcgttcctcgtcgcgcagacggcagcggtgcggggaacgagatccctggcgaggggtcagcggcggcggtgcccgcgtcaacgcccggcgccccccctcgaggcgcgcccccctcttccctcagtgtcgtgcggcgggccccgccctcccacgtgcgcctggccagcctgaacctgaccacgcccgccggcaccaccgccacgctgtgtgccgccgccggcgccgcgccgcgcgtctcagcgcagagcctgcaggcgctggcgctggcggatggggctgtggacggcgtgggccgctgcattccgggcgtccggctgaacgtcagcgtgcccgcgccttacgagtttgtgagtctgcgcgcggggctggccttcccgcacgtggagggcatccgcgtggaggccggcggtcaggtgttgacgcgcgggggggtgggagacggcgccgacgccgacggcggcggcgacgcgctttccttcccgcccaccgcccccccagagacnnnnnnnnnnnnnnnnnnnnnnnnnnnnnnnnnnnnnnnnnnnnnnnnntccccgccgcgttcgtcatgcgcctgcccagcgacatgcccgtcgacctcgacgtgctggtggtggccgaggacggcgtgacctcggcgcggtacccgctgcgcctgctgcgccgggggactgctggcccggccggcgcggcgcgcgccgcggccg

SEQ ID NO: 43396 - DNA, 61 bp, Chlorella protothecoides
ttactcatggtttggggggaggggggggggggaaggccgaccagaaacaaggggaggctcc

SEQ ID NO: 43397 - DNA, 103 bp, Chlorella protothecoides
gcgagggtcgcaggcggggccgccagaccttgcagcggtgaggggcggggccacgtgagtgggcggcgccgtactggcgccggcggcagggcgcgcacggcct

SEQ ID NO: 43398 - DNA, 122 bp, Chlorella protothecoides
aactgcggggcagcgtgtgtgcgtgcgttttggtggtggtgactcatgtgagcggggtggaggggggtgcacagggggggtggcatgtgattgcgctggtccctggacagccgtgtgccgag

SEQ ID NO: 43399 - DNA, 16894 bp, Chlorella protothecoides
  modified_base (373)..(382): a, c, t, g, unknown or other
  modified_base (473)..(482): a, c, t, g, unknown or other
  modified_base (1097)..(1106): a, c, t, g, unknown or other
  modified_base (1210)..(1219): a, c, t, g, unknown or other
  modified_base (1404)..(1413): a, c, t, g, unknown or other
  modified_base (2406)..(2429): a, c, t, g, unknown or other
  modified_base (3150)..(3159): a, c, t, g, unknown or other
  modified_base (3257)..(3266): a, c, t, g, unknown or other
  modified_base (3775)..(3871): a, c, t, g, unknown or other
  modified_base (4470)..(4479): a, c, t, g, unknown or other
  modified_base (4979)..(5028): a, c, t, g, unknown or other
  modified_base (7158)..(7167): a, c, t, g, unknown or other
  modified_base (7727)..(7736): a, c, t, g, unknown or other
  modified_base (8234)..(8243): a, c, t, g, unknown or other
  modified_base (8688)..(8697): a, c, t, g, unknown or other
  modified_base (8790)..(8799): a, c, t, g, unknown or other
  modified_base (10037)..(10046): a, c, t, g, unknown or other
  modified_base (10466)..(10475): a, c, t, g, unknown or other
  modified_base (10864)..(10873): a, c, t, g, unknown or other
  modified_base (11818)..(11827): a, c, t, g, unknown or other
  modified_base (12088)..(12097): a, c, t, g, unknown or other
  modified_base (16052)..(16061): a, c, t, g, unknown or other
cgcgccggcgccggacgcggccaagcgccccgcgccgcgcccgctgcgcgcgggctacgcggggcacctcacccacctcgccaaccgcctcgtcgcgacggcggaggaggagggcggcgcgctcgtacgcgaagccctgcgcgccagccccgagtgggaggccttcgttcgggaccagctggagccgcgcaacgcgctggagagcgtgtttgcctggcagtgcggccgccccaccatgcatggaggtgagcaggcttgtgggttggtcgttgaggaggggctgggggtgaaggagaaggggggcaaggggcggctggatgggggattgacgggtggatggccgagtcagggtgcccaggcaaggatcggaggnnnnnnnnnncgcagcatgccacctcgcagacccagcttgccatgaccccggctcgccccgctccctccgcgctcgccccgcccccatccctcccccctcnnnnnnnnnntaggggctgggggtgaaagagacgagggccaaggggcggctggatgggagattggtgggtgtatggctgagtcagggtgcccaggcaaggatcggaggggtgcagccggcgcgcatgtatcaccaggcatgggcagggcggcccaagacctgcagtgcaccccgccgatgcatcatcgcaggatgcaacctcgtagacccagcttgccatgagcccggctcgccccgctctctccgcgctcgccccacccccatccccccctcctcccttccccctgcaggcgactcgtaccagcacgacgcgtaccagcgctacggcgtgttcgagggtgacatggagggcggcgaggaggaggaggacctggacgtggtggccgcctcggcgctggccaccgtgtcgggggggaatggcgcggggccatccctggggccggtgtgggggacggggcccggcagtgcggggccgggggtcacacccttccactcctttgtggacaacagcagctcgtcagacgaatcgtcagacgacgcctcgggctcagactccggtatgttgtgtgggggggggcagctggcaggggggggtggtttggcaaggggatggtgaaaggagggnnnnnnnnnnaccacccctctcgtcgatctcagtgcgccatgtccggtgttcatcgcacctacaccctcgcggccgcattgcgacatgcaaggaccttcgctcacgtccctccnnnnnnnnnntgaatcgtcagacgacgcctcgggctcagattccggtacagtggcggggggagggggggtggcccagttggcagggggggttggtttggcaaggggatggtgaaaggagggagatcctgctggagcgggcgtgcctggcaggggggtcccgagtgcatgtgtcccgtacttgcgcgagccctggnnnnnnnnnntctgttggagcgggcgtgccttgcaggggctcccaagagcatgtgtcccgtacttgcgcgagccctgggtgcgcgccccctctctcatcgatctcagtgcgccatgtccggcgttcgtcgcacctacaccctcgcggccgcattgcaacatgcaaggaccttcgctcacgtccctccctctccccctgaaaccacagacggcaacagcccgcggggcccggtgaacgacctggccgccagcgtggtggtcggctccgtgcgctcggcgtccgacggcgcggacatggccgacatgtcggacgatgccgtgctgcaggacgtggaagtcgcagagcaactggtgcacctgcgcgccgacttcgagggcgcgctgcaccttcgcgacgcccccggcgagggcggcgccgaaggcgacggcgaggaggctcggcgcggcacggacgacgcggggcgggaggcggaatacgacgccttcctcttctggaagacggagttgccgggggtggggccgggggagggcggcagcccggagcccggcccgcaggctggtgatgccggcgcggagggtgccgcagaggacggcgctggggacggagcaaggaacggcacggaggttggggcggctgaaggggcagcacaaggagccagccctgtccaggacgggggcgacgccaaaggtgcctgagtggaggcgcaggactcgtctgtacaccgccgcgccacagaagaaaggagcaggtcgcgccgcaaggctgcggaccctgcttgcgctgtgttgtggatgtgcccatgccccctgctgcgacacttggaccccacccagcaggggcacccttcatacttgacgcgtgctgcccgaaacttgaccccttgcgttagtagccaagtgacacaaggcgggatgattgcaccgcgggtgagtactctctggatgaattaaaatgtccaaagctgcgtccctaggtgtgggcgctccagcggcaaagtcttgcnnnnnnnnnnnnnnnnnnnnnnnnctcaagacccctggcacgccgccaaggcgcggatgaaggcctgctgctcgtccgtctcgggcgagcgcgcgatgttgtcgcggcgtgtcgagaaggcgcgctggatgcggtccagggcctcatcggcgcccagcccgtaggcgcggcgcaggaaggcggcgcccacggtgccggcccggccgcggccgccccagcagtgcaggtacacgccccggccctcctccagctgggcgcggagatcggagagcacgccctccagtctggagggcagggaagtgagtggcagggagtgattgtgtgttggcgggattgctggagcagtcggcaggttgctcagggagcgtacgagggaaaatgcaaaggggagtgatgcagtgtctcaacgatagagacgagaaggggcaccattggtccaccatccgcgctctcacatgtctggctcaggcagacccaggtccacaatggggtggtgcaggaaggtgaggtctctggagatccttgccgcagctgcctctgggtctgccaccgccttgcggcgcggtggcaggaacttgtccaggtcgggggtcctgagccctgaacaaggggggaagggcaaggacaggaggctgtggatgcacgtgcggatggcaagaggcacagcaggtatctgagaatgttcaggagcagcacaaactgcaattagtacacgaatgtgtatcttgaccaggtctcctccccnnnnnnnnnnggaaggggcaccattggtccaccatccgtgctctcacatgtctgactcaggcagacccaggtccacgatggggtggtgcaggaaggtgaggtctctgnnnnnnnnnnacaggtatttgagaatgtttaggagcagcacaaactgcaattagtacatgaatgtgtatcttgaccaggtctcctccccgctcccaagccaccccaccgttgaactgctcctggctgggagggggtgccagggatgcagcaagcagaccggcaataggtttgtatgcctggaagccgttgtgcccacccacggtcagctcagcctggggcggaagctcttcctgcgcagaatggggtacaggggagcaaagtgcaggcacagtgttggacaggggttgtaacatcaaagagctgggggacagcttatccgattcgtccctctctcctggacgtaggaattcagcacaaactcatgcaaagttgcactgaagtacctggagacagatgaatgttgtgattccggcttccaggagttgtttaagctgcgcctcgcccatttccctggacctgggaaataatattaaggttgcaagagttgtatcaagtcttttgaatggcactcttgtggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntccggccgcccacctgcagcgactgggttcgatgaaggggtaccgccccagcatcaggcgcccagggatcagccagttcccaaagctggtgaaggtgcatcgctcctcgtaccgctctgtgcttggtatggaggtaattgtgagtatcggttgatgggtggaatcctgcacccatgacagcatggtaaatgtgctttcccagccccaagagcaggcccacccagtaacttgaagcaacccctagccgccatggcgtaccatccagaggtgggagggctggaagactaatggaggaggtgatgctcgcggatactgcacgggcccctgccacccaccgattcggccgccgatgacgatgctgggacattgtgggagggagcaggctggagcgggcgggctctgatgtcctgctcggatacccagcttttaattgcatagagccgtgcatttattgagtggatatagctcgctgtccagcaccagcacaggacggtgcggaatctgtatgggtaatgctgcgccacgaactcgagctctgcccctctcacggacatctttggattcaaagttttgagagcttgattccgggatggctcttnnnnnnnnnnagtaatgctgcgccacgaagtcgagctctgcccctctcacgggcatctttggattcaaaattttgagagcttgattccgggatggctcttcggtggggaatcactggaaattgtcaatggcagcaccccacgtgtcggcgccccgacgaggatctgtgatcaccgtgcatctgctctccacagcatgcagcttacatgccaccccactttcacacacaatgtatggaatttcgtcttcctatcatcttgatcacagcagggcgtgcgagatggagtgtcgggaaacattgtgacgcccctgtatggagtgacgggacatggacccagcttttcccccccgcctccctgcgcctgcgatccctagatgtgcgggatatctcatgtatgggtcgtagcagaacttcgtctcgataaattgcccctgaacgcccctgaggagcaatgggttccacccgaggccggggctctccctcacccctccttccaccctctcccccccnnnnnnnnnnnnnnnnnnnnnnnnnnnnnnnnnnnnnnnnnnnnnnnnnncccccatgtttgagcggtggaagacgggcgagcacgcccccctctggcgcctgcgctacatgtttgtttgccacttcacccaggccctcttcatcgtcctgccctacaccgtgtcggtgtatatggtgcgcgacttcctcgtggccggcgccgcgcccggccagcccgtgcccgagcagcgcgtgggcgtgctgaccggtgcgctgggcgccgtctcctccgcggccgcgctgctcaccagctacccgctgggcgcactgtcggaccgcgtggggcggaaggccgtgatcctggtggggctggcctccagcgtcgcctcgctactctggtacggcgccgcgccctccctgtcccaggccctggccgcccgcgcgctgggcggcgcgttcaacggcgtcatcggcgcggagaaggccatgattggcgactgctgcgacgcgcgcgccgccacccgcgccttctccctcttctccttggcctggggggtgggcgcgctcttcgcacccgtcctgggcggcggcctctcccgcccctgcgccggcgccctcgccggggccacctgggcgtgcggtgacgcgggcgccccgctgcgccgctggccctacctcctgccctgcgccgtgtcggccgcgctgtgcgcgctggccctggcgctgtgcgcgctggggctagaggagacgctgccggggaagtgcggcgacgaaggtctgggctcagggcaggccagcctgaacctcagcctggccagctccgtccagctgtcggtgcggcgtgagggtggcctggacagcgtctccctggactggccggcagacgaccgccctggccaggtggggccggaggcggaggcggcaaccctgctgccgcagaagaccgacggcagaacggcgcccgggcccgacggggcgggcgcacaactgccgcacacggcctggcacaaggaccggctggtcatactgtgcctgatcggctacggcgccgtggccttcatctacaacctgtgagtgttggagttttgtggtttgtggggggagaggccacaccgacgctgacggctgggccacctgacgtgatgggcaggcatgtgaatacttcatcagagcgtgctgccctgcctgctcccctccgcatgccctgcgctcgaggtggccacccctccccctcctcgcccgccttccctctccacgcccacctcacgtgcacgccaccctccccccccgcttcacctccacagcttcgacgagctgctcccgctcttcgcctcagccccgcattccgagggtgggctggcactgcagccctcgggcctggccccctcaaacgcctttggcggcgccgtgctcatcctgttcaccctcctgggcctgggccccgcgctgcgcgcgctgggtgtgctccccgtcacccgcctcggcctgtggtgcgtactgccctttgcagtcctggtccccctggccagcgaggcgccccccggccgcggcgccctgctgcaggccacgctcttcgctggccaggcgctgcgctcgacgtcggccgccaccgccttcaccggctgcctgatcctggtcaacgccgcggcgcagcgctgcggcgcgctgggcgccgtcaacggcgcaggacaggcgctggcctcggccgtgcgcgccgcggggccgctggcgggcggcggcctctgggcgggcgccgtcgcgctgggcggcgcgccctggtttcctcgcgccgcgctgcagtacgtgccctttgccgcgttggcactcgtggccatgctggcgcaggtcctctacctccacgtgcacctgcccctggagggtgggggggaagaaaggggggcacaggatgacgctgaggccccgccgctcagaagttgatggcttgcggatgtctttggtgtgcggtgggaacacccgctgtagtttaactctctttccctggctgtggccttggttacagcacgtgtctgtgcagcctggagtcagattcaagccgttccctttggcgcactcagtcccagtggggcgtcctgtgtaggagcacatactgcacgtatgtgttgcaagcaggggagaggccggggatgtagaatgcgcgggtgaggaccggcgaccgccccgcatccaggaaggggagcannnnnnnnnnccacatgtccgtgcagcccggagtcaggttcaagccgttccctgtggcgcactcagtcctagtggggcgtgctgtgtaggagcacatactgcacgtacgtgttgcgagcaggggacaggccagggatgtagaaagcgcgggtgaggacctgcgaccgccccgcatccaggaaggggagcacagtcacgacctcccactccgaggcgttgcctggaggttgggaggtattgtgatggaggtgcatacactagtgatagaaaccccgaggggttgcacacatccagggaggcgttgcgcttgaggcatccgtgatctgttgtggaaggcaatgcatatgcagacaccaattcacccatgattgtacactacattacccttaccaatatcatcaccctagactcggtcaaggctgggcatggcgggctgatgcggcaagaatgctgggcccatcccctcacagcctccttctcacaaggcgctcacctggtttgtctaggtacgaccagccttgctccgcaccagggtccttccagcgctgcgtcaccaggtatgcgcagccnnnnnnnnnncacactacattacccttaccaagatcatcaccctagactcgatcaaggctgggcatggtgggctgatgtggcaagaatgctggccccatcccctcacagcctccttctcacaacacgctcacctggtttgtctaggtacgcccagccttgctccgcaccagggtcctgccagcgctgcgtcaccaggtatgcgcagccgtcagacgtggcccacgcgttctccggctcctcccggttcagattgttgagctggcgtggggaagaggctgtgccgccctgtcatgatcaacaaggacggcggcatgagtacaggtgtatgggtgtcgggagaatgacgtacattggggacatgcgcacattgctgcgctgcacgactgattgcacattgcaggctggcgtagcgagtacaccgttctgaattgcctccacaggaggaacagcaccacgaacctacctcctcggcgctaaagggccggggcaggagcccggtgaagccannnnnnnnnnaattgcaggctggcgtagcgagtaaaccgttctaaattgcctccacaggaggaacagcaccacaaacctacctcctcggcgctgaagggccggggcaggagcccggtgaagccagacttgacgaactggagcctgtaccttggtccaggcagccagaaggagctggggaagcggtaccactccgcgccgaggcagaccggcacctcgtggcccgagccctgcagggagggcagcgccgcaaacacgagcggcggggcgcggtacccggtgtatagcgccgccaggcgggagatcgagccgagggcgaagagtgccagcacgccaagtgtcagtgcgcgcgaacccctgcgcgccgagtgcgctttccagcccagcatgcggagtgcggcccgactacttctcccaagggcaagcaccgtggtgccggccgccacacacatctggnnnnnnnnnnttgtccccagcccattcatgcaggcagagcgtctgtggccgggacgggtggcatgggtgctcgactccgcatgccctcaccaaccctccaccnnnnnnnnnncccagcccagcatgcggagcgcggcccgactacctctcccaagggcaagtaccgtggtgccggccgccacacacatctggggagggagcgcaggtggaggtggcggtcgagcgggggtgggtgatggcaggggggttagggcccagggaccgctggcactcgcatgccgcaagggaagctcggtgcagctgcagaccatgccgggcacatgaacgccgggagtgtccccaggcctttcatgcaggcagcgcgtctgtggccgggacgggtggcgcgggtgcttgactccgcatgccctcaccaaccctccaccccctctcgcatcccagcataatccgcaccaggggatacacaacaaacaggaagcgctcctctttgtgcggaagcgctgagatggccgccagccagaggaaggcggggccgaggacgagggcccctaggctaacctgggccttttttggcaagcctgcggggcaacagcgagggtggctgggagggtgccatggccatgggcacagacagcaaggccccccccgcggcccaagcacgtggacccaacctgatgcgtcccctgcctcgggcacacaggaacgtctccccaccagcgcccgcgaacgcaggcggcccacctgccagcgggagcgccagcggcgcggccatcaccagagccagccccgcctggaagttgacggccgcgttgcgcaggtagaatgcggggccctcaatgccgtagagcgcgctgtcgccgccgcccacaacgttgtaccgcacgaagttgagcagggacaccgtccagcggccgtaggccgcgcggtcggccagcgccagcggggccagggtcgccagcagcgccagggccagggcgggcagggatcgcgccagcgggcaagaaagcagcaccagcagggccagggggaggaaggcgatgccggccacacaccagccccagacgactcctgcgtggagggtggtgagagggcagggcggtgcgtttggtggattggaggctgggcacgtccggcgaagcgtgcgcgcaggtgtgatcagtgcgagcaggagactcgtgtgccagagtggacagcagtgtggccctgtgttccattacggcatggatatggtgcaagagcagctcataccccgcacaggacaattggccaggccattcacaagacaaccacccctgcgcacctgccacagagactgcgatggtcagactgacccgccgctccagtgcggcnnnnnnnnnnggtgtggccctgtgttccatttcggcatggatatggtgcaagcgcagctcatgccccgcacaggacaattggccagaccattcacaagacaacccaccctaggcacctgccacagagactgcgacggtcagactgacccgccgctccagtgcggcggccacggcaatggccagtgccaggccggtgaaggtggaaggcaggaacgcggtggacgcaatgaagcatgcactgctggcggtgaggagggagaggctgatgcgcgccagggccggcgagaccctccgctcgatggatctggggggggggggggggggggcgcagtactttgccatccctggcgcatgcatgcagtgccctttgaagggagacaggaggaggaggccagagccagggcaaaaggatggccctgtcaatcctccnnnnnnnnnngcttgaagggagacaggagcaggaggccagcgcaagggcaaaaggatggccctgtcaatcctccacaagcagccatgctcccacctgattaggtatgcttcactggcaaaggaggccacggcaaagacgatccttagccagaagaaaacgaccaacttccctgcggacatcagataggttgaggaccttgaaggactcatcggtttgggtagaacatacgtaacgtatgtggctgagagaaaggtcttgcatcttcttgccgagaaatatggtccgggagcctgccctgcatcctcgacactgcccgtcgcttgatcacttgggcactcctgagcgtcactcgctacgacatccctggctgcatcatggcccgtcccgcacccaccctnnnnnnnnnncatgtgtgtggctgagagagaggtcttgcatcttcttgccgagaaacatggtaggagagcctgccctgcatcctcgacactgcccgtcgctagacacacttgggcactcctgagtgtcactcggtacgacatccctgactgcatcatggcccgtcccgcacccacccttctctgtgcctgcccagttgagcaggggtagcaccactgcggcatgcaggtccaggtaccagtaagagcggagggcgaactcggcgctgtactcccaggtctgcaggcccttggcgtacaggagatggtgcaggggttcccagtagttgtacacctcatcgcagtcgtgtatcaggttcaggcaggcgctggccagccgggccgcgagcagggcgaggaaggccagctgccctggaccgtgccccggcgggacgcgagatgggaggacgatggattgcccggatgcggaatcctttgtagacgcaggtgtaggcttgatccgccgacgcagcattgggacaggtctccgcgactgaacatgcgataggtatcgatggagggatcgcactcctcggcttaaaggatccctttcaaatctgcacaggtctcatccttcagtctcaggactaaatatttggaccatgatatgtgccagtcctccagtccggcgtagcgcagcttagagaagagctggacgtatgtgatctgggaccatccgccgtacatgcaactcgcgcagcacgagtcacctgcggggggcttcgagccccgcacctgatgcaaacatcccgatgatcgagagtgcgtcgtcaacaatgcgatctggacatgtacccgaatttcgatgcaatggattggagatcgtgatcgcagaatacctgagggtcacttttcttgcttaccaggcctgccaggcaccgggcgtgatcatgcccgacaaaagggaagtatggatannnnnnnnnncacccgaatttcgatgcgatggattggagatcgtgatcgcaaaatacctgagggtcacttttcttgcttgccaggcctgccaggcaccgggcgtaatcatgcccgacaaaagggaagtatggatacaggtcaccggtgatccaggccacgtctgcacggattgcgtagattttgcatcaatatcccatccgagtaaatccctcgagacagaaccatcactttgtcggtgtgttcgacctccggacgtccgcaatccccatnnnnnnnnnntttaccggtgatccaggccacgtctgcatggattgcgtggattttgcatcaagatcccatccgagtaaatcccacgagacagaaccatcactttgtcggtgggttcgacctccggacgtccgcaatccccatggcgtcagttccgagaggcgggccgctgacgacaacatggcccgaggaacccccccaccacatccaccctcgggcagcttcagcggacttcgtaacgtgtaaaaacctgcatcttccgaggattgcgcatagattgcatgcagaagtcatcggaaacgtaggaggtgtcacttccgagagtccctgggcgagtccaccccccatcgcacatatacaagaccgggcccttatccctcaccattcaccttctgttctcactccacacacgccccatacactactctcgtcaacatataaagtcatacattcacacacaatggctcgcacagcagtttccatcgcctgcctcctggtcgtggccctggccatcggcgcccgtgccgacgaggacagccctctggtcaaggtccgcattaccggccacctgggcgacttcacgccattcgacttctctggcactggtgacttcgcggtagaccccgataccaagaaagtggtgagtcgtggtaacctgtgaaggccagagtagagaaatcacatactcatgaccagtgactgccccagatccctcccactgcccactcatgcccacgcctctcgcccccattcaccagggtgtggccaccgcatctgccctgggcgtgaacgatttcaagctgtggctcgtcaacggtgagtcaaggtcgtgggcagggacctcggacccatcgcgcgcccttgcatgaacgcgttcggcccgactcgcacatgcccagtctcagcttctctccacttcccaaatgcccatcaaacaggcgagaaccccgtcgctgactctgatgccaccgcgtctgcggtgagaaccagtgtcgttagtgctctggtcttgagatccagcatcgcacgtgcgcggccgtgccccgggttgcgtgcggccggcccaatgaccggacgcctcacccgatccccacccactcatctcacaggacaccggcgctctcgtcctcgcggctgcggcgcaagccatcggccagggcgacacccaggtcaagaccttcaccggcaccttcccatgaagacccacatgcagagcgagcgaacccggtgccgctgactcacatatctcaaactccccccatcgtgccttgtgggggcggggagctgttccagttggcacccctatccctttctgtaatattgcatcacgtcatcatccttgggaagcctgacaggcttgtcatcagaaaagggggagacttggctcggcggggtggcatggtcagtaaccccgcaatgatgagaatgtgttgcttctgagtgaaaggcaaggtggcatcgtcgcaaggaggcagcgcaaaggggaagcagagcatgatcgtaccagctgggggtcctccttttccattgcttaccaggggagcgggaaggtggctgggagggcatgaaaccagcgtctcgccagcatgtcatcctgcacccgagcgcatggattgccgcccaggtaccccctccctgggctgattctcgatgggaatgtcgggctccggtgttcacaggtcctgcctcactctctgccgcaatgccttggggcttgcaggcacatgcgccggcctacaatgccatggctattgccagcgcagccgccaggggccccaccagccatgctggtcctggcagggccgccgccagggccgcgctcccgggtggcggcggtggcggcggcgtcttcttcccctgtgatgtggatgtggcgggggcgagcatgcgatgggtgcatagaggcatatcagaggacgtggaggtcttggggcctagaattgaccacgagttgggtccctcccttggcaaggatatgtacggggtgggcggacatctggatgcgtttgcaaagcttcctgtgcatgtgcgtcttgtaacggcatgctggggatgcatttggccactcgaaacaagccaagttgcagcctcccacatccgcccccagagatgccttcacaggcccctcccccctcccctccttacaaaaacaaaaacacccaaaaacattcccagcccatccacccatccgcggcactcacaatgacgcccttgctcttgaggacgcgcaggaccaccacggccacgatgcccagcgccacaaggacgaagagcacggtgatgcaggtgtcggtggccagcgacttggccatgtcccgcatgatctgtcgcgctttcttcatggtgaagtggatctcgtccaggtcgtccagcacctgcatggtgtgtggagggccacggcctgaaggggtgacgcagctggtgctgcctggtgctgtgcttcacggcaccacccatgcactcaaggggcgatcagcgatccctcgtgcgactcagtagactctgcaggacactgagccccaagcccaccggctcattgcatgcgacgaggccagaggccttgcccctcagatccatctgtgcggcctgcattccaggcatccaataggccacagccccacctccacatgtagcgacctccatgcaaagtaacagctcgtcctccgaccgccccttccccccttccttacacacacacatatacacacaccacaccttccccagctgctggccctggagctgcagcgtctcggcggtctgcgcccccaccgccaccgtgtcattgacgatgcgctcggagcgcagcagcgaggcgtccgtctccttgatggccttgcggccagacaccatcaggtccgacacggtgctggtgtcctgggtgggcagcccagaggggcccacctgcatcagctcgtcccgccccgggatgtggccgtgtgcgtaagccttcttcagccctatgaagccgttcagctcctgcaccagctgcttgcggcgcgccgccagctcctcgggggacaggccgtccaggcgtgcctcccgctcaaactctcggatcaggctgccggcgggttgatgggaaagggaggtgagtgcacactggatgcctgggcatgactccgcagacatggggtaacaacagcatgagtgcttccaacgcccacagtgccggagcagggggtcgatacatcatcaagtcggtctcacatcttggcctcctgcatgtgcgccgtgagctccttgagcagggactggcgcttgctgccttctggcagcttgtccagcttcttgaatccatcggacagggtcttgaaaaggttctcgagctgcacttcctgatcgtacacctccgccattctggtgtttcagcaggggatgcgcgtgagggatcaccgtcctgcctctgtccacagcgcttccgcgtctggccagggatcccggcagggagtgtgggagacttgcgcgatagtgcaggcttcacagcatcccaaagagtccaattgagacaagtgtgtgcaaatagtgccgagactcatggagcgggcagaagcggacactttgtcatggcccctgaagcgcgattcgcaatcatgggttcaatgtcagcgggagggccaaacttgagcgcgcgccgtgcatgggagaatggagcagtattcagtctgtatcacgcaggtctaccagagctgcggcaaggcatgagccaaagaacaatatcgatctaaacgctttatagtgaattcctcatcgcgactggagctgccgaatgggctgcgcatagacgcacccaccactcgcaatggctggcgccgggtcccaacacaacaaggtgaacacaccaggcataccatccatgacactccattacctgctttatacataatctcaatccattgggattctctggccattcatccgggaccactcgggctccgagcctgcgcatgccggacacaaccaaccacannnnnnnnnngggcataccatccatgacaccccattacctgctttctacataatcgcaatccattgggactctctggccattcacccgggaccactcgggctccgggcctgcgcatgccggacacaaccaaccacactcacccattccacaggcccacaaagctggccgtagggctggtaggagcgcccgtgaaaagcataaagacagcaaaggtgtgtcgagggctacgtggggtctggagtctgtcatcatcaattctggaagcccctccctggtggtggtgggtcctacagcattgcgtgggcagccttggcgccccaccctctctccaactccctgccccaccaatcccccagatgccggtggtcgcgcccccataaaatccggcgcgggggtgcagcagcgccgggccgaccgcctgaattcggccaagcaggtacgggagtcgaagcgcgcagcgctgctggccagccgccgggcggccgccccgccgcgcgtggtggccctgttcccgctctctgattccctggacgtgaccgcggcctgggcctcgctgctggcggcgtgcggcgcacccgaggcgaccggctcccacacaccgccccgcccggtcacggtcaccacgagcgatgcacggcgctcgcgcctgaccctgctcccgcccccgcccgtccccggcgacgcgctgggggcgctggacttggcccgcgccgcggactgcgtgctgctcctggcggacggcgagggcgggctgggcgaggatgtcgagcgcgtgctggccacgctgcgcgctctgggcctgcccggcgccatcggcgcggtggtcagcggcgcgccgcccg

SEQ ID NO: 43400 - DNA, 153 bp, Chlorella protothecoides
cccggggtcgcatggcgatgtcccaaggccggggggtctggcgcggcgtgggcgaggaggtcctgcgagacatgcacagggtgcggtgctccattccggatgccagcacgccccgccatcccacccacccgctttccaccccgccccaaacca

SEQ ID NO: 43401 - DNA, 117 bp, Chlorella protothecoides
gaagttggacaggtccgtcacgcagaagcgctgaatagcctggtaaactctgcagtgggtggggtgggtgttgcttggtttgggggacaaagggggagggagaggtggtggcaatga

SEQ ID NO: 43402 - DNA, 61 bp, Chlorella protothecoides
ccttgctccccacactcctcttgcagctcaattccagcctgaacacccgtacgacccaccc

SEQ ID NO: 43403 - DNA, 61 bp, Chlorella protothecoides
gtgtggctgtgcgtgacctgcggcagcggggatgtggctgatggacagaattcatgccctc

SEQ ID NO: 43404 - DNA, 107 bp, Chlorella protothecoides
cggagtgagcggcgcggacgccgacggcttggccgccgggtgcttggggcgtcgattcgccctgcagatcggcggcgcgacgggcgcccaggcaccctttgacggct

SEQ ID NO: 43405 - DNA, 7018 bp, Chlorella protothecoides
  modified_base (595)..(604): a, c, t, g, unknown or other
  modified_base (1330)..(1339): a, c, t, g, unknown or other
  modified_base (1590)..(1599): a, c, t, g, unknown or other
  modified_base (2941)..(2950): a, c, t, g, unknown or other
  modified_base (3758)..(3767): a, c, t, g, unknown or other
  modified_base (4356)..(4365): a, c, t, g, unknown or other
  modified_base (4846)..(4855): a, c, t, g, unknown or other
  modified_base (5388)..(5445): a, c, t, g, unknown or other
  modified_base (6169)..(6178): a, c, t, g, unknown or other
taggccaggcccagcaggcgcgcgcgcgcgccgcccgggccagcgagcggcgcgccgcacgcgtagcgtccggccaccgtggtgtaggcgacgccaggctcgtgggcgccagggtaggcctcctccacggcgcgcaggataccccgggtctggtcaaaggtgccgtccgggggcggggcctggggcgagcccaggctcacgtacgcgtccacgcgacgcgctgcgggcgggcgcgcacccagatacacgcgccccagccagccgccggcggagtgcgccagcagggtgagcggcgcctcgccgcccagcgcgcgcagcgccgcctccgccgcatggctcacgcggtccaggtaccagtccaccgtggggcgggggttgagcgtgcccttccagtaagcggcctggcgcagccccgccgcgttacgggccctggggtgtccgtggtgggggtgggtggggtggtgggtggggttgcgtgacaagcagggggatggcttggtcttggccgagtgcacaggccccaggggaaggacctggaacgaggaagacccaggcaagtaatgaccgttgaaagctccattggctccatgcacgnnnnnnnnnnggagtgcacaggccccagggggaggacctggaatgaggaagacccaggcaaataatggccgttgaaagctccattggctccatgcacgtagcccgacacaggtcacacattcgctgcagtacattcctttccctccctcctcccccctccccccccctcctgctcaccagtccaggcgggacatgggtgccacttccacatgcaagttcctttgccgcaggaggtgcacgagggccccgtagtccgtcgaattgttgcccaggccaggcaggataatcacccccctgctgggctgcgcatcccctgatcccagcacagcgcagcgccgggggaagcccctacgtcgtggtgcgccgatacggacagtctctcggggaatccagcgcagtgacgtcgtggaggcgacgctgtggcggcggcatgacgcacctcgaactcctggttgtgaggtggtgctacgacctccgtggccctcatgagcgctggccgcgaccagcatgtttgcatgagcaagggtaatgcacgcgagacaacatggaaactgaatgttcagcgcatcactgtgtgcctggccgcatgtatcgcgtgacagactgtgattttctgcggccatgatgggccgtcatcgatcaccagatctgttgacccctcgagtgtgaactcgtgtgcatgagcatactgtttcatcaccgacgatggagccatgacccaaagcatgctcaaatnnnnnnnnnnacctcgagtgtgaactcatgtgcatgagcatactgtttcatcaccgagcatggagccatgacccaaagcatgctcaaatttttgaagagaggggctccggccttgagcatttgatgcagcacttattcatgcttagcctggtcgaatgctcccatctgggctgcgccctggcattcactgacttggcagtcccttgatgcaaccatcacacgctgccaaagattcttcccaatctaagtcaccgcctggcnnnnnnnnnntctggcatttactgacttggcagccccttggtgcaattatcacacgctgccaatgattcttcccaatctaagtcaccgcctggcacgagacattgacaagcaaggttctcaggtccagaatccagcaggggcgcagtctcagcatgcgcagaggctggcgtctccagcaaagagaggttgcactactctggagacggtcagaaaagcctttttgggggggggggacggggggcgacgtcgcgcacagggcaaggtttatgggtcgaaacatgtccgcccaggagaggtgatgccatggcataccgacaaacaggcacgaaaaggattgctggggttgttgaagccctatgcacccgtgggagatcaggggggagtcacatatagaatcactttggggggaaaggcgcgtgggacgaaccctggttttcctagtagtgatgctggaaaaagggatcatttgcagacccccagactcgttgaggttggaggatcacagaggcatggctctgtaaagagcgcgagtggagatgctgaccacgcctcgagcactttctgatacgactgcgatcatatagggggggtggggggagggatggagggagttggagcagtgatggatgaagggtgggaggaggactggacaggtagggcattgatgcagacaagcctcccctgggcccagtgagacacagtgcacaccctgggttaatgtgagacgacaatgactgttcacaggaaacccaacgcaacaggctccgagatcacacatgattgactgctttgcgcattgcagcaggaacattccatctcaatactcaacctcagccccttccatctccccgcctcacccagagcatcactgggcagggtgagtggcacaagccccttgaatgccttgaggggggcctgcccggtggtcaacatgaccttcaggctgtcctgcagctgcagccccgccgcgtcagcgcctgcaggaacagaggggagggaaggcatgggccgtctgacgctcgttcagcatgggtcccactcagaaatgagcgtggttctactccccagcaccgtcctcttgataccacggtcctacgctgcccacaaccccatacctgtcacgatgctgatggtctcgtcttcgaggtccttgccggcgacatgcagctgactcagcagggtgagccaggtcagcaccgatgtcacaccgacctctgtcccggcatctctgcgccaggagcaggaattttaatagaggtggaggtgccataattccaggcaagatcccataccagcagactctctgaacatgttgattgcatcagaccagctcagccgccaacaatgccannnnnnnnnngtaatgaggtggaggtgccatgattccagacaagatcccataccagcggactctctgaacatgttcattggatcagaccagctcagccgccaacaatgccacccaagaccaacaccaccccacccctcagacacacctgaggttgacccagccgctccctgactgccccggcagcacatagtgcttgaacacccccagggtgtgtgcctgggagcagagttgcaccgccaggtgggcctggtccgtcctggaggccgagaggatgagcagccggtaggtggtctgggtgaggcgaggggaagtgggtgagagggaggtcaacagggtagcttggcaagcagatgggctttcgacaagggcacccagctgtgagaaggggacaccttcctggtggacatctcacatgaccagcaaggcgacgaaggttaccctcttgtgtatgaatgagacccctgggccagccacatgcacttcaaccgcatgagtctgacggatccatctctcaccgcgtctgcgctcagccccgagtcctggatgcgagtgagcaagtggatggtggcctccaggtccagccgcccgatgcagccctccagctcccggttggcctcctcgatggaggcaaaggggccggggttcaggcctggcacggtccccaggggaaggaagggggaggggggggactgcgccgcggacggcagctgcagcggtccgcccaggccggacccagcggggctcagggcaggcgagaacagcggcccgggggcaggggagacccccggcgcgacctcggccaggccggggccggtannnnnnnnnngcggacccagcggcgctcagggcaggcgagaacagcggtccgggggcaggggagacccctggcgcgacctcggccaggccggggccggtaggggacagcgcgccgggcaggcgcccagcgcccacgccggcgccacccacgcccccggcgccgcccgccgacatcagggtcatgagggctgccagggtgccggggtccacgttcagcctggcctcctgcatctggcccagcacctccaccatgacgttgtactgccccgcagtcagggccgtgctcagcaggtggttgtaggccggctccgcgctcgccaactacatcgtgagtggtgggtgtgtagtggatgcccaggctacagaggatgtcagggactgcacctgccgggccagcacacatgcacaccaaccgccttctaaccactgtgagcaggggccgcccacactgagcaccccacgctaatgaaccacccctggtgggcatggggggcggggcggcgcggcgccccccgccatgcatgccgagcgtggtgggcgggctggtggccaggtgagcgttttgtggtgggcgtgaggggtagaagggcatgagcatnnnnnnnnnnaaatgaaccactcctggtgggcatgaggggcggggcggcgaggcgccccccgccatgcatgccgagcgtggtgggcggattggttgccaggtgagcgttttgtgttgggcgtgaggggtagaagggcatgagcatttcgaatccagtgccgggagtgggagtttggggtggggactcggcaccctcaccggctggaatcacgctcttccccgctatgcatcgcagtctcagtcagcaaggatgcatgcatgacccctggacagccgtcccagccctccacctcaacccggccaccaccaccactctcgaacctgagcggcggatgccgcggcgcacagcgactgcgccggctcccaggcccccagcaggctgcaggccgagatgagggaggtgaacacatctgcatccagctgcacgccctgggacaggagcgagtgtgccaggaaggcagccttgcccacctgacgggagagagggaagnnnnnnnnnncgcatccagctgtacgccctgggacaagagcgagtgcgccaggaaggcggccttgcccacctgacgggagagagggaagggggttggggtgagggtctgctgagcgtgagtttaagggggggggggggccccactagatggtgaatatggtttggggcatcgacacacccgatccctgatggcctgcatcatcacaccaattcaggtgtgcgaggacatcccaagccaccatgctctctgtgttcttggaccatgccctacccccaccatccatcctcccccaggttggcaccggcgcgcacctcccccagctgcagcatggactgcaggatggtgagggctcccgcagcgtcgggcgtctggccctgagccagcatgaggtcgtgcaccgccagcacctgctgcgggttccccgtggccgccagcaccctgaccagggccaggaaggtgtcggcgtcgcgccgcgccgcgcgcgggccctgcatctcgcggaacacctgcagcgcgccggccgccagcgcgggacgctgcgnnnnnnnnnnnnnnnnnnnnnnnnnnnnnnnnnnnnnnnnnnnnnnnnnnnnnnnnnncggcgcggcctccgcggcgcgcgccagggccgccaggcacgcgttgaagaggggggtgccgggggcgaggccgccctccaggccccccgccagcgccgcgcgcatggcctccagcgcgtcagcccaggcgccactggcgccacaggcggtgagcatggcgtgcatcagcgcgggggagggggcctgccccgaccccagcaggtcgaagaagaaggagcgcaccttgtggtactgcccagacttcatatacccggagatcagtgtgttcactgcgaggagtgatgggagccggggggagcccgcggggtggtgggtggggtggtggggggagatggaagaggtctggtagggtggggaccattggggcgagggcatgtggttcgacagcgcgctcttcccaggtgggacccctcacgcattacagggcaaccgggcacctgcgcgctttccatcaacagcaatcagcgcactgcacccttcccccccccaagaagaacacgccagacagtgtcgacaataaagtaggactcacgggccgtggtagggccggggtgggtgccgtgcttgggagtccccacgctgcccagccagggtgtgcccagcggcgactgcggctcctcacagtggcccagctgcaagggggggtgcattgaggatgaggggcaagggagtcagagggggagcagagggtaaaagcttccactgctgttgtgggccatgtcannnnnnnnnnacgtgcactgcaccctccccccccaagaaagaacaccccagacagtgtcgacaatcaagtatgactcacgggccgtggtagggccagggtgggtgccgtgcttgggagtccccacgctgcccagccagggtgtgcccagcggcgactgcggctcctcgcagtggcccagctgccagggggggtgcattgagggtgaggggcgagggagtcagagggggagcagagggcgcaagcttccactgctgttgtgggccatgtcatagtatccctccatcaagactgggcaccaaacctgtctcatacacgtccaggaccacagaacaatgcgcacccctctgccatccacttcccctcccctccatcgcccccttccttccccctccaaccccacacccctcctttccaccttgacgagcgcggcgacaaaggtgttcatgcaggcacccttcacgtcgcggtcggcgacctccagccagcgccccacctcctgcagcgtccccgccgcccccgcctcggccgcggcggcgatgaggcagttgaaggtggtgatgttgggccgcaccccgcgcgaccccatctccttgaacacctccagcgcgcggtccagctcgcccgcgttggtgcaggccttgagcgcggtgttgaagctgaccgcgtcgggggccagcgtgggcccgccctcccacatcgcgcgcagcaggtgcaccgcgcgctgccactggggcgggcgcgcacgcgcgtaggccgccagcagcgcgttgcagcagacgcggttgggtgtcacgcgcgcggcgtggccgaaggcaaaggcggggccgggaggcgaccccgcgcgcgccg

SEQ ID NO: 43406 - DNA, 75 bp, Chlorella protothecoides
gcgccgcctcctcgccaccatccgctgcctcccccgcctcgccgcccttccccgcctcgccgccctttcccgcct

SEQ ID NO: 43407 - DNA, 71 bp, Chlorella protothecoides
cccttcgtacacaactgaaccttcaatcaccccccccctcccccttacccagccaccccacaaatgcacat

SEQ ID NO: 43408 - DNA, 61 bp, Chlorella protothecoides
atgtaggactgccggggctggagcagcaggggcagcaggtgctcctgtgcgcgggtttggg

SEQ ID NO: 43409 - DNA, 61 bp, Chlorella protothecoides
tcttcctgggctgcaggttggtggcggggggaggtcccgggatttccctccatacaccgca

SEQ ID NO: 43410 - DNA, 448 bp, Chlorella protothecoides
  modified_base (183)..(305): a, c, t, g, unknown or other
cgacgggccccgcggcggccggggcccccgtccccgccgcgcgtgcccccctcgccagcgcaccctcctccgcctcgaccacaggcgaggaggactccatagagcgcttctgggaccgcaagtggatgcagagcagccgggtgccgctgccgcccgccaccgcgcgccgtgcggcggccgcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcggtgggcgggccgtcgccaggcgagtcttcgccggacggcggcgacccgcccttcctcacgccggcctcttccccagccaagcccgtgcgcggcgcgggcggcgtcgagcctgacccccgagcgggcacgcccgaggcggc

SEQ ID NO: 43411 - DNA, 61 bp, Chlorella protothecoides
agatcctggcagacataggtggggggggggggccttgtacgtcgacttgctgctgtgtgga

SEQ ID NO: 43412 - DNA, 5730 bp, Chlorella protothecoides
  modified_base (416)..(425): a, c, t, g, unknown or other
  modified_base (1799)..(1930): a, c, t, g, unknown or other
  modified_base (1996)..(2005): a, c, t, g, unknown or other
  modified_base (3098)..(3107): a, c, t, g, unknown or other
  modified_base (3752)..(3761): a, c, t, g, unknown or other
  modified_base (4056)..(4065): a, c, t, g, unknown or other
  modified_base (4721)..(4730): a, c, t, g, unknown or other
gcgctcggctgcgcggcagggcgcggcgggacgcaaggacgccccctcggccggcctgggcgccgcgcccgccttctacgccccagacctgctctacgcaggggagctgccggggcgggaggggcggccggtggtggacgactgggactgcctcagggtgagtggtgctgttgatgaggagcggggaggagctgattgcttggcgggtgtgggcctccactcagaagagcctgctgagtctggctgagcgcagaccggtgaggtccaagagtggtttcgcgcgcccgtcacccgacctcctagatttgcagctgtgattgagggccgagtctgtcacaagcatggcatgccccccctcacgaccatcgtgatcagtaacgacaaaatgcaccccctgcaggacatggtcggggccnnnnnnnnnntttgcgcgtgcccgtcacccgacctcctaggtttgcagctgtgattcagggccgagtctgtcacaagcatggcatgccccctctcaagaccatcgtgatgagtaacgacaagatgcaccccctgcaggacatggtcggggcctgggagggtgtgtgcggggcgctggaccagtatggcatgcggcacagcagggcctttgccaacctgtgcaacgccggcgtgcggccctcggagctggggaccgcggctgcgctggcgtgcaccgacgccgacgtcgcctgaagctggcggcccgtggcgcatgcagggtgggagggaggtcgcttgcctgacttgcactggccatcccccacacgcgtgcatacttgaacgatgagcggcaggggcgaccagggccggaggacatgaaagcgccatggagccctgcctgtgtgactatgcacatgcgttgcccccatcacattgccctgccccgtgtactttctcagcgcgtgcttgcatcgaccgagtgtttgttccattgctctggtacagtcgtgccgtgtacatgcctcccttagcagagcagggtgcgcagggtgaatggattggtagcaggcagcacgccctactgctggtgagcaggctacccctgctgccccccctcccacctcagatctcgtcgtcgtcggagaaggcaaagtcgtgggcggggaagtccccgaccttcaccaggtctggccgcacgaagctgccgtagcccggtgcgcaggtgaagcagcggtggcctcgcgcgctgccgtcgttcttgcccacgggctcgtcgtactgccatggcaaaaggacataggatgcggataacgggctcagcaagcctatcatagggcgtccaggcaaacaaagctgagtggtccgtggcagaagctgtcgacgggaacaacaggcaccccctgccaaacccctcccctgggtcgttcaccaacccacctcgacgccgatccagaagccggcgggcaggctcggacaccggcccacgaaacgcacggtgccccttcgcccgccctgcacctcacaccgcgtgcccacggcgatgccggcggccagctcctcttggaacgagtcgtctggggccggaccctgtggcgcggggccagttgcgcccctggcctgagttggggggtgggaattttcagatgggttaacgctggacacagtattgagcagtcccctttacccccagtccccagacagaacacacagctccatttgtcaggttcccgactaccttggaccttgcctccatctccttctccagcgtccatgtggggtcctcttgcagcttcgtctccttgaacttcctgtgatcatcgggatcccaaccgagcagggcacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatggcacctctctggaatgaaattttgacaccgtctgcagcgcccctgggaatgcaggcacacgnnnnnnnnnngagacgctgatgtggggtcgagatcctccacatgaagtgtgtccctggtgaagagatgtgcaagggatcgaggctgcaggtgcatgggaagaggtccacacctgtactgcaaatttcacaccattctccccagatatggcacctctctggaataatgttttgacaccgcctgcagcgcccctgggaatgcaggcacacgtacctgtcttgtggtgagtagtagcccagcttcttgtcattctgtagtattgtactggctccaccaccggctgctcgcaggctgagagtcatggctgagggtgcagagccggtgtggaagcacagcttgtccttcacagccgagaccgtcatctgtcaaatggagatatataataggagtttgtgacacatggtgatcatcttgcaccaaaaactgggctggcaagcagggcctgcaggtgtgcccccccctccccacaaccaaccatcgcacatggcggtcgaaccggatctccatgaagcgagccttcagattgctatgcgttacgctcagcagcactgtgctatctgattgattctgcatgtcccctggagtcatgacatagtcccgcagtgccctcagatcccctgtcagcgctgccatcgtcgagtacggtggagggggtgcggtatacaggagttacccgaccttcgaacgcctgggacagtgatcctgtagtctccgggaacccaagggaccgtaaaatgggtgctttcggattacagtatgttgatcgcgcatggcagcatacgttcccgactgagaagcctttcgaatcggttctcggccttccctccagatttctttcggctgccccgtcagacggcctccccatccccgcattgggggcttagcccggcagacacataccaaatcctgtcagacgctcgcacaattcgcagcaaaacttcaactgcgatctaccctctctgaagaaacatagggcgccatgtcatcctcacagctttctgatggtgcgccgcgctccaacactggcttccctatatgccgtgccttgctgcttcgtcttcactcactccccctcgtttccccagatgttaagactcggctggnnnnnnnnnntactggcttccttatatgccgtgccttgctgcttcgtcttcattcactcctccctcgttttcccagatgttaagactcggctgggcttcggggccgatgacagcaccaagctcagtccggaatggatggtggagcccaaggcaaggggtggcgaggctcctcacgagtccgccttgcaatctggatgtatgcctcccgctcgatgctcactccctccacatgatgacattcattccttcaggatgctccacggcccaaccaggtcccctggagggccccaggggcaaggatggcagcaaagcccccggcggacgcctccccctccctgaacatgctggggagggggagggagcatttcccggccggcgtgcgccccgccgagccccctcgctggggcgaggagccggggtggcgcagcgatcccaagccacgggacggctgggtgaacagggagggcggcggcgactggcgtgcgctcgacccccgtggcggtgatgagtggcgcgtggatcgctggaagcactcgccagcgccagtgcctggggatggtgagctcggggtcagggggcttgttaggcctggattggccggcagggagcgggaagccttgcgcgctgtgcccactggttcgctgctgcaccgggnnnnnnnnnnaccagcgccagtacctggcgatggtgagctcggggtcagggggcttctcaggcctggattggccgacagggagcgggaagccttgcgctctgtgcccactggttcgctgctgcaccgggtgtcccagcggcgtgatcatgcctgccctcggtgtttcctcgtcaatggccattgcctccctttcccctgacccctcctccaacccacaatacagaggacctgagtggcgcccgaggccgactccacccccagccccgcgccgtgcgccccggcggcgacacctggcgtagcggcnnnnnnnnnntggtgtttcctcgtcaataatcactgcctccctttcccctgacccctcctccaacccgcaatacagaggacctcagtggcgcccgaggccgactccaccccccgccccgcgccgttcgccccggcggcgacacctggcgtagcggcgcgtccccccttccgcccccgcccctgcccggcccgggcctggtcggccccgccctcggcgacctcggcgccggcgggtatgggcggcgtgcgggcacgggcgcggagcaccggaccccagcccggccccgggcccgcgggtttggcccaggcggcggcacgcgtgggaccatgcggatgggcccctcctgcgcgcgccaccgctactccaccgagacgctggcgcggctgtgtcgccgcctgatgtacagcggccagctgcggctgccgcgggggctggcgcgcgacgagcccaaatttttcctcccccctggtgactttgtggatgtggtggagcagctggagggcgtggaccccgaggaggtggcgcgcctgtttgagggtgcgtgcttgtttgttctggggcaggggtgggaggaagggagggggatgccagctgagggggttgatggagggtgatgtggatggataccaaggggggaggagattggcgtgggcgcccgtcagccnnnnnnnnnngctggggcaggggtgggaggaagggagggagatgccagctgagggggttgatggaggggggtgtggatggataccaagggaggaggagattggcgtgggcgcccgtcagcctgggcgaaggggccccgtacgatgtccggtagtagaggccagtctgccctgccagcttgtctttagcgcgggaaggggttgggggataccgagcggctgggccaaccttggacctggaaccccactccatcacctcacccatgaccccaccgccccggacgcagagttccggggcatcaatgcctacagcgcggcccgcttcgccgcgctgggcttggaggaggcgaggcacgaccacggcgagccgccgcaggaaccccgggcgaccgcgcacgccgaggctcacccggcgccggccgcagcggcgcctgctgcgccccaggcggccgaggcagccctgccggctgctgcgccggcccccgccgccgcagcgacctgggagtaccaggacccccgtggcgagatccaggggcccttcacggtcccggagatgctggagtggtgggtttggcgcgtggctggcgtggctgatgtgcggggcggagggggccgggttgtggtcgtcgccggctcccacgctgcctcggggatcccactgcatgcccggggctggagcgacgggggagactgcggagcgttggggctaggaatgcgtgggagatcataccctgcccagcaggctactcgcatcccttaaccacgcatcccacccacctggacacccaggcatgaggccggcttcttccccatggacctgaagctgcgccctgcggggtcgggcggcgccttccagctgctgaaggatgtgctgccgcggtggcagaaccccacgcccaagcccccgggctttgccgcgccgggcgacgccgcgccggcgcccggccccggccttgaccccggactggcgctggacgcgtggcacggctggcgtgggcaggctccgcccagg

SEQ ID NO: 43413 - DNA, 76 bp, Chlorella protothecoides
tgccgccgctgacgagagcgctgccgccgccggggagcgctctgccgccgccgaggagcgcgctgcagccgccgag

SEQ ID NO: 43414 - DNA, 61 bp, Chlorella protothecoides
gcgccgcccgcacctcaggcgcggccaccggtggtgggtttgtggcgcccagatgcagcgc

SEQ ID NO: 43415 - DNA, 61 bp, Chlorella protothecoides
gttggcatggttactggcttgctaatggtgggacttgctggcccgccgctggaattacctg

SEQ ID NO: 43416 - DNA, 62 bp, Chlorella protothecoides
ggacgggggagcggcctcggtgtgtgaaggaatggcatggcgacgcaaggcgatggatctgg

SEQ ID NO: 43417 - DNA, 61 bp, Chlorella protothecoides
gtgggttgtgggaccgaggagggggggggggggtcggtgaagggagaaggaggggtcaggg

SEQ ID NO: 43418 - DNA, 452 bp, Chlorella protothecoides
  modified_base (123)..(342): a, c, t, g, unknown or other
cagaggagccaccaagatctgcatgcgcagtgcgcccttataatctcgggacacctttgcctggatcgtagacatctagtgacgtcactcgatggtgtgcacagcatgcaggtgccggtttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaggctggggagtctcgctcagagtcggaaagctgagcacccagttgccttgaccagccagtaatacgccagctccccttccgatcctctgctacgactccagacgtggt

SEQ ID NO: 43419 - DNA, 61 bp, Chlorella protothecoides
ccttctcggagcgtcggtgtcccagaggggggcgtagggttgagctgctgggttgcacgac

SEQ ID NO: 43420 - DNA, 125 bp, Chlorella protothecoides
tgtcggaggagagggcggggccggcgggggccgcccacgtctgcagggccgccatgatacggatgcggtcctgcgcagcggggtgggtgaaaagtgggtgcggcttgggggcaaggaccggcgcc

SEQ ID NO: 43421 - DNA, 689 bp, Chlorella protothecoides
  modified_base (115)..(297): a, c, t, g, unknown or other
  modified_base (515)..(611): a, c, t, g, unknown or other
ggcggggtcgctggcctgcgcgcgcgcggcgtccagcgacgccatcagcaggtagctggggctggagctctgcaccatctgcgggggcgccgcgcgggttcgcagtgacaggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggcctggtccagccggtcgaggtccaccctgccgccacgcacgtgcagcacggccgcctgcgtcagcgcccccagcgtcttgtgcgtggactggacgaccacgtccgcgccgcaggccagcgccgaggctgggaaggaggggtgcaggcccaggtgcgcgccgtgcgcctcgtccaccagcagcggcaggccgtgggcatgggccacggccgccagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagtaggtgggcgagacgacgagcgcggccgcggggcgggcgccgcgcgcgagggccagccggacggcccggtccagct

SEQ ID NO: 43422 - DNA, 165 bp, Chlorella protothecoides
gcgctgctggccgccgcggagcgcgtggaggcgcgcgtgctggcgctgccagccgcgctgcgcggccaactggcgctgctgggcgaggtgcactccgcgctgcgcacgctgagcaacgtcaccaccgactggggcgctgaggtggacggcctggccgaccgcctg

SEQ ID NO: 43423 - DNA, 76 bp, Chlorella protothecoides
gtggacctaccaggccatgctgcacgaggtgctgggcatcgtcggagggtgcgtggaccttcgccacgtccccggg

SEQ ID NO: 43424 - DNA, 61 bp, Chlorella protothecoides
ccagcagggcagcagagtcgtcccgcagcaaggcagcagagtcgtcccgcagcagggccgc

SEQ ID NO: 43425 - DNA, 78 bp, Chlorella protothecoides
gtcgcctcccccaccagcaaagaagtcgccccccccacctgcgaagacgtcgcctcccccaccagcaaagaagtcgcc

SEQ ID NO: 43426 - DNA, 61 bp, Chlorella protothecoides
ctccctcccaaggaccatggcacacaggcctcaccctccgcgtctgaatctcgcagccccg

SEQ ID NO: 43427 - DNA, 127 bp, Chlorella protothecoides
ccgagactgggaggagctggcggaggtgcgcgaggggtgtggttgtggtttggcgggggcgcgcatcgtgtgggagggtggcagatgtacgtcacatagggtgcctgacgaagcagggaggctgaag

SEQ ID NO: 43428 - DNA, 144 bp, Chlorella protothecoides
ggcgctccagggggagcgatgggatgcagaaccccccagcagctccttgtccacgctcctgggcaagaattccgacgataccccccccccaggaataggaaggagggcctggagcgctcacctttgaagcccgcgcgctggagg

SEQ ID NO: 43429 - DNA, 15414 bp, Chlorella protothecoides
  modified_base (391)..(400): a, c, t, g, unknown or other
  modified_base (697)..(706): a, c, t, g, unknown or other
  modified_base (1491)..(1500): a, c, t, g, unknown or other
  modified_base (1627)..(1636): a, c, t, g, unknown or other
  modified_base (1743)..(1761): a, c, t, g, unknown or other
  modified_base (1830)..(1839): a, c, t, g, unknown or other
  modified_base (2213)..(2222): a, c, t, g, unknown or other
  modified_base (2696)..(2705): a, c, t, g, unknown or other
  modified_base (2989)..(2998): a, c, t, g, unknown or other
  modified_base (3090)..(3099): a, c, t, g, unknown or other
  modified_base (3244)..(3253): a, c, t, g, unknown or other
  modified_base (3503)..(3512): a, c, t, g, unknown or other
  modified_base (3843)..(3852): a, c, t, g, unknown or other
  modified_base (4888)..(4897): a, c, t, g, unknown or other
  modified_base (6128)..(6137): a, c, t, g, unknown or other
  modified_base (6700)..(6709): a, c, t, g, unknown or other
  modified_base (7440)..(7449): a, c, t, g, unknown or other
  modified_base (7677)..(7686): a, c, t, g, unknown or other
  modified_base (8238)..(8247): a, c, t, g, unknown or other
  modified_base (9020)..(9029): a, c, t, g, unknown or other
  modified_base (9132)..(9332): a, c, t, g, unknown or other
  modified_base (9432)..(9441): a, c, t, g, unknown or other
  modified_base (9760)..(9769): a, c, t, g, unknown or other
  modified_base (10016)..(10025): a, c, t, g, unknown or other
  modified_base (10186)..(10195): a, c, t, g, unknown or other
  modified_base (10580)..(10589): a, c, t, g, unknown or other
  modified_base (10896)..(10905): a, c, t, g, unknown or other
  modified_base (11444)..(11453): a, c, t, g, unknown or other
  modified_base (11529)..(11538): a, c, t, g, unknown or other
  modified_base (12571)..(12580): a, c, t, g, unknown or other
  modified_base (13352)..(13361): a, c, t, g, unknown or other
  modified_base (13903)..(13912): a, c, t, g, unknown or other
  modified_base (14105)..(14114): a, c, t, g, unknown or other
tccctggagcagcgtgaccagctgcagacctgcttcctcccgcctggggtccccctggccgaggtggacgtggaggccaccccgacccctcatccaagcgaggcatccttcctcctggaggagcgacggggcgaggaatgcagccagctccaggcccctgcgtcgccgccgtcgcctccatccatgcttgccagccaggaggacatcggcacggctctgctgtcgaaccgggagcctggcctacagactcggcgccaaggtgggctgcactcgggtcagagcaccatcaggggaacgagagtgtggactaagggaaaggcgtttcccagcgatgcatttcctcacagcggtgcatttccccactgcaaaccacgcccgcggcgctgcactnnnnnnnnnntcacgaccgagctcctaggggtggcgtccatgcatctccgcactgcgcacaccgtgagagtacaggtggttgaatgtgtgtaacgatggcctagcgctcctctggccccacccatcctccgctgcgactcacggtcggtgtccacctcgaaggagtttacgcccagtccggagggagactccatctctaagtggatggtatgagtgagtagtatgctgttgtaggaaagttttcaatcagctccagaaattccccaagctaaggtcgagcaccacttcttaagtgctagacctactnnnnnnnnnntcgacgcaaagtgcatgataaggtcgacatcagatgcatcctctgagcatttgccttcgaccattaattactcgagaacatatcggggtcagggttctgctgcctgcatccgcattttctgctgtgagcagggttcgccatgcctgcccggtcctctgaccaatccttctccgtctgggtgccggaattccaatcaggtacgatgaagcgctagaatttaggtgaaccgcctgtgtgatagcctggtgggatgttggccctacgactccccattccctccccaagcacaggcccagcagaccccacaacgtcctccgaagccggcatctacatccgagactcccccctcgcggcggcagtattcaacttggaccctgccagtcagaagcccttcatgtcccagggccccttggcgcgcaacctgtccaccaaccccaacctgtcgccccccgcgtccccccgccacgactccccccgttcacatgacgtcaccctgcacgcgaggcggcccacctggagccctccccccacccagggcagcgtgaccccggcccgcgggaccccgcccctgtcccccaggatcgtgagggtcagcaggcagcgctgtccctcctggccccggctctcgtcccccgacgtgatgcagcagctctgcgactccgcgccagagcccgacacgctcgccagccagagcggggtgcaggcgatgggtgatcgacgggcgttggagggcgcaggactgaagcaaggattctccctggagcagcgtgaccagctgcagaccnnnnnnnnnncggatgcatctgatggcgaccttatcatgcactttgtgtcgcaagtgtcagggggctgtgccgacagcgcgcgtgccgggggatgccgcccgtagaagtaggtctagcacttaagaagtggtgctcnnnnnnnnnnagcttcctcccgcccggggtccccctggccgaggtggacgtggagaccaccccgacccctcatccaagcgaggcagccttcctcctggaggagcgacggggcgaggnnnnnnnnnnnnnnnnnnncccactgtcagccccagctcgaatccccttgtgcctcgccgcaggcgcaggcacatcctttgcagcaannnnnnnnnnctgccagccaggaggacatcggcacggctccgctgtcgaataaggagcctggcctacagacgcggcgccaaggtgggctgcactcgggtcaaagcatcatcaggggaacgagagtgtggactaaggaaaggcgtttcccagcaatgcatttcctcacaacgatgcattttctcactgcaaaccacgcccgcggcgctgcactgcccttgctgcactgtcagccccagctcgaaccccctggtgcctcaccgcaggcgcaggcacatcctttgcagcaaggctcaggtccatggggctcgtggttgcggcggtgttggcctccatcctggcgttccacgcctttcacccgtcccggctggacgtggactccctgnnnnnnnnnncggggctcatggtcgcggcggtgctggcctccatcctggcgttccgcgccttccacccgtcccggctggacgtggactccctgctgcaggagcgactggatgccctgtcccaggtggagcacatgggaggcagcctggaggaggccctcgccgggaacggcgccgcactgcgcctgctggtggaggaagtggacaggctgctgaagggagggggcgccgatgtcttccccgccctcgcgtcggtgagactcggcttgggtgggtggtcgtggacaggaagtggggccaagcgatagcctgtgcaagccggggtgatgaactgatgtgtggcgggaggtgcaccggtctcgttcctactggtgttgaggaggaaggaacaaacgacaccctggcttccacatggccgctgcctcgtgtgcccgacgccagccctcgtgatgtcacgagtgtgtcgagggcaatcgcatacctccnnnnnnnnnncacaggctgctgaagggaggtggcgacgatgccttccccgccctcgcgtcggtgaggctcggcctgggtgggtggtcatggacaggaaaggggggccaagcggtagcctgtgcaagccggggtgatgaactggtgggtggcggggggtgcaccggccccgttcctactggtgttgaggaggagggaacaaacgccaccctggcttccgcatggccgctgcctcgggtgcccaacgccagccctcgtgatgtcccgagtgtgtcgagggcaatcgcatacctccnnnnnnnnnncccaactcctgaccgccattcgttttgcagcctgtgttgcaccatgcatccctggaaaatctaacccaccccccctcccccgcgatgtcctnnnnnnnnnnctcggcccttccacaggtgtttggtgccctggggcagctgtccgctgcgaccctggcagcgctcaacagcaccggctaggtgggatttgcatgaattcggcccacggcttgcgaattgcaggtacaccagaagaacgataagaannnnnnnnnngatccgccccacggcctgcggattgcaggtacaccagaagaacgataagaacagcacgggatctcagcatgcgtgcaccttgccaactactgaccgccattcgttctgcaacctgtgttgcaccatgcatcattggaaaatataaccccccccccctcccccgcgatgtcctacatttggctgaacttccaaccatatacaaatcaaacttttggaactgaatgctctataccatgtcgcatgactctcnnnnnnnnnntcaaaccaaagttttggaaccgaatgctctataccatgtcgcatgactctcaatcattgtgatgctctgggattgcaacgcgaatcattcatccaagcattcggttggtgtgtctcagcgatcggctacgtgatgatgtggatcttccggtcagaatccggagggaggcgtaacgtcgaggaggcagcaatggaccactgctcgcccagccacactccaccacttcatcccagcgggaccttaacatcggtatcctaatcgaatgtcgaggatgtgacgagagcttccagaacccctcaacccctgccagcatgccccatgtgggcatctnnnnnnnnnngcgggaccttaccatcggtatccttatcgaatgtcgaggatgtgacaagggcttccagaacccctcaccccctgccagcatgccccatgtgggcatctccaccgcccgcatgcgcaccagcgtcggggcctgggggtgccgggtgctgcgggctgctcggcgggctcgcacgggcgtggatgcccccgagaacatgatcattgccaaggcgcggcggatggggcggaacggtgggtgcatgatcaccttgacgcgagtcaaccgaggcccggatccagggcagcaggggaggatctccaacattgatcgaccaggctcagcccagggccccccgccccggcctgctcttctccacccacacgcttccttgaaccccctcccccaccctgtcacacccctccccaccgcaggcatggtactttctgtacaacataggcgcggtgtgcatggtgccgtacctcatcctgctctacagcgggcgcggcttcggcgccatgcagatcggcgtcctgtgcgcgctccgcccctgggtctccgcgcccgccggcaacctggtggtggccgccgccgacgcctggggcctgcaccgcgcggcgctggtgggcaccttcctcgcggcgctcgcgggccgcgtgctgctgtcgcacagcactgggtttgccgccaacctcgtgtacaccgtcgtcagcgaggcagccgcggcccccatgagcgtcctggtggaggcggcggtcgtggccgccaccgtggatgtgaggctgtgaagagggggggtgggtttcattacaactcgcaatattctcctcctccaagcggggcgccaagagcacacaggatgagaggatggtgcgggaaggtattgcgtcagcacgcagagggccgcgatcgtgcactctccacaccgcgcggcgtgccaggtgcctggcacaggtcgcaggacgatgccctgcctgggccctgcctcgtcaaccttcccaggccctccaggccccgtccccagcctactccacccccccaccccagcccactccacccnnnnnnnnnntgatgccctgcctgggccctgcatcgtcaaccttcccaggccctccaggccccatccccagcccactccacccccccaccccaacctcccgccaccccaggacagccagtacggccggacgcggatgtgggcctccatgggttggggggggatgagccctgtcgccggcctgctgatcgagcggtacggcctgcaggcggcactgggggtctacgcctgcgccgtcaccctggccctgctgcccacttgtctcctgccgctggggggactgggggccaagcatggcgacgcccccgctctccctgcgccgcccgatgcgaccaccaaggatgtggccgaggcccctccggagcggccgtgggccgcggcggcggcgggcacgccaaccctggcgcagctggaatgggccgccagggcctctgtcaccccgctgtcccccgtcctcgcctggcagtcgcagtcggccgcggcggccgcggcggctggcatggaggcgggggcccgtcgggggcccggcacccctgggcctgagctggacggctcgaccccagggccggaccccgctggcccctcgggcatcgacagccccactgcgccgcccactgcgcgcccggtccggccctacaccgtgctccacctgacggtcgacgggtccctggctgggctgtccgcctcgccgcgggcgggggccgccacgccctcccccggcattcccctctccatactctccaggaacgctgcggctgccagcctgctcacgcccacgcgcgcccaggcgctggcggcgggcagcgatgcgggcgagtcggtgtgctcctttggcagcgagggcggcagcagcgccgcggggggcgaggggggagtctggacagtggtggggcggctggtgctgagacccgacgtcgccgtgttcttctgggtaacgctgctgatgggcatcgggaacgggttcattgcctacctgttcctcttcctcagcgacctgggtgagtgtggaggggagcggggctcgagcgggttgggcagacgtgtaggcatgcgaacaagactgtgacacaaggccgaggatttggcccaaagtcgcgcccccgacgtcagccccccggtctagctccggagatctccctcctctcccaagctctcgggctgagacgtctcactcatccctctcttcctctccaaccccacatcatgctgatccaggagcccatgggaccctgctgggcctctnnnnnnnnnngcgtctcacccatccctctcttcctctccaaccccacaccatgctgctgcaggagcccatgggaccctgctgggcctctgcctgtctgcaaactgcgcagcggagatccctgtcttcttcttcagcggcaagatcctggagagggtgggcgtcctccccgccttccacctctccatggcggccttcctcctgcgcctgacctgctatgcggtgggtcaggagggggctttgggctgcgtggcgctcgggccggccaggttgatgccaccggcgctgcagcatgcctgctgcacaacctactgcgactcagctcgccacctggcagctagggcggcgtgctgggagcccgtccccccagatgcaagctcgatgcttttccacaccccctttgcgtgaccccgcaacctcaccctacacctctccacaacccaactccatgcagctgctccccctggcacccactccctggctggtcctgggcatcgagctcctgcagggcgccacctttgccctcggctggacggcagggtgtgtgtacgtcaagcgcacggctccccgccacnnnnnnnnnntctgggcatcgagctcctacagggcgccaccttcgccctcggctggacggcggggtgcgtgtacgtcaagcgcacggctccccgccacgcaaggtccaccacccaggtgagctcgtcatggtgcgatcctggctggcagaggcccccactcacacgtgcctcgatcaccacctgcatgaacctgttgagtgaaatcgagtcgctttggtcccacccttgtcaagcccgtcctgactgctgactgttgcctgcggggggagccgatccttcaagcctgacaggccgctacctcacgccgacagaacgatgcacacttctgttttcacagccgccaaaccagcatccctgcatcgcattccggcaccttttctgcgcacatcctgccctcctgtgatcccctacagagcgtgttttcggggctctacaccggaataggagcaggcgtcggcgcactactggcggggggactctacggccccatgggcggggcgggtgtgtttggcctgggagccggcatgctggcggtcggctggggcgccgcgctgtgcgtgctgtggtggctgcggcacacgaggacagcacacagcagcgcctacgtcaggctggaggctgagctggcgccgcccaggggcctggcgtcgccatgacgccaagccatgcccctcatgcatgcagaggtcccctgaattccccaattttgccagcccagtgcccactcccctgtttccgcnnnnnnnnnnagcgatgcccctcatgcatgtagaggtcccttggatcccccaattttaccagcccagtgcccactcccctgtttccgcgccacgtcctgagcgagcttgcatgtatgagagaaggcaggtcattggggccaagcgcttgcggctgtttcaatggagatgtgctgtaaggggcagggggtggcactcagtggcgctcttgccagcccatggctcgagtcctgcagcgcnnnnnnnnnncagggccaagcacttgcggctgtttcactggaaatgtgctgtaagggggagggggtggcactcagtggcgctcgtgccagcccatggctcgagtcctgcagcgccatgtgcatgcagcatgaccctccaggcagccaagatccttgctgctgggcagcgcctgcccttctctccactccccggcagcagctctgccaggggggatgcaggcgaaatgcccaggcctttgcgcatatcctaaaggggcaagccaggcctacttgtttgcatcgcggccgcgctggcaggccgtcaccctgcagcatgctgccccgccgctgctgtgacgaccttgctgtccaccaggatgagcctcatgtgcttcgctgccagctccagctcatcccgcttgctggagccctgtgtggggctcagcttcagaatcacgtcccgcagctcaaagtcccagacctgcacggatgaagataatggggggtgagggggcgtgttaagcggggtgggagtatttaagggggaattgtctgcctccacccgccctgggtgggcatgcannnnnnnnnnagggtgtggggggggcgttaagcggggtgggagtattttagggtggacagtcctgcctccacccgccctgggtgggcatgcaggcatgaaggacgccagggggagtccctctcacgttgtcgcagtatcgatacgtgtcgagctggcccttgaatgatgacttggcggtgactcgcttatctagagccctcagtattgcggcatcgaactgcgtgacgggtcgggagggcagtcacaggcgaagggaagacccggcgatgcacgcacaagcaccctggactctgctgagatcatcaccatgctgacctcctggatgactcgcatcgccagaacatcagagatcttgccatcgtcctgaagcagtttgagagcgcccatgaggctctccccaatgctggagctgcggtacagcgcatcggtcatggcgtttgagtccctgttggcgggtgcggtctcaccgtctgagaccctgacaagggagggcggatcctgctgaggacatgttcttattgacgaaaatgtacacagaatgatgaccctcaacgcgcctgaacactgggcgggacggggcactcggaatggtaatgtatttgccgggtacagggtggaaggcacttgatcctccccaaccctggtaggcggtggattacacttgagcgcatgatgtgaagaccatccttgcagccaatggatgacctgtgctgtatttaggttttgagattatgcaaagcagtttgtccataaaggaccagaatggttggggccctgagccnnnnnnnnnntccatccttgcagccaatggacgacctgtgctgcatttaggttttgagcttatgtaaagcagtttgttcataaaaggaccagaatggttggggccctgagccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnactatcctgttgtagccatgatcatcactggcaaggttgatgagcaggcagtcagtaggtcactagcagactcttagtaaggatgcggcactgacatccnnnnnnnnnngcaatccaccaaggctcgccgtttggcaaaactgcagtgaaaggagaattctgtgggtgaagtgcatatcgcttgcgcacagccttcgtaaggaggatgcagtcgctatcctgttgtagccatgatcatctctgccaaggttgacgagcaggcagtcagtgagtcactagcaaactcttagtaaggatgcggcactgacatccatcatcaatgtgttctcctccgtcttggccctccttgtgagatcgtcaattaccagaccaagggcctctgtcgcaactctgcaacaggctccactgcaatgatcaatcatgagatnnnnnnnnnnttgaccaggggcctctgtcggaactctgcaataggctccactgcaatgatcaatcatgagatggtataaaggcgggctgtcaggtcagttgtagatggcactctgagtaaaaagcctggatcgtacacaacattgtctctcgcctaaaacccctgtcacttgatgatacggcgcaggattgatgcacaggctttatgagagtggatgccgtcaagtccatgtcatccatacaccgaaagagggaccnnnnnnnnnnacacaggctctatgagggtggatgttgtcaaggccatgtcatccatacaccgaaagagggaccgctctggagtccttggactgcgcactgataaataccgtcgtgacgtcgttgatgtacataagtcgtagccgtctctacacttgggccgagcgtcgtgnnnnnnnnnncctgttcaataccgttgtggcgtcgttgatgtacataagtcgcggccgtctctacacttgggccgagcgtcgtgagcgcctcatcttgtctcacaaaggtacatgtgtcggtagtgagctggtataccacaaaacctgaacatgaacgaatctctaggtgcaaggacctggatactatggctatgcatcctgcaggcccagcgcccaccccgagctcttgcctatctcaggccagaactcaattcagaccagtatgcatggttcactctgcagggtcgctcggcaggacggctggccagagacaatggcagttacaatgtgattacttgggtgagcctggctcgtcatacatcactacctgacgaaagcagcttgggagcagaannnnnnnnnntctcaattcagaccagtatgcatgcttaactctgcagggtggcttggcaggacggctgtccagagacaatggcagttacaatgagactacttgggtgagcctggctcgtcatacatccctacctgacgaaagcagcttgggagcagaaggtatgcatggctggctgcatgtccattgcttgagcttgccacaggcccacgccaaacctctgctgtaggagggcctcccatggtggtgcaggtctcgtctctcaatcaatggtctgtatgtctgttgagccggtcactaccgccatccactgcaacannnnnnnnnntatggtcattgcttgagcttgccacagtcccactccaaacctctgctgcaggagggcctcccatggtggtgcaggtctcgtcttccaccaatggtctgtatgtctattaagccggtcactaccgccatccactgcaacaagttgtggtggacgaaagctcaaaaggtcgtcctcttaagtgcaccacgttagaccactccgtcatacgggctagggtatgcccgcactagggttcgaacctaggcctccgttaggagagtgcatttcgaagggggaaggcgttcaaggtttctttaccagtttccgtcgcatcatataccgggaaggtggtgtcggagaataacactcgtcattcccttgtgtaaccccaaggacccgtttctctcaccgaccgtcctgacatcccatcatgtcgtcagcctgatgaatattaacaccactcgccgtcgcacccctctgatacaagcaggccttgcggggggcaaggcacggaggggcttgcatggcgagcagagcctcagcccaggcgggacagcagnnnnnnnnnntgtggtgtcggagaatcacactcgtcattcctttgcgtaatccccaggacccgtttctctcaccgaccgtcctgannnnnnnnnnccacaagcagaccttgcggggggcaaggcacggagggctttgcatgacaagcagagcctcagcccaggcgggacagcagcacctcctcgctgagcgggtcgttcagctctgccggctcaaaggggagcatgagggaggggtcgcaggacacgtaaaccctctgcttcaccccaaagtcgtacagcgccctgtcctccttcttggacaccagcaggtccatctcctgtgcgatgtgagggtggggtgggcttgtgtcgtgtggcatcacgccagcaccacatggccatgccctggtgtcgcagcgagatgacaccgcccctgacacacggcgcacggctcccgcccaaaatgcaacatcgcaggaacatgtgctcccagccaccccaccacctaccctggcctcccagtgtccaccctcacaggtcgtgcccccgagtcgccctggaccagtcccccccccccctcaccagcccgtcgtcaaactggaggtagtagcgcgcggtccagcccaccagcgtcttggcgatgaccgtggcggggcagatgcggggctggcggtagtcggcgtgcaggctgacgtcggagggcctgaccatgacaaaggggcgggcagttgtcagccccatcttgcgcacgaagaggcagccggcgggaaggtgcatgacgtcgcccacgaagttcatgacgaagggcgagcggggccgggcggcgatgtcctccattcgccccgcctgctccacgcgcccagcgttgaacagcaccacgctgtcggccagctcccaggcctcctcctggtcgtgggtgaccatgatggtggtcaccccgatctcgcgcacgatgtcgcgcagcgagcgctgcagcgccttgcgcaccagcgggtccagcgcgccgaagggctcgtccaggagcagcaggcgcgggctgcaggccagcgcgcgggccagcgccacgcgctggcgctgcccgccggacagctgcggagggtagcgcgaaccgtaccccgccagccccgtcagcgccaggagctcggccnnnnnnnnnncgggtagcgcgacccataccctgccagccccgtcagcgccaggagctcggccacgcgcgcctggacgtcgatgcgcaggcggcgcacgcgcgggccgaacgcgatgttctccgccaccgtcatgtgcttgaacagcgcgtagccctggaaggtgaaccccacgtcgcggtcctggatggagcgctgcgtcatgtccacgccgtcgaacgcgatggcgcccgcggtgggcgtctccagccccgcgatcaggcgcagcagcgtggtcttgccggagccggaggggcccagcagcgcggtgatcgtgcccggcgccacctccacgtccacgtcctgcaccgcgcggaacaggccgcggtcagtgtggtagtgcttgcgcatgccgcgcaccgacacgtgagtgccctggacgtggaaggaggaggcggcgggggggtggggcaagggcacgggcggcgggggggagcgggagccgtccgactccagcgactcgagcgccgggggcccgaccgagcgggcgggaggggcacgccgacgacgtccctgggaggttggagggagggagggagggtgaggttgggatgggtggagggtgattgtgagggggggccagggaggaaatggtggatgcagggagggtgatgcaagggaccagggaggggtgaggggagacgggagaggtcaggggtttcagaggatccactgagatgataattcagtatccaggggtgtcttcagcgctcaaaagtgtgcacaggagaggccgtgagcaggnnnnnnnnnngtgataattttgtatccaggggcgtcttcagcgctctaaagtgtgcacaggagaggccgtgagcaggagggcacactcttgtgcccagactgagagtgtttgtggaccggaggcgctcacacgggcgccggcccgcttcgccatcccacccggacgaccgatctccagggccactcaccggtgcaacgcggggcgggcaggtgtggaggggtgccttgaggctgggcgcccagcagtgggctggggatgtgagggccttcatgcgcgccggccggaaagtggcatgagttccagcaattatccacgcggccagggacggagcgggcggatgggggataggtcctacttgtcctggtccggacagggtggtctacaaaccagctttgccgggaatgtggtgcggggtgcgagcggtggtcgagcctcgaccaccgggcgatggcacgtgaaaaaaagaccaggccacacagcgctccgcggcggtgaagcttgcgctgcgatacaaggtttccaaggctactcctgggagggagtattgcttnnnnnnnnnngggtggtcgagcctcgaccaccgggcggtggcacgtgaaaaagagaccaggctacacagcgctccgcggtggtgaagcttgcgctgcgatacaaggttttcaaggctactcctgggagggagtattgctttctcggtcacagaggcttcaggctgacactccgaatcacatcacccacggggtggcgagcgcnnnnnnnnnnatcacaggggcttcaggctgacacactgaatcacatcacccacggggtggcgagcgcccggctctcaaaccctttggaaagggcgggggtcgtcccggtatctaagtgcagctggggtgcaaagagggcatcccgactccaagactgcgcatcaggatgcagcattagtcgatctgaatgcccctggacatgcgttaccccagatccaagacggaggggtgaccataacccccgttttgtcggcaaaagcggggtgtggcttgcgcaagtggcgaacccgaacatgggccagctgtgtgggaagccagatgtgctccaaccccctcctcaccaggacacatccctcaaagggacagcctgtccgtcatctggctgcgcggatgccgcgacatttgcgaaacagggtcgcttgggacccggcacggcatcaacaaccctgatgccgccgcggtcgagggtgccatcctttgccgcctccgccatcagctgcgactccagtgactaccagagtgtgacgagtgaggcatgggaggagctgatgagggaggcctccctcccactggagaatacagccagcatgagctggtcgaaggtgggtgggtgggtgcggacgcttgctgctggtgcagggcctgtccacttgatgacgggctgggggctgaggtagggcctgtgatcaatgtgagaggtttgggttctgtattctcgtccagcaaacatgcctctcctccccgcaactcccctccaggaccgtgtgaagagggaagccatcttccgcctggagcggtacctgagcctcgcacccacgcggaagccagagcgcgcccctcgcccctcccgacccttgccagccgccctggagccctccctcctccccctcgtcaagcccctggccgacaaggacgcgcccgcctcgcccgaggaggccctggcgcagctgcaggccgcgctgctggcgcggcgccccctggcggcggccgcggcgctgcggctcctaggcccgggcccggcatccgccgccggtgtggactgcgacgcggtgctggcgcaggagagggaggtggcggaggcgctggaaatgctggcggccgatggagactcggcctggcgccacttgcagtacaaggacgtgctgtcgctgtggtaccgccaggtgccgcactccagccgccaccacctgaagatgaaggtggaggtggcgcaccccatcaagcacctggtggccatgatgcatgagtgggacctcatgagccagtggaacaagtaagagagggagggggggagggggggaagggggggg

SEQ ID NO: 43430 - DNA, 131 bp, Chlorella protothecoides
accagagctccattgccagcgatgcggaatgactcagcgcactgctcacgccttgctcgtcgtgccatgcactgaaaaaaccagccgaactcaacaggggccccgctcagcagtatagcccctcgtctcgc

SEQ ID NO: 43431 - DNA, 61 bp, Chlorella protothecoides
cagagtcggggcaggtaaagccggaggagggggagaaggggagggagaagggaatggtgga

SEQ ID NO: 43432 - DNA, 75 bp, Chlorella protothecoides
ctctgcgcaagaagcttactttctctcaaatgggggggtgggggagggggggggcgatcctgcgctccctcccac

SEQ ID NO: 43433 - DNA, 100 bp, Chlorella protothecoides
cgtctacgacgtcgccttcctcgcggcgggcgatgctggtgctcggggcgccgaagatgccgcagcacgggcttccgatggtgatgcatcacccgccgcc

SEQ ID NO: 43434 - DNA, 61 bp, Chlorella protothecoides
gacaggcatggctgtggcggagtgaggatgggattcttaagtttggtgtctgcaacttata

SEQ ID NO: 43435 - DNA, 74 bp, Chlorella protothecoides
cggagcgtgtcggtggtccgcgggggggggcccggcgcgatgggcacgccaaggcatgccatcgacaggaggtc

SEQ ID NO: 43436 - DNA, 29067 bp, Chlorella protothecoides
  modified_base (466)..(475): a, c, t, g, unknown or other
  modified_base (782)..(791): a, c, t, g, unknown or other
  modified_base (1182)..(1191): a, c, t, g, unknown or other
  modified_base (1381)..(1390): a, c, t, g, unknown or other
  modified_base (1574)..(1583): a, c, t, g, unknown or other
  modified_base (2299)..(2308): a, c, t, g, unknown or other
  modified_base (2409)..(2418): a, c, t, g, unknown or other
  modified_base (3048)..(3057): a, c, t, g, unknown or other
  modified_base (3846)..(3855): a, c, t, g, unknown or other
  modified_base (4710)..(4719): a, c, t, g, unknown or other
  modified_base (4947)..(4956): a, c, t, g, unknown or other
  modified_base (5206)..(5215): a, c, t, g, unknown or other
  modified_base (5538)..(5547): a, c, t, g, unknown or other
  modified_base (6994)..(7003): a, c, t, g, unknown or other
  modified_base (7537)..(7546): a, c, t, g, unknown or other
  modified_base (7613)..(7622): a, c, t, g, unknown or other
  modified_base (7851)..(7860): a, c, t, g, unknown or other
  modified_base (10794)..(10892): a, c, t, g, unknown or other
  modified_base (10973)..(10982): a, c, t, g, unknown or other
  modified_base (11063)..(11072): a, c, t, g, unknown or other
  modified_base (11212)..(11287): a, c, t, g, unknown or other
  modified_base (11610)..(11619): a, c, t, g, unknown or other
  modified_base (13312)..(13321): a, c, t, g, unknown or other
  modified_base (13968)..(13977): a, c, t, g, unknown or other
  modified_base (14372)..(14449): a, c, t, g, unknown or other
  modified_base (14520)..(14529): a, c, t, g, unknown or other
  modified_base (14600)..(14609): a, c, t, g, unknown or other
  modified_base (14824)..(14890): a, c, t, g, unknown or other
  modified_base (15153)..(15162): a, c, t, g, unknown or other
  modified_base (15594)..(15603): a, c, t, g, unknown or other
  modified_base (15736)..(15745): a, c, t, g, unknown or other
  modified_base (15800)..(15809): a, c, t, g, unknown or other
  modified_base (16297)..(16306): a, c, t, g, unknown or other
  modified_base (16486)..(16495): a, c, t, g, unknown or other
  modified_base (16805)..(16814): a, c, t, g, unknown or other
  modified_base (17357)..(17366): a, c, t, g, unknown or other
  modified_base (18604)..(18613): a, c, t, g, unknown or other
  modified_base (20177)..(20186): a, c, t, g, unknown or other
  modified_base (21137)..(21146): a, c, t, g, unknown or other
  modified_base (21632)..(21641): a, c, t, g, unknown or other
  modified_base (22189)..(22198): a, c, t, g, unknown or other
  modified_base (22652)..(22661): a, c, t, g, unknown or other
  modified_base (22913)..(22922): a, c, t, g, unknown or other
  modified_base (23316)..(23325): a, c, t, g, unknown or other
  modified_base (24061)..(24152): a, c, t, g, unknown or other
  modified_base (24648)..(24657): a, c, t, g, unknown or other
  modified_base (25340)..(25349): a, c, t, g, unknown or other
  modified_base (25402)..(25411): a, c, t, g, unknown or other
  modified_base (25482)..(25491): a, c, t, g, unknown or other
  modified_base (26727)..(26736): a, c, t, g, unknown or other
  modified_base (28285)..(28294): a, c, t, g, unknown or other
  modified_base (28633)..(28642): a, c, t, g, unknown or other
ggacgagcgggggcacctgcgccggggatgggccgaccagcccccgcacactggagcgcgacgtggacgccgccatcgcgcgcaccatggtcgccgacctgcggcgccaggaggcggcgggggagcggtctgggcgggcgggggtggaggcggaggtggaggcagagctgggctccatcctggcgggtggggccggcgaggaggaggccgccgcgctggccctgcagcacgaggcgcagcgcctggcggggcagcagccgctgcacggcgcggggctgctggacggcgggtcatgaaccaggagccagggggagagggcggtatcgtcccccagaccccctcctctcatgcaatgcctccccctggccaccattaacccctttcctgttctgcatcatgggcatgatgccacacggcgtcagcgtcgttcacccccacactcccagtatgccccctggacgacagnnnnnnnnnnctgctacacgacgtcagtgtcgttcaccctcacactcccagtatgccccctggacgacagccgggggtgctgcatctggtccctttcgcccaacaaataagcttgccctgcagggggctgtatcccttgcctggcaatttagattgtatttattcttagagaaagatgtcaactcatacagggaagccagatgggggaagcatcgctgtgaggcaaggctttcggctctgatcagggacactgtgcctgggtcttcttcatgcatcctttgtaagcgctgcagccaggatgacgcccgctttgtagnnnnnnnnnnagggagcatcggtgtgaggcaaggctttcggcgctgatcagggacactctgcctgggttttcttcatgcatcctttgtgagtgctgcagccaggatgacgcccgctttgtagcccaggtagccacccaggacacagaggatcctggtggagggagggacgtcaagcagaccatcccagtgctggcatgggatgcaggagggggaaaggaggagggatgaccatggtttcagagagcctcatgctcctaccctttggctgtcactggcacagcacatgcaggtttctggacgcccatgcaaatatccttcaatcccgttgcacacgaccacaatggagtacacctcgtgactcccaccctgatctgcccgtaatccccatcacctcccggcnnnnnnnnnnacccatgcaatattccttcaatcccgtcgcacacccccacaatggagtaaacctcgtgactaccaccctaatctgcccgtaatccccatcacctcccggcttcttccacgccgcccttccccctgagcccctccaaccaccccgcctcagacctgaagagccttgtagcctgccaggagcaagagtgcgnnnnnnnnnnagagcccctccaaacatcccgcctcggacctgaagggccttgtagcctgccaggagcaagagtgcgggcagcgcgactcgcacaggtccggaaaggagggaccgcaggccggccatgccctctctcccctccccattccctagtctggcgacgtaagcgctctggacagccagacccacgagcnnnnnnnnnnaactcgcacaggtccggaaaggagggaaggcaggccggccatgccctcattcccctccccattccctagtctggcgacataagcgctctggacagccagacccacgagcccgccggccccacccaccccggccgccgtgcccgccccgggtcccagggccagggtcgtcagggccacggcagagaccgcccccgcggccccgccccagcccagacgcagggacagggagctgaaggcctgcatgcctgccgctctcatggcggcagcctcgtcggggtccaggacgcgcgagcccaccagcacactcccctctgccattgggaggaggagggccgccgactcggcgccacgtagccccaggcgctgccggcagacgaatctggggtcgagggaaggcgtgatggttgagggggcatgtgggaggggccgtcagggatgaagccggccatgactgcaacacctcctcgcatggtctcccagcccagcagccatggacaggcatcgccgccaaaggcagatcccgatgctcaacgactccttccatgccagcgtcacctatctgtggcctctccatgctgcacttctagggtgtcgcaggcccaagtcccccgatcaggacccagcaggcaggcttgcagtcgtcccagcggtggaccatacagttcgacctgggggacaaggggaagggatggcaattgttcgccttccaacagggnnnnnnnnnntgcccgacgcctgcggtcagccaaaagagccatggcacattccctctaagccagtgcaatcacctcatccgtggcaccctcttggaaacgccgggcctggnnnnnnnnnnggaacgatgatgcgaacgtggcccagaattcccatttctatcaaggactccttttggtagccttcagcagtggtcgctgacactgccagacagcagcggggcaggggctgggcacacaacactgggatgcaggcctgggcagcgcctgccggggcatccatggcgcccgacgcctgcggtcagccaaaaaagccatggcacatttactctaagcccatgcaatcacctcatctgtggcaccctcttggaaacgccgggcctgggaagattgcaaagagagctacatgaggcatgaacttgtcgaggccagggtccagcaggaaatagcatcaacagggtagcttgcgataaagtgttttcaccttggtgcacaacaccctacgcacggctttgctgcagaacgcagggagtcggcatagcagcgccgcaccatcttcagacatcaggtacagctggacggaggcttcggggtctaacagcgcagagccacgctctggcatggtcttcaagcggaggcgaagaaggtgtgtagccgctcccgtctggcacacaggtagcagggaagggggggtgttgtgagtgcaacaggacgaggtgggcattcccatgcaatctaagagtatcctctcnnnnnnnnnntgtcgctcccgtctggcacacaggcagcagggaagggggggtattgagagtgcaagaggacgaggtggacattcccatgcaatctaagagtatcctctccagattttgatgcggctgcatgtcgacaagatgcaggccttgggatccatgggcatgagggctcacggagcgccagcggccaactagaacgactcactggtctgtaaaccttgctccacaatcctcctcatgcaaactcacagcttgctcgtgtgccagactgagtgtctgtggcaagctccatggtgatgtgagcgcgcaagtcatgtatttttgtcgctctttgacagggcggatggcgcagattctcaggccatgccgtgcctgcttcatgcccaaagcagtcctgtccaaaacgcagcgatccataccgagtgatagagctttgcgatccctttcaccattcaggtatagatgtaatccacgatcccctgcattcgaatgaagaacgccgtgatggttccatgtcggagattcaatttgttcatgctccctgaaccgcatgctgtgatatatccgacgacccaagtatcattttgctgagactctcagcacatgtcgtaagcaagtgctcactgcaataattaatctaccgcattatcaagatcacccctcggtgtgcctgaaaaaggagtgcgtggacctctggagagcgggcttggtctcaacgattccgtgctgctctgatatatcgtggagggtaaatcctgcggccaccgcacagcagcgcttcgtagtttcagctcattnnnnnnnnnnctaatctgccgcattatcaagaccatccctcggtgtgcctgaaaaaggagtgcgtagacctctggagagcgggcttggtctcaacgattccgtgctgctctgaaatatcgtggagggatatcttgcggccaccacacagcagcgcttcgtagtttcagctcattaagtgcatttagatgcgaggaaccatgtgtgggatggcagtcagatgagcccgatcatgggcaggtctcggaggaagcggagcagcgagcaggagtgctcggattctgagacggagccgggcaccggcacggagtgtgtctgcgcgcagagccccacagggagagccaagcggtgagcctggctgcgggttggtgggggaccagaagcgcgtcttgttgggagcggcccagccgagcatcttcccaatcagggaggccagggcagcggtgggaaggaggagaagctggcgcctcctgctgggctacccctctgctagacagcccccggccaccccatgatagccacccccaccctctctttgtttccctcacccaacagagtgaggttcgctgacgccccctccgagatctctggcaagtatggcaccagcgatgggcacagtctggacgaggggaggggggttgtccctgtgcggtgctccgaccggaagtgggtggcgcgcatcactccttcggaggtccgccaactcgagtcggagctgggggaggagtatcaggcatccctggaccgactcaagcggaggtggggccccgggtgggggagcttgtttaaatggaggaggtgagaccttggttgatgcaggcaatgccgggggacaaacttgtaccagaagcgggaacgagcacgacnnnnnnnnnnaggggagcttgtttgaatggaggaggtgagacctttgttgatgcaggcaatgccggaggacagacttgtaccagaagcgggaacgagcacgaccacatggtagcttctgtgtatgtctcagggtcgctgtcaggtgcttctgcgtatgtctgggagtcgctctcaggtgcttctgcgtatgtctgagagtcgctctcaggtgctccaatccatgccggcactgccagnnnnnnnnnncgtatgtctgagagttactcagaggtgctccaatccatgccggcactgccagggctgggatgctgtcgagggtgcagctggtctccctgggcctcctcaaccagtctacgagtcgcatggccatcaaagctgatgccggcgaggtagatgctcccaagccaaccctccctgggtcgagtattcgcctgggctcgctgacagggtcgctgcgcggatcggccccactcaagaatggtttgtaaacttttgnnnnnnnnnnagtagaggctcccaagccgaccctccctgggtcaagtattcgcctgggctcgctgacagggtcgttacgcgaatcgaccccactcaagaatggtttgtaaacttttgccacgcatggcaagtggttccatgctgatgactttcttgtaacaatacgaatttctctagaggcagactatgcgttgtaacacttcatttgattcaaagtatatttgaattgggatgggtcataccagatacaccactatgattcccttctaccatcaaccatggttggtgtaggttacattaacacagtcctacttcaggatcctacactacatnnnnnnnnnngcgcatgtgattccatgctgatgtttttcttgtaacgatacgaatttgtagagggacattatgcgttgcaacactccatttgattcaaaatatagttacatggtgatggttgttataccagatacaccgctataatttccttctaccccatcaatcatggttggtgtaggttacattaaaacagtcctacttcaggatcctacactacatcacggcaagggaaacagcatcaaaatttggacattcagcgagcggtctcgtcagcgcggttggcggccttgtcggcaccctcctgcaggctgtgctttgcctcggtggtcttctcgcccacgcggttgccgaactcgttggccttgttcttggcgtcgtcgatcaggccgccggtgccggactgcctggaggaggcctggttcttcgtctcctcagccctgttctgggcggttccggccagctgcaatagattaagcaaggggttaaaaggcgatgagcgatcgttgtttgccggaacaatggctcgcgcattgaaatccttgcacgcaccccgacaccatagcaatgctgttcggaactatcaatcgcgttatcgagtgtcgtagctcacctcggaggccttgttcttggctgcatcccaggtctccgcggccttgttggaggcggcgttcagggcatcctgcgcctgctcagagatgggcttgccggagccagacatgataggaggttttgatgggttggaaggtggaaatggaggagtaggaagttggaagagttgttgagaatggtgccgatcctgtgccgaaagaggcttcttctagcccaaaggacacgggctacgaggaaccgtccccgtagttgccgcgtagctgtctcttacccacgtgcacaatgcgaacctccgggaaggaggctgaactttccgaggtatgttgcgattgctcgagttgaggcgggaagcaaatataatttccaaatcgaaacgtccagcaggtgtcctgaggttcagctgagcagcaccaaggccgccatcaccgggaccggccctggtcacggcggaggattgatgacttgaaaaggtgctcagaggaatgctggtggtcccacagcgggggagaatgttcaatatatgcatgatggggtttggtatttttggaccactctcgtacataactatgcttcaggcagatttcgcttttgacacctcgtactgtgaaacgtcatgcgaccgggcaatgcactgagggctataccaggacaccccccgtgggaatatgctactacatctgctttgagcaaggggggtatcctaacatgcatatgcatggtgcatcacgcttgagtccagtcttcagcggttacttggccagaatgtcatgggtaatattgtatgggcatggctgtcatatgaagtcaatgtctgctgagggctgctgcgagccccctggcagcgcgnnnnnnnnnntcatgttgcgtcacgcttgagtccagtcttcagcggttacatggccagaatgtcatgggtaatgttgtatgggcatggctgtgatatgaagtcaatgtctgccgagggctgctgcgagccccctggcagcgcgagggcgcagaccctcatcagcctcccgagcattggcaacgacatccttcgaaggcaaagccttgttcaaggtggtcaccatggatggcttggcgcggcggagcaaaggcaggcgtcctgttgagtgagaagttggtgtgattgaagggctgatttatacaaactggacgttgatgcagcgctgcctgtaaagggagtcaacaagaattgtcacaaaggtccaccactccatgtcaccttgacgagctgttgcaggtttgacaggcgaaaccttcttcttcactccaggcctctggcagctggtttgcttgacgggggatggggcaggagcctttggtgtcgatgccgaagcagtgcttgctgccctgctaagctgtgtggcgccgagctccgcggagtgcnnnnnnnnnncatacaaactggacgttgttgcagcactgcctgcagagggagtcaacaagaattgtcacaaaggtcnnnnnnnnnnatcactccaggcctctggcagctggcttgcttgatgggggatggggcaggcgcctttggtgtcgatgcagaagcagtgcttgctgccctgctgagctgtgtggcgccgagctccgcggagtgctgcggcggcatgggcatgggaatgggcgctgccgcgtcagcacccgatggacggccgctgatttgctggggaggcgctccctcacacctggctgcaccggtcttannnnnnnnnnttgggcatggacgctgccgcgtcagcacccggttgacggccgctggtttgctggggaggggctccctcacacctggctgcaccggtcttaccgcccagcggcgggggccctgtcacgcagccttcttcgtcggccgagggatggaccgcagccgtccgccgcgcgctcgcccgtgactggcgcgcggttagggccccgtccggtcggtccctggtctcaaagcccgagctctcctctgcagggacgacggcgtcgtcttgggaccggcagggcgttgggacctcctcgggcacgctggtactgggggcagcctccggctgctgctcctctgagccgccatctgacctctgaaagatgtaggcggtgaagctgcggccgctgcccgacatggacactgggaaggaggccctgaggagcaggggcccgaagcccatggcagccatggcggcctctgggtcggtgcgcatggcgcgctggaccaccgcaactccgcgcaggctggggctggagcggaagaggcgcccgaaggcagctctgccgggggggggaacgccctcccagaaggagtaggcgtgcgtgcagtcggtcagctgggccacctgtgtgtggtggggtgcggggggtggcatgtgcaactagcacctgcagtgggcacccgagcgacgtcatctgcccctgcattggaatccgcaacgagatcagcaccatgcccagcccacgacatgcaccccctcacacctgctcgatggcagcgcactgcatggtgggcagcaccatgtcagcgcggaccaggccccgggcctggagccgttgcgccgtctgcttgaggaaagcgtgggccttgtccaccttgatctggtccagctccacgccatgggtggccttgaccccgggttcgatcagggcatgcaagaggggtctggcatgggaggggggtgtcgggggtgcggaggtgagtgcggggatgggatcatgggtggggcgccaacgaaccaccaccaggacaggtggtgccagtgcacgtcagttggtatcgtcgagagcctcacctgcccaggcccgcgccaatgtccaccagcacggagtccttgtccaagccacagtgcttggacatggcggcgagcaccttttgcgtaccggtgcaggtgatggagccgtacaagccttccactccttccccgcctcccagccggttctgcgagatgcatgggggtgtgtggagcggtatggtccttgcgtagcccacatgaagttgagggatcataacagattaaaacactgtattgccctcgcacctctatagactgcatggcactgtacagggcgcgaagggtggccgtggtccccgaggacggggtcgtggacttgggcgggcccggggccttggtggccatcgtggcagcgtccaatgggcaaaatgtgcgtaagtgatgcgatccaccttgtacgaaacagctttacggcgtgacgtttgtgacagcacccggcatctcgacatcccacgtttaaacgcccgaatcctcttcccgccatgatcgcctccccctgccaaggtgctaccgatgccagaccctcataatcagaagaccagataaatccccaggtcctcccaaattgctcatgtgcctgaaaatgaagaaagtttgtcgcttgcaacccccccggtgctatcgcaatgccaggcatcagagaagcatacagaactggtcagcactatataggccaatctacaccatgttatatctcttcctgcttgccacggagtcatcggcgttcaaacatccgtgctactgccactcaaggtgatgacagagaagtctagccatagtgacactggtacccatttcttctcagggtggcattacaattggcagccaattacatgccaggaaaacacggaatgtctctcggcgaaatactggatgcccctccagaataggtcaaatgtacagcagcattgagttcaatactccagtctctgagataaatcctaatcaagtaagcctgccaccccgggacgttctctggggcgattcctgcagtctctcagggggtgtgccgtcgtggctgcagctcggtatctacccaggcccacaacgacgagcatcaggagactcatcgggtctggtatcgatataatatacacatagtcgtgcggctgtcatgttgcgacaaagtcggggcgcgctgtgccgaggagcgaggcacatgcaggcctttgccacggtatgtctgattggtgctggggcacccaaagtgcatccttgcctttggagattgtcgcgattgatttcaaccattgaacacaggatgctgccgaccccatcgcctcgacctccggtgcgggtccctccgccgaggcgacgcccccacctcaaggctaccgcaccctggatggtctacccttccccacgacgatccagtccaagaagaaggatcgaatggctcctattcccctcgcaacagccctcgcccgtgtcaaggtgggtgcctgcccagccagacccacaggcgcctgtgcgataattttggaggacctccccttgccagcctaccctcgcacctcctcctgcatcctctcgcagtccactgtcacacacccgaataattgcaggcctccaagcgtgccaagttcgacgagacggtagagctggccctgactctgggtatcgacccccggcggggcgaccaaatggtcaggggcgtcacccagctcccgcacgggacggggcgcagcgtccgcgtggccgtgtttgccagtggcgaggacgccatcgccgcccgcgaagcaggtgctgcaggggaaagtggccctgcgttggaaatcgtggccttcgtggggggattggtggtgcagggagccggtgaggcggtctcaacatctggcgtggaggggagacatgggtccgggtgcgacgctgacgtcgtgcgtcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcagtccgcaacgccgcgacacgcagacatggcgctcaagagcccccccctacacacctgtgcaggagcggaggtggtggnnnnnnnnnngcagtccgcaactccgcgacatgcagacatggcgctcaagaacccccccgtacacacctgtgcaggagcggaggtggtggnnnnnnnnnnagtgaggcggtctcggcatctggcggggaggggagacattggtccgggtgcgacgctgacgtcgtgcgtcgcccggccccctcggcgcaagcttgcccagaagatacgccaggcgtgactgactgccactggcaccttgnnnnnnnnnnnnnnnnnnnnnnnnnnnnnnnnnnnnnnnnnnnnnnnnnnnnnnnnnnnnnnnnnnnnnnnnnnnngagccgaggacttgatcgcctccatcgccggcgggggcgggctggactttgacaaggcggtggccacgccctccatgatgcccaaggtgggccgcgtggctcggatcctggggccccgcggcctcatgcccaaccccaagctgggtaccgtgactgccaatgtgggcgaggcggtggcggcgctgaagcgggggaaggtggagttcaggtgagggcagggcaggcggctcggggttggggttggggagtatgggtgagggtgggccgaggtcgtgtgggaggaaggggttcaacaggagggtgatgtgggcagatcaaccttnnnnnnnnnnggttggggagtgtgggtgagggtgggccatggtcgtgtgggaggaaggggttcgacaggagggtgatgtgggcagatcaaccttgcccaggacccgcgacagggcttccatacctgcccacccactcgctcctccttccttgcacccgcggacccagggcggacaagggcggcgtggtgcatgcagggctgggcaaggtgtccttcaccgacgccgcgctggccgggaacgtggcaagcttcatggccgccatcctggcggccaggccgcgcggcctcaagggcggggcgggggcctacgtgcgcgccgccacgctttcctccacaatgggcccgggcatccccgtcagcctggcctccctcacccaggcggccgctgcggcccaggtcaacgcctgatgggtcccagtctgagctgctctgtgagtcgacgcctgagactgcatgtcacgctgcatcgccaggttacagagagaagagaggccaggggcagtgcaatgcagaaccattccaattgcagagcggaggggcaaggccatttggccgggttcaggggtgtcaagggaattggtgaagaacagagtgctctcagggccccgcgccgccccgtcccagttcggcgcatgcaccgaatgcccgctcgcgaggggagcaaataagctgcacccgcgccggggtggcatccaatcaggcatgcgtggcgacgttgcgcaggatctgggaaggaaagagtgatacctgagattgcagggagtgccatggccatcggcactatggaccgccaccaggtacgcttccccttccttcttcccccacatgctcttctttcccaccgtataactggcctcgtcaccaaagtccagcttggcgccaggcttgaccttggtgcgcttccccttcttcagctccgcgccgtccaggtaaatctccaggtcggagtcgacatcggtgacgtacaggacggagggggagtcgtcagggtgggaggcgccctccgcctcaaagaggatgttgatgccgccagcctccagcactgtctcgtccccatcctggaaagggaggggtgacgtgttggaagagcggatggagggggctgattggacagataagggagggctgacatcatctgccattgcctcaccgatccaccctgcgggcgcatgcggatcctcaccaacccaccttctgaccactgttcccagggtccgagcgcaggcgatgcgcacccgactccccaataagctgtacctcctcggaggcgccctcgaagaacttgctcttctgcttgcgaggagccaggctccatcgggtgttggcatgcaccgcgaaacgcatagtctggcgtggacggcagcgttgcacaccgagcccgtgactcggtgcgcgcaggcccgacagtgtagtctgcatggcgatggcaatggatgaggtatccgaaaagttccgagtgcagtctaggcactcacaatgcacagtcgagagttcatgcaactccaccctgcagagattagatttgcgatttcccgggacggtgtactcctgccatcccgggacaatgctccaagacccagtccaccaccttaccggggcacacccatgtttaaagtatacatgcaagcatcattcatcgcattatatggctgcggggggccttctagactgaattagtatttacccctcgccgacgcctcccnnnnnnnnnncaaagtatacatgcaagcatcatttatcgctttatatggctgcggggggccttctaggctggattagtatttacccctcgccgacgcctccctgtggccagtcgaggatggaatcgcaccaataaaggcagattcttatggttaaatgtctaagaattattagattgtcggctgcaatggccattggaggcagtccgctcacattgatcgtgctcggtgtcctgcttttcagcttggtgaccattgcgggaaccctctcatccgtcgccctcactaggcccgatatggctcccaacaacacatttcctgcctggatgctggtcttcctgataacaagggttgggtttcatagcagatacaagctcaccttggccttcacttgcccattgaagcagtccacagcctcttgccactcccccaatcgggatgggagcggatgcaagatgctctgccattggcgagctgctcacagtgcatggtctcagctgatcaagtgggggatgacatgcggcacagtttttaccagggccatgttgggtgtaccgtgctctctgtggacgcactgctttgcgaccagggaggtccaggactgttgcctctggagtacctcaatattaaggctggccctccagtggcagggccgggtnnnnnnnnnncctctgtggacacactgctttgcgaccagggaggtccgagattgttgcctctggagtacctcaatatcaaggctggccctccagtggcagggccgggttgcctggagataaccggtggacatggtggtgtgccctccctccccccactgcatgcttgagcccttttctgatgcagtcgacatccacatggtttacggcgtgggccctgggcaggcggccatgttcaccgcggtcggctggcatgggaacacaactgcttgcccttccaaggtggcccatacctgggcaaagcaatgccagcacgaggacaccgttgcgaggtggcatgccaatgccctgcattctgtgcagtgcactcacattcgagtggtgccagtgtgcttggaagggagtannnnnnnnnnnnnnnnnnnnnnnnnnnnnnnnnnnnnnnnnnnnnnnnnnnnnnnnnnnnnnnnnnnnnnnnnnnnnncactcttcccatttaccatttcccctaggtgccaaacgcgtaagacggcgagcacggacgcgaagcttcannnnnnnnnngactcttcccatatacccttttccctaggtgccaaacgcataagacggcgagcacggacgcgaagcttcannnnnnnnnngcacaactgcttgcccttccaaggtggcccacacctgggcaaagcattgccagcatgaggaaaccgtcgcaaggtggcatgccaatgtcctgcattctgtgcagtgcactcacatttgagtggtgccagtgtgcttggaagggagtatcatcggtgaacttcctggcctgtcgtgattgcaatgccccggctctgcagtcgtcgaggtgatgccnnnnnnnnnnnnnnnnnnnnnnnnnnnnnnnnnnnnnnnnnnnnnnnnnnnnnnnnnnnnnnnnnnngcgggtgacggcgtttgtctaagacctgcgggggggctggctgaaacgatggcgaagcctgtccaagtactggcctccaagcctacctgcggcgccaccaggcgatcaacaagctggccgagcgtttatacgcagccccccccggtcaggcaactgttgttggcgttggccattgtcgtgcccaagcccgcgtgtgtgtgtgtgtttatgcgggggcatccgctagggccctggatacggtttattcggcgcctgcggagggnnnnnnnnnntgctgagcatttatacgcagcccaccccggtgaggcaactgttgtcggcgttggccactggcatgcccaagcccgcgtgtgtgtgagtgttcatgcggggcatccgctagggtctgggatacggtttattcggcgtctgcggagggtgtgcaaggtggtatcggtagatgagtacaggacatcgaagctatgctgcgcctgctacatctccttgcacacccaccagtataagtgggtgcggcgagaggtgtagcaggcgcagcatagcttcggtgtcctatgttcctataactgccaccttgcacaccctccgcaggcgccgaattaaccatatccagggccctgccaaatgccctcgcatgaaacacccccccccttcctgggcagaccggtcgccaacgccaacaacggttgcctcacaggggggggggnnnnnnnnnnccggtcgccaacgccaacaacggttgccgcacgagggaggggcctgcgtataaacgctcggccagcttgtttatagcccgctcgcaccgcaggtaggctcgcttgcgcagctttcggaagggcttcagcattnnnnnnnnnngatgacttgacggggccagcagttgtattaccgtgttcatcgaccgcggtgaatnnnnnnnnnncagcttgttcatagcctgctcgcaccgcaggtaggctcggttgcgcagctttcggaagggcttcagcattatccaagcagccctccaacaggtccggatcaccattctcacccaccatagcaagacttcagtgctcgccataccacgtgtcgggcacctgctaagagatggtggatgggaaggattggcaccattgcaaggcagcagggtcggggttattgaagtcgtgacaggacaattggtgacatgacgtttactctcgttccactgtacaccggtaacactcgttcgtagaggcgttgctcagactcagggggcattgcatgtcactgggcaactgtctgctcatgctggccatgcttcgccatggcgtagcatgacttgacagggcgagaagtattaccgtgttcatcgaccgcggtgaatatggacgtgcccccccagggtccatgccggagatcatgtggatctcggcattctcgttggannnnnnnnnngcgtgcccccccccagggtccatgccggtgatcatgtggatctcggcattctcgttggagggtcatacgactgcagcgggtggagaaggagtacagtacgactcgtgcaacagtggcgagagggggatgcttgtcgggccactcccatgtcaacattcgcatgcctgaccagtctcatgnnnnnnnnnntggtggcgaaggggggatgcttgtcgggccactcccatatcaacattcgcatgcctgaccagtctcatgagacccatcaacaaatattgatgaagcctgtacatgtcctggcacgcgatgttctttaggcgcttcgttttgtacccgtcgtcccatttggcgtgcagttacggaccttcatgcggtggcagaggggaatcgacgagtgtgtagccctactagcatggatccatccgttgagcttttgtttcggcttgcaaatgtaaccaaatccacatcgcagtggtaatcagactgcaatgcctgccannnnnnnnnnagggagtcgacgagtgtgtagccctcctagcatggatccatccgttgagcatttgtttcagctttcaaatgtaaccaaatccacattgcagtggtaatcagactgcaatgcctgccatcctttgctcgacttgtcgatgtatgacctggattgagtaagggatcagtagggtggcacatataaatgcacagctgaacaaacacggctgccccagaggcttcttgacttggcacgaggtgaacttaagacgctgattcagtgaaagattggctgcactctctgtttgccctcgtggactcaggctcagcagctggacgcatgtagtgctgcgttagctactcagcgtatcacgcaccctcgctagagattgcagaggagcagcgcatcggtatcatccattcctatgcatgccaatccctgttcatcgagcaagccctttcccgcttttgtagtccacctcgacataggctgtctcaaacattcacttcacatcccggagacgctcgctgggcagcctcacccatgtctaggggggatgtaccnnnnnnnnnnccagctactcagcgtatcacgcaccctcgcaagagattgcagaggagcagcgcatcggcatcatccattcctatgcatggcaatccctgttcatcgagcaagccctttcccgcatttgtagtccacctcgacacaggctgtctcaaacattcacatcacatcccggagacgttcgctgggaagcctcacccatgtctaggggggatgtaccttgccgctctaggcttggactcaaaaggacactcatgggccatcagggcatggtgatggtggggcacgagatgaggagcacggcatgcaggtgcgaggagcaggaatgctgcggcagagtatggcggcggcaccggcgcgaggcgctcagggatcgggccgggctcgcacctgtccccctccctcgacgccggcagcgtctgagtcatgcacggcgtggggaccgggaggtacgactttcatgtatcccgggccattccaagtcacctcggatcagggggagggtgctggggcgctcgcctccgactccagggacgacacgcaggccgccaggttcccgatgggggcctgcacgttgcgcagtgccagcgacaggatgatgctcgcgttctgggccgctgcctggttgatggcgcctgcggcgggggtggtgtgcagggcagggtgtctggggggtgacgatggcagtggagtgtggggctgcatgccaccccctgcccggatcgctgactgggtgagggggcgccggggcatgcctcggacgaagtctgcgcccggctgcctcatcgcatgcaccaccccccttggtcccaaacgcacccttgagggcgtcggtgaggggcgggtagcacccgacgctcgtgaccatggagttcagcgtgatggccgaggtggagacggtgtcggtgcgcaggagggactggtagatgaggtcggaggcggtggccagggaattgcgcgccacggcgtccgccagggtcaggctgtaggcctggcccacctcgctgatggtggaggcggccagggggaggacgctgcctgcggggagggttggggttgagggagggtcggcatggacatggttcaagagatatggaagcactgcggcaggcagcactcccctgtgtataccagcgagagctgggagttgaaaggtgactggaattccacacccaagacccagcccgggcacctaccggtggcggtcacggtgaccacgggggcatcggagaagttggcaggcagcnnnnnnnnnncgaaaggtgactggcattccacacccaagacccagcccgggcgcctaccggtggcagtcacggtgacgacgggggcatcggagaagttggcaggcagcaggaaggcgctgaagtcgcgggcatcggagccaccgggagggggaggggggcttacggtgttgatcaccaccttgctaccggtgacgtagtcgttcagggtgcccgtccatgccagcgtaccaggcttgtcggactctgaggcttgtgcagttacgatctcgggggaagcctcccccgccaggagcactcgggctgcaagggcggggaatagaggatctggaagctagtgttcactatagcacaccacaaagacgtaccagtgtctggggaacctgggtacctggtcctgcgttgacgagcccagttgcgctcaaaaggacgaccacgagagccaggccgcatgtggcgctgcgagacatccttgaagaggatgtgtgtatcggccttggtacaattactgggaatgtggatgtgttggacgtccgactgcactcgaattggaaggggctcgccgattttcagccgttacggtgccccggaacagctgtccctgtacgcggcaccgggtgccggcgcattcaacttctcgacgagggtagattccccaagcttcggcaagatgatgtgcaaaccgtctccagaaaattatgctggttgactctagacattcttaggctactttgcgtccggaaacagtcgatgccagacttctactgcgaggtcggtgcgcctgtttcctgattgagccatgcgaatgacgccaaggtctgaacagtaagctgtcgcgcaaactcatcctctccacatttcatgactatccatgcataaatgacgatggttggaaggtagcccgtctagcacctgcgcatttcaacccgttcttgttggcgatgtactcgaacgccatggcggagatttcggacagctgagaggcttgttcatacgtccacaagcctggatggctgggctctacacccacaaaacacctggaggtcgtttcagggtccatcatcaggcccaatgttccactcactaccatgcgccgtccaggctgccatcatcgtcgtcatcatcatcccctccgccgaggtcgttcacgtgcacaaccccttccaggtgatggatcaaggcttgcaggccgtccctcccggcagcatccgaaagcctggcggcctctcgtgcatcaaagagggcatggtgcagacgcccagcggcctcggcatgtgcagcgcgcgctgcatgcgctcggcagagtctctgtcccgccgccgcacgctcggggggggagtcatggcaagcctcaaatgcctcgcacgcctcccggacggctgcatccagggcagcctccgcctcactcgtgctgtgtgctgaggcacgtggaggtggccggtacacccgctgcggctgcggaggggcggtctgaccatggtgcaccacccggggtccataaccagcccccggcgggccctcctcccgcgccgccagcctgtcgttgtaggcggcccgctccacagcgtcgctgagnnnnnnnnnngaccagcccccggcgggccctcctcccacgttgccagcctgtcgtcgtaggcggcccgctccacagcgtcgctgaggacggcccatgcacgctgcacggcgctgaaggcttcggcggatcccccgcggtctgggtgtgccgtcggcagggcggccaggtacgccctgcgcagctcccccgagctggcgccggggacgcagcccaggacgtcgtacagagtgcctggagcagccatgaggtcctggggtaggggctgcgaggatgaaaggagtcaggcgtggggtgccagtgtggtggccagagcaatgctgtaagtccttgctctgtctcttcatgcagcccgcatggccgatagaatgccatcgtacctgattagtcaggagcgactgccttccgtagcaacatcagagccaaggcatccagtttggaggaaaagcgagcccgtcacaggacctgcacgatttgcaagaccaagagcagtaacgaggcgcctgcgaggctgatgccgagccttattccgctgagagaatattgctagggttggaatgcttccagcgtgatagattgattacttgtacatttataaaacttgctacatcaggatgcgggacccacggaaagtcaaaccagggttgcatgcgcagcacatcacagcaagcacgcgcaatggcagctcctcatgaggggcagacaacctagtcagggatgctgatcagggcttcaacactggttcagaaagacaacaatacatacgagaaagtatacagggctgcacatcccgatcatgggtaaaacagcagccatggcaagatcgcctttggcgcatgaggagccgatccaggtacgctgggacacgcgagatatattcgcaggattcctaccataaacaaatattcaatgctgcagccctcgacaccccctctcccgcgatgcaggtgcggctggacaccnnnnnnnnnntgcgagatatgtacgcaggattcccaacataaacaagtattcaatgctgcagccctcgataccccatctcccgcgatgcaggtgcggctggacaccaggaaggattgctggctggctgtctcctacatgccctggttccagtacgacgcctcggcagggcagggcagaggcatcgccactcccagcaagactcccggaaggctccggctgaagttcagcccttcagatctccacataccatccctgagctggcggaccaccagtgtcggaatcgtccccctcccgccaggcatcgccatccacatccatccccaggtcagggaggagggctaggagtgcattgcgacactcgtggggtactgccgggccctctgtttcccagaatattattgggacgagggacagaaggccacaaacgcttgcgcaacccgcatcccaaataggtactggagggatggatggacgagaagacgggcgaggtgcagnnnnnnnnnnctttcccagaatgtaattgggacgagggacagaaggccacaaacggtcgcgcaccctgcatcccaaataggtactggagggctggatggacgagaagacgggcgaggtgcagctgcagtatgactcccgcttttcggcagccatcccatgctactccccgcccagcatccacgtggcctgcacgctgagcacggaaggccgcatagaaaggggaaacagggaattcaaaggcctgcgcctgcagcatgggcatgtggtcctggtgggcaaggccaccatcccggcgaccaggcactggttgacggacaccctgctgcagctcccagctcagtgctgttgcgtcctctctgcgaccctgaggtttgaggaggcaggacagcatggccagctgcaggagctcctggtgcctgaagggcctgagtagctggtgacatgttccacggttgctgatgcctttgtgcatttgagcatgcctggagtgcattccccaggtctgccacagttctcatgcgtaccttcctcgggtagggttttgcaccctcgtgtgnnnnnnnnnntacggttgctgatgcctttgtacatttgagcatgcctggagtgtattccccaggtctgccacatttcccatgcgtaccgtcctcgggtagggttttgcaccctcgtgtgctgttactcgcgatccaggcgtacccttcaagcacggtccacactctgcccatgcccaaacggcgatcgctgtatttacagttcgtaatggcctcatcgccccgtgttgagatcaggtcgtaagccagcaactcgccagctgtcccggttccgacaggggtaagggagggccggacctcctctttagcatgagcgcccctgttccgaccagcaacggcgcctcccatcccgtagagcatgctccagaggccctggacgagggcatcgcggggtacaccagcgtggaggccctgctggaggtcagcggtccctcagcgtaccgggggaaggaacctaggccagcannnnnnnnnncagcatgagcgaccctgctccgaccagcaatggcgccttccatcccgtagagcatgctccagaggccctggacgacggcatcgcggattacaccagcgtggaggccctgttggaggtcagcggtctttcggcgtaccgggggaaggaacctaggccagcaaacatgcgacagcattcagccccacctcccccatcccactaaatcacaggataacctgcctcaggacaagctcgaggctgtgaggcggctcnnnnnnnnnnccccaactcaatcacaggataacctgccccaggacaagctcgaggctgtgaggcggctcctgtacggggtgaaccagggccagctggtctccgcccttgccctgcccccccacctccaggaggcagtggagtatgggggctttgacgtgcaggcctacgccttcaccgcgcggcgggagcagctgcgcgagccacgggtcgtgcgcctgggcctcattcagcacgggatccaggtctccacttccaagccctacgctgtccagcgcgaggtcaggctctgcacaggggactgtcctcgtgcacggggccggcacggcgcggccctgcgccctgcagcccgcgcatggccagagagcatgatcgtttcctgcggagtgtgttgaacgaatgggcnnnnnnnnnnactcgtgcacggggtcggcacggcgcggccctgcgccctgcggcccgcgcgtggccagagagcatgatcatttcctgcggagtgtgttgaacgaatgggcgtaggccaccgtgcgtgtgggcctccctgcgccctcctgcaccgatggccctgactgcatgccagacctgtttctctccccctcaacaccccctcgaccacggccttccccaccaggccatattcacgcgcgtggaggagttggtgaggatggcgggccaggccggggtcaatgtgctgtgcctgcaggaggcctggcccatgccctttgcattttgcacccgcgagcgggagtggtgcgagttcgccgaggacgcagtcacggggccgtccacggcgctgctctcctcgctggcggtgcagtaccgcatggtgatcatttctcctatcctggagcgagactcagcgcacgccgacgtcatctggaacactgctgtggtcatagggcacaacggcaacgtcatcggcaagcaccgaaaggtgggggctcttgatctcagtattcctgggggtttcagaggaggggagccaacccaaaggccagcctgtgggccgtgggatgcttgggatagccgggcgccaggactgccgggcagcctggcccacctcttctgcactctcaccaatcctacttctgccctgctcggaggtgacgagcatttctttcaagattaccccccccccccccccccccccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgacactgggcaccccgtgttccagaccgcctacggccgcgtcgcggtcaacatctgctacggccggcatcaccccctgaactggctggcgttcgggctgaacggtgcggaggtggtgttcaacccctccgccaccatcggcgcgctcagcgaaccgatgtggggcgtggaggcgcgcaacgccgccatcgccaactcctactttgtcgccgccatcaaccgcgtgggcaccgagctctacccccacgccttcaccaccggggtccaaggccagggcccccgccaggacatggggcccttctacggcagcagctatgtggcggcgcccgacgcatcccgcaccccgggtctctcccgcgatcgggagggcctgctggtcgtggatgccgaccttaacctctgccagcaggcacgcggaggtcttggcgtggattatgccgtgaatgggggccagatgttttgcaaaggtaccatcaagcatcaagtggaacatggnnnnnnnnnnggtagattatgccgtgaaggggggccagatgttttgcagaggtaccatcaagcatcaagtggaacatggggcgtggcgcgacaggccaccatgcccatcctccaccctctcccccatccaaccccacacaggtccgcgatcgctggggcttccagatgacggcgcggtacccgctgtacgcccagctgctcagcgacttcatcaagccggggtacaagccgcaagtggtcgtggatcccaccctggactcctctgcctcgcgcaaggccgcagactgcgagaagggacggtgagtgggttctgcttgagatgccaatgaggcagcatggcatgttttcagctgcaacatgccgactggcctgactgcaccctattctgtggactcctgatcgggtcttacacaacttgtaacatgtctgcgaccatgcacgtgcaatggagcactgtcacgcccgagagcggaaggtcagggagcggaccagagccccaaaccaagtgccatggagcgtcacgcggccagtcagtcgcgagggacccatgtgaagcgggccgccatcctgcacagcaggcccttgaagccccgcttggcctcctcgccggcgcctgtgttggatgtcttttccctcttcgaacgcttggcttgaggtggagcggcgtcctgacatgtgcaagtggggaggggnnnnnnnnnnggccccaaactaagtgccatccagcgtcacgcggccagtcagtcgcgagggannnnnnnnnncggccccggccccggccgaatcatggtggcgtgctcgcccccgcgctccagggtcaccacgtccggcgcannnnnnnnnngtgcacttccgtcgggtggccatctcacggcaggaggctgcacagaaaaggacctggcgcgggtgctgctggcctgcgcatggctctctacacacaaacacgccctcccccaccgccaggaatgcactgccccaccccctcgaaagcccttcacctctggatccaggtctccggccacctccgcgatcttgcggcgcgccgccaggatggagggcggcagcgccggccttggccccggccccggccggatcctggtggcgtgctcgccgccgcgctccagggtcaccacgtccggcgcacccggcgcgacgggggcatggaagcgctgcgcggcggccaggccgcgggccctgcgccccggcccggacaggtaggcctggagctctgccgggtccacctggaccccggcctccgcctgcacggggctgggccccggcgggacctccgccgccgcctggctgggtccggccgccgcctgggtctccaggcccaggccccagggttggctggcccccgcctcctgcgtgaagaggggcgggcgcagcgaggagtcccacacggcgcggggcaagggctcgctgggcggccgcgggacagccgcccgcggactggagggcccggcctctggcgccgcgccgccaggcgcggcccggtgggagggccctggcgggtctgctgtctcgctgcacggggcagcgtgagatggaggggcgcggggcggcgaccctccttgggccctgaccagctgggtgggctccagcgtgatgtgatctgtgcatcggatgcagagggagggccaggaaggtgaggcatggggtcaggagagcagcgtcgacagcagggacgggcatgctgcatgaggagatgagaaagtgacctcttgacaggcggcgggaggaggtgagctgagcggaagcagtgaaagccatgtcggacccgcctagcgccctgccgttccaccctgctcccaccataccctggctatcctcgtcggtgtcgtcgtcagaggtgtctgagctgaactcctgctcgcgtgaggtacagagataatctgttgtgagtgagtccacaccccctcagcacaatcttaagaccattaacagtccccccaccagtcagcatgtacgcgggaaattacacccccccgcacacacctcatcgttcccatccccacagactcgctcacctcctcctcaccgccctgtacgaccccagcggctgcagccatgttggacnnnnnnnnnnctcagaccattgacagtccccctaccagtcagcatgtacgcagaaaaatacacccccctgcacacacatcatctttctcatccacacagactcgctcacctcttcctcaccgccctgcacgaccccagcggctgcagccatgttggactgcgcagcgggtgcctgggttgcgtgagtctccatcctgacctcctccccggcagagtcctcccggtcctccacctgctgcacaggctgagtcgccgggactggcgcagtggctgcggcgtgagcccgattcctggtcagggccccgggcacggtctgggcacgtgcctctggcagagactgggcctctgcctgaggttccggctcgtcctcgaccccagcctcagcctgaggttgggcctcggccacggcaccagcattagcctgagattgaggctcgtcctgggagcggggctccgccagagcttgggttgggggcagggtctgggtctcgacctggttttgatgctcggcctgggggtgggtctgtggggtctgtgaggggtgtggacccccccccgccagtctctggctggggctggtcttacaagcggggcttgctgccgatggtcctgcagcatcgctcccaggcgcagccctcagctccatttgttgcgacgacggcgacagtactggtggcgggttggttgggctcgatgtcgatgcaggcgcggtatctgcatggaggggagctggctcgcttgatggatggagaacctgtgccggacggttggcttccactgtacaaggccaagcacgttttcgagcggggaacattgtgggaatatggatgaaacatctgctctgcacacccagagggtgacatacctctgttgattccctctggtgatggaggggatgcgagctgggtaggggggaggaactccatcctcctgggtgacaagttttgcctgccataatgtgccacagaacgcagtcggccaacaagttcatcgccagtcacgttcatgtcgcgtgatcgaaggtgcgctgagagctcccaggctgaaggtggaggagagggttgaggagtggattgagctttaaacagccagccagccagctctcgaatagtatgactcgattccaagtttcagaacgtagctcaccttcagcgctgttcagtatgacctgttgcgcctgaggaatgttcatatcggcggcaatatctgccggatcagcgtcgagaaggtattgtgtggccattgcaggaggtgcaggggctggctaggcgtgccccggcgcgatcagcactcgatagattcacttttggcgaagcacttctctgatcatgcccctggcatgcagcgtcacggtggtagctgccgcgatcgtgcttcgcgtagcacgggttggcttgtactcgggtgttcacccctgaaacgcatgcgccgcgtatcttttcaactcgaatcgggagatcgccaccaaggggaagatggccagggaccactttcccagcagtatcatggttgctctttcgtgtaaatgtacagtgtatctgcgcaataaggcgacttgnnnnnnnnnngtgaaacgcatgcgctgcgtatcttttcaagtcgaatcgggagatcgccaccaagaggaagaacgccagggaccactttcccagcagcatcatggttgctatttcgtgtaaatatacagtgtatctgcgcaataaggcgacttggacctggatggtcgtcaaaggagggtcttgatatttccccgggtacaagagccgggagcatggttgggatgggcaagccggcggcggggagctcaatcataaaaagccgtcagggtgctcaggtctctgccggtcgcgaatcttgggtccgcattgctcggcgtgcgcgtgtgtgtcggtcagcgtgtcagtcgnnnnnnnnnnagtataagagccgggagcatggttgggatgggcgaggcggcggcggggagctcaatcacaataagccgtcagggtgctcaggtctctgccggtcgcggctctttggtccgcagtgctcggcgcgcgcgtgtgtgtcggtcagcgtgtcagtcggtgcgtagaatgggaaccagccacggcctcagtcgaagcaggggtccaggtcggtggcgtccccgtcctccccgctctccagacccgaatcgaggccgggttcctcgggcttcctggcgcgctgcgcctccagggcggcccccagcgcgcccagcgcgccggcgtcgtggcacaggatggcctccaccggcagctgggccaaggcgtcggcagggtcggcggccgcgcaggccgcgcgcgcggccgccaccgcgcgcgcgacgcaggcggcc

SEQ ID NO: 43437 - DNA, 74 bp, Chlorella protothecoides
gaccacaccatgttggccacgcctggggggttgggaggtggggcgggggattaggtgagaggatgacatcattt

SEQ ID NO: 43438 - DNA, 61 bp, Chlorella protothecoides
aagcatgtgccgctggtccatgcaggagagtggcattcctgtgccgcggcacatcatcgtg

SEQ ID NO: 43439 - DNA, 62 bp, Chlorella protothecoides
tccagaactgtcgccggccgggcacaaaaacaactccatcacagcccgtccagggccgccca

SEQ ID NO: 43440 - DNA, 61 bp, Chlorella protothecoides
gcttgagggaggtcgacgatgcgggggaggggctgcgctacgtgggttcctacgacgcgga

SEQ ID NO: 43441 - DNA, 106 bp, Chlorella protothecoides
cgccgcggcgcgctccgcggcgctaggcgcgccgtcgccaaacagtccgccggccagctgcgcggcggccgccgcatcctgccccgtgtacagcatggcggccgcg

SEQ ID NO: 43442 - DNA, 61 bp, Chlorella protothecoides
gcgatgcttgcgctggcgttgaagcgggggtggttgggggcgtcgacgccgccgtcgaagt

SEQ ID NO: 43443 - DNA, 61 bp, Chlorella protothecoides
ggcaggtccgtcgggaccagcttcccgaggggggaagccctcgcgatcacggcgcccgcaa

SEQ ID NO: 43444 - DNA, 172 bp, Chlorella protothecoides
gggggggggagctttctgcatggacaaccatcgcgtgatctgcagaatggcacctgaaacacggccggcgggctgctcttctgtgcacagcgcccacgaacaagccccttccccccctcaagtcagccccaccttgagcctcctttccacgaggcgcatggggaagccgggg

SEQ ID NO: 43445 - DNA, 61 bp, Chlorella protothecoides
gaagggggaggtgacgagggcggaggagaaaggggcggcagagagggcggaggagaagggg

SEQ ID NO: 43446 - DNA, 61 bp, Chlorella protothecoides
gggggccggaggagtgttgaggctggccgggctgactgaccgccgcctgagctgactcttg

SEQ ID NO: 43447 - DNA, 552 bp, Chlorella protothecoides
  modified_base (173)..(182): a, c, t, g, unknown or other
gcgcgcagccagcgcctcgccctcggcgcgcaaccgctccgccagcgcctcggccgcgtcggcgcgcgcctgcgcctcggccagctgccgcgccgaggccgcgtggcttgcgtcatcctttccacccgcgtcaccaccgcctccagccccgcgccgctccagctccgcctccnnnnnnnnnntgaggccgcatggcttacgtcatcctttccacccacgtcaccaccgccaccagccccgcgccgctccagctccgcctccaggtcggcgacgtgggcgtgcaggccctccacggtggcctccagctccgccaggcgcgcctgctgcggggcgatccccgcctcgccgcgcgcaccccccaggtactcctcgtcgtaggaggacagcacggcctgcaggcccgagcgctcgcgcaggaggagcgcgacgcggcgctcggcgcgcgcagcgtctcgccgccgctcctccagtgcggctgtgaggcgcgccacctcggcctcagagagcgcagcgcggtcctcggcgcgccccgccgcggcgcgcgcggcctcg

SEQ ID NO: 43448 - DNA, 61 bp, Chlorella protothecoides
ggagcagcgatcagaggggttcggcagggggcctcatcagcatggtggcctactggggcgc

SEQ ID NO: 43449 - DNA, 36615 bp, Chlorella protothecoides
  modified_base (619)..(628): a, c, t, g, unknown or other
  modified_base (797)..(806): a, c, t, g, unknown or other
  modified_base (1465)..(1493): a, c, t, g, unknown or other
  modified_base (2424)..(2461): a, c, t, g, unknown or other
  modified_base (2841)..(2850): a, c, t, g, unknown or other
  modified_base (3419)..(3428): a, c, t, g, unknown or other
  modified_base (3781)..(3790): a, c, t, g, unknown or other
  modified_base (3895)..(3904): a, c, t, g, unknown or other
  modified_base (4102)..(4111): a, c, t, g, unknown or other
  modified_base (5146)..(5155): a, c, t, g, unknown or other
  modified_base (5830)..(5839): a, c, t, g, unknown or other
  modified_base (7664)..(7673): a, c, t, g, unknown or other
  modified_base (8421)..(8430): a, c, t, g, unknown or other
  modified_base (10407)..(10416): a, c, t, g, unknown or other
  modified_base (10519)..(10528): a, c, t, g, unknown or other
  modified_base (11212)..(11221): a, c, t, g, unknown or other
  modified_base (11293)..(11419): a, c, t, g, unknown or other
  modified_base (12015)..(12024): a, c, t, g, unknown or other
  modified_base (12106)..(12115): a, c, t, g, unknown or other
  modified_base (12557)..(12566): a, c, t, g, unknown or other
  modified_base (12834)..(12892): a, c, t, g, unknown or other
  modified_base (13293)..(13302): a, c, t, g, unknown or other
  modified_base (13516)..(13525): a, c, t, g, unknown or other
  modified_base (13943)..(13952): a, c, t, g, unknown or other
  modified_base (14173)..(14400): a, c, t, g, unknown or other
  modified_base (14813)..(14822): a, c, t, g, unknown or other
  modified_base (16480)..(16489): a, c, t, g, unknown or other
  modified_base (17002)..(17011): a, c, t, g, unknown or other
  modified_base (19051)..(19060): a, c, t, g, unknown or other
  modified_base (19124)..(19133): a, c, t, g, unknown or other
  modified_base (19532)..(19541): a, c, t, g, unknown or other
  modified_base (21000)..(21009): a, c, t, g, unknown or other
  modified_base (21774)..(21783): a, c, t, g, unknown or other
  modified_base (22411)..(22420): a, c, t, g, unknown or other
  modified_base (22513)..(22522): a, c, t, g, unknown or other
  modified_base (22759)..(22768): a, c, t, g, unknown or other
  modified_base (24519)..(24528): a, c, t, g, unknown or other
  modified_base (25125)..(25204): a, c, t, g, unknown or other
  modified_base (25325)..(25334): a, c, t, g, unknown or other
  modified_base (25786)..(25795): a, c, t, g, unknown or other
  modified_base (26337)..(26346): a, c, t, g, unknown or other
  modified_base (27363)..(27372): a, c, t, g, unknown or other
  modified_base (31191)..(31200): a, c, t, g, unknown or other
  modified_base (32029)..(32038): a, c, t, g, unknown or other
  modified_base (32222)..(32231): a, c, t, g, unknown or other
  modified_base (32580)..(32589): a, c, t, g, unknown or other
  modified_base (34334)..(34343): a, c, t, g, unknown or other
  modified_base (34569)..(34578): a, c, t, g, unknown or other
  modified_base (35443)..(35452): a, c, t, g, unknown or other
  modified_base (35740)..(35749): a, c, t, g, unknown or other
cacgaagaacgccgggctgcgcagcggcagccagcgccgcggggcggggcgcttcatcgcatggcacaagcctcgcaccgctacggaggatgccgcggatggggccagtcccccgtctggcagcgcatcctcgtccatggccccacggcctgccgggcctgcgatgggtcggtgtgtgggagtgtgtgtgtgtgggaggaggggggtgaggggaagggggggtggggcgacacctcgacgtgtcctgggactccctttgcccagattgcagggcgcccgcggtccgcaggggcgatcacacccactcccagcacacagcgcccagcagacagcacaccgcccgacgcgtcatgcacacccaccccggaggcgcagggtgcccaggacgtccgagtcggagaggtacaacaggctggctgcgacgtcctccatcgcatccgcagctgcaaactccagcaggttctcgtgcaggaacaggctcacgcggcctgaaggtgtgagaggaggggatgcattgtttggtggtggtgggaggtaagcgatcgtctgggagcaccctggtctttgacgccgccaggcttggcaggagggctcgctgaccgaggtacgcgggcagctnnnnnnnnnncgtgattgtctgggagcaccctggtcttggaagccgccaggcttggcaggggggctcgctgaccgaggtacgcgggcagctgccctctgtgccgcggcaagagctgtacgaccgccagcaacatccagagctcaagaaagacctcgacagcccctcgtcctggaatgcnnnnnnnnnncacgaccgccagcaacgtccagagctcaagggagacctcgacagcccctcgtcctggaatgcatcccaaccagcagctcggctcgcctgcgtcgaggtcgcaggtcgccaggatgccctccgggtcgaatgccaggggcccccgctccccctcctcccctgcagcgtcccgccggttgtacaggaccttgcccagcgcgtgaaaggtgcccagcgaggcgtcgcgcgccgcgcccagcgcactcggctgcggaccgggtggcggggccgccaccgccgcggcgcggatggcggcgcccctcgacccccgcttcctcttgagctgggcgggggccggcgccgtggcgggggggcagcacgacgcgcccagcatgcagaagcgcagcgtggccagcgcgttgctgagatcgccgccgcacgactccgcgacgctgcgcagctgcgagtcggtggggacaatgttgaggggccttgggtgagagtgaaggaaggagccaaacaggagccggggtcatgccggagtgcaacaatccagatccagcccttgagtggcctgggtgagaaagttcgccagcggcatggaatagcgagcatccagccctgatcactccaacacatgtgcctggccgccatccccccccccccccccccccccccccnnnnnnnnnnnnnnnnnnnnnnnnnnnnnacctgctcctcggcgagacttgacccctgccgctgcaacacctggcgcaggaccttgaggcagttggctgccgtgatgggattgagggacagggagggaacgcccgcggtggcaagctcgactgataatgcctgcaagggtgtgggggagtcctgtggcggagccacgcatgcggaggtaacgtggtcggacgcagcctttcagcacgccacagcactccctgccacagatcgacgccagatccccatacctctcaccctgggcagaccggtcttctctgaggcggcgccgggtcccttctgtgaccgcccagagacctctgtcccgcagatgaccagaggctgggaggcatggcgggcacagctcactgacgggaatattttcgaatggggaaatgggaaagtgagggtttgagtaatgggtggagcgtcgcggcagcatggcacgagcatggtggccccgcacgcgatccgtactccccgaaacataaaagcaggcttactcaccgagtgcctgcaccaacctccgggcctggccggggtctggggtcagaggcaggtcggcgaccacagtcaggcgtgagcctggccgctctgagggctggccgcggggaggaccggggccgcccactgaggacagggagagcaccggcatgcgaatgcggagcaagctctcctcaaaggcggaaagcctcgactgataggactcgccgggggctgcctgggaaagggatatggagggggaaatacttgggaagagggggttcttctggtctatgagatcagctgtcgccaacaccgacgtggaggtgcttgagactcaaaccaacatgagcacactacgaggtcggacacagttccgatgcgattcattgcgaccttcctccgctccttcaatcgattcccgcatactacacactgaggcatccccnnnnnnnnnnnnnnnnnnnnnnnnnnnnnnnnnnnnnntcgaaactacactgaccgtggctcgctcctcccagctgccgctcgctgctgcaggctgcagctccaccaggttgaaacccagctcctgcgccagaacccggaggagcgtcgacttgccgcacccaggtggccctgcaatttgcggagggtggtgtggtggggatgacaggcagtctaccaggtactgctacaacaataagaggaccccgattgcgtgcaccagcgccccaacctcaattccatccatccctaatgatgtcctccagccagtgtgctgagtgcgggtgcgtctcaagctgccccaggaaagagcaggtgctcctcacacccttcctccctcccaccctcgaacgtgcctgtgagcaccagggcggctgagnnnnnnnnnngacaaaaagaggaccccgatcgcgtgcaccagcgccccaaccccaatcccatccatccctgacgatgtcctccagccagtgtgctgagtgcgggtgcgtctcgagctgccccaggaaagagcaggtgctccgcacaccttcctccctcccacccttaaacgtgcctgtgagcaccagggcggctgagccgggccgtgtcggcccgtgtggagcctgagcggcgtcccggcgcgctgccagccacgccctcacctccgcaaccttcttcgggtggatgaccagctgctctgatgcgcggggggcgatggcccagccatccttgtcttcctgggggcccgagagcgcggcgccagggaggggcggcgcggaccttaatgcgcgtggcccgtgctggctggcgggctgcggcgagctggcgggtgtggaggcggctgctggttgcgagagggatgatgcaaggtgaggggagaggccgtgccatgagtgcagcaactcgagccacagagcaacacgccacctccgaggtgctgctcgcatctccaatgccatacccgccccaccgctctgtnnnnnnnnnngtgatgcaaggtgaggggaggggccgtgccatgagtgcagcagctcgagccacagagcaacacgccacctccaaagtggtgctcgcatgtccaatgccatacccgccccaccgctctgtggctgctggctgctggtgaggtacatggacagcgtttgctggcgtgaggtggaagacgtctgcgcatcgagagagcacgagggtgaggccagaaggtctcattgcgtggaagggatgctgcatgcaccacggttcatcgcaatggggaacttgaagggttctccaaagcttgccatgcccgagaatcggactggacattccccacctcccgccgtagccctaccttgcttgaannnnnnnnnnctgctggcgtgaggtagaagacgtctgcgcattgagggagcacgagggtgaggccagaaggtctcgttgcgtaaaagggatgctgcatgcaccacggttcatcgnnnnnnnnnncggaggggcggagcgggggtgccacatccttagtttcctcctccacgacatcctcatcatcaccacttgaatcgatgatgtcccacggaggggcaggcagctgccgcctgcgcgtcctcatagtgcagtcatgcccaaatgccctgggtcaggccccaccaatcagccggtcctgccttggccaggcagcatgaattnnnnnnnnnnacagtcatgcccaaatgccctgggtcagggcccaacaatcagtcggtcctgccttggccaggcagcatgaattgagcttgcagaagagcactcagatgcagatccgctcaggcacgcttcagtgcagcttggaggtgaccgatgaagtgaccagaggacggcatgcctcgatgaggaggctcaccctctcgcacttgccaacctcaggacgattcagctcagtcacgaaggtaaggtgatacacgtggtgtctaagatgtattgggagtcggtgggactggctcgagctgccagctgagatcacgtccctgcgcggaccaacacctctccccaaacttggttctggacctcttaagagcccgtaacaatctcgatgatagaatcaattaacatcttgccacagggtgtatcgaaatcgcgatcatggccccctgattcgcagtgcaccatcccgaccatgctaggcatgctcgcatggagttttgagggaggcgggggtctgacgccagccgcactgtgagatctcaagtacaaccacggtagcctcgcgagcaatgggacctccacgcgcaactgttccgtcaagctccggtgaaatttggcatgtggccatagcacttggagggtgtaacactcacgagttacatttcccatgtgctcaccggcaccagctgacattggtgttgcccaacgtaccaccccagcagcaggccctccttcgagtgccagggcgcattcaaaaattttatgtgaaccttgaatgacacatgctcctattcaaccttcaaggataaagcctagaccttcagatgagtgcatttgtaagtgagtgtgatgtactcaggcacaaagcccagcctggtttggggtgacttttgcttgcactggccatactttgctatttcatgtgctctttatggaaacttaccgcttggtgcctgcgctttgaagcatgctgtacccctgggcaatgttgaaatgattgctgtcaaaagcagcaagtcaccgaatggtcaggttcccatctgtacattnnnnnnnnnnctcagatgagtgcatttgtaagtaagtgtgatgtactcaggcacaaagcctagcctggtctggggtgacttttgcttgcactggccatgcttttctatttcatgtgctcttgatggaaacttaccgcttggtgcctgcgctttgaggcatgctttacccatgggcaatgtagaaataattgctgccaaaaccagcaactaaccgaatggtcaggttcccatctgtacattcatgaacgcggatgccatgtctccttcgtctctgtgcagaagaaggtcgccgaaaggcagcgctacggcacttcgttatctgtgacctctgccaaaggatgaattcctaggtattagatgtggctaggagacggaactctgccaagcagacgccagcaaccatttgcacaagggtgttcaagtcgaagcttggccaggtcagacactccggcccccattcaggcaagtctgaagtctacttgtgcccaatcgcgagttatttgcagcggcgcatagcggtatcagtgccaggcttggatagaaaacacgtccggattgtccggtactcgagccgtcggtctttaacctgggtgcgggttaaatttgtaaccatctccgacgcggagcggaagctacaagtttccgtaccagaattgcgaatggaaccatttgcaccacactgttnnnnnnnnnntgacgcggagaggaagctacaagtttccgtacaagaactgcgaatggaaccatttgcaccacactgttcccatctcggcaaatacaataactgatcccccgatgtcatccaacacgctgcccaagcgggttttggtagccatcaccagttacaatggtgcactgtatgacgatggcaagcgcaccggcctctactggtccgaagccctccacccatacaatgtcttcgtcgaggcgggtttcgaggtggatgtggccagcgagaagggcaccatgggctacgacgagcactccatcgagggcgacggcctcgaccccgagtcgaaggaggcatgggaggacgtaaacaaccccctgaagaaggccctgaaggagagcctgctgaaggccgcggatgtcgacccctccaagtacggcatcttcttcggtgcgggcgggcacggcgcgatttacgactacccaggggcctccggtctccacgcggcgggcagtgcaatctacggtgctggtggtgtcatcgcggcggtgtgccatgggcccgccatcctaccggggatcaaggaccccgccaccggccagccggccatcaagggcaagaaggtgacagggttcaccaaggtaggcgaggaacagatggggctgctcgagagcatgcgcaaggacaaagtgcacaccatcgaggagttggtcaccgaagtgggtgccgagtatgtccaggtaggaagggatggagagcagcatgtgcgtaaaggagggaaattgtgactggcgtcattgtatgggtgttatcgtggagatggtggatgctcagatcactcacaaggagacttgctccttgagttcagatttccgagaagcgatctgctcaggattgatactataccctgattctgaagcaacttatcaagataccctgcctttctgtacagcctcctggaggccctttcgatgacttcagctacactgatggcagggtagtgagtggagtgaaccccgccagcgcaaagtctaccgcgcaggctgccctgaaggcatttgaatcgtccaagtgaggaggctgaacatgatccaaagtgactgctgtgtgacgtcgtcagtgcgcagagagacctttggcttttgacagattggattggtgcatgcagaaatcctgtctattcccaatggcttgtatcgacccaagaaggatactgtaccagggaagaaaaccctgtcttcgtccagtttacgcgagttatcggagtaggtgccaggaggtggaatgacagggaacgcgcgcgttgggtaggtgggtcgatttcggccaacaccagacaagtacaaagacaaacagtgctagcgaagctgtgtaagaaggtcgaaatattcactcggtcaagatcccggtgtatggcagacctgcgcccacatcttgtgttcgcagggatcgtcgttgggaagtgatccgcacggcaactcaccgcttccacacgccgattccacggcatggacgacgtggacagggtcctgtttgtatgtagggaactcgatgtgtacaagatccctcccagaaccggagcgggtgggcacaggtcgggggagtggcgcgtggacgacaagatcttcaccgcccgctgccgtgtcatggcgcgagggcaggcccttgagatccgactggaggacaccaccacgtacgtatgtgaggcatggcaactttattctcgcatgggccccagcacccgcgtcccttgtgggtccagttccgccacgggactcccattccctacgcaggggggatgtgtttggagtctgccctgtccccagggggcaactacacctggtagtgnnnnnnnnnncgtgggtccaattccgccacgggactcccattccctatgcaggggggatgtgtttggagtctgccccgtccccagggggcaactacacctggtagtggaacccgcggccgactcctcccgaaactttgtcgtgcgtttggaggacgccgcctccaagcgccacgccttcgtgggcatcaactttgcagagcgctccaccgcctttgatttctcggtggcgctggtgcgtgcctgaggggatgtggagtggtgctgctccatgtttggcacgaatgggactagactgaatcccctgcggattttgcacccagagttccagcaaaggcctgcttgcgcaggctcgatggcaccagaaactgactgatgcccacttcttcgtcatctcgtagagcgaccacgagaagcagctgcagcgtgccgacaagctgcaacacattgaggcgtccgacgacccgctcgccgccgcggcgaagtcgctgcctgaggcggcggccctgtaccagaagcaagatctggcgctggaggagggcagcaccatcaggtgtgggaatgtgaatcttggtgaggacctgtcgagcaggtttgtgtgccgctgctgccatgttcacctggccccctccacgatcccggcacatgcatgggggtctcctctccatgaggctgagcatgcatgcccccgccccccgtcgcaggttggcggtgcgcaggccagagggtggcgcggcgggcggcttcctctctcgcctgnnnnnnnnnnttgccccccgccccccctcgcaggttggcggtgcgcaggccagagggcggcgtggcgggcggcttcctctctcgcctgccggtccagggaggcgccctggcctcccccggcaagggcatcggcctggctgcccctcctgcgcccagtaacggtgcctccacggctcctgccgcgccgcgcgccttcgatccccccccctccgccgcgctgcagggcgccccagtcctcccccctcccgcgtcgggcggagaggcaggctgggcgactttcgattgaccctcccgtggccgctcccctgatccccttcacatgccaccagtcagccatgggcacccctcccccgtgacccagaggcatgcctcctgttacaggcaccctgcacgcgcacatctcagatcacgcatactcgttgggcttgatgacgtcgtcgatcttgaggatcatcttgcagacctgggtggcgagctggagctgctgccgcttgcccgccagcgtctcaaacacgttttgcgcacgcatgtcgttggtgcccaggtcgttgcagtcgatgccgaggtgggggtcgccctccgtcagctgccgcgtcttgacctcggtcaggctggcgatgggcgccaggcccgagttctcggccagggacagcgggatcacgtccagcgcgtcggcaaaggcgcgcatggcgtactgctccacgccgcccacacgctccgcggcggcctccacggccagcgagcaggccatctccgccgcgccgcctccgtagaccacgcggttgtcgcgcaccagattgcgcgccacgcacagcgcgtcgtgcagggagcgcttggtctcctccagcaccatcttgttcccgccgcgcacgaagagcgtgaccgcgcgcgagccggggcagccctccaccagcagcatgcggtcgcgggtggtgccgaagctgacctccttgaccagggccgcggagcccagcttggaggcgtccagttcctggaagcgcggcacgatgcgcgcgccggtggccaacgccagcagctcgatctccacgccgcccacccagcgcaccgccggcagcccctcgtgcatcagcaggtggttggcctcgtcgtcaaacccccactggcacaccaccagcgtcgcgccggaggccttgcaggcgcgcaccatgtcggtgaagtaggccttctctgcgccgcgcagcgcctcgaacttctccaccgtgtcgatgtccacctgggatttgggatgggatgatgttgcgactcggtggcgggggggcggcgaagtgttgtggggcctgggaatgctggctgaacggcttggtgaggagggccttgcattgctccggtgctcagccccccgggtctggtgcgggctccatccctccaagctggggcaaccaggacgacgggccgcgggcactcccgccgccacctcccccccaccccccccaccttgtgcttggttttgggctttggcggctcaaaggggcaggtcaggatggctatcttcacgtcgtgcagctccttaggcatctggggatggctcatgtccttgtccaggatgacgccctgcacgaggcgggagtcctccaggcgcccgcccaccttgccgtccagctgccgggcagagggcaaaggggtttgaaggaaagaagagggcacgaactttgcactgcagccggctatcccccaggcaagggcacatcgtgtcccacatccacagccgatgccctcccgagtcaccacaccttgatgaggtccaggttgacgtctttcctctccaggtcggccacggtcagcacggcctccacacacatctcagccaggggccgcttgtaccgccccacactgtgcgtggttggaaaggggggaatgctgagcagagagaacggagtttgagggggaaggcatgaggccagtgtagtacccctgctggacaagaaccctgcccaccgccccacaccccgatgcacactgccaggtnnnnnnnnnngatcctgaaggcattggatggcatggtggtgtgtgtgagaggggcacacagccttgcataccccaccctcatgtggacactcaggctgctctggcgccagtcnnnnnnnnnncccctgctggacaagaaccctgcccagcgccccacaccccgatgcacactgccaggtcggcagggaaaggacggtcagagccccccgtcctcctcacatcttggagctgagcgtcgtcatgcaggtcttgatcaggggctccaagtcctccttggtgccggtgccaaaatcgaagcgggtggagatgcgttccagctccgcggtggcaatcttgcaggccatctcgtatccctccgcaatcctgaaggcattggatggcatggtggggtgtgtgagaggggcacactgccttgcagaccccaccctcaggtggacactcaggctgctctggcgccagtcccccgtcattctgagtcccacagagcaagacacacagtgccacccaccggagcgggtggatgcccctgtccagcaggctctcggcctgttccagcaggctgcctgccagtactgtgaccccagtggtgccgtccccaatctcgtggtcctgcgactttgacagctccaccaggagcttgcccacctgatgctccacctccatctgctccaggatggtcgcgccatcgtttgctggtggaaagggcgaattgagggcaagggtgggaggggggtggcaaggatactgtcctgggagcagatccacctaggccaatcccacccttccatgacttcagcggaatgagnnnnnnnnnntgcaaggatactgtcctgggaagagatccacctaggtcaaacccacccttccatgacttcagcggaatgagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtcgccgtctggcccctggagcagcttgtccatgcccttgggccccagggaggtgcgcaggacccgcgacaccgccttggcagcctggatgttggacttgaccgcctcgatgcccttcacccgactctgcttctcctgctcctgcagcacggcgaaggggtgatcacgggtttcagcgggtgcccggtgccaggaacatcatcgatggatacccatcaagggcaccacgtaccctgatgatgatgaagggacgcccatactcgtcgaatgccaggctcatggcgggcccgagcccctgcggcgagatcagacgaccaagcagacggtggcaagcctcgcgattccagagacaccagtcaatgcacgtgccactttaagtgaagatatcagtccgaatcgagaatagtacctggcgattgtgggtcatgcaggcggagcactgatgtgtccgggggggggggggcaccgattcaatgctcccgccctttccagcccggggaatgcaagtgcattgctctgcaccccttcatgaatgcccctcccaaagctgttcacttatcgtcacgaagtcaaatacccaaactatcacgatttnnnnnnnnnnaatcagtccgactcgagaatagtacctggcgattgtcggtcatgcaggcggagcactgatggggggggggggggggggcccnnnnnnnnnngtgctctgcaccccttcataaatgcccctcccaaggctgttcacttatcgtcgcgaagtcaaatacccaaactatcacgattttgattgtctgataacgctcacctgtagacatttcctgtcgatcttcaccgtcgctctgtcatcacccacactaggctctcgaaggcacagcctccggctcacgaggggcatccgagtccgtaccccaagcgctgagcaatccgaggtaacaaaatgtgaattgcccatgaccatgcaagaggtcggagcagtgggaccccgtggcaatacgatcgtggtgtcggacccatactagagcatgatggcgtcatgaccgcagcatgcatgcatgccccctcgccacccccagatcatggaaaattatcgccgcgtgcgacagcctcgcactgatctgcccccgatcgcccccgatgagctgnnnnnnnnnnagatcatggagaactatcgccgcgtgcgacagcctcgtaccgatctgcccccgatcgcccccgatgagctgctcgtcaccgccatcagcaaccccgtggaggtggccggcaagggagtgagcatgctcgaggaggagcaccccgccattaccctgaaggctatgggccaggccatcggcaaagccgtgtccgtcggtgggtgcctgggcggaggacctcggaggtggtgatatggaagggcatcagtaccggccaaagtgggggaggnnnnnnnnnnnnnnnnnnnnnnnnnnnnnnnnnnnnnnnnnnnnnnnnnnnnnnnnnnnagccacccacttccccatgcccacagctgagatcctgaagcggcgcgtggcggggctgcaccaactggtggccacctccacggtcgcgctgacggacgtgtgggagcccacggtggaaggcctggagcgcatcgagaccacgcgctacgcctctgccatcgagatcaccctgtccaaggtgggatcatggagattttctgggagcagccactgcgtgggttgaagcaggcccttgtggagtggggctgccggaagtttcatcttgcctgcatagtttcaccgtttgtgggctccccaccgtgtcgagaaaaggggttggggatggatggtcctgaaccatctccacttggctcaatcagaaagagcgaaagatgctcccgcaacccttggagcaccacccnnnnnnnnnnatcatggagattttctgggagcagccattgcgtgggttgaaacaggcccttgaggagtggggctcctggaagttgcatcttgcctgcgtatttttctgttgtggactcccaagcgtgtcgagaatggggttggggatgatggtctagaaccacctccacttggctctatcagaaagagcggaggatgctcccgcaacccttggagcaccacccnnnnnnnnnntgagcaccggcccagcaggggcccgggccaaccccgcagcaggtggggtggaacaggagtgaaaggaaggaatgccgcgagagttgctttattggttggagattctgacgtgagaccactgaccccgacccttcctcccctgtcactgccttgcaggagcggacgggggcgcggcaggggcagggatcgtggtgggcgggggccctcggaggatgctgcggatgatggctttgcgcatggcgctccggagccagatgccaacggccaagcgccgcatccaaggccacgggggccccgcagcggcaggtgcggggaggaacaggcaggcactctgtggtgtgggacgagtatgggcgcatggctgctgggctgccgttccagtttgaggatccagctccaggaagcacccccctctgcnnnnnnnnnntctagccagagccttccccttccacccctcccagacggagctggacacctccaagccggggtaccaggcgccgctgtcagaatctgatgtcctgagcagcccggagggcctggcagccctggaggccagcctcgtgaccgagcaccggcccagcaggggcccgggcaacccccgcagcaggtggggtgctacaggagtgaaaggaaggaatgccgcgagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgcggggagggacaggcaggcgctctgtggtatgggacgagtatgggcgcatggcttctgggctgccgttcaagtttgatgatccagctccaggaagcacccccctctgcatcgcacccttggtgtgccctcgggtaacattccgtgcgtacactgccgcccagccagtggtgctccacaactgctctttcccccggcatcccgcaggctgcgtggactccggcctcagggcggcgcagggcagcctcggacgtcggatgcggagcccacggtgacggaagaggcctgaccgcagcgtgacactctgggtgggctggaccccgcaccagcccagacccctttttatattacccgcgtgtgacgaacctgcacctgcccctctggcctccgtaacattgctcggtgcggggcannnnnnnnnncaccagcccagacccctttttttattacccgcgtgtgacaaacctgcatcagcccctccggcctccgtaacattgctcggtgcggggcagagagtagccgaggcccatcaggacggtacctttgttgtccccgtcggcaggacatggcaggtcgtcggcagcagcgcaggcatccgagcgccgacggccagcgccggggacggatcggttgcaaacctccctggcacttccaactgcgtctcacgacgcggccggcagcttcttgcgcacgagccccctgaaaaagtccaggctgttgccgtcggggtgcagctcgtaggccagccccgcgtcatcgcgcgcgagcaggtacccatcgggcgtcagcccctcaatcgtgagcgccacgcggctgcctgcctcctccagctccacgcgctgcccgctgtgcagccaggcccgcaggtaccccggctggaagggctgaaagccgtgctgcgccagcccgtctacggcgggctccagccagcccagcagggaggccagcaggcgctcgggccgggccggcggcggggcaggcaggctgcgcgcggcggctgcctcttcaaagagccggtccaggcaggtggtgggcacgcggttgcccacattcagccccagaccccagaccaggtggaatgcacggtcccggtatgcggagtggcacagcacgccgccgatcttgtgttcgccagcgtagatgtcgttgggccacttcagtcgcacctccacctcagcgccaccctgcggcggaggtggagatggaaggagggaagatggagcccaggtaggctgcatgaggggctcagtgcagcgcagagggcttgcgtgccccttcatcgccacagcgcccagcccaggcgctggtgtggcgacgcctgaggcggaactttggctcaccagcaaccgactgcctgcagtggaagcccctccacccccaatggcctttgtggaatcctgaatggactgaaagatcaacccttacctgcaggcaccgagcagcctcctcccgcacagcctgcaccacggccatcgagacgaggtactggaggaaagggaggcgctggcccgagatggtgaggcgcatggccgccgacaccatgagacagcctgcgggggactcccatacgttgccgcccctccctgtttagagaagcaagggagaagcaaggttatcagcaggctgattaagggcatgctccgcccctgacacaaaacttccccccccctgccaatgacgcctgccccgacccaaagaccatggcccggccctggactctgtacctttgccttgaacctgcttgtcggccacaaacaccacgccatccggcagactgcgcaggctgtcttgcagcagggactgcgtcgatgtcgtggctcgactcgtcaacaaaaccctgcccagggcacgagtcttgagattcgagaagaagtctggggcatagaaagcgctcccatcattgccagaagtcctgtgttgctccctgaactccaggtcgctcccctggctctgcaagttagttctcagggcacctgcacattgcacagtgcatgagtgtgctcggaggacactaccatctacatcataggggcatgattcaatattttccaggcttggagcactgtgcagggcatcgcannnnnnnnnnaagtgtgctcggaggatacgaccatctacatcatatggggcacaattcaacatttttcaggcttggagcactgtgcagggcatcgcatacccgtctccagggcgtgtcgtgctgccagcaactcctggggacttgctgcaaatacggagaccgggtccatcaccccaaacttgggcaagacgctggggttgcacacaggcagggcactgggccttgcaaagagtggaatggccctcgcggatgcgaactgctgcagcatgcactgttatgggttgccgcaacgaggtgctcgagacttgctgggtatgtaccgcaaggtccccgtaaacgcagcgtgcgttgttgatggatgctaacccctcatcacagtggacgtgataggtgatatcgctaagtagagacgctccgagaaaactggatggcaagttctgtgtattgggctttcgtgtcaatgccgaaagcttttcctcactgaactgtggatctgctccagaatctgccaacagagaatgnnnnnnnnnngtggatggcaagttctgtgtataggattttcgtgtcaatgccgaaagcttttcctctctgaactgtgaatctgctccagaatctgccaacagagaatgttcagcaagaacaaatgtcagcgaacaagaattatacgagttcataatcgcagagtgttattataatccgtgccgataggtagacagccgaaggtattcagcttgccgcggtgcccacccaagcacgttcagccatggcggagctcccatggacggaggccgacgtgatacagcgctgccagcatgagtatcaggttgcagctcgtgaaggaggtcaggagggccaggatgcgaccgttcggtgagctgctggcgtgttcatgcacccttggggcctcagcgtgttctgaccacctcggtgctcctcgcgaccgggcacattggacaggagatcgccaccccccgcacatttcccttccatgtctccgtcttcactgacgctcccacagactggcatgggcccaggtccactccaccaagactagcgacgtcgaccgcggtgtcgagttgctacaggccatgcttacccaagagtctgcagataccagggatctcctgtacctcctggccgtgggtcagtatcgccgcaggcactacctggacgcgcgcacgacgctgcgagacctgctcaaggtgggattaagaggtttaggagagtgggaggttcaacacagcgtcgaagcaatggctgtagccccgttgaatctttcagctggcccatgcatgatgtgcctgctgccagcccccaacccccagcatgctgctacctgcaggggaatccagagttcaggcaggccgaatcgctgttgaagagtgtggacgaggacattgtgcgggatggcttggtaggagttggggcgggagctgccgtcatcggggtgataggcgccatagcctatgccgcgctgaggaagcgatgaccgtgccgcactggtgcaacgcacaaggctgccccgttgggatcaccatgagacggtcaccctcggtggcctgctgcctctttgtgctgaggcatctcagtcgctgcaagcattgtacacatagcctctcatgagctcgttcctgacgtgcttggctcaccatgaacccatctgtgatacaagttgcagctcgccggtggtcgaagtatgtttggcccaaggtatatggttgggcgggcgaggcataacacttcctgagcaggaacgtgcttcaggaagaattgcgacaagcatcaaagtatggtctcctcgagaggtatatggaacacagggtcaatactaagcatgcattggttgacacagcattaaggagcgccgggagttgtacgcagcacagctgtatcagaggaaagctcgtcgttccgacacgacactggatgagataccgaaacatacaagtgccgagggtgaaaacgcagcagcaaggacgattgcggcaaatcatatgatctgaaaccatgatcacgaagagctctgttcacatggaccaggtgcgctccgtcttgcagggactccactccgacaagggttcctcggcagcggcacacaaaggtggggatccccagatctgtcttgcagcataccattgaacatctttggactgacatctctaaaggtttatgctgctgcgaccccggtctaccgttttcactggccagcacagataaactggcacagaccaagctccgagagcgggagatgcgggacgcagcgaaagcggatgcccaagccaagcgcctcgccaaggatcaggtgagattgggctgcggcatgcgggtctcgatccagtggcggcccatctgtccagcaggtttgtatccatttggtgccggagattggttagggctctccaggctgatgccctcctcattacacattcccatgctcccaggagcgcacctccctccgagccctggccaaggaggagcgcctcactcacgacaccaagcgcgccgccaaggatcgccgtgaggtgagccgggtgtgggtttctccccatctcatgtggtggctctgggcannnnnnnnnnatccagcaggtttgtatccacttggcgcgggacattggttagggctctccaggctgatgccctnnnnnnnnnntctcacccacgacaccaagcgtgccgccaaggatcgccgcgaggtgagccgggtgtgggtctctccccatctcatgtggtggctctgggcactcagcagcaggaccccctgacaagtgggactggtttcccctgtgcagatggcccgccgcgaagaccacgcccagacagggcactcctgcgaacatggcatctggcgctgcaaggtgatggggcaggacagaacggggggcgctgacctcgcaggggttgacattcaggcatactcacatgagcactcattcgacccgcttcccttccccctcccatgccagatctgcttcccgcacaagacgtccaagtgagggcaagcccatgcgtgttgcttctcccaagcatcttccagcgccctccctctccnnnnnnnnnncagctcatgcctgttgcttcccccaagcatcttccagcgccctccctctccgatgtgacctttcccctgccaccattttgtaatgtcatacttgcattgtaccactccaagcatcaactcatgtacaacgaccaccggggtttagccggaggtgtgggaagcccgtcgcagggcggccatcctgtccgccagctcgtcgatcgcagaccgcaccgaggtgaggtcgcccgaggggcgacccaggctcctgcctggagaaagggcagctgcagggggaaggccgccctccacgctgcccctcgcactcgcaaggcgctccctgcatgagtgggagggggcgaaaaggggttcaaccgagggatttcgagagatgtgatcctccctttgcaagtccaagtatcagcctcccgtgccgccagagccccacccacgtggcatccccggcagagtctaccgcgctcatggtctcccgcctgctcccagccccacacccccgccgcgctgcctcatacctgaggctgttcagccgcgcgacggagcccgcagccgatccgtcagacctggcggaggccagcggggatggggtggccgcggcaccctggccgccgggcgtgccgctgccggaccccggcgccgcacccgggctggggatggacaggaccggcggcaggccggccgggccgggggagggccgcgtcaaggctgcgaccccggcgccgcgccgtggagggacaggcagcggtggcctgtcgtctcccccgggcctgccgtcagccggtgccccgtttgcggccgaggccgggggcgtccccgggtcctgggcgccgtcgtcccgggcctccagcttcgccagcccgtcgcggatgtaggcccggaacatgtcggacgtaccggcgatgtacttgtccacgtactcggggtgttgcctggcgagcgtgagtgtgtgtgtgcgtttgggcaggaggaagtatgagggagcggtgtggtgtggattgcatgcactcgcgacttggggagggcgtggacgtggcggcaggggggggggttgccacacaggtcgctccagcatgatgcatcagtccaccttcccctcccctcccattgccctcctctcaccgcctgaggtggtacagctgctgcatggctccctccgcctccgatcggtgcatgagtcggggcatgatgtccttcagcccggctttgaccgccgccttgtcctcctcggagatggcggagggggcggggcccgcaccaccaccccctcccgagccctctgacacggccggcgacgcagagtcgcccttctcgggggcgatcacgcctgtgaacgagtgataagataggtattcggctgaatgggtccccaggatcagtgccagtgtgacatcaacaccctcgccacgccaatggccccatccccgatctgccccaactcactcaccccccccccccccccccnnnnnnnnnngaggtatttggctgaatgggtccccagggtcagtgccagtgtgacatcgacaccctcgccacgccaatggccccgtccccgatctgctgccccccccccccaaacaagttcagcaatgtaacccccgcttccacccccaaaacagcaaaatcgcctcacaaccccatccaccccttgcctgagttggacagggtctgcaggttgagggcgatgtaggcgaagatgatgggctggggctgtgcatcccgtcccgggatgccacgggcgtgggcgtaaatgccgtagccctgcatcttgcagagctcgtgcaggatggtcttgaccatgcgcaacggcttgtcgtccacgccggagcgccgccggatctcgtccacacccaggaacaggaagaagtcgtggatgttgagcagcaggctctccaggtccacgccctgcgggggggggttcaaagggcgggtgcgcaaggggggtggaagaggggaaacgtatgtggcgagtgaggcggggcccgactcggcgccacctctggccctcaaaccacccacctccatctctgcctgcaggctctttgtcagtttgatcaggcacttgaccaccagatcgtagaacttgggcagctgcgtggagggagcaggggtctgcggtcgagggctacgatcttcctagcagccgtcgcgacgtcgccggtagattgctccaattccccgaccctttctgccttctactacggcacgatgcaccgaccaagacgggagaggaatgatnnnnnnnnnnggcgacgtcgccggtaggttgctccaattccccaacccttctgccttctactatggcacaatgcaccgaccaagacgggagaggaatgattcccggtctgcaccacaatccgatgccctgtaagcagcacgcacctgctcggcggtgatgcccttgggcggcgcccggagcagctgcagcaaggccgcgaagcagtacgtcctgtttgtcgtttcgagcacctgtggcgcgtggggtgggagaggctggggtctgcagcctgaccggtgcgcatccaagcatgcccggcaggagtcaccactaacagtgaataatgtgattccggcgacctcccagcaaaaccaaagcgctctcaaggccaccttgccggcccttcccatgcggcccgctcattccccctccacccactccccagcctgccttgagcatgagcacgttgaccgccttgaccagcgtgggtccttcctcaaatcgcagcaggctgcggtcatccagcaggcggaggagcagcagggagatggtgtcccgtagtacgccctgcacggggaagcgtgttcagggagcacagttttaccaggaaaggtgcgaaacgcacgggcgcgggcccttgcccccccccccccccccnnnnnnnnnntgggggagcgtgatcagggagcacagttttaccaggaagggtgcgaaacgcacgggcgcgggcccttgcgaacccccctgaaccccccccccnnnnnnnnnncaaggtatgcctggcatcccaagatccagcacagtctgctttaactcccacccttccacacccctcctcccacctgcgagaggctgagcgcgacgtcggggatggccaggccctgcagcagtacattaaggccgtacttgcagccccgcgccgacggctgcacgcccgggccgccaagaggagaccgctcccccgcccccaggatagaggacagctgcgcgtgcacggtggcaaacnnnnnnnnnnggtggaggccgctcccccgcccccaggatggaggacagctgcgcgtgcacggtggcaaacagggtctccgccgacgccgccatcaaggccacagacctcgcagacatccggccctctgccagagggggaatggggagcgtggcagagattgagagtttgttgatgggcagttggggtgggacgaggggaggaagtccaaagcaggtaaggttagtggggctgcggtgttccctgacactgtgttcccaagctgctgggcaaagcaagcagagcaggaccagcgaggaatgtggacccctgcggcacccaagtcctctccaactccagcaggcaaggctcttgggtggacccgacgcacacgctccatggccccgatctggtccacccctcggccacccacctgctgccggcatgaggtcggagcagacctgcttcatggcctccaccgcctcgtccatgtcggggctggccacaccggcaacctgggcggtccaccgcgcctcgaacccaggctcgtcctggggcgggggagcggcggcgcgcggtgccacggcgccggcgccggcggggggcaaagcagggcgcgcctggccccctgcacctgcctcccagccggcgggcgccggggtcgcttgcaggggcacggggggggtgaagcgggggggcatgggtgcggagaactcaggcgtgccggccacggccgccggcaccggcggcgacggcgcgggtccgggcgacggtggcctggcctgggtggcgggcggagccagcgtcgaggccgggatctgggcggctgccgcggtcggcgccgccacgcgagctcgggtgctcctgcgcagcttctcctccaccaggtcgtgctcgcgcacgtccagcctacaagcggtggggatgatggaggggggtgtgagtttgcaaaacgcctggagcgggtgtggcaacgccggaggggagggacccggcgagaccaaaggcaccgtcgccagagggcacccctcgatgcaggcacagaagtgtcggggtgcaaagacgcttgggccatgccgcgagtggtcgtcgtcggcaggacagcaggcatgaccatgtggcatgcgggcacgccccgccaaaccccacgacgcccagcacccacctgcccaggtgccgccagacctcgtcgccctcggctacccacaccgcctcgatgacggtgagggccgccgtgcgggtggccccatcccggtctttcaacagctgcggcggtgaagggaggcacgggggatccagggtggtgggagcttacagggcttcagacagcaaatccctcccaccttccacctgcaactccagagatacagcaaaatcaagcacgcccggcatccaccccaccaagcacccaccgccgcgacggcgctgatgggcttggagcggctggcgagggccggccccgcgccgtccaggtccagccgctcggcgaggaactccgcgcactcgatgcgcgtgcgcgccgacttggaggccaggcccggggtcaccaggtccagcaggcgcgggacggggtagagccccgccgcggcgtgcagcacctcccggtgcagcgcccgcacgcgatcctgggtggaggggggtggaaagggaggcagggatgtgtcactgaagcctttgtggtggggagaacctgtacaggcaagcagagtttgatgggaggggcgttcgtcttgagggtcagtaaaggccagaggatacactgaatcacggcttcttgtcatggnnnnnnnnnnaggacgtccgtcttgagggtcagtaaaggccagatgatacactgaatcacggcttcttgtcatggtccatctgcttgagtcccagaatctgaccctcgattgcccagcagagcagacctctgcccgcacggcagcatgcatcaacgtccccacagccgtggcccctgcccaggagcctcgacggggacccccctttctctacacccactcatcaatacactgttactcttctgtcctggccccttccaccctctaccagcaccagcaactgacctgcccgtgccccgccttctccacgatggcagggaggaagaccagggcgtccagctccgtcaggtgccccccagcgtcgcgcagcgcgcacagcagggcgcgcgccagctccagcacccgcaccaggctctgcatgttgccgtcggccatgcgcaggaccacccagcgcaggatcaggtccaggccggccaccacgcctgcccacaccaggtctagctgggccaggagggtgtcggctgcctgcaggtggcctttgaagtccctgctgaatagtagcgccctgggatgagggggacgggagggggaagggggggggggaggccnnnnnnnnnnnnnnnnnnnnnnnnnnnnnnnnnnnnnnnnnnnnnnnnnnnnnnnnnnnnnnnnnnnnnnnnnnnnnnnngcgttaccctgtaaagatctcggtaagcttccttcccgctgacacacacacggcacggtgttaccacgctcacctgaattcgggggaggccaccccctggaactccttctccagcagctcnnnnnnnnnnggtatgtgttttggtctgggaggtgagtcacgcaaagggttggagcatgggaagggcctgatccaacctcaagactgctttgatggccacattatgatggcatattgtgaatcccactcttggtgtggcaacatgtttgtcgttcacccagtgcatgaacgtcaccctgtgaagatctcggaaagcttccttcccgctgccacacacactacacggtgttaccacgctcacctgaactcgggggaggtcaccccctggaactccttctccagcagctctggctcgtcgggggacagaccctcgtaccggagcgagcgtggccggaactgggacgagcaaaagggatgggtgggcgcgagggagcatgggggtggagggacagcgggggcagggcgaccatgccttcgtacacaaagcccatggatgcgccgcaggccccacccacaacgcannnnnnnnnnaggggcagggcggccatgccttcgtacacaaaacccacggatgcgccgcaggccccacccacaacgcaaccatcgactcacccgccgcgctcgctcctcccgggcttggggttggggcaccagaatggctgcctccaccggctctggcgccttgggctgcggctcaaacgcccccggcagccgcgccgcccccgccgcaggcttggcctgccgcccggcggcagcgctggtcatcatggcagcagggcctgccgccgagggcgcagcagggccgcggggtccctcacccagcccgccgcctgccagcttggcgaaaagctcccccgccgccttcttgtccccggccgggagcccgttctgggcggccaggaggctgtcgtgagggaccacctgtgcagcgtgcaggttgtgggagccggtggcagtcggaagacagggctcaagcagcctgccccagagaggtattgctcctttggcgcattgcgcataaaacatggtgtacttcttcttcgaccggtcttgggaaagacaagtcgttgccnnnnnnnnnnttattgctcctttggcgcattgagcgtaaaacatggtgtattctttctttgaccggtcttgggaaagacaagtcgttgcctgccccgtgcagcactcttttcgtgtccaggcacgccacccttggccactaccacagccctgcaagcgcttgaacatcgcactcctccacctcacacccacctgtgcagcggccactaagagggcagagcctgcatcccgcacagccacggtcttgtcccggcttgcggccagtatcgcgcggaccagggcgtcagcgccctcccgcttcaccccaggccccaggctctccgtcatcctgaaagggtggggttgcggcggcacaggtgggtgagggtctgggtggtaaccttggcaggtccacaccgaggaggaccaccactagcacagcactcgacggggcgcagctttgccactctcatgtcgcggcgcagctctgacacagcactgccgcacaggagctcccctgcctcccagctttggcaagctcttccctgattcccttttggctcctgcacgtcaccccctccccgccctcccaacccaaaacatacacacaaacccaaaccccgccgcctcaccaggcgagggcggccaccttgccgtcggccagggttcgtgtcgccacgacggcctccagcacagccggcaggaggcgatccaggctggccacgcccagccaggcagtgagcaggcccagcgccgcgtcgcgcacttgcttcttgttgtccgacaggttggacacggcgggcgccaggaggaggcggcccgccacacggtcaaactcggggcccatggccgtggcaatcctggaaagcgtgagcagggccttggccgccaggttgcggttggtgtccgccagccgggactgcgcaggagcgggtcggagaggttcatggagtgagagggctgatgagtgtgctcgcgagcatcgaatccgcatgcatgagactgacccgagagaggcaggcttccgctgatcgaggttcaggagcatnnnnnnnnnngtgcataagaccgacccgagagagggaggcttccgctgatcgaggttcaggagcatgcgatctgtaccatcgccagcccatggaacccttcgacatccaacttcccgctatccttgcccacccctcgatggtccacctccaacacacatcacagaccttgagggcagggaggagctcgcccaagtcgggcgcgatgcggccgcccgcgccgcggaccaggtcgtccacctgctcgatgcccgtgttccgctccttccagttggaggaggccagcatgctgagcagggtgggggtgatggcgccggcgatggaggtgcggggcaggaggtcgtccaccgacaccgcgccgggggagggctcgctacccccctcatccacatccatgggggcagcgcctgcaggggggatgttggtggtgagggttgataagcgtgggtggaggcggctgagggggcggagttgggccatcgggacttcggacactctcaaatgggccgcagctgccctgcccggtcatcccctcatcatgctcggtctgcaccactcctaccccttccctccctcaattccagctcacctcctgctgcagtccccgccccagcccccgcaccgcgtcggcggacgtggcgggtgggtaccacctcctcgcgtgggttgcgccggaaggcgtcctccacttgcgtcacctgggcgggcttcagcccctccagcgcccccgccgccatggccgggcccagctgcgcgtggcaggcgcccagcaggtccacaccccgcgcccgcaccggcgcggctgccgagcccagcgcctcccgcgcccaggccaggagggcgggcacgtcgaaggcggcgacgccaaaggccggcaccgcggccgccacccaggccagggcctcggcggggaccttggggttcttggccgcgccggccaggcgctggagcgtggtgcagacaaagccggggcccaccgcctcggacaccgcgtccagcccggcaatcacggggagcctgtacgatgtgtgttcatatttgggaaacgaactgagcctgggattgactcttagggtcggatcaacgcactgtcaggcagtgtgagctgcagagggggccccaccccatggctatgagaggagggcagccgatgcgaacgacccccccacttttcaccgaccaacaccttcagcccacacctgtgtttcagctcagcgatcttctcggccatgccctccaccgcaatcccggcgtcccgccgactcagcgggccggcagccagggcggcgatcacctcatacaccttgttcagcacctggaagttcttctcgccccagctggggagcaccgccaggcactggatgaggacgccggggtcgcgggcggcggggcccctctcggccacgagcgcggccaccttttccatgccctccagcctctcctgccacttggcactctggagcagggccactgcaaatcagagggaggttgggtgtggggtggcggaggatgggtgcgtgctcagccacgatcggttcccatggtgcacagggtttgctccatgacggagcgcggccacgtgaaaccctgagtagtcacagcctggccgccaccccatcatcgccagcatggccctgattgcggcatgcgcgcatgcacgtcaccgtgcaatgcacgagccttagtccacgccctatctcctggacttgcctgtgtcggcgcccaccagctcagcaaatcgctccagggcctcctctgggcccagccgcgggccggcgctcgcctcctcgtcccgtccgccgcctgttgtgccagtatggcagggagaggagggcaggaaggtgaggagtcagattagaaagcggtagacattcaggaaacccaacgctggtcgcccaagagcacacagcgctcatgcccaaggcaccacgcagaccatggcctccctaacctcgccctcacctggcgctgagcgtgccgacggcggcgcgcctgccgctgcaggctgcctgcgggccggcgcgggctgcgctgccttgatggcggctcctcccagcgacttgcccgctcctggtcgagggctggagcccttggatgcgggcttggacgcggcggcggccgccttggcggcgggcggcgcggcggccttccccgcccgcggcccggcggccgcggcagccaccagctcctccactttcttgcgcttgccgtcgtccagcttctccagcacctgtcggtgcaaagaagggggaaatggggcctcgaggagggtgcgtgcggggcaggtgtcaagacacagcttgagcggggagcgtcggcaactgcatcgccctgctggattggggcgtgcgcacaagaccagagtccgtcacctttagcgtgtcccacgagcactccctcgcaccttctcgatggctgccagggacccgccgcgcacggcaaaggcggccaggcctgcctgcgccgcctccctgaccccggcatcggcatcggaggccagcttccccaaagctgctggcagggactccttgagagccctgagtgcgatgggcttcgggcagccctccaccatggccgtcaccagcttgcccgtttccagccgcactgcgtgtgtgtgtgttggtgggggcgcgaacgagctcgtcaggggtttcttgcttgtgcacgagcggtctgggattcagaggaggctgtcagacagctccattgcgccccgccctcacgatccctgactcgacagcgcacgacttgcatgtgttcccagggccccagagccccacgccgtttgcgcgcctcagctttgcgcacggcggcctttcggtgccccatctcaatccattgcacctgctcacaagccttccaaggcctacctttggggttcttgtgctccatggccgccaccaggtcctccgccacgtccagcagtgagtagcagtgggtgcccagcgtgcgcagcgtgtcctccgcagcccggctcatcatgatgttcttctccttcagccgctccagcaggttggggcacaaggactgggaggacagagaggaggggttgggttggagtgagcagacagagtgggcgtgcaggcggcctggccaagcctggcgccgtagaacacagcaggcaagaatgccacacacccatgttcaatgcgcgatgccacccggggtctcccatcccagccccactggccccacccttgcacaccttggcagcattgctgaagccggagcggaggccggaaccaagggcacctgccacctcagccgcggccgtggcgcaggtgatgttggcgtctttggccagcacctttttcagctcccgcaccaccgcgccgtagtcgccttccgccaacctgcacacaagaaaagggtggggcaaggggaagccataagcgagccagctccgggcactctgcgcggtcccgccatccaccgtggcgacacggttcccgtcaatcctcaccctcccactccttccaacttcccaaaaccagacctggtggccctggcggcgtcccgcagccggtccagggcagctttccgcacattccacttcttggactcgaagcagtcccagaaggccaccctgttttgacgagacgatagtgcgatcaaaattgatgctgcttccattgccgagtttggagcagagcccgcccaaaagccatggtactgcgcaggtccatcctggaagccaccacacaccctcaagaccaaaggagtcagcaaatctacatgacgacactgtgaacgcatatgaagcagcatgcccacttttggcttcagggcatcatcaaccaaaaagacatcacctgtcgtccccgatggtcnnnnnnnnnngtgccgagtttggagcagagcccgcccacaagccatggtactgcgccggtccatcctggaagccaccacacgccctcaagaccaaaggagtcgacaaatccacatgacgacactgtgaatgcacatgaagcagcttgccgactttcggctgcagggcatcatcaatcgaaaagacatcacctgtcgtccccgatggtcagcacctccttctgcagcggtcccaggatgtccaccggcgtagcatactcatatgcatccactcccttgaatgaggatggggggcttggtgtcagttactcgggaagatgcctgatgcagaacgccacagcatgtgtctcctcacacatcacccccaccacacccccacctcacctcatcaacctcctctgccgcttccgcggcaacaaggccgggctctgcctcatcgtcgacgtccatagcctctggctgccccgcagccacggcccgctcctcctgctcccgcctggtccaacgctccggggcgcgctttcccggcggcagctcggcgatggccgcctctacgtccttcttcatcgcggcaggcatcttctcgaacagcgcccccgccaccacggccaggcccaggtaggaggccagctccaccgagatctccttggccttgtcgcggacctgggcattggcgctgccatacacagtcggcagcgcccggatgatgggcttggggtccaccaccttggtaccgaacaggctgtgctcagttgtgaagaggaggggagaggaggcggagcgtcaagagggaaggtggtgcgtgagaagagctgcagcgccccatgccacctaccggacnnnnnnnnnntggttgtgaagaggaggggagaggaggctgagcgtcaagagggaaggtaatgcgtgggaatagctgcagcgccccatgccacctaccggacccggcagtcagcgtgcctgctggcgccatgggggcacatccgcaaccccaatccagccgctcaaccccccaatccagccgcttaaccccccannnnnnnnnngcatgggggcacatccgcaaccccaatcctgccgcttaaccccccattccccccgacctgacggcgtttttcaggatgtccagcgccgcgacggcgaccttgggcaccttgtccccggacgccttgatcgcgctttccaccaccgactcctgctgctccagctcgacgagcaggtagcaggcctcggcggcctttgccactgtgaagggccgggccttcagggacttggcaccgatggccgagcacacgctgctggccagcctgttggaatgagatggaaaggggaaaagggcatgagtcactgggtgcagtggtagtgctggcgctgggcacgccccccacagatcgnnnnnnnnnngagaaaggcatgagtcactgggtgcggtggtagggctggcgctgggcacgccccccacagatcgacctcctgccaatggacagcgggcgcgagctggcatgatatcttggaacactagcgcacacacacaggaagtcacagtcacctagaggcctgttgtacatcggccttggcgagccaggcgcagagggcctcaatggaggtgtcctggacattgagattggcgtcgcccaggcccttggcaaacagaggccctgcacatgcacggatcggaaggggggctggagatcagcacacggctcaatacgaggctgaagaggcgggatcgtcgcctaatacgcaccaccaccaccctccgcgcctgcttggtgaaggattggatcctcgctgctgaaggccttggcacaggcgtccttcacgtcatcgaagagctcgctcctgaccttccatgtcttgtgagccgccctctcgtccagaggaagcttcttggctgcggcgaggaccgcagcctcattgtccgccattgcggcgggggcacggagggggtcaccccctatgagctcaccgtccctgaaccgtgtcgcgcgacttgggagctgttgggtcaccaggcacgcgtattgtatccgaacatggtatccttcatacccttgtaactggatcgcggaatgcggtgtatggggatcgacgagatttaaaaaggtcgccgctcgcccgtcgcctgtcggggcgacgatcacgcgctcagactttctcctcgcatgcacttaccaccatggccatttggcttcggaacgaatagcgtgattataactgaataaattgccagactctatcctattgatgcgattgaggacacgttggctcctataccagtgcagcgtcacaggagcggcgtatctgaccagagctctgcgtgctgcacggcaagcctgacacacactcaaccctccgagtcagcgtaattatcgtagctcatagctgggtgcaagttcccaacggtaagagatcttggcgagtgccagcaccctgctccaatgctcccactcgcatgcaaacatcaaggggtgcatgtttccgatgcagggttgaagagtgatggaggacatcgacatgtatgccgacatcggtaggtcgcgcattctcgagttgacatagcgcagcggtgatctgcatggtccctttgacagtgccagggtgtgccgagatgtaggacggccattgcttctgcgtctgaacatcagggtggggcgtgatagccctcacgaccaccctcagtactgggtgtatagtcaatgtcttcttcaatcaccatcaccgcacaccactgctgctcaccgcagccggctaccaggcatcggctgaggagaagccgtcgactacacagggagacaccaagccagaggtcaagccgcatgtaaagccctcgcctgccacgccaggccaggctgtctcggtgttctttagtaacctgcagtggtggaccaccgacgtggagatcgaagggatctgctccgagcatggtccggtgctggcggtacgcttcatcgaggataaggcctgcggcaagtcgagggggatggcggtggtcgatgtagcctccctgacgaccgcgcaggccatcatcgccggggtgaatgggtaggtggttcatcacaggaggcgtttgggagtctgaggaattggcacattcatcctggcagacatgagcacctataagtatctcattcgaggacagtgatggnnnnnnnnnntattgatcctggcattggcacattaatcctggcagacatgagtacttataagtatctcattcgaggacagtgatgggtagggacatcacatcccgcgacgagcctccctccctggatcctccattgcttggcttgcctcctgcccactgcaggcggacggtgaacgaccggccatgtcgggtgacccttcaccaagagcggacctcaactcaaggggcggggggannnnnnnnnngtccctcattgcttggcttgcctcctacccactgcagacggacggtgaacgaccggccgtgtcgggtgacccttcatcaggagcggacctcaactcaaggggcggggggagccagcaacgcctctggcgcaccccccgcccctctcccactgggagcttcagggccaagggccctgcccctaggaagacggccaggggatggaggagcagaggcaaaggggccgcccatgatgggcatgccgcacatgatgggcatgccgcacatgatgggcatgccgcacatgggtatgccaggtgcgctgaagttggggaagcgagttgggagcacaaggctgctgggtcaaactctcttgtgctacagtatgccatgtgtcgagtccctgattcccctggctttggggctgtacatacacagatgtcccgagcaaagggcggcagagcagccagctggatcatgcggtgcgcgatgttccaccctatcccccctctcccctcctcgcaggcatggagatgatgatgcagggtgtgatgccgggctacggcatgcccgtcccgccaggcatgccggggttcaagccacccccgccgcccggcgcgccgccccctccccagcggtgacgtacgcaccaggagcggcggtgcggcgacgcacaagagcggccctgtgccggggagcgccgtgccctgcgccgatctgtaacccgtcttccttgccatgcacatcacgccgcggtgctccatccaggccaggggcgcgtggtgtgggcagcaactatttgggctccgagccagaagcacgtctcacaaaaaattctcctccacgccgcagccactgccgtaacagccagggtcggccgagatcctnnnnnnnnnnagccctgtgccggggaacgccgtgccctgcgctgatctgtaacccatcttccttgccatgcacatcacgccgctgtgctccatccaggccaggggcgcgtggtgtgggcagcaactgttcgggctccgagccagaagcacgtttcacaaaaaattctcctccacgccgcagccgccgccgtaacagccagggtcggccgagatcctgggccgcctgccgccgcgctccgcgcgctgcggctgcgcctccggcacgtgccccgcctcccgcagccactccctccacacnnnnnnnnnntgcggaggagcgcggagcagcccaggaccaccagcccgcgccgcgcgcgggtgatggccacgttcacccgccgccggtcggcgaggaagccgaggcgctgcgtgcgcgtggtgctgagcaggaccacgtccgcctcgcgaccctggaacccgtcgatggtgctgatgcagaccagcggcccgcgcggccgcgcgccccgcgcgtcggcgcagtccagcgcggccagcgcgccgtcgccctcggcgtcggcggggcgcgcgatgcgcaggcgggtcgggtcggcgtggcgcagcaggctggccgcctggccggcgtagggcgtgaggatcgccacgctgcgcacgctggggtccgccgcggagatggcctccgccagcgccaccgcggcctgcgcctccagcgtgttgttgtaggtgtgggtcagggaggagcccgcgctggagcccaccagctgctcccggccccccgactccacgaagagcagcggggagggggccgaggggtcgcccgcgctcgcggcgggccaggccacgccagccaccgcggggcggtccgcggggcccacccccgacgccagccggccgtcatagaagaggcgggaggggaagctggccagcgcggggtgcatgcggtactgggtgtccagcagggacacggggaggcccgcctcctccgccagccggtgaaagagcgtgggcgggggtggggggcccgcagcggcgccactgctcctggcagcgcccgacgcggcacgccgaaccccctcggccctgcctctcggctcgccaccaccagcagcggtggcgtcccccctcccccagtcgctgtccccttgccgcgcccagggccgccgcccgccgccgccc

SEQ ID NO: 43450 - DNA, 80 bp, Chlorella protothecoides
cccccccccccccccccccaaaaaaaaaccctcacttccccctttccctaaaaggtcccagcgtgacgcaccgcgtggtg

SEQ ID NO: 43451 - DNA, 61 bp, Chlorella protothecoides
ggcctacgagccggtgtgggccatcggcaccggcaaggtggcctcccccgagcaggcgcag

SEQ ID NO: 43452 - DNA, 61 bp, Chlorella protothecoides
ctctgagcattcggttgtggctgtgctgggggggttgggactcggtgctaggttgaggtgc

SEQ ID NO: 43453 - DNA, 7473 bp, Chlorella protothecoides
  modified_base (600)..(609): a, c, t, g, unknown or other
  modified_base (865)..(874): a, c, t, g, unknown or other
  modified_base (1936)..(1945): a, c, t, g, unknown or other
  modified_base (2562)..(2571): a, c, t, g, unknown or other
  modified_base (2828)..(2837): a, c, t, g, unknown or other
  modified_base (3121)..(3130): a, c, t, g, unknown or other
  modified_base (4235)..(4244): a, c, t, g, unknown or other
  modified_base (5565)..(5574): a, c, t, g, unknown or other
  modified_base (5626)..(5635): a, c, t, g, unknown or other
  modified_base (5697)..(5706): a, c, t, g, unknown or other
  modified_base (5773)..(5782): a, c, t, g, unknown or other
  modified_base (6083)..(6092): a, c, t, g, unknown or other
cgcgccgccacccgcgtccccgcgcccgccgcggctccgccccagctcgccgcccgccacgaccgcgctggccagctccttaagattgccggcggggcgcaggccggagggcagtgccgcggcggacagctccgcgatggccgccgacagcgtgtactgctcgatgctgtacacgcggtagatgctctgcacagcgcgccggcccgaggcggagggcgggccgtcgggcgcggaggcgggcggacgtccgccgtactgcacgtactgcatgaaggcctccttgctgaccaggccggtgcgcgggatggccagctccgccatgatcatctggatgtccagtgtgctgggctccagccccagcgcgcgcagcaggacctgcaggtctccggcgcgcagcgcgtcgtcgccgtcggcgtccgccgcatcgaactgctcgctcagcagcgcaaactgctcggggtcgatgcgcagctgctccggcgggcgcgagccgtaggtggggtctgttgtgtgtgtgtgtggagggggggttgggggttgatgaggggagaccctgaggtgggagtggtgggggtgtcttctgggggagctagggagcgnnnnnnnnnntggaggggtgtgtgtgtgtgtgatgaggagagactctgaggtgggagaggagggggtgtcttctgggggagctagggagcggttgcgagggagcaacggtggtggtgttgagggaggtaagatgcggtctcaaggcgtaacaagagggttgaagcaaggaaagtagaagcaactcccctctttcacccctctttcccccgcaaaggagcgaccccctccacccaacccacccttccgctcacccagcggcatgagnnnnnnnnnngggtgatggtgttgagggaggtaagatgcggtgtcaaggcgtaacaagagggttgaagcaacgaaagtagaagcaagtccccactttcacccctctttcccccccaaaggagcgaccccttcacccaccccacccttccgctcacccagcggcatgagcttgctctgggtgcgcacccagctgaggccgtaggtctgccacagccccaccaggcgctcggggtggaaggcgtcgcagccgcgctggggcacgctgccgctgatcacgtccatgacaaagtcggcggggttctcatgcagtggcagctcaaagtccagcgactcgaagtagggcatggccagccaggaggggcccagatacaccaggcgcccgcccttgcccagcagcatgatgtcgtcgaagagcgcgaagatggagaagcggggctggtgcagcacggcgatgacgttcatgccaaggcccgccatgcgcttcagcgcctgggggtgaggaggcagggcgggaggtgtgtggggggggcccggcattgagatccagtgtgttatggcatgcatgacctccatgccatcacccttgaggaaccaaagccaggcgcttccctatcccccacatcccctccccccttacctgcaggatgtcggctgcggcggtggcgtccaggccgctggtcggctcatccatgaacaggatggagggtttggcggccagctccaggccgatggacacacgcttcctctgcccgccgctgcagggacgtgaatgggggaggggcatgtgtgcttgcagtgggacccctggggcctcatgcaagcactggcgagccggcggcagaagatacggagcagtgctgcaaggcaagcttcattccaggcctgtcaagccgctgccattccctccaccacagcgctcttccagccatgcaccgcgccaaaccatcttgcaccaaagaccccctgtgcccggcccaagccttgacccgaatccccaaggggtattccactcccatgctcaacccccctccccccaccacaaccgctcgcctgatgcctcgccgctccacgnnnnnnnnnncgatacggagcagtgctgcaaggcaagcttaactccaggcctgtcaagacgccgccattccctccaccacagcgctcttcagccatgcaccgcgccaaaccatcttgcaccagagaccccctgtgcccggcccgagccttgacccgaatccccaaggggtgttccactcccatgctcaacgcccctcccccccccaccaccgctcgcctgatgcctcgccgctccacgctgcccacgatttggtgttggacgtggcgcagctgcagcacatccagcacgtcgtccacgatgtccatctgctcctggcggggcttgctggtggacaggcgcaggcgcgcggagtacaccaggttctcacgcactgtgagatcttcgtgcaccaaatcctcctgcggcacaaagccaaccacgctctgcaggtcgggaatgcccaccgaccggccgttgatgcgcagcgagcctgttgctcggggggtggggggtggagggggtgaggggtggtgggaccttgccagagggtggcattggtgtgccgggaccaaacaggcagggcagtcacgggtgcaggcggcggagggatggagggaatgctgccgtcggtggtctgtgggctccannnnnnnnnnattgatgcgcagcgagcctgttgcttgtggggtggggggtggagggtgtgaggggtggtgggaccttgccagaggttggcggtggcgtgcggggaccagacaggcagggcagtcacaggtgcgggcggcggagggatggaggaaatgctgccgtcggtggtctgtgggctccagcgctgatgatatgatcccccctcccacccatgtacataccgacatgaagtcctttctcaaacagcgtgatcccactcacccannnnnnnnnncgatcatgtgatcccccctgccacccatgtacagaacgacgtgaagtcatttctcaaacagcgtgatcccactcacccattgtcttcccgtgggaggaggactgtcccatgaggaccgacaggaaggtggtcttccccgcgccactggggcccatcaccgcagagaccttggagtgctcaaacctgcgagggagtgaggcatggggtgggtgggattggtggacttgcaagggcagtggcacgcctgttcgagctgctgtgacagccgggggccaggcagtagnnnnnnnnnngggtggacttgcaagggcggtggcacgcctgtttgatctgctgtgacagccgggggccaggcagtagacagttttccaaaccatggttggccgagccccgcacaagcgccacagcaaggaggctgcccgtcaaaaccagtcccagccccacctgccggtgacccctgagaggatggtgcggccgtcgtggagctccaggccgaggtttcggaactcgatgtgcagccgcgggcggatggagttgaaagccctgaaggagccctcccccctgcggtgaggagggtgcgaggagtacaggcatgagtttctcctcgccaatctccaccttggcccctatggcgggggaccccagtggggagaggggcaccccggaatggtatcaagggtccagaaagcacatgcggccccatgtcctcccggaatcccaccctttccccctctccaatgacatccgccctgcctgcggtggtggggcgcaaacagcgggttgaggagcttccacagcctgtcccgcgcctcctgcgtgtgcagctggcgacgctgcgccatgcgcatcagcgcctcggcggtgcagtacgcggccagcaggcccagcaggatgccggccaacaggataaatccggtccaggacagcgctgccttggaggagcccggggggcaggaggtgaggaaggggcaggggctggggtccttggacccaggcttgcagaaggagcccttcgggcagggcagcgccaggcccgggctggggcagtacgtcccgcccgcgcactgcgtggagggcgtggatgagttggcggggcagtagttgccgcccagcgtgtcgccgtccacgtacaccgagctgtacacggtggttgggcgctgcggcagctccatgttggggctggttcgcagcagctcgtccatggcgcaggtggtgggcgccaccgagccggggccgcagaatgcgccctgggggcagggcagctgggccaggggggaggggcagtagaagccggagcggcactccagccccttcattgccctgtgggtgtggggcaggagggagggggggggcatggcggatcgttttggacactgggagggccgcccaaggtggccnnnnnnnnnncgccctgtgggtgtggggcaggggggagggggggggcatggcgggtcgttctggacactgggagggccgcccaaggtggccatgtggtaggtcctggtggggcggccccaatgcagggaggttttggcggtgaggggtatgggggcaggcttgacatgccgggccgtgcaggaatacaatcgattcaaatcttttgccccatgcgattgcgttggggcatggtgggacagatgtcgcccgaactctgacccgactgcctcatcactggccaacctccccttcaagcctgccacccctcctgcacgcacgtctggaagccggggtcacggaaggccggcagggctgtgccctccgggcagtactggccgaagacgcaggggatgcagaggaaggggacgctgccagcctcggcgtcgctggccagggccactgaggttggctgggaacagaccaggccatcaccgcaagactgctgaacatcctgcccacacagacagcctgcggcgcgaaagagcgaggttgagggcggcagactccttggtaatgagtaagggtgatcccattcagcgatgaggcctgcccaaggaaccctggtcaggtgacctggaaacataccaggtgcggctgtcgcccccggccttggggcgctgcagttggccagctgcgcatttgcctgtgacagggaccggaaaccgggtgatgtaagagtaaaacaatccgttgagagtttgtacagcgcccaattgtccgtttgcatgacggaactacgaggtgcaccggcctcggccgcggagctccgcacctggagggtcacagacagcagcagccaaaccgtcgctgtgagcgtcctcgctgagcttcgcataattcagagggttcaatgttccattattgggacctgggcgtgaatatgtcgaggatcagcgcctgtgaggaccagctcgggccggtttcggaggaccgacgagcaggtgcaaatggagatctggggtcccgggcagcgcacactctctctccgtgctgtgagaatcaaaaggcaagtttcggtaggtgagcgattgtgtctccaagtttctcgaccgtgcattgctgtggcgaatgcctcgccaccgttgtccgtcaggagggcatggttcactgagcgtttcgaggctgacaggtatcgaatgctggcagatctcctcttcgcgctttccccaactgcgtccgaatgaaacacacggcctaaggtgttcgggcgacacatgttccttctcatgagcagcgccgatggctgaagcggcatccttccacgactccttacacttgagcctccaatggnnnnnnnnnncccgtgctgtgagaatcaaacggcaagtttcggtaggtgagcgattgtgtcnnnnnnnnnntgcagcgcagatggctgaagcggcatccttacacgactccttacacttgagcctccaatggnnnnnnnnnngtaaacggaaatcctcatcaaaattcccaaattcacatcttgccttatatgcactgtcttcaggagnnnnnnnnnnaccatgtcgggacccagtactggaacatgcaggtaagaagcctgatctagcatataaagggaaatcttcatcaaaattcccaaatccatatcttgccttatatgcactgtcttcaggagagctgggctcagcgctcctctgacggctggggcctcgacacgacgggagtcttgtacagcgagatcagcggggcccaggtcaggaaatcgcaatccggtgatttgatgtctacaatgtgcactcccagcaaacggatggaagaatcgctgcaaccatgcacgcatgcaggggtccgccacannnnnnnnnngtccggtgattggatgtctacaatgtgcactcccagcaaacgtatggaagactcgctgtaaccatgcacgcatgcaggggtccgccacataccacccccgactggtgctctgcgacgcgagcggcagtctgggccggggctgggcctcgacatctggcacgcccaatgtgcaagccgatgatgccgccacgcagacctggctgggccaaacgcactgtgtcggtagggtcgcggccgatgaggtgggtggcagggtctgggacatcggcggggctactgtgtctttttgcattcgcaacgctgctgtcctccactgaggagcaggtcctcacatcccaccgcctcacgtgtgcagggcgcgcagcagtccttcacgtccctcgcggagtggcacccccaccccagatccacgcagctcatccccggggtgtggcagggcgtgagccccttctctgccttctccgccggcacctcggacgccctgcccgccggcttccgggagggcctggtggacgtggtgcggagcttcgtggaggactgcgactgcccgcagggcctgcaggccctcgtggacgaccagtccgggtttggaggcctggcggcagccacgctcgcggtgaggtttgttgctggtggtggctgtgtgggtgcggcatgtgccagaatgtgcctgccgtgcagtatgacctggaaacctgcccacgccacctgtagcattgccttgcggaggttctctgctccatgctggtgcgtgctccccaagggctgcggcagcacagcctccgtgctggcatgtcacaaggccctccccgtcccatccatgccctccccccatccatccctccaccaccccaggagctgaaagaggacctggccctccccgtcgccatcttctgcgtgcgtgacgccggggcagcaggcacggcaaacaacttccacgcccccctgaacgctgcgatgtcctacgcccagctggccggcatcgcggaggtttacgccacgcccaccgcgcctgcaaggctcacgttcaccgaccagtccgtgggtcctgcaagtttccccttcccggggacgaattgtctggccgctgcgctgttcaactgctcgctgccgtacgtgctgggcggcatctccgcccagccgccgcccgccagcgtgagtggcacgctgggcacgctgcgccaggtggcctcgctgctcacgtcggcgaacaactcgccgctgacggggctggccgtgcgcgcggcggtgggggccgatccctgcctggacatgctgtctctggcgccggccgcgctgtcgctgcgggggcgcaacgccgagctggcgacgtggtcgggcgcgcccgggtcgatcgccgacgcccgggcgcggctggcgg

SEQ ID NO: 43454 - DNA, 61 bp, Chlorella protothecoides
catctgggagaggaaggatgccaggcgtgtgaggctcgcgctgctcacctggcgtggcgag

SEQ ID NO: 43455 - DNA, 611 bp, Chlorella protothecoides
  modified_base (113)..(122): a, c, t, g, unknown or other
gggggcgtgggtgacgagcgacgggcgggtgagcgagcgcgagctgcgcagagtgggcctcggacgccggactgtgacccatcgacgcgcacggcgctccagggtgtgtcacnnnnnnnnnncgggcgcgagctgcgcagagtgggcctcggccgccggactgtgacccaccgacgcgcacggcgctccagggtgtgtcacggccaggggcacgcccgctccggcacatgccaccccatcagctccgcagcttgcccacccctctccacaccgcacaacctcaagaacccctcccatccaccccaggtgcacctgagagcgcgaggtccaccgcccaggagcccatgtccaggaagcggccgagcaggaccagggcgcgcaagcggtgcacctggctcagcaggacctgcaaagcgggaatgcgcgaggtgaagggggttcgaggttggtgagggggtctggtcgggggcctgggcgccgatggacgctcagattcaggagggtgaggggcgcagaggcgctcggcccctgggcacggtgggcgccgtcgggcacggcgcctgcagacacggtggggctcccccccctcccccactcccccccgccccccc

SEQ ID NO: 43456 - DNA, 69 bp, Chlorella protothecoides
tagccttggtagccccagcgggaccccggtgctggctgtatgtagatcagcaccgctgccggatgccgt

SEQ ID NO: 43457 - DNA, 379 bp, Chlorella protothecoides
  modified_base (122)..(315): a, c, t, g, unknown or other
tcgtcgggggcgcggcgcgagccggcctgagaccccagggcaagactgcgctctgtggcctctcgttccacagaccttcacaaggggctcgtgcagggtgcccggtgccgtcggaaagcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtgggggtggcttctggggacgggggggcgaacgtgaagctggcgtgagggcccaacgacagc

SEQ ID NO: 43458 - DNA, 61 bp, Chlorella protothecoides
tggggggcttctcttcggtggaggagggaacctctccttgggtggggtggggggttactct

SEQ ID NO: 43459 - DNA, 77 bp, Chlorella protothecoides
ccaaggcatgtctggtgtctgggcacaggggtcgctggggtcgggagaccgaagggtggtctcatcacagcggcctg

SEQ ID NO: 43460 - DNA, 9368 bp, Chlorella protothecoides
  modified_base (102)..(143): a, c, t, g, unknown or other
  modified_base (951)..(960): a, c, t, g, unknown or other
  modified_base (4536)..(4545): a, c, t, g, unknown or other
  modified_base (4975)..(4984): a, c, t, g, unknown or other
  modified_base (5871)..(5880): a, c, t, g, unknown or other
  modified_base (6121)..(6140): a, c, t, g, unknown or other
  modified_base (6195)..(6204): a, c, t, g, unknown or other
  modified_base (6407)..(6416): a, c, t, g, unknown or other
  modified_base (6490)..(6499): a, c, t, g, unknown or other
  modified_base (7470)..(7479): a, c, t, g, unknown or other
  modified_base (7804)..(7813): a, c, t, g, unknown or other
  modified_base (8281)..(8290): a, c, t, g, unknown or other
gccggacgcccacccgccgccgcggccggcctcgctgaccagccggggcagcggtgtggccgagtcggcggccgacgtcgcaccgcggcggcggggcccgcnnnnnnnnnnnnnnnnnnnnnnnnnnnnnnnnnnnnnnnnnngcccgctttgcctctcggcgcgcgtggcagccaccgcggcgccctgcggccacgtcttctgctggacctgcatcgcggagtgggcggcccagaagccggagtgcccgctgtgccgctccgactgccccacctccagcctggtctgcatcacgcacgcagatttttgaactggacgagacgacccagtgcctatggagagctctattccgggtggagggcggggaggcatgtgatcagagtgcagcaagcgtacaccattgtatagagcgtgaggacccggtcacccttcctcgtgcactgcctgggatggggtcgccaggccggcgccatgctgcctcaggggcgcatgccccgctggcaatgtccagaccccaaaccgcaccagtttagatgtacagtcatggtgggagaacagacatgtcgacatcagggggtcccctgggaggagccatgcaggttgcattgggggtaacaacaggtaggaagcacaggagatcaggtacacatcgggtctttgacaagtggaattcttgcaagagatgcaatgcgtgtggcagctaccgattcatcctcgggatagtcaggaaagagggcctcgccgggtcatactagcaaacaattgctgacgcaagggccgaacagtgcaagctgtgagggagggaggtggtgcagtgggcggggggaagggaccaggcgacagtccctggcgcagatgtcgcctcctgcaggggacgatgcgccgtccccaaagtccatccccgggcgggcgagtgcttcatgcacatgcttcctttcaaagccgggcctnnnnnnnnnngtacaacaggtgggaagcacaggagatcaggtacacatcgtgtctttgacaagtggaattcttgcaagcgatgcaatgcgtgtggcagctaccgattcttcctcacggtagtcaggaaagagggcctcgccgagtcatactagcaagcaattgctgacgcaggggccgaacagtgcaagctgtaagggagggaggtggtgcggtgggcggggggaagggaccaggcgacagtccctggcgcagatgtcgcctcctgcaggggacgatgcgccgtacccaaagtccatccgggcgggcgagtgcttatgcacatgcttcctttcaaagccgggcctgcatccaggcaatcagctcctccagcaagatctcattcccgccttctttgaccagcacatgccacatgtggttcaccaggcggatggttttgtcggtggcccgcgcctcccggtacagcgccttggagccgtccgggtcgcacatggagtcattctccgagtgcgccacgatgaatggcagcgtcacctcccccagccgccccatgatagactcggtgcagcgcaggtactcattggcgtttcgcacgcgggtgttgatgtgcgccaccagcgggtctgtaggtgccgttgcgtggggatttggagacgagggagggcgaggatattggaagggtccagcactccaagaccgagatttgaggtcctgggagagttgtccatgcctgcgccccatcagtgtgtgctccaaggagaccccccccgcacagcttcccctggccccaaaaagcaagctcacccgagtcccactggtcctgcaggacggggttgagcttgttgcggtccgttgccacgatggccgcccagggcacgatgcggctgagcagcgccgccacggggcgcatgtagggattcaggccgcggcgggagacgcgctgcagcgacagcatgggggccagaagcacgagaccccggaacagggtttgctgcgggaaaaggggagtgggaaggccgttggttctgggcagcgggttccagagcaggggatgaactgctgtggatcaatcctgtgccccgggccagcacatgagctctcaatggcaggacgtcaaaacctaggcactcacgtcctcgagcgcggcatggagcgccacgcagccgcccatggagatgccagaaaggaagaccgggaggtcacggaagccgggcacgtccacctcgctcagtgtccttttggcatgtggtggttgtggtggtagttttgatggcatcgagcgccagggcgtgacgcatagacagatgcaagcccgacccaggatcacagctgcccgcccagcagtgcccatgccttaacgtggcttggtgcatctcgacacccaccggcgcaggagcaggacgtcgttcacgtagtcctggaaggactccacaaagtaccggaggttcctggcaccatctgagcggccacagccctgattgtccagggtcacgacgctgatgcctgcctcgttgaacttctggacccagcccccatacaggggaggttgccccagttcctgcagcatcaggtacgggcacgaggacacatcggtatgggctgatccacgcctgagacacgcgtcggcaaggatcttggcgagcgggcacgggcaaatgcgcctgttggtcaaaaacccttctcatccgcctacctcgatctgcaagagctcgaacaggccgtgcgcgccgtggccatgcacgaagagcagcacggatctggcctggtctgcaggccagtagaaggttttcaacctcaggccctgcgcattgacgagatccctctccgcgccttgggggcccaggtaggtggcagggtcgacgtcgtcgtacgtggtgtgcggcaccccgccggatgaatcacgagaagccccagctccagtcttggcgatgggctcgctggcagccttctctatgccattcgtctggatcacggtggcagccacggacatgaggctgcggttccggaattcggatagggccgttcggggctccggggcagcagcaatgctacttcggctccagggcgattgttcaagcagttaatcaacgagtagttgtggaacgaccgacacctggtcgtgggcatgccttgcctgacccagctgcgcttggctggtgtgggcagcatgggaaaatgagcagtacctcccccggggggtaacctccacgcgcattcacgcctgcaggcacgattgcactccctggcgacatgtggtgtaccccccctgcccccggaacccttgcccaaaccccgcaccgtgctgtcggaaggtcataccgctgcaggctcggtgaagttctcaccaccccagtctcgggcctggaggtgactcatcggccaggtgcctgcgtccccgcaccccccctcccgtcatgctgcggctcatcaagcgcaactcggggctgctgcagcagctgcgcgggtatgctgcctcctctgaggccgcggtggtagagagcgaggtgttcacccgctacgcctcccccttccccgcccagctgaacctgacctcggccctggcccagctcccggagaccaaggtggattatagtatagacttgttgttgttatcagatgcagggacagtgggatcgccatcggcctcgcggagccgggttggcgcatcgaccgtggacccccagatgttgagaacacccctgctctgggtccctctaagcccgtcatcccctccctctcctccgttcatcaccccttcatcgatccttccccctccctaccctttcaaaaacaacaccaggtttccaccctggcgaacggcctgcgtgtggccagcgagtctgtgccctttgccgagacggccacggtgggcgtgtacatcgacgccggcagccggttcgagaccgatgccaccaacggcgcggcccactttctggagcacatggcgttcaagggcacggccagccgcggtgtgcgcgacctggaggtggagatcgagaacctgggcgggcacctgaacgcatacaccagccgcgagcagacggcctactacgccaaggtgttccagaaggatgtgccccaggcggtggccatcctggccgacatcctgcagaacagcaagctggaggagcgcgccatcgcgcgcgagcgcgacgtcatcctgcgcgagcagcaggagatcgagggcatcccggaggaggtgctcttcgaccacctccacgccaccgccttccagcactcccccctgggccgcaccatcctggggcccgcggagaacatccgctccctcacccgcgccgacctggtggactacatcaccaccaactaccgcgcgccgcgcatcgtggtggccgctgcgggcgccgtcgatcacgaggccctggtggccgcggtggagaagggctttgggaagctgccctccgacgggcccacggcctcccagctcgtggacaaggtgcgttggtgattgggaagggggtggacgcccgggtgtcatgcggggccgggggacaaagaggggcgcggtggcagcgaggagcgggggcgactcaagcctcccgacccctttctgaacctcaggagcccgcnnnnnnnnnnccaaggtgcgtcggtgattggaaaggggggggcacccgggtgtcatccggggccgggggacaaagaggggcgcagtggcagcgaggagcgcggatgactcaagcctgccgacccctttctgaacctcaggagcccgcgctgtacaccggcagcgaggtgcgcatcagggaccctgaccaggccaatctgcactttgccctggcctacaagggcgcctcctgggccgaccccgactcggttcccctcatggtcatccaggtgggtgtgtgtcgtgtgtggtgggggggtgggggggacttgatgctcaggaggctgtacctcagtggtggtgtgcgggcgcgagtgcctagacattgcttccctcaacccccgcccacccaccaacccactcatcatccgcagacgctgctgggcgcgtgggagaagaacnnnnnnnnnnctcgtgtgtggtgggggggtggggggactcgatgcttagcaggctgtacctcagtggcggtgctcgggcgcgagtgcctaggcattccttccctcgacccccacccacccacccacccactcatcatgcacagacgctgctgggcgcgtgggagaagaactctggcgctgggtccgaggcggccagccccctggtccagcccctggcggtcaacggtctggccaactccttcatggccttcaacaccaactaccacgacaccggcctgtttggcgtctacgccgtggccgacaacgacgccgaccatgaggacctggcctggaccatcctgcacaagatcacggggctgacctacggtgtgagccagaccgacgtggaccgcgccaagaaccagctcaaggcctccatcctgttctccggcgatggcaccacaggcacgtgggatcttgtgaggtgtagtgaagatgagggggagctgggcgggaggaggggtgaggagggaggggtcggtcggcgggcgaaatggtaacaaagtgtgcggagacgaggctgacagaggtgtatgtgggttgcggctgccctcagagctcttgcgatggactcgctccgaggtggccaccctcgcccgtcgttctcaccctgcctttcaccaaccaacccccaggcatggcggaggacatcggccgcaacctgctcgtctacggacgccgcatccccaaggccgagctgtttgcgcgcatcgacgcggtggacgcagccgcggtcaaggacgtcgcctaccgcttcttcaacgaccaggtgggagggagagatagagaggtggaggaactgaggggtgcaagaaaggtggatgaggatgggtctgcaaggcgcaggtgcttcctgcnnnnnnnnnntgggggatggagaggtggaggaactgaggggtgcaagacaggtgggtgagaatgggtctgcaaggcgcaggtgcttcctgcacaaaacctaccaccgccgaggtcaatgaaactgccccgcatgctgctcctcaccatcttcagaacaacaccccgcaggatgtggccgtggctgccctgggggacacacagttcctgcccgattacacgtggctgcgccggaggacatactggctgcggnnnnnnnnnnnnnnnnnnnngtcttcctggctcactccacattagggcaggacatgcggacgctggacacgacannnnnnnnnngcctgccgggttttaagatgtagaatgcgcgtgctgcaggagttcaggctcggttaccaaaagggttgaaaggcaaactgacagaagcgggtccccatgcgcgcgcgcgcgccccaagacccggcacctgcgcgtgaagtagccgtgcatcttcctggctccctctacattggggcaggacatgcggacgctggacacgacannnnnnnnnnattgatatgtatgtttgtatttttaacgcttaccctctgcctcctgtatacatgatgcagaccattccactcgnnnnnnnnnnatattcagaaggcacgggaatgtcgtatctgaaggcctatgccgtggcgatggcctcgctactcgctggggcgaccgtggtgcaccacgtcttcaagcccgatctggcaagtggcatgtacttcgatggtcacaggacatgatgcgtgcatggcttgatatgtatgttgatgtttttaacgattaccctctgccttctgtatacatgatgcagaccattccactcggacaccctttcaagggtgtatccagcgttggccctccagccgcacagaagactccaaattaggatccggtggccttgctgtgcgtgctcatccgtctgagtgtcgtcgagcatgcacgccgtggagctggccctgcagggctacgatgatccccagccacacctgctagctcgagtgagggagcacctggcagaatgccaggatgatgcagcagtgtgcctagtatgcctggagaccatagcatcagcaggtagggatgctggagtggtgactgcctgtagccctggagagccgtcgatgccatacaagagtgcttggcgccacgcctcccacccccctcactcatccccagaagcggtgtggtactgtcgtggggggtgctacgtgatgacccaccttggctgcgcacagtcctgggcgcggcagcagctggacgcggcagacgccaagacaatccacagcctgggtcaaatcgagcgtgaccccggccaggccccgcccacgtgggcctgtcccaagtgccgccatgagtatgcagcctctgccatcccccgggactactcctgcttctgcggcaaggtggcagagcccgcggccgacccctggctcctggcgcacaggtgcgatcttggagtcggagggctggaggggtcccttcacgatggtgtcgtgactggcgtgcaggcagtgcatgctgccgtgccagtggggcccgaccatgcttggtcagagcttgcagagcagnnnnnnnnnncgctgacgtgccagtggggcttgaccatgcttggtcagagcttgcagagcagactgccatcgtgcacctgacttcttcatcccaaaggaagggtgactccagcgctgaccctattcacttcattcaaattcaccatgcagttgcggcgggacctgtggccgtccgctccccggctgtgggcacccctgtgccctgctctgccacccaggtacgtcgtctgcctcgcaaagaatgcctggtgctctatggattttcaacttgtcaagtggcacttcgccactgcccaagcgatttcaccgttgcccaaccatactccccccacttnnnnnnnnnngcttgtcgagtggcacttcgccactgcccaagcgatcccaccgttgcccaaccatactccccccacttctggtacacttcactgccattcaaccctcagtctctcctcaccccaggcccgtgcccgccgtgcccgcgcatgctcctcgccagctgccactgcggggcagcctcggagcagcggcgttgccacagcgccgcctttgcctgcggcgctgtctgcgggaggcagagggggtgtgggcatgcctgctctcagccctgccatgcggtgagcgcagactggggtggcagggggtgaaaacctccaatgaatgggaaggggacgggatctgcaggggctcagctcctgggtcagggtggcagcaatcctgcaggcacacccatgtcccaggacacaaatccacccgtcacccacctttccacctcagaaaccagtctgacacaaccctctcacctgcccactcannnnnnnnnnagtggcagcaatcctgcaggcacacccatgtggcaggacacaatccacctgtcacccacctttccacctcagaaaccactctgacacaaccctctcacctgcccactcaacacacacagggcccctgccctccgtgcaccgcgtcgagcatcctgccatgccgctgcggagcacaggtcttcgagaacgtgcagtgctgggaacgaggcacgctgtcgtgcagcaagacgtgcggcaagcccttgggctgcggggcgcacacctgcgcgtcggtgtgccatgccggcccctgccccgcctgccccctggcgggccgacagacctgcccatgcggcaagacggcggggcgcgccggtgccgggtgcggggaggaggtgcccccctgcggcgccacctgcggaaagtccctgccctgcggccagcacacgtgcgaggagcggtgccacgccgggccctgcccctccgcctgccgcgcctgggtcgacgggacctgcgcctgcggcaagaccagccgccgcacacggtgtggggaggaggtgcgctgcgaccggaggtgcgccgccatgagggcctgtggacggcacgcctgcaggcgccgctgctgttcgggcgactgcccgccgtgcgaggaggtgtgtggttggagtgggtggggtgaagaggggggccaatgcgaggggagtttgcgagggtgccaaagggcgcttgcatctggagaagggaactgcatggaggggaggcggcggggctacaccgccgagcttgtgcacagctgggtggatgcacggggcatgcagggttttcgtgggtgacgcctaggcctgagggacgctgcggtgagcagggggcaaaacatcccctacaacctgggccaaaactctgcccgccagagctccctcatccccctcccaagtaccgccccaccaggtgtgcgggcggaggctgcggtgcggcagccaccgctgcgcggcgccgtgccacgccggcccctgccgcccctgccagatgagggtcacgctgacctgtgcgtgcgggcacagtgcgcacaccgtgccgtgcggcgcccagcgcgccgccg

SEQ ID NO: 43461 - DNA, 73 bp, Chlorella protothecoides
caagggcgagctggaggagatggtggagtacctgcgcgaccccgcgcgcttcaccgccctgggcggcaagctg

SEQ ID NO: 43462 - DNA, 10466 bp, Chlorella protothecoides
  modified_base (166)..(175): a, c, t, g, unknown or other
  modified_base (2143)..(2152): a, c, t, g, unknown or other
  modified_base (2395)..(2404): a, c, t, g, unknown or other
  modified_base (4931)..(4940): a, c, t, g, unknown or other
  modified_base (5611)..(5620): a, c, t, g, unknown or other
  modified_base (5944)..(5953): a, c, t, g, unknown or other
  modified_base (7754)..(7763): a, c, t, g, unknown or other
  modified_base (8192)..(8201): a, c, t, g, unknown or other
  modified_base (8398)..(8407): a, c, t, g, unknown or other
  modified_base (9409)..(9418): a, c, t, g, unknown or other
  modified_base (9855)..(9864): a, c, t, g, unknown or other
cggctgcgggaggggctggcgcggcaggaggcgggcctctccggcatgctggccgggctgggggcgctggagcgggcgctggcgcaggccggcgcgtgaggtggggagtggaaggggggtgggaggtgtgggacgtcagacccacgcggctccgcaccgagccttnnnnnnnnnnctgaggtggggagtggaagggggatgggaggtgggggacctcagacccacgcggctccgcaccgagccttcttggccccagtcggcggtgtgctgctggctgtaagagtgtgcatgagcacggtcacaggcaggagatctaaagagggtgactgcacgcgaagtgccccacctggtggagcaggtgccctggctccagggaaaacgtgatcattccgggtgagaagcacctgctccggaagggtggcgttcccggatccagggccccgccggcccccgaaagactccggctttgggaagatgtggtgtcagcgacacgtttgggtggccaaagcgatggctcgaccgcccaggatcgcagcacctcgtttcgggcggggtggctggaacccaccacgaaaccgttcatgcacattccggggtcggatggagccgcccccttatcaaacagcatccgcatgccccccgatgagccgacgccaccagtacattagccgtgcgcacccccccccctcgcccttatcccggactccccagcccttttgcacctccgccctcccccctcccacgatggccaccctctccatctccgcctctgcggccgtgtgcctgcccgtgggccgcactgccagcaccacccgcagccagcctcgcgtggtctccaggcgcgctccttttgtcagcaatggcaacatcaagcgcaccaccgccatgctggtgcgtcatgcggggtagaggccgcgatgccctcatccggggccaccccaatccattcccatctcgtttgctcatgcccatgctgacgcccaccccgccccctcccgacgcaggtgtggacccccaccaacaacaagtgagtcgatcattgaaactcgtggagcacttgcggcgttgccgtcgttggggcatgggagggtctcggtctcgacctaggcgggccgttgcggatatggtttggcagtactcggacatggtgtcgcgcaccatgcgcggttgccccgggctcctcccaccctatgctttatccacacacatgatcctcatggcctgcctcccgtgcgctcatcgcctcgaacctgtaccggcgctcatgacttcaccccccctccgtgccccggaacaggatgttcgagaccttctcgttcctgccccccctgtccgacgaccagatctcccgccaggtcgactacatcatctccaacaagtggatcccctgcctggaattcatcgacgaccctttcccgtacgtggcgcaggagaacaccatccgcatgggtgccgtggcctccaactactacgacaaccgctactggaccatgtggaagctgcccatgttcgggtgcaacgacggcagccaggtgctgaccgaggtgggcaactgccgcaaggccttccccgacgcgtacatccgtctggttgccttcgacaacgtccgccaggtgcagatcggcgggttcctggtccacaggcccccctccgccaacgacttccagcccaccgacaagcgctccgtgtgaggaggctcgggccccatgccctctggggtccgccgctcaatgagccgccgccctggggcaaccgctgccggtctggaccctgaattctttgggcatgcagccccatggacttgtaagcaccatcccacctggccttcagactgttattttgccgagttgatgacgttaataatcgggtgtgaatgtccgggtcagttacagcagggcagtagtccagggtaagtgcacacctgggcgtggctaggctggtgactgggtgaggaggcacagggctgttcagcgaggttacaggcacaccagtgggatggagtagtcccaaccgtcaagtgcttcttgtcagcagacacacgagtgtgcacaccgtcgccactgctagccaacagagcgcagcgtgtttgcctcggtgtcttcggactcctctggcgtgggcctcacgtccgggaactcctccnnnnnnnnnncagtccagggtaaggacagtcctgggcgtgcccaggcaggtggctgggtgaggaggcacagggctgttcagcgagggcacaggcacatcattgggatggagtagaccccaccgtcgagcgcttcctgtcagcaggcacacgagtgtgcacaccatcgccgctgctagccaacagagcgcagggtgtttgcctcggtgtcttcggactcctccggcgtgggcctcacgtccgggaactcctccnnnnnnnnnnggtattgtgcacccgaatcgcatccctgtgcgacgcattgtgaacaaagggttcagcatctgaggccctgtactctttcatgacggccacggtctcccactccatgatccgagctgggagctatgcatcccctgcacctacgctgccgctcccttctgcgcgcggcgtccaaccccgctcagtatcccaggtcacacccctcggccgggacccccaaccgcacctgagccgctggaccttggagacggaggcagagaatgcatccacccggccctctgcaccacgatacaagtgaaagaaagggagcaccttgactccaactcccctggccagcgccttgttctcatcaaagttgatggccaggaagatgacgtccttgttggcctctgccagcagcacgacctgggccaaggtgggggtcggcggcgctgactgcatggcggcgatcggcatggatgaggctcccaagcctccgggcaggggcaacccatgtcgatagatctgggcccatcccaaccaccatccactcctcggcagaccttggggaagagggccttgcaggctgcacaccagggcgcaaagaagtccaccaccaccagcttctccttggccccctccagctcgttcacaaactgctgtacggagtggacatgccgcatgttcgggggggtgggccgctcgtaccatgcctcccgcttggccatagtggccccggctgctgcgctgctcctcgtcatcctgcaccggggtgggggatcagtgggcatgaaatcatgaagagggtcgcacaagataccacccgcttgcggtccgtgacgacacacgcacgcacctcaggttctgaggcgaagggtgggtgccaaagggttgccatgcccggctggtgcgttccaaggacctggtaaggctatatgggttgctacatgctgactttgggagcctgtgcgtggcaaatggcgggcaggtgcccgctgcggtcctggtacacgacgccatggagagggggtcgacaccaccgagctcctgcctcagggctccaaggagaaggaggttctcgggaagacgacaaccaccaggactttaaaggaccagggattatcgcttgtgcatgtgcattgacgcgagagcttgaatggtcgtgaggaggagttcgcgcgttggtcctcccccggatgatctgaagggtagatgcggaccacctgtccctgtcctacgatttctttccctacagacacaagtcctgaggaagtctcgagcgcgcactgtatgctaattgggtttcagtcatgtgcacagagacaccagcaagaagatgttgcagtctgcagcacggcgggacggcttgtgaggctgtggtggcctgctggctagcaaaagctacagggcagccccacactcgatccccgcgccgcctcaggaggccaggagctgctggatggccagcacaaggcccacgccgctggcgaggaagccgaggaccaggaccagcaggggcaggacgacgtgctgcgtcatcgccgcggccctgcgcgccacgctgggctcctgccgcacgctgtgcacgctggggtactccagcgtgacaggccccggctccagccccgccagcttgtcgtccaggtccgcccagtgcgccaggctggccgcgtgctcggccgaggccagccgcgccgagccggtggagggcgcggtgctggcgggggagccgggccggccccaccccgccagcgacagcgtggaggcgttgtgctggttcgcgtcgggcccgaggctggtgcccagcagcgcgtgctgcgcgctgggtgccaggtcaggcactgacgcgcagcgtgccaccgccgaggcggggcggtagaacaggcgcaggtggaaggccacgggcagtgcatagcagacgacgcacaccgccgacgcgcccgtgactgcgatgggagagtgagtatgatcggtcattcagggggtgaaaggataagtagtaggggaggctgggagggttggggacgagggcatgccgtgcaggtagcacggaaacacgatcccgccccagagacatccccgctttctctacattgcagcaagcatcccagccgccaaccaacgcactcgcaaacatcttctcggccgcggtggggaagcacagcgccacgcccagggaggaaagcacactcgcagcggtcacttgcatcgtgtgcgccctggaggtgcgccgccccggtcccaggatcagcctgatgattttggaaggaaaggggggccacttgaccatagccgcttgagggggggcatgcggtcttgtagccggtggaaggccatcctagcagcgcattaagccagcagcgagccgatcagctcacgcagcatggctcctttcaggcagaaaggggttgggacggtgcacgccccagccatggggcatgcgccatgccttgcggggacagtgcatcgccgggctcgcacgtgctgagcggtggggatgcatcccgaccctgccgcactcaccccagcatctcttccccctcccacaccnnnnnnnnnntcgggctcgcacgtgctgagcggtgggcatgcatcccgaccatgccgcacacaccccagcatctcttccccctcccacaaccctctctcccccgcgcgctcccctctgcactcacgcgtccagctgcaggcgcagggtgaggacgatggggaccatggagagggcgaggtagagcgccatgcccgcgtccagcgcgccgtcccacgccccgcccagccactcgttgaccagcacgtcgccgccggtggcgaggccgtagcgcgcggcggcaaacacgccgatgacggagtagatggccagggccacgcccgaggtgaccagctgattggcgcgcgcggtcagcgccacgccgcgcgcgcccgccggcatctccgccagcatgggcagcagcatggggtggacgtagaaggcaaaggagagcacgccgatcgcctcgggcaggtcgggggtgagccgaacgtggaagaggtccagctcgccggagcggacggcggggaagtcgtcagccacgcagcggcggatgatgatgacggtcaggacgccgacgagtgccacccctgctgctgcggcctgctccagctgtgtggtcattggtgtgttgggggagtgagcatgcttgaggaaatggatggggagaattgggaaaggaagttagggctgggtactgaacnnnnnnnnnnattgggggagtgagtatgcttgaggagatgaatggggagaatcgggaaaggaagttagggctggatactgaacagctcagggcctgcgaaggctgtggcagaatgcacggtcggagactcgagggagggccaggtaaggcagtggaatgggcaaggggcggaccaggaggacggcgcccaggtgatgcaacagtgcttgcagatcgacatgccccatctcccgcagcttactatcccagaaaggcacgccacgcgcaggctcgagggacagaagccctcactttcattttccatggagcggcctccctcctctccccacacacnnnnnnnnnngcagaagccctcactttcatccccctggagcggcctccctcctctccccacacaccgcttccctcctgtccggcagtcccccaccctcctcacaccttccgaatgtgcttgaggcagctgagggggaggaccaggcccaggcccagcagggccacgatgacccggccctggccggccagcagccagtggggcgcggcagaccccgccagcttgcccaccgccaggcgccccgtgtcagccaccagcgcaaagtcgccgcagagcgtgccgaacagcagcaggacgagccaggactgggtgaaggcgcgccagcgcggaccccccagcgtctcggccagcgcctcgtagctgctggtcccgcaggcgcccgccgcacgcaccagcagcgtcccggtcagcgagttggccagggagaccgccagcgcggtgagcaggcccagcagcacgcccgtgcggctgaaggcgtatgggatgggcagcaccgagctgtgtgtggaaggggggaggggggaggggatggacgacagcgcaagggccatggaaggatgcatcaggacccgtgacccccctgcccgccaggctggggcctcgctggagccgcggcatcgccatgccaaacactcggggccaggccaggggcacaaccgagcttcacacgcaggtccaaggcaggaactcgggctggccaggtgatctcagagccaggcatgatcagtctccaagaaacaccttcccactcgcgcacacagcactccgcagtcaccttcccaggattgagagggttagggtgatcaaggcggaggtgaaggccctgctagagctctcagctctggggtgaggccagtgttcgaggacgacctccggcatgatggcttcctgctccgcgggtgaccgcctgggccactgggctggaacccaggacgtggcggagcgaggggccctcctgaagcccaaactaagctatactgtggcctggctatgggaggcggactgctgggaggcccacacaatgcactagggtgcccaccaaatgttatgcatgccggcatccctgcacacatttccgacagtgcttgaactttcccgccaggaccccgtggcaaccttttgagcaagagttctttcacgatgtagctggacctctagccgacataccgcgatcgcatgatgcataatgcatctgcaggacacaatgcatggaactgaggccgctatggtggactgtgtctggttgttaaccagaactcgaagtttttggtagccgcgatggcgcaggaactcgcgagccagcccacagaggctggcgatgggcgcgatccagcgccgataaaggattcttgggtgcagtgcgacagatgcgagaagtggaggaggatccctgccgctgtggccgagagactggacgaggagacaccatggtgtgcagtcagggagggccgcagagcgcatgctggggcgctgggaaacgcttcatgcgccaatctaacccgtctttccgctttccaaatgcaatcaccccctcacgcccttgcaggtactgcgaactgaacaccgggaaattaaacagttgtgccatgccccaggagctctccgatgctgagattgacgagaacaacgcgcctgcagtgagtggggcagagagctgctgtaggcctagacagtgcttcatgatgtgtcttgtgtgaggcagctgtctggagtgagactggaatcatttgctggagcctcagcccacgtcccgacctgtgaagccccttctcggcactttccacacactccccgctgcctccctcatcgcccnnnnnnnnnncgagcctcagcccacgtcccgatctgtaaagcccctcctcggcactttctacacactccccgctgcctccctcatcgccccaggacgcgcagtctgcgctgtcgccccgtgcgaccaaggcccccctggcctcccaccctcccgtctggcagctgatcgccgagaagatctacacccaccgtccccggcgggtgcaggaggaggatgacatcatgatctgccagtgcaagcacatctggccctcggacaccaccagcatcggctgcggggagcactgcctgaaccgcatgctcaacatcgaatgcgtggcggtgagtggggagctgccggccatgagtcacggggttggccagggcgccgcatgcctcgtccctcacatgcgcatgcagcgcatgggagtcctgtgggagccacggcatgggtgatggnnnnnnnnnnggggcggcgcatgcctcgtccctcacatgcgcatacagcgcatgggggtcctgtgggagccacggcatgggtgatgggtggcgagattcctggccgcggggccacaccatgcgtgcatgcatgtgccgggaggggtttggcacatgtcacggactggttccccctggccgcccacccgccgctgcccacctgtccannnnnnnnnntgccacaccatgcatgcatgcatgtgccgggaggggtctggcacatgtcacggactggctctccttgccgcccacccgccgctgcccacctgtccacgccacgaccttcccgtccaggagtactgcccctgcggcgaccgctgcaccaaccagcagttcaccaagcgggagtatgccgcgctggacgtcctgcgtgccggggccaagggcttcggcctcttcacgcgcgacggcgtgcgcgccggccagttcatcgtcgagtatgtgggcgaggtgctggaggaggacgagtaccagcgtcgcaaggagtactacatcgcctccaaccagcgccactactacttcatgaacatcggcaacggggaggtcatcgacgcctgccgcagggtgggcaaagtttctaggggttttggggggtgggtgggcaggcgccttggtctgaagaggcggccgaatgggggtgtccagaccagtgagtgtcctggtcagcgagttctggatcgggagcgccgagactcggagctgggtgccatggggcctgagaccctctgccagtcgtcgcagtgacatgcttcatgcagcgcccgaaccccccccttcccccccctccccctccttcctacctacagggcgggcagggccgcttcatcaaccactcctgcgaccccaactgcgagacccagaagtggctggtggagggcgagctctcgatcggcctctttgccatcaaggacgtgccccccggcggagagctcacctttgactacaacttcgagcgatacggggacaaggtgggcgggcaacagctgctgggtgtgggattgtgtacagtgacgggggaggaggcagggggccatctcccgagcttgaaggggtgtgagatcctggctgccagccgctcccgttccgagaccccctttgccctgacgcacacgacccgctggtgtgccgcctgtgcgctacgtcgctcctccccagcacctcgctcacctcaccccaccnnnnnnnnnntgttccgagacccctgttgccctgacgcacacgacctgctggtgtgccgcctgtgcactacgtcgctcatccccagcacctcgctcacctcaccccaccctctcgtgccagcccatggcatgcctgtgcggctcggccaactgccgcggcgtgatcggcggcacccaggagaccgccgtcctggccccgccggtggtggtccccgagtacgaggacgaccccgagcccatcatggtgagcggggtcaaggccacgcccaccctggagcgcctgctggaccgcatcgtgggcgtgggcagccacgtcgggctgacctcgggggagcggagcctgtgagtggaggaggggcccgagggtgtgtttgtgtgtgtgtgtatgatgagcaggtggtgtgctccggcctgggccaagggcatgggctgttgcgggtcgtgctnnnnnnnnnnggagggtgtgtttgtgtgtgtgtgtgtgtgatgagcaggtggtgtgctccggcctggaccaagggcatgggctgttgcgggtcgtgctggggcgccgggtcctcacacggcggcccaagcctcgtctgggccacaggagtggcctcgtgcttctcaccggtgcagggctccgacccaccgagcgctggccggccccctcacccccatgcagtctcaagcagctggcgcagcagcggggcatcaccctggagtcaagctccgaggacgaggaggagggcgaggaggtggcgaggcagcacagggaggtgcaggagccgccctcgccgcccgcgcgccccgcgccccccgcgccctcggacaaggagagcgacgtgtcaggtgtgttgccctgcatgcgcaccccggcggggcccgatcgtcatctgggtccccgtggatgcctcgcctgccaggccgtcatgcgctcaccggctcgcgccatgccccctccccgcagcgagctcggaggcgagggtggacggcgcgtcgtcgctcgcggcaaacgccgccgccggcgtcgccggcatccccccttcgggcgcgcggcgcgcggggcgcgccgc

SEQ ID NO: 43463 - DNA, 93 bp, Chlorella protothecoides
tgggaggcaaggggttgggactgcgtgggggagggggaacacatgactcgggggcatgattgcgccagtcggggacggcccaggactcaagcc

SEQ ID NO: 43464 - DNA, 67 bp, Chlorella protothecoides
tgaccccagacatgctacttccaaggagggggcccccagccctggcagggcaccgagtcagtcgagc

SEQ ID NO: 43465 - DNA, 61 bp, Chlorella protothecoides
cgtataggatgaaatttatcgaacggcggggtgtcgctcgtggactacatcccccccacac

SEQ ID NO: 43466 - DNA, 61 bp, Chlorella protothecoides
tcttggatgggggtggtggagtctccttgggtgggggcggtggagacttcttggatggggg

SEQ ID NO: 43467 - DNA, 65 bp, Chlorella protothecoides
ccggcgccgcaccctccgcagccgagccggcgcctttcgtcttcggggccgcctcggcggcggca

SEQ ID NO: 43468 - DNA, 61 bp, Chlorella protothecoides
ctgacgccagagggagtcgaagacggcggggggcccacggtcgggcgcacaaggcttcaca

SEQ ID NO: 43469 - DNA, 61 bp, Chlorella protothecoides
taagtggaaggcggagcgcaagcggtagggggggttggaggacccctggggtgcagagacg

SEQ ID NO: 43470 - DNA, 105 bp, Chlorella protothecoides
ggcgccgcgccgggggcggggcgcatggaggtgcccacgtactgattgacgtcctgcaggtgcaggatgcccgggagcgccgcgtgcgtcagcgtcagcgcggcc

SEQ ID NO: 43471 - DNA, 3851 bp, Chlorella protothecoides
  modified_base (191)..(200): a, c, t, g, unknown or other
  modified_base (734)..(743): a, c, t, g, unknown or other
  modified_base (1248)..(1257): a, c, t, g, unknown or other
  modified_base (1327)..(1378): a, c, t, g, unknown or other
  modified_base (3684)..(3693): a, c, t, g, unknown or other
gaacctgccgcggccaccgccgtcgcggccgccgtagccgccgcggccaccgccctcacggccgccgtagccgccgcggccaccgctgtagccccccccatcgcgatcgccgtagcttccccggccgccgccgtgcctgccgccgtcgcggctgctgtagccaccatcgtacccgccggtgggcgactccnnnnnnnnnnaccgccatcgcgatcgccgtagctttctcggccgccgccgtgcccgccgccgtcgcggctgctgtaaccaccatcgtacccgccggtgggcgactccgccggaccgcggtggtgtggcctgtccccgccgcggtctcggtcgcggaccccctcgcgctcacgttctcgaccgctcccccggtgccgctcgccgtctcgatggcggtcaccgccacgatcataatccctgtcacgactgcccccctcccgcgctcgagatccactcatcgtgggagggtgtgacctcctcaagagtcgttcccggtgccacgctgcctcgaaatctcgccggaacccactctcgcaagtgttcacggttccaaatcctgttgcaaatgatgtgtacaaggacctgaagctgagcaagagaacccagagatcaccgtggctggacatgcggattgtcaacccgggacccaggtccacgacaacaacgaggtttcatacgcatccacacgcccccgtcagctacgagtccctcacctgcacttttannnnnnnnnngccctctcgcgctcgagatccactcatcgtgggcgggtgtgacctcctcaagagtatttcccggtgccacgctggctcgaaatctcgccggaacccattctcgcaagagttcgcggttccaaatcctgttgcaaatgatgtgtacaaggacctgaagctgagccagggaacccagagatcatcgtggctggacatgcggattctcaacccgggacccaggtccacgacaactacgaggcttcatacgcatcgacacgcccccatcagctacgagtccctcacctgcacttttaatgcaagatatacatagttgagcgaggcttagcgtgcatgtgttgccacattgcaagatgatggtagatgctatacatgtcttgcttcaccctgtttcaccctttcccgctcggttcaaggcgtttcgccccatgtcggtgatcctgctttggttcgagtatgcatgtagctggggacagctgacactcaccctacgcctcgcgcacctctnnnnnnnnnncgcaagatgatggtagatgctgtacatgtcctgcttcacccctgtttcaccctttcccgctcggttcaannnnnnnnnnnnnnnnnnnnnnnnnnnnnnnnnnnnnnnnnnnnnnnnnnnncaaacctgcccgcctcctgcctcagctggatgagtcccagaaggcagggagctaggtgacagcccaggaacgcctccctgagcttatgtcagactccagtaggaagcggaggctggccgaggttgcctcgacctccctgaatgttttgacgatgggctcggcgaccacgacggacgtcagccacaaggtgagccaggacggcgccctcatctcgccgcgcacgacccgtcatgagtcttcattggctcacgaagcggcccccttgcccccagatacgcctgctgctgaaggcgctgctcgccgaagctgatcccctgaaggagctgcagagcgtgaagaccacggtccgggccctgctggagatatgcaagaacggtgagtactgggacctcgccggggaggaggtgacgttgcgccagggcccgggccccttcctgcagtcgccaggcaccctgcatgcctgccctcctgctcggggtgacgaagcacctctgtcgccccttgcagaggagaacctggacgcggcggccagggaagggactgtgggcgccgtggtccccctgctgaagcaggcgtgtggctccgatgacccctcctcggtcaacccccctgtgtgagtctgcgcgccactgccaatggttgggggtatgggagaagcaacgaatccggactcttctgccgggagctttgccagctggggactgggacttgcggggctgtcacctcctctaacgctgcactggatctgcgattcctcctgtcctgcctcacactgccatggccagtcgtgttgtgctggggacacacgccatacgaccagggctcctggctcgacatgatatcgcgcacgagccggcaggcccctgcctgtgaagcgtcaccatgctctcattgtctgctcccccccaaaaccttcattctctccttctccccccccccgcatcacccccacgcagcgaggtggaggagctggagcgcgacatctgcttcctgctgggcctgctggccatcaaggtggcgcaccagcaggccatctgcaaggccggcgcgctgcgcacgctggtggcgctggtggcgcgctacgcggcgcgcggcgacccgcacctctccggctccgcggcggcggcggcgcggcgcgcggccgacgccatcaccaacctggcccatgagaacaacgcgatcaaggaccgagtgcgcggcgagggcggcgtgccccacctggttggcctgctgtcgtcggtggaccccaaggtgcagcgcgcggtggcgggcagcctgcgcacgctggcgttcaagaacgaggagaacaaggcgctgatcgtggcgctgggcgcgctgccgctgctggtccagatgctgcacgcggaggacaccacgctgcactacgaggcggtgggcgtggtgggcaacctggtgcactcctccgcgcccatcaagcgcgcggtgctggaggcgggcgcgctgcagcccatcatcaacctgctgtccagcccctgccccgactcgcagcgcgaggcagccctgctcctgggccagttcgcgacggagggcgagtacaagttcgccatcgtgcagcgcggcgcggtggcgccgctgatcgagatgctggcccacgccgacacgcagctgcgcgagatggcggccttcgcactgggtcgcctggcccagaacgcggacaaccaggcggggatcatcgcgtcggggggcctgctccccctcatggacctgctggagtcgcggctgggcaacctgcagcacaacgccgcctttgcgctgtacggcctgtccgacaacgacgacaacctgatcgagttcgtgcgggagggcgtggtccagcgcatcctggcctgcgacatgatcgtgcagcccagccgcgactgcgtggccaagacgctcaagcggctgcaggagcgtctgcgcggccgcgtgctggcccagatcctgtacaacatgcagggcgcaggcggcgcggcgcgcgcacgcatcgccgtcgcgctcgccgcgctgaccacgcccgacagcccctcccccgccgccaagcgcgtcatgttcctggagaagcgcaccgtgcatgtgctggtggacgcgctcactgacccgcacacgccgggggacctgcaggcgcaggccgccgcgtccctcatgcgcgtggccgaggcttgtggtgccacctcgcccctgcccctggaccccgagccgccggagccgcaggtgggtgggctgtgagttttttggaggggggggattaaccacacgcctgggctcccgggtcacccagatgccggcctgcagggagatgccgtgcnnnnnnnnnnaatttaacacacgcctggactcccgggtcactcagatgccggcctgcagggagatgccgtgcccactctggccggctgcactctcaccctcggtcggtgcacaatgtgccagctcctcacctcctggcacctgctccactcctccccctccccccccc

SEQ ID NO: 43472 - DNA, 61 bp, Chlorella protothecoides
acagccgtcgcaatggccgccagcggcaggaggatggccaggcagagcacacctgcgcttg

SEQ ID NO: 43473 - DNA, 61 bp, Chlorella protothecoides
tgcatgccgcccggctgcgaggagaccaggtgcggcagcctggtcggcgccggtccagaac

SEQ ID NO: 43474 - DNA, 64 bp, Chlorella protothecoides
gagaggagagtcgtggggccatggggcattggtgatgcatgcaaggctggggtgggcggtggtg

SEQ ID NO: 43475 - DNA, 113 bp, Chlorella protothecoides
aagcaatcccgggtcccggtatggatcgatatccatcggccaatgacaatccggcctcagcacccttcccccccaccccccctcgagcagatcccccctccgaagtaccttga

SEQ ID NO: 43476 - DNA, 61 bp, Chlorella protothecoides
gtcggatggagtgaaaaggggtatggatgggcttcaacgagagaaaaatccggaaaatgct

SEQ ID NO: 43477 - DNA, 61 bp, Chlorella protothecoides
ggccgccacacgccattggatcttggcccctccccgccgctcccagaaactcccctcagtc

SEQ ID NO: 43478 - DNA, 92 bp, Chlorella protothecoides
gccgccgcaccaccgccgccggccaccagtcgtgcccctccaccttggcccagaccacggagccgggggggaagcgcgcgccgcgcgcgccc

SEQ ID NO: 43479 - DNA, 61 bp, Chlorella protothecoides
ggggctcgcctggcggagaatggggcgaggggtttggaggcaggtgagggtgggagatgcc

SEQ ID NO: 43480 - DNA, 103 bp, Chlorella protothecoides
acctgcgcgcttgagcctcctgatggggcccgagctgtcccccgacccccgcggcgtccttgccgcacacccttccccttggcagaaatgctgagactcaaga

SEQ ID NO: 43481 - DNA, 61 bp, Chlorella protothecoides
gccagcggccccctggctgtgcaaacactggctgatctgcccaggggactgaggccacggc

SEQ ID NO: 43482 - DNA, 61 bp, Chlorella protothecoides
ttgatgaatgggtaacagctggcttgagggggttggaaaggacgcgctgagggcttgcctt

SEQ ID NO: 43483 - DNA, 61 bp, Chlorella protothecoides
cggcgccacctttgacgacctgctgagtcaacactacgccgccgcgctgcagcgcgcgcag

SEQ ID NO: 43484 - DNA, 114 bp, Chlorella protothecoides
ggcgccagccccggcgcccgccgaggccgagcccgtccccagccagcccccgcccgccgatgtcgcggcggcgctgggcctccagttcggccagttcggcatcggcggcggcca

SEQ ID NO: 43485 - DNA, 61 bp, Chlorella protothecoides
tgcatcatcatgcggcgcactggctggggggactaatattttggggcgagcggtgcgagca

SEQ ID NO: 43486 - DNA, 61 bp, Chlorella protothecoides
ggtcgcagcccggcagaattgccacatcctcgagggcggtggtattgagacagatggcaca

SEQ ID NO: 43487 - DNA, 78 bp, Chlorella protothecoides
gggatggcaggcctgcccatgccccatgctttttcccaggtgtgcactgacaagccgcctcgtccacgatcgccaggt

SEQ ID NO: 43488 - DNA, 74 bp, Chlorella protothecoides
tgcgaggtggtgggatgggaagaaggttgggggggcgcacgtgagtggcatgtccatgagggcatgctccctcg

SEQ ID NO: 43489 - DNA, 91 bp, Chlorella protothecoides
caccctcactcaaccccaccctctccaacctccaccctcactcaaccccaccctctccaatccccaccctcactcaaccccaccctctcca

SEQ ID NO: 43490 - DNA, 61 bp, Chlorella protothecoides
gctaattttcctttatcactcgctccaccgcctgccaaaacagttgatttttctacccaat

SEQ ID NO: 43491 - DNA, 61 bp, Chlorella protothecoides
ttggccgtgatgtggtagtcccggaagagggctggataatccatctccagtctgttggcct

SEQ ID NO: 43492 - DNA, 79 bp, Chlorella protothecoides
cccaagaggcatccgacacaatacactctattcccaaaaactagaacaaaaacaaaaaggtctggtgccagtgatgatg

SEQ ID NO: 43493 - DNA, 151 bp, Chlorella protothecoides
tcttggccgctgccgtcttctgtagagcctatgacatccctcaccatctagccctgcccgcttacactcaggacaacctcatactgggtagcgtggtggctgtgtgcctgcttttcatcctgatctactgggtcaacaagtaggacgggac

SEQ ID NO: 43494 - DNA, 7228 bp, Chlorella protothecoides
  modified_base (104)..(113): a, c, t, g, unknown or other
  modified_base (192)..(248): a, c, t, g, unknown or other
  modified_base (1354)..(1363): a, c, t, g, unknown or other
  modified_base (1719)..(1728): a, c, t, g, unknown or other
  modified_base (3824)..(3833): a, c, t, g, unknown or other
  modified_base (3958)..(3967): a, c, t, g, unknown or other
  modified_base (4543)..(4552): a, c, t, g, unknown or other
  modified_base (4767)..(4776): a, c, t, g, unknown or other
  modified_base (5076)..(5149): a, c, t, g, unknown or other
  modified_base (5510)..(5519): a, c, t, g, unknown or other
  modified_base (5705)..(5714): a, c, t, g, unknown or other
  modified_base (5890)..(5899): a, c, t, g, unknown or other
  modified_base (6644)..(6653): a, c, t, g, unknown or other
cctcccccccctcccacccccccaacaccagtgcctcatccccgagatacggttcctgctggacggcgaggctgggctgtccacctacctggaccgcctgctgnnnnnnnnnncaccagtgcctcatccccgagatccggttcctgctggacggcgaggccgggctgtccacctacctggaccgcctgctgnnnnnnnnnnnnnnnnnnnnnnnnnnnnnnnnnnnnnnnnnnnnnnnnnnnnnnnnnagggagcgggccagcacttctttgacaccccccaccgggaccgcgccgccgaccgcgacgtgggcccctggctggcggcggctctcaaggagcggcacccgggcgcctatgtcaagtacatcgacccctcctacctcgtgcgcagcgtgcccaccgtctccagcgaccgcacctactgcaaggtgctggcgcacaacgcggtgcacgccgcctttgccggcttcacggggaccacggtgggcctggtgaacacacactacgtcctgctgcccatcccctttgtcacccaggcgccgcggcgagtggacccgcagggcaaccagtggaaccggctgcgtgccgccaacgggcagcccaacttcacttgagagccgggagatgagggaatgccaggctcactgtgtgtgaacagctatcacaaccagaaataggaaaagcgggcgttgctaggagagaagcaggggggttgtacaagtcaggttagggtcatggatacagggagaggcactgcggaggccgccgtgcagcgggacaacacaggctccacgccgctcaatcgtcgtcccgctccgggggtaggccgcaggggaagagcatgttctgtacgaagttgtacttgacccgcccgatggactcgttctccgcgatggcgtggtaggtggccagggagtggtggcccaccagggaggcgtaggtgtcccgcttgatgttcagattccactcgaatcgggtcgtgtccgcgtggcccgtgcccacatatttggactgcaggtgctcgagctggctgttgatgttcagccggtcctgcagggtctgcgccatgcctggccacagctattggatccttgtcctatatattcatcagatgcggaggttggcttggcattcgctccataaggcagagggcgggacgctgtcccatgcgcgcaagttctgatcgcacgggaaggcgcgccaaactcctcgcccttgaggccttaatcgccccttccccactctcctcgacacaccagcatgcatgaggccagtacacacatgcaatgtcaacacagtttataggtgaaattgaccatttaagtctgagtgtaagctttcctcttgaatcnnnnnnnnnntgggaaggcgcgccaaactgctcgcccttgaggccttaatcgcccctcccccactcccctcgacacaccagcatgcatgaggccaatacacacatgcaatgtcatcacagtttataggtgcaattgaccatttaaagtctgagtgtaagctttcctcttgaatcaggctgggatgtgcccattcaacctcgtcttgatgcgctgggctaatggtaaacactaagcgaagctggctggggtgccaagaaaacgctagtctctagtcatgaaccctaaactcaaactcccaaaatatgaggtaaaggaatatactttgccaaaaactatctaactgtggatgctggcttacagagcannnnnnnnnncagtctctaatcatgaaccctaaattcaaagtcccaaaatatgaggtaaaggaagttactttgcccaaaaccatctaactgtggatgctggcttacagagcagcagtgaagatagggagaagcagcgacctgggctgtccccccgcagcactgcagatcatagtccagggggagcacatccaagcacgtgtgaggcaggcctccagtatgacccacacaccgggcctctcctacccgcggcgcacattgcgcttgaccttgaccctcctccgcgccgactcggactgggagtttgagccgagggagaaagccccaggcatgcccccaccaaaggcgttgggcacggcctcccctcccataccgggctgagctggctgctgctgcactgctccaaacccaaaggcgggctgagggtttgtgcctgcagagacaacgggcccaggtggtgaaggtgctgggttcaccgctcagatgtggcaaggcagctggggtgcaggcgcagcagctgcagagctcgagccgtgtcgtcgcatgcgcatgcaccgcagaacaacacccaacacagtccgacagtgttctctgctcaccaaaggccggtgcagactgagcagccccaaaggcgaagcctccctgctgttggtcgggcgcctggccaaaagcccccattgcctgctgcggctgggctccaaacccgccaggagcagctgccggctgcccaaagggattgggctgcggctgcccaaagggattgggctgcggctgcccaaaggcattgggctgcggctgcccaaaggcattagcctgctgtggagcggccgtctggccccaacccatgcccgccccggcttccggctggcttccgaaggcaggaccagcctgctgcggtgcagccccaaagccaaagccggaggcagccggcgcggccggcacgggggcggctggtgcgccaaaggtaaagggagcggcggcgggcgtggctgcggcgggccccgccccgaatgtcatcccagaggacgaggctgcgctgctcgccgccggggccccagcgccaaaggcaaagggtgccgccgcggcggagctgctggcggccgccccaaaggtaaaggtggttgagggggaggaggcgccggcgccgccaaagccaaaggacgtcgccggcgaggcagctgcagagctgggggctgcgccaaagccaaaggacgtcgccggcgaggcggctgcagagctggcaccccccgtcgctccgaagacaaagcctgcctgcggtgccgcggcgctgctagcgggcgccgacgtcccgcccgcgccaaaggtgaaggcggcgggcagggctgggctgctcgccccgccagccgagaaggcaaacgtggtgtggccggggtcggcggcgggcgccgagctcgtccgccccgctccaaaagagggcgtgctggacgaggcagcgggcgttgcgaccgccccgaaagcgaagctgccgggcgcagcaaccgaggcgccggcactcggcgcgccaaagaggggcgccggcgccgaggcagcggctgcagctccttccgcagcaggggtggctgcagctccgccaaaactaaaagtgggagcagaggccggcgccgtgccaaaggtggtggatggcaggccgcccagccccgcactggctgacgctgcggcgggggcggcggcgccggcgccaaagagcgctgcggaggtggccggcgctgatgtcacggcctccgagggtgccgccgccgaggcggccccgaagacgaaaggcgccggctcggctgcggagggtgcggcgccggacgccgaggccccaaacaggccgaacgcgggggcgctgccggcagaggccccggatggcacggctgcctgcggcgcggtgttggcggcggtgccggacgttgctggggcgctgccaaaccctgtgggtccggtggatgggccgagcgctgggctcggggagctagcagctgccccaaagaggggaggcgttcccgtggccccaaaagtgaaggctggggccggggcggacgccgccgcgggggcggtgtcctggctggcagcagccgccggggcaccgaacgagaaggccagannnnnnnnnngcgccgaggctccaaacaggccgaaggcgggggcgctgccggcagaggccccgaatggcacggccgcctgcggcgcggtgttgccggcggcgctggacgttgctggggcgctgccaaaccctgtnnnnnnnnnntcgttcccgtggccccaaaagtgaaggttggggccggggcggacgcccccgcgggggcggtgtcctggctggcagcggccgccggggcaccgaacgagaaggccagaggtgcagtctgggaggctggcacctcgcttgcgggcgctggcgccgcgcttgaggacgccgaggcgccgaagctgaaggctaccgggatggaagcagccggggcgctgtctgctgcagcgggctgcgcgccggacgcgagcccggcgctgcccaccccaaaggagaaggcaggcgctgaacccgtggtcgtcgctgggtgggcgccgcccccctggctctcctcaatctccttggccactgcggcagttgctgcctcagacgccgccttgtttgcctggagtgatgggtagagcatgagagcgcaaaggcggaagagtgacgacggcacagcgaggtttggcttggcaagagggtctacgggtggaaaatttcctttcatagcatgtttctcaagcatacacacccaatctcaagaccgccccaccttgagcagggcctccccccatccgccgctgccgctcgtggccnnnnnnnnnnctttccctccatagcatgcttctcaagcatgtacacccaatccctagaccgacccaccttgagcagggcatccccccatccgccgctgccgctcgtggccggcgccgcctcggctaccttgtcagtcgcaggcgagacggtcgagggcgcagccccaaagctgaaggccgcctccgtccccgcattggccgccgcctccgtgccggccgctgccnnnnnnnnnnggtcgcaggcgaggcggtcgagggcgcagccccaaagctgaaagccgcctccgtccccgccttggccgccgcctccgtgccggccgctgccccaaacttgaaggctgggacgagcgaggtggaggacgcgccggccgaggcagccggcgccccgaagctgaaggcggcgggcacaccagaaccggccgccggccgcgactgctcctcgatcgccttctctgccgccttggccgcagccttcgccgcagcagcgtttgactcgaggaaggcggcaccccatccgccgccgccgttggccgnnnnnnnnnnnnnnnnnnnnnnnnnnnnnnnnnnnnnnnnnnnnnnnnnnnnnnnnnnnnnnnnnnnnnnnnnnctgggccgctggcccgctcctcggcctcgtcggacgagtcgccgggcagtggggagcgggccgcctcggccaccgccgccgccgcggccccgcccgcacccatcccgggcctcgggggcgaggggggcctggcgctcgagcccacgggaggagcgcgggccttgcgccccgcatcccccaccccaaactcgaagatgggcgcggtggacgctgcggccgccggcccgacggcagccaccacggccgccacctgacgctccgtcgcggcgtcccgggaccgcccaaactcgtagacggggccggctacggcaccattggcctgcgggggggcggtcgtcgcacccggtgccgtctcgcgacnnnnnnnnnncacggcgccattggcctgcgggggcacggtcgtcgcacccggtgccgtctcgcgaccgcccgtccccggctggtcaggggtctggctggtgccctgctgtgcgtcacggcccgtcgcaccaagcaagggctcagcgccgaactgggagccggcctgcgcggcgggggcctcggcgccggccttccnnnnnnnnnntgtcacggcccgtcgcaccaagcaggggctcagcgccgaactgggagccggccggcgcggcgggggcctcggcgccggccttccgccctgacgctggggtgtctctgccagagtcctgaggcgtccaccccctcccctccccacacggcttcaggctgctcgacatggccgcggtnnnnnnnnnncgtctctgccagagtcctgaagcgtccaccccctcccctccccactcggcttcaggctgctcgacatggccgcggtcgaggggtgaggcttggccggggcgcgggctcgggcgcccgcctccagaacttctggctggaaggagacgccgccaaaggccacgcgggactgcgggcgcgcctcgccggcctcgtccagtccgcctggggtgtggcacgcagggcgggaggcgggtttcggtacgatggagtggcaatggtctggcgtacaggctgccctccccccctcctcagtcccccccccccaaaaaggccccttaccagcaccgcctggcagcccacccaccacacacacacgcacccacacgctcctccccatgcccaccgtcggcgttcaggctggtggaaggagggggcgcgcgcagggcctcctcgtcgccctctccggcgccctttgaccccggggtcaggctggcgtccagcgcgtccagcgtggccaggatgcggcgcgccgtctccgtcgtggcgcgcggcaggcccagggggtcggacagcgaggcgatctgggcacgcgcggggcctgtgattggtgggcagggacgggggtccgattaggaaagcaggcgagcgagcgcgtggggaggggaaacccggtacgctgattcggttcctgggccctccgcgtggaccggtctgatgacaaaggcctgctgacgcccctcccaaaccctgcagctgtccacctccnnnnnnnnnngtcgattaggaaagcaggcgagcgagcgagtggggagaggaaacccggtacgctgatccagttcctgggccctccgcgtagaccggtctgataacaaaggcctgctgacgaccctcccaaaccctgcagctgtccacctccctactctgcgaccaccactccatcccatacagtccctcacccgaccaggggctggccggccctcccagcagggggaagagctccggcgtggcggagccccgggcgcccggcgtgccggcggcgcccagccccggcggggctactgcagggcggtacggagtccgtcctgcggtactggcgccggcgccgcgcgcccgcgtccgccgctgcaggtccaggatgctgatggtgtcggcctcccacgcgtcgccgccggggccctcatcctcccccgcccggcgcttgaggcccagcgcggagggcgtggcaccgcacgtacgctgcatgggtgtccaagccagccgcgccggctgcgccggtggtccgggcggcggcggcgccactgcagcgccaggcccggcggcggcggacggggatggggcggcgcgcccgtt

SEQ ID NO: 43495 - DNA, 14929 bp, Chlorella protothecoides
  modified_base (113)..(296): a, c, t, g, unknown or other
  modified_base (807)..(816): a, c, t, g, unknown or other
  modified_base (1318)..(1327): a, c, t, g, unknown or other
  modified_base (1998)..(2007): a, c, t, g, unknown or other
  modified_base (2485)..(2494): a, c, t, g, unknown or other
  modified_base (3173)..(3182): a, c, t, g, unknown or other
  modified_base (3265)..(3274): a, c, t, g, unknown or other
  modified_base (3524)..(3533): a, c, t, g, unknown or other
  modified_base (3590)..(3599): a, c, t, g, unknown or other
  modified_base (3696)..(3705): a, c, t, g, unknown or other
  modified_base (4460)..(4469): a, c, t, g, unknown or other
  modified_base (4674)..(4683): a, c, t, g, unknown or other
  modified_base (4773)..(5013): a, c, t, g, unknown or other
  modified_base (5271)..(5280): a, c, t, g, unknown or other
  modified_base (6685)..(6694): a, c, t, g, unknown or other
  modified_base (7220)..(7265): a, c, t, g, unknown or other
  modified_base (7572)..(7581): a, c, t, g, unknown or other
  modified_base (8282)..(8291): a, c, t, g, unknown or other
  modified_base (8364)..(8373): a, c, t, g, unknown or other
  modified_base (8469)..(8478): a, c, t, g, unknown or other
  modified_base (8677)..(8686): a, c, t, g, unknown or other
  modified_base (8772)..(8781): a, c, t, g, unknown or other
  modified_base (9125)..(9134): a, c, t, g, unknown or other
  modified_base (11456)..(11465): a, c, t, g, unknown or other
  modified_base (11684)..(11693): a, c, t, g, unknown or other
  modified_base (11772)..(11781): a, c, t, g, unknown or other
  modified_base (12826)..(12835): a, c, t, g, unknown or other
  modified_base (12984)..(12993): a, c, t, g, unknown or other
  modified_base (13322)..(13331): a, c, t, g, unknown or other
ggcgccggcctgcagccgcgtgcgcacgagctcgaagggcgcggtggcgaagacggcggcggtgcgggacagcgtgccggcggccagcggcgcccaggccgcgccgccggcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggccctcgcgcagcgctatgcgccacagcgcgtccagcgtgccggagaagaggggcggggcggggggagtgggggcggccgcgcgcgcgggggaggccaggcactccgcaaaggaccagcgcctggatcaatagaaagggtggggtgggggtgttttagcacctgttgagagggggaaatgacagacacccgattgcaggggtgctggagggagcttgtggagggcgaaggacacacaccagcccaggaacttgcgcattactcgaagatcacgaacatccacagagacagaccacccacaagaactactcactctaggagggcggcatgggtcgccgcatagttgggggagctctgcacctggatccttgtctgcgaggcgggcgcgacagggagttctgatccctgaagagtgattaccttgctataaaatcaccacatggcatcaggcgacactccacccacccactcccaggcatccctcccaaatccacccctcccctctcaacnnnnnnnnnncgtctgcgtggcgggcgcgacagggagttctgatcattgaagagtgattaccttgctataagatcaccacatggcatcatgcgacactccacccacccactcccaggcacccctcccaaatccacccctcccctctcaacacaccttcaccacgtccagggggttcaccaccagggcggagacgatggacgcgcccgctgccgcagcactgcgatgcgccaagctgatttcatggcgaggaggggggtcgaggggtgtgtgctgggccgtgggcccctcgcccttcatggcccctcggaactcgtctggaagccgaggccaggcgaggtcgaccctgccgcttccaccccgctggagaggggccctcgagcaaatcaatcgatgtccttgtccaaggaaatgaaatgggaattctgcagtattctttgactgccaggaaattatgcccctgtcgtgggtccactcattccctccctgagaatgagtgactcacctctgcgcnnnnnnnnnntactctgactgccagaaaattatacccctgtcgtgggtccactcattccttccctgagaatgagtgactcacctctgcgcgctcgctccgaggaggacagaaaacggactcccgccacggctgtgcaggggtccactgctgttgaccaagtcaaataattcgctgcgcatccctgcatctgcatcttcacggggcccgcctccatcggaatcgaagcattacagggtagagggacgcctccagcatgcccttcgacctcatcgtgagttgtttgaaggcctggtccctgcccagtggctcaagaccaccccacccacccttcaccccccaccaccccgcagaccgggaagtttgtcccggaaaagtccaacatctggagggactgcgtcgatggctactatgactgggtgcaggagcacatcgaggacgtgcgtgctcgggggtagggtgtacatggcgccgcggacgacctgcggagcagtgcctggaccggttgtcacactccgctgtcactgccctgcagggagcacctctgaatgaggcagatcactgcggcgatcccccgctcctcctggcagccgggaatggtgcgccaggcggggagagatgctggggagttattgccggaatgcttgtgcccgatagtattccaccttctcgacccccccccnnnnnnnnnngattgccggaatgcttgtgcccgatggtgttccaccttctcgattccccacccctcgcgccgtcgcaggccacctcgcggtgtgccagctgctcctagaggagggtgcggatgtggagcagcggaatgtggtgaggagtagactgcggtttgttgtggcatctggaggaggctgccctacctcagggtacaagacagcgtatgctgagggtttggaggaaaaggcacggaagaccaatatccagtcctgacctgccagaatatgctgtgatagcacctgctgtcgccccttccatccaatgcttggagcctctgcaccatccagatgggggagacaccgctgatcagggcggcacacaatggccacctggcaaccgtccagtacctgatcgacaagggagcggaagtcaactccatcgacatggtgagggactggtttgcgtgcattcatttcatggatgagtgtcccactctgcgcnnnnnnnnnnaagggactgggttacgtgcattccatttcatggatgagtgtcccactctgcgcgctgcatcagctcagaaacaccccttctcatcaacctctgccatcgctccttcttcccccccgcagggcgacaacaccgccctgcactgggcctccatgcgcgggcacgtggagatcgtcaagtacctgctggcgcagggcgcggatcgcacgctgcgcaacaagcaggagaagatccccatcgacctctgccagccctgctggtccaactcctaccgctttgcccgccagctcttgtccgcgtactgagctgggcggctgattgagggtcatggtgcttgttgataggtgttggtttgtaccccccagacaatttaagcccagggattggcagggaccagttcgatgagactgttccagcctgtgtgcctcacaaccggggaaaacagtggtgatgtcctcctggcttgaagggtgtgatggacaggcaatggcactgtgcaggcaggcactcagtgggatcaggcactgagactgtgcactgacttcgtattggaaggccgggcaccctcgaaaggccaggttccaggactgcggggccggtggggtctagcggtgcagcacgacagtggcacaacctccgctccttcttcaacgatgggtgtgcatgccagggcgcgaggcgnnnnnnnnnncgtgcaggctggcactcagtgggatcaggcactgagacagtgcactgactttgtattggaaggccgggcaccctcgaaaggcnnnnnnnnnncgtgcacgcccctgcccccggtcctgacatccctcaggcggtggccgaggcttgctgggtcgcggctgcgctgccgcacccccctgcgcccgcctcttggaagacggccgagctggcggcgcccgaggcgtagggcaggaaggcgggccggctcttcaggcccagcaggtcgaacagctgctcgtcctcgccccggtcgttgttgggcgtggtcagcagcttgtcgccgtcgaagatgctgttggcgccnnnnnnnnnntgtgcacggccctgcccccagtcctaacatccctcaggcggtggccgaggcttgctnnnnnnnnnnagccaggaagcacagcgcctggcggggggggtgggggggggcgggggtcgtgtctgccgttgtttgatgatgggatgatgtcgtgacactggagtgnnnnnnnnnnggccaggaagcacagcgcctggtggggtggggtgtgggggtgggggtcgtgtctgccattgtttaatgatgggatgatgtcgtgacactggagtgcaatcgaggcgatgtgagccttttggagttgccgagcaggcaaggccaccgagaatcagcaatgattctccccctccgggacgccccgcccatctccacacccatgtacttacacacacctcgtcccccccccctccccttcttccccaatcacacctggtcggcaaaggacagcgtgaggcggcctgcagacagccgcaccaccgtgcgtggcatgagcacgcgggcggtggccacgcagcgcaccatgtccaggccgctgggcggcgcatgcccggcaaagggcgtccccgccactgccaccagtgcgttgatgggcaccgactcggggtgggcgggcagggtggccagctggtgcagcaggcccacgcggtcgaggtgtgcctcgcccagcccgatgatgccgccggcgcagaccgagatgcctgcctggcgcaccgtgtcgatggtgtccagccgatcctgtgatgagtaagattttggaaaggggagaaggggggggaaggtctgagatctgaaataacacggggctgggaagactccccctatcaccccagcccacacaaagaacccccctcccccctccccgacagagcaccaccctgcgggcccccacctggtagctgcgcgaggtggtgaccttgccgtagtactcgcgcnnnnnnnnnnaacaacgaacccccctcccccctccccgacaaagcaccaccctgtgggcccccacctggtagctgcgggaggtggtgaccttgccgtagtactcgcgcgaggtgtccaggttgtggttgtaggcggtgagccccgcctcgcgcagcgcggccgcctggtcgggggtcagcatgcccagcgtggtgcacacctccatgcccaggcnnnnnnnnnnggtaagattttggaaaggtgagaagggggggaaaggtctgagatctggaatcacacggagctgggaagactccccctatcaccccagccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggccgacctgggaggggccgcgccaggccgcgcccatgcagaagcgggtggagccggcctccttggcgcgcaccgcggccttttgtgttttagaaaggaggaggtgggggaaggggagtatggggggaaggctggcatcccaatgagaggtttttgagccagtgcagaactattccgatactgaaaaaccaatcaggtcctcaaacacatccacacactcattgcaacaacccacctcgtacacggcgtccaggtcnnnnnnnnnnggtgtttcggagaggaggaggtggaggaaaggggagtatggggggggggaggctggcatcccggcgagaggattttgagccagtgcagaactgttccgatactgaataaccaatcaggtcgtcaaagacacccacacactcattgccacaacccacctcgtacacggcgtccaggtccatcagcttctcggccttagtcccggtctccttgctccacgagctggactggctgcagtagttgcaggtctcggggcagccccccgtcttgatggatagcagtgtgcagcgctggaccatggcggggtcgttgttggcacggtgcaccaccgcggcggtgtgcaccaggtccagcaggggggtgttgtacacctccccgacctcctcacggctgcggagggtgggagagcaacgagggggctggagctcaggggaatggggaatacctcctgccgtgatgtgtcaggcccaaggcagcctcgggcccagcggcggcaggcagcaagccaatgcggccaggtgagtgtggtgttggcacccaccgtccccccctgtacctccagtctgtgcgcacgacgcccaggcgcgaccgccagtccggcaaggcggatggtcccgattcgggctgaggggcgggctcagcattacgccccgcgctggatcccgctacgccccgcaggccgagctgggcgggcgtgccagtttgccactgggagcagagggcgcggaccgccgcgcgggcgtgtcgctggacctgcattgtggcgcagggtggtcgagacgcccggaacgaggatgaggaaaagggtgctggactgggtcgagggagggaggccggcacggatctggtcagatcgacgctcggtgacgcaggcagcgcccgcgattgacagcatggccggaccaggacgctggatcgacccgcccgacagtgaggggatcactctcggggctagctgcacagtctacgagttgcactattatacctcgatctcatgctctgagtgcatggaccccggcgagatcgcctgagtggtgttacggcgggggcgtctacgtgacccaccaccctacgatgcacctctatggcgatggtctcgccgccgcattcacacagtgttgcattgtgtattacatgggtgcggccctcctgcattatgtcttgcccgtcctgttgccgcgtccctcggtgcaaaagggccaccccaagcagggtcaggtgttgaaggagtccatcatgagcataggtgagtgcagggtgatttgggtgctgtgatggggagctgtaagacgcagtgttgcagggaaggagaagctggtgtgtaattttgtacaatctcttccacctgcctaggtgcactgcttgtaaaggccctcgtgctgacggctgtggagaagctgcatgcannnnnnnnnnctgtataatctcttccacctgcccaggtgcactgcttgtaaaggcccttgtgctgacggctgtggagaagctgcatgcagcagggtatggcaagctatacaccggaagcatccactcagtctctgatgtgagtccagggtgtaggcatgatgggtggggcggacccaggtggatttgtctagtctgggtgcattgctgtaccagcgtcaagtgcaaagccattgcacacgtcaacttctcctctcaaaccctgtcaggtgacctacgctgtcatcaccatagtcatcctggactgcctgcatgacacctggttctactggacgcaccgtctgctccactggaagcccctgtatcgccacattcactacatccaccacaagtgaggctcgtgatgggtggtgttggggtgtcggagggggcagtgcagcaccctcagggtccttgcctcatgctggaatcaatcgaaaatctttcccaccggcggctcattacttggcacgttgtcaccaggccatgcacaattccnnnnnnnnnnnnnnnnnnnnnnnnnnnnnnnnnnnnnnnnnnnnnnacactcccacacaggtccactgtacccaccccttttgcgggctactccttccatgtggtcgaagccctcattgtctttgccaacgagatcatcgtctgcttcctcttccccatccacgcgtcactccaccgcatctaccaccttttcaccaccctcatccacatcggtgtgtggggtttgcagccgtggggcaatgcttgggggagggagagtggcccccgtcactggaagggtgcttggtgtctaagaggggggctccccagccctggccgatagatcggcgctgtgcctgcctcctgtataccannnnnnnnnnagggtttgcagccgtggggcaaggcttgggggagggagagtggccccgtcactggaagggtgattggtgtctaagagggggggtccccagccctgaccgacacatcggcgctgtgcctgcctcctgtataccattgcactcccctcgcgcgccccccctccccccccctcccgcatccctctgtacatacgcatcttcgacgccccccctcccttcttcacacatcatccaggcgggcacgccgggtacgagatggcgccccttatccccagcgtggagcaggcgctgagctggctggtccaggggcccaggccctgcggtgccctgaacacggtgaagcaccacgacatgcaccaccagatccccaccatccactttgccctctactttgtgcactgggataggttgtgcggcacagagcacccggcgtaccggggctatgcccggaaactggcggcccagggccaggaggagagctgagagtctgcgtggctgtgcatgaacgccggtctgttgagcttggaggcatgccaggggcgcgcttgcccgtactgttaccctggcccctcatcccctggctgtgagcctgcttgcacccattgcctatcctgatgcttgctgcgagtcttctttctcctcactgttctccattctcccggtttgtgcttgatacttctcttgtgatcagcgggaaggcacannnnnnnnnncctttctcctcactgttctccatacttccggtttgtgcttagtacttctcttgtgatcagcgggaaggcacannnnnnnnnnaacgcctacgtcatatttggagctcctttcaattgattacatatattactaaaattttagattgtcatccgattgctcgaaactgcgagaggtacnnnnnnnnnnccaagggcagatgttgcaggagccggcctcatgttgcggcactcttccacacgtaaaccacagcgcttttatccccgaagcttttcttccgaccccactcaaggacgcctgcgtcatatttggagctcctttcgattgattacataaattactaaaatacacaattgccatccgattgctcgaaactgcgagaggtacnnnnnnnnnngttcccacactgccccccagctctttgttggcagtaggacacttctcataccacaccccctcccccgacttcttttctgctatctnnnnnnnnnncctttgtttttatggttttgtcacgagtgagagacagttgagcgttggaacaagggcattccgacctttccccctcggcctcctccattcccgcactgccccccagctctttgttggcagtcagacgcttctcataccaccccccctcccccgacttcttttctgctatctgtgctctgtacacggttggctgatcttataacgctgggcgggagggggggcaggggcaagaggaggactgggcaaaggtggttccattcagggatcctgtgatgactagacattcatgctgtagacactattttagtaagttgtctgaggtgcatggtgttttgttggttggnnnnnnnnnngtgactagacattcatgctgtagagactattttagtaggtggtctgaggtgcatggtgttttgttggttggagtgtgtgggaagttgtggggcgagttgtaccaacccctcctcaggccttgggccccgacttgacgatctcggccgcgacctcgggcgtgacgaagccgccgccgtcggcgtacttctcaaagttggcgcggaagagctcgcccaggttgcgcagcgtggcgtcgtacccgtcctggtcggcccaggagcgggagggcatcaggagctcggagggcacccccgagacggccttgggcacctgcagcccaaacacggggatgggctcgtactccgcgcgccccagctcgcccgagtggatggcgtccacgatggcgcgcgtgtggcgcagcttgaagcggtagccgacgccgtatgacccggccgtccaccccgtgttgatgagccagaccttggtgtcgtggcgctccatcttctcggccagcatgctggcgtacttggtggggtgccagaccaggaaggcggagccgaagcaggcggagaaggtggcctccggctcggtcacgccctgctccgtgcccgccaccttggcggtgtagccggagatgaagtagtacatggcctgctccttggtcaggcgggagacgggggggaggacgccaaatgcgtcgcagcacagcatgatgatgttgctggggtgcccgcccacgcaggggatgcgcgcgttggcgatgtactcgatggggtaggacgcgcgcgtgttctccgtgatcttggccgagtcgaagtccacctcgcgcgtctcctcgtcgaagatgacgttctccagcaccgtgccgaagcggatggcgttgtagatgtcgggctcgttctccttcttcaggccgatggccttggcgtagcacccgccctcgatgttgaacacgccgtcctcgccccagcagtgctcgtcgtcgccgatgagctcgcgcgcggggtcggccgacagcgtggtcttgccggtccctgacaggccgaagaagagggtcacgtcgccggccttgcccacgttgcagccggagtgcagggacaggatgccgtcgcgcggcatccagtagttcatcagcgtaaacacgcctgtgggaatggaaaggggtggaaaggggtgtcagagagggtgaacatgggtgtgatgggcggtggaggggcaggggtgtcagagcccgggtgtcacggagggaccaagattgttcaggggtaagtgcccggtgcgaatgtcaagcaggtgaccccgccctgcatcgctccatgagccaatcagttgtatgtcctttccccccggccctaactcacccttcttcatgcaccctgcgtagttggtgcccaggatgaccatctcccgcgccttgaagttgatgtccacggaggtggaggaggtcatgtagctggtgtggcggttggcggggaagccccccgcattgtagatggtgaagtcgggcttgccaaagttggccagctcctcctcggtcggccggatgagcatgttgtgcatgaacagcgcgtggtaagggcggccgcagacgacgcggatcttccggcgcgcggccgggtcccagcccgcgaagccgtcgaagacgtagagccggtccagcatgttgaggtagtccaccgcgcgctcgcggttcagcacaaaggtgtgctcgtccatctcgtagttggggctgccctcgccccaccaaacgtgcgccgaggtctcagattcgcgcaccacgcgcttgtccttggggctgcgcccggtcttcgcgccggacagcgtggccagcgcgccgctggccacgatgtgggtcgacggctcgtgcgccagcgccttctcgtacagctccgcgggggtcaggttgtggtacaccaccaccggcttcagccccgtgtcggacacgtgctgggcgaaggccgacccgctggctgccagggagcgcggggagccggggatgtaggcgtgcttgggctcgcccttaaccacgcgcggccccgtctggcgcgcgttggagcgcagcgtctccgacagcgactcgaggtgcgcggcatgcacagtctctgccaggtggttggggtggaaagggggggtgggtggatgggttgcattgaggtgggaacgttgggatggggaacacgagagtgggggcggtggtgtgagtggctttgggctgctgggcgagggacggtggtgctggggattgcggggtggcggatggaagaggatacaggatgggattgaatgaaggggagggcacttgagagtctggagacgcccaagcatcaggggcgtaagggagnnnnnnnnnntgggggggggggatatgggctgcattgaggtgggaatgctgggatggggaacacgagggtgggggcggtggtgtgagtggctttgggctgctgggcaagggacggtggtgctggggattgcgcggggtgcgggatggaagaggattcaggatgggattgaatgcaggggagggcatttgagagtctgaagacgcccaagcatcaggggcgtaagggagnnnnnnnnnnaggaagagggatgggagcagtgcacgggaagctgtacagggggccggaacaggccgagtgccccacccaacagcacgtnnnnnnnnnncaggagtcccagaggcaaagaaaggcagtggggctggtggcctttaggggtcacatcaccggcagacgtcctgcctaaaaatacatgccaatgccagcctttcaacgggcactggcggcagcgttggcagggaagacacgtcaaaagaggacacgggaagagggatgggaatagtgcacgggaaactgtacagggggccggcacaggccgagtgccccacccaacagcacgtgccggggtatatgccgcgggctgcccgaatccaaccccctccccagctccggcaccgggatctcaccatccttctcgcggttggacttctggagcgagcgcagctcatccagatcctgggccctgcgtcagggaatcggaggaggggggttcaggaagggtcgcgggcggaccaagtatcgcactgcagagcccaccgccatcggtgcccacctgggggggtgggcttcgttcaccatgcggcgcagatcactgccattggagcttggttttgaggtttggatcctgtttttcaacgagagggttggtgagggcagagcgttgatgacaggcgcattgtcggaggaagctccgcccatcgctgccgcgggcggtgacagatcgcaagcgccttgagtatctaaacaatataaaggactcatatacactcacggtgcaacgccattggacgccatgctgagcaaactggaagggacccggtgtcgggtgttcaggtgccagggaacgtgagagcttgaatgctgcgagccttgcgaccgcggtggtgtatgtaacttgtcgggaacaatttaatatattaccgagtatgatgaggtgtcgggttgagggtgcaaggttgacctctttgcatctaataggctgcaaaaatttgtcaggacgcgtccacgtaccctgcgcgaggaaaggtggagcgcgcttgcgtggcttaagacgtctggagcggcacgtgccagaggaacactgacgacttcacaagaggtcgtactccttgcacggaaaattaagtgtatatcatgagaccgcgggaatgacnnnnnnnnnngacactgacgacttcacaaaaggtcatactccttgcacggaaaataaagtgtatatcatgagaccgcgggaatgactccaagctgatggctggccggcttttggcgcatttgaggggtagccgagggtccggatcctggatgatgccannnnnnnnnngccgcttttcggcgcatttgagggacagccgagggtccggatcctggatgatgccagcttcggtcatcttgcacatcttaaccaagcggctggaacaaggtgggagccataggcctcgtaacaccatgctctagatcggcatgacccgtgaaacgccacgaataaatccgacgagacagcagtacatggtgatgatagattgcgaatgaatttgcgaagttgtctgggaagagtattgcaggtgtatatcctggcagctactggtggacgggaaaccaccgagtcacaaccacagagaactactccttacatgtactcatactaaacannnnnnnnnncccgacgagacagtagtacatggtgacgatagattgcgaatgaaaattgcgaagttgtctaggaagagtattgcaggtgtatatccaggcagctctcggtggacgggaaactatcgagtcacaaccacagagtactactccttacatgtactcatactaaacaagaaaaccccattgtgacgaatggtgaagcgctctgattggcggggaagctaatcgaccccagggaggtggctgaccgcattgggaagaccccacgcgcaaaaagggaacatgcactcagtggcaaccaatggtgcgggtgagagatatgaacttccaagtggaattttgggttcgggctaatctttggtctggcgacagtctggtatttggtcggcttataaagtattgggcgacagcttctctctaggcattgacaggtgcgatcacccaccactccaagtgtctttcagccgatctccgcttcctgaattcatccacgagcccctggcatgattcgtccacgcatcttgcatgcgcaagcagaacgatctctaagcatggcgaatccaaggtttctcgtggtcacgctctggggccacatcataagcgatgcgttccagcgaattgaagtctggacaacagcgtccatccaatcgattacctcaaggtagacattttcattgtcgactctcacctttcatagccccgaacgccgtatcggcagggtcagccccctccgacacccgacgcccgtcaccccaccgcatggcccccacgcctggcccgtgccactcatagcgcgcatcccagatgctgactgggacggccctgggtgtgctcacctggggcggtggcgcgtcatgcttgtttggcgggttcctggccgtggttgcggccagcaagtcccgtgcagcccaggacctgggctccgtgcgtgaggttgagagcctttccggtgggtcctggcctggtgtggcctggttaggggactcggctacttgcagggacgagatcagggctcttgcagcgagtcgggcgcctgcaagtgtcacctcccaggcaaccattccgcgatggacgagggggtcctgtcttgatccccttgtgggttccatctccaacgctgccaggctgagtgcgtcgctggatttcccaagattgagccaaccttgtccctctcctcccatatctcccccccatctgatacccacgtaccagacctaaaggagctggcgtccctggtccccctgctggtggcggtgagcgggcgcgtttggtgcgcgcgcccgctcacctgcgagctgtccgccggcgaggccgcgatcgtggaggtccaggaggagaagcgcaccgagcgccgcttcggcgcggtgtgggtgggcgagaccacgcccctccgcgcctcggtgcgcgagacggagtggtgcctggcggagggcgagggcggggccggggcgcaggtgccggtgctgggcggcgccggcgcgcgtggcgacgcgctgcagcccacgggcgacgtcttcctgccggcccaagaaggcgcgctgggcgcgctggtgggcgagctggcggggcaccgcgcgctgggcacgcgcgtgcgcgaggcggcgttg

SEQ ID NO: 43496 - DNA, 93 bp, Chlorella protothecoides
gcacatgccgtgcgcaaacggcgggtgcccgacctctgtgagttgggatggcgtgtggtgtgtggtggtggtggtggtggtgggggggggggg

SEQ ID NO: 43497 - DNA, 71 bp, Chlorella protothecoides
gcggggcatcggcagagcagctgcaacgggtgtgtgtgtgtgtctggatgccagttgcagtccagtctcag

SEQ ID NO: 43498 - DNA, 61 bp, Chlorella protothecoides
ccgtcttccatcgctgatggcagggagggggggttgcgcggcgtaagtatcgccccaccac

SEQ ID NO: 43499 - DNA, 77 bp, Chlorella protothecoides
ccttcctccccctgctcgccacccccccccaaagccaccctccgcctctcaccgtatggtgatgcagtccagcaggc

SEQ ID NO: 43500 - DNA, 61 bp, Chlorella protothecoides
gcgcagggaggagaccctggcccgctggacttcctcggagcgccctgcgctcaaggcgcag

SEQ ID NO: 43501 - DNA, 645 bp, Chlorella protothecoides
  modified_base (102)..(111): a, c, t, g, unknown or other
tatgttctcgtctctgaaggagaccctgttcttatcacttggctgcttgatccgccctttcctcacacctcacacctcgcatcccatcgtgcatcgcttccnnnnnnnnnncgctggccgccgtggcgctgtggagcctgaccctggagtcgccgacctggctgctcctgcgcggcaggaaggtgcgcacgtgggaaggcgggggtggggagaggtgggaggggtgtctgcggagtggcgacagttatgttctcgtctctgaaggagaccctgttttcatcacttggctgctcgatccgccctttcctcacaccttacacctcgcatcccatcgtgcatcgcttcctctcgcgatccacacatgcaagcaccctcctatcaaggcccccttcaaccttcactcaaaccccacagggcgaggcgacggcggtgctggcagtgctggcgtcggccaaccgctcgcgcctgcccgccgcgcagctggccgaccccaccgacctgctcggcgccgcgcgcagcagcctgcgcgacgcgctgggcgtgccgcgcatgcgccgcacactgctggcgcacgtcgccacgctgggcgcgctgggcgccgtgtactggatcgctgcagggctggcaccccgcctgggcggcggc

SEQ ID NO: 43502 - DNA, 61 bp, Chlorella protothecoides
cacgtacatgggcgcgtcgggggagggagcagagatgaccacgcgcttggcgccgcccttc

SEQ ID NO: 43503 - DNA, 61 bp, Chlorella protothecoides
ggatggcaaaaatctgtgtcaggggcagggtggcatacctggtcactcccacaagagtgcc

SEQ ID NO: 43504 - DNA, 93 bp, Chlorella protothecoides
caccgcgtcgcagtccacaccggcggcggacgccgggcccaggcctaggagccgcagcgcggtggccgccgccagggggcgccgcgccagcag

SEQ ID NO: 43505 - DNA, 98 bp, Chlorella protothecoides
tttggcgccgaggtgaggcggggcggcagggtggagggccatcgcgcctggaccctgcctgccggcatgtgcggcgccctaccatgtcgtgaggcgtg

SEQ ID NO: 43506 - DNA, 10969 bp, Chlorella protothecoides
  modified_base (325)..(334): a, c, t, g, unknown or other
  modified_base (1650)..(1747): a, c, t, g, unknown or other
  modified_base (3043)..(3052): a, c, t, g, unknown or other
  modified_base (3237)..(3277): a, c, t, g, unknown or other
  modified_base (3356)..(3365): a, c, t, g, unknown or other
  modified_base (3728)..(3737): a, c, t, g, unknown or other
  modified_base (4367)..(4376): a, c, t, g, unknown or other
  modified_base (4442)..(4559): a, c, t, g, unknown or other
  modified_base (5035)..(5044): a, c, t, g, unknown or other
  modified_base (5165)..(5174): a, c, t, g, unknown or other
  modified_base (5371)..(5380): a, c, t, g, unknown or other
  modified_base (8099)..(8108): a, c, t, g, unknown or other
  modified_base (8444)..(8453): a, c, t, g, unknown or other
  modified_base (8632)..(8641): a, c, t, g, unknown or other
  modified_base (8972)..(8981): a, c, t, g, unknown or other
  modified_base (9581)..(9590): a, c, t, g, unknown or other
  modified_base (10649)..(10658): a, c, t, g, unknown or other
cgcaccgacagcggtgcgaaggccccgcgctgcgcgccccagcgcagcgccagcgccgccgccaccaccaggccgaagaccagggtgtcggccgccgcggcgcggtacgcggccaggcccgcctccagctggcggtccacggcgaccagggcgcggcgccgcgcctccgccctcgccacgcctagcgacccggtgcgcagctcattggcctcctctccttgcctggggggcagaggagaggaaagggggattcattgtgtgtgatgcacgctattacagacagagcggggcgatggtggcgtgtgccagctcgtggcatgtgctnnnnnnnnnncagaggaaggggggattgattgtgtgtgatgcaagctgttacagacagagcggggcgagggtggcgtgtgccagctcgtggcatgtgcatgttttaggagcggcagcatcacctcgaagcaccagcgcttcagttgacccagacagagcccacatggcctatgtgaccctgcggtgtgtcagcctatcatgcccgaccagcgtccctccctccctctcccccaccccaaatcacacacctgaccatggcctggccatgcgtgcgggccaggcggacctgccaggtggtgagcacgctgtgcatgagctgcacctgctcggcgggcgccagctcagcgaccttcaggcccatcgcctgcgtcatggtcttcacgactgatgccgctgcgtggagttccgacgtctcggtggcggtcagggcccagccggcatccctgccttcgtgcaggggtgagagcagggcagagctgcccaggcccgtcgcggaggaggaggcatcgtccgtgctggggtcgccgccaggcaagggatgcaggcccgctgatgtcccaggggctcctgtagatccggcatgggcctgactgtcttcttgtacaggctctggggtgtccaatggtgcagccttgtgtattgcagcctcagcgagcaacggaggtgcaggcggaggggtgccggtgagctcctcgagcacttgcgcctctgcagcaggtgcttgagtcccgctgcagggtccagtctcgatctgatgggttgagagggcctctctaccacccgccggaagcaggtcagccgctgcaagggccccaaacatgtctgccgtgccagggagccgagcagcagctgcgcccaagaacactccacagatcagtcccgcagggaaggccagccatcccaacgcatacaaagcgctggctggtgggttcgaaactcttgccgcaggtctgtcacaggcttcgagctccgcgctcttaacctttagcagcgctaggcattcctggaggccacttgaggcctgagaggacgacccctcgggctcggcagctggctttggcagtcggatgggttccaatacaaccgcagggcttgtgggttgccagccacgagggttgtaggatcttcgtaccggctcggggctttcgtccgagctgtgggcgccggacagtagcagggcgacgatgcagagcgtaatggccaggcagttcgccgacttctgtcgtagcattcctacaattgattcgtatattgtgcggccctgccgaagcggtccctgctctacatcctcggtacagaagtgatctgagtgacgacgtggcagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcgcaaggcagcagatctgatcgagcgtgcatccatccgatgccactgccgatcgccggctgggcagtggctgtggctgccgtgagcgctgtggtcacatacctggcaggtaccactggcagtttggaggcttgtgtgtgtgctctgggctgctcctatgacctgatgctccacgattccgacccaaaacgttccaggaaatacgcagtttgcccccggcgcatgctctcgcctggaggctcatgccggcagtttcctggtgggccaggacctggcactcaggctggccaccgacgccatctgcgaccatctggacgacccaaaccctgcccgtcccctgatcctctctgctcatgggccgccgggcgtcgggaagtcgctgttccacctcttggcagcccaggcactgtatagcaagaaccccagcgaagcgatgaaatgccccggccacgactgcgctggttacaaggtgctcggaatgggagaccaggggagttgggggatatggatctaggtgctgaagcgccgaaactgcgtcctgtaggtcaagtttacctgatgcaggtcgatcccagaccctgccagtgccacaggcagagcgtgcggggctggccgggcctggctgacctggctaccatcctcttctcctgacgctgctcatcctatatccccatcacccatcattcccccttccctcatgcacaggtcatgtacggcatggactacgtggcctccgagcgggccgagcagcagggcctgttgcgctccgccctcatagaccacgtgcggcgcacacccgaggcgctgatcgtggtggaggaatacgacaagctggactgcggcatgcgcggcttcttccgccagttcctggagaacggtgcggtggggaacgtcacccttaataaggccatcatcctgctggagtccaacctgggctacctgcagctgctgggcctgctcaaggccagccggagcagggcagaggtgacggcggagcaggcccagcgcgtgctcaaggacctcatcttcgagcgctgggagcggcaggcgtgcgaggaccgcaccgacaccctgaagatggtgggtctcggagggtcttgggtggaggcaggggctgtgatgtcgtgtgtgtttgagagggcgtcggtatcccagaagaggagagacacaggggggcggctgagtcgcctcggtagaggtcaagctggtgcacaagaaacagtcattcacaggcttcagccctcctgcacaccctacctcatcaacacccaatctctcaacccccccccccccacnnnnnnnnnngaggggctgtgatgtcgtgtgtgttggagagggcgtcggtatcccagaagaggggaggcacaggggggcggctgagtcgcctcggtagaggtcaagctggtgcacaagaagcagtcattcacaggcttcagccttcctgcacaccctacctcatcaacacccaacctctcacccccccccccccnnnnnnnnnnnnnnnnnnnnnnnnnnnnnnnnnnnnnnnnnctggcccaggcgggcgtggggcggctggcgtgggacgcggctgtcctcgatttcctgatatcccatgtggagttcgacnnnnnnnnnnccctttcttcccgctggaggccagccacctgcgcgccctgttcgaggcccggctcgagcgccgcagccaggccttggcccaggcgggcgtggggcggctgatgtgggatgcggctgtccttgatttcctgatatcccatgtggagttcgacggcgcgtacccgctggagggtgccaaggaggtggcggtggtgctgaccaagaccgtgtcccgccccgtgcgccgttgggctgaggagcagcagcgacgccaggccccggcctcgacagggaaaggggagggcgcggacgtcccgcactgcgcgctgcaggtggtgaagccgctgggccgaccccggcagctggtctgcgcctgaggcggggnnnnnnnnnnctgggctgagaagcagcagcgacgccaggccccggcctcggcaggaaaaggggagggcgcggacgtctcgcactgcacgctgcaggtggtgaagccgctgggccgatcccggcagctggtctgcgcctgaggcggggctgagggctgattggaagcggggcgccgcggcaaggactcagctgggacgatgggaggtgtgactggacgggttaccatggtgtcctgccgccatgaatgctcgagggaaggacaatggccagggcggctcccagatcctcctcaggaaagcctgagtgcactctccaaccggaatggccaggtgggagggggaacgggaatgctaatgtagtcggtgtcgccttgacatggtacatggatgtgcggccgggaaggtagcacgggtgaatggtcggcgcttggcagttgctgacatgaggcaatagtctgccaccgggggcgccttagcaggctcttgcctgcttctgatggagtgtacaatctccttgctcaacacccttcaggcaatccctccctgcgcagctgtggatcgatggatgtggacacggcggtggacccccccccatcccaccccaccccccgtgctttgccgcagcatttctctgtcgcaannnnnnnnnngatgtagttggtgccgccttgacatggtacatggctgtgcggccgggaaggtagcacgggtgaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccttgcctgcttctgatggagtgtacaatccccttgctcaacacccttcaggcaatgcctccctgcgccgctgtggatcgatggatgtgcacacggcggtgacccccccaatacacccccccctgtgctttgccgcagcatttctctgtcgcaacatttccctatccgcctcgtgataccccgggtcgcatgcatgcatggcgcgtcgcacgtcatgtacagcgagaggatcaagtggcaaagtcagagcgcaagggagggggaagggacggcgcctgtcgttctctgtcggcggcgaacgcagggtcgatgaaggtgggaccggtgcgcggcagcatgaaccctcacgaccgggcgcccacggggagctccaggggcttcagcaccacggcctcgcgccccggtcccaccccgatccacttgacgtgcacgcccagcctcgactcgatgaagcgcacgtacctgtgcaagggggnnnnnnnnnngccatggtgcgccctgcaacccttggggccccccgcatcaactgttcaccaaacaatccggacacagccaacagggttcacaccccgacttcgacacactcacttcttggcgttctccggnnnnnnnnnntgggaggtggggggggagatgggttgtggcaatacagggacggcagggtgtgttgagaattgggcgaggagggagtgaccaggggaacaaaggggcttgccctatctgctgccctgggcttcatccggccggatgctgcacgtcgggcgccaccggagcacatccacatccactcagcagggcctggtccttctggnnnnnnnnnnagcttcatcccgccggatactgcacgtcgggcgccaccggagcacatccgcatccactcagcagggcctggtccttctggcagcgccaccacggtgcgccctgcaacccttggggtccccccgcatcaactgttcgccaaacaaccccgacacacacaacaggtttcacaccccgacctcgacacactcacttcttggcgttctccggcaggtcctcccaggtgcgtgccttgctgatgtcctgctgccacccgggcagcgtctcccacaccacctcggcgcgctccagggtctccaggtctgcggggacggtgggcaggtccccctccggggtccggtaccccacgcccaccctgatctccttcagcccgtccagcacgtccagcttggtgaggttgaggtgggtcaggccgttgatgcgcaccgcgtagcgcagggccaccatgtccagccagcccacgcggcgcggccgccccgtggtggtcccatattcggcgcccacctcgcgcagcgtgtcggccagctcgccgtggatctcggtggggtaagggcccgcgccgacgcgcgtggtgtaggccttggccacgccgatggtggcgcccaggcggcggggcgccaggcccagccccaccaccacgccgccgatggaggggttggaggaggtgacgtaggggtaggtgccaaagtccaggtccagcatggtggcgttggcgccctccaccaggatggaccgcccctcgtccgcccactcgttgagcgcgtgcacggtgtcggagacgtagggcgcgatgcgggccgcgatggcgcggtacgacgcgatctccgcctccacatcgtagtcaaagtcggcgaagcggcgctgcccgtccagcgccagcgcgcgcagcttggcggcaaaggcgtccgggtgggcgaggtcgcccacgcgcaggccgttgcggatggccttggaggcgtaggcggggccgatgccgcgccgcgtcgtcccgatctccttgcccgtgcccgccagctcctcctcgcgccgcccgtcgatctccttgtgcaggtcgaagagcaggtgcgcgcggctgctgatgaacagccggccctccacgcttacgccccgggcctgggagaagggatggaggtggtttttttgtatgtggggggttcttgacaaaggggaaggagggggggttcatgttggggactaggcattggctggcgagggagggtactacagcctggcaagcatgggacagtgagtgccactgggaagccgtcccagctctgaggagaaacagggtgccttcatagacaggccatctgatatgatgtgccgcgcagacgcccgccccgcagcccctccccacacagcgacatggctcgacgcacgaagtgctcccaggcccgcattccatgttaaatcccagaaccaggccccccttgcacacccacctccatgccctcaatctcctccaggagggacggcaggtgaaccaccacgccgttgccaatcacgcatttggccttggggttcaggatgccggaggggagcaggtgcagcttccacttgttgccctccgtgtcgtagatggtgtggcccgcattggctcccccctgtgcaaggtggggtgttgcaggttgaggggagttccagacccgaacacagttgcgggcaggggagtaccgcatggtaggcatggatgcgggccagaggcagtcgcagcctggacactatcgctggctggagaccgtgcagcccacaacacaggtacactcccatggggttttcaggggtcactcggtcccagcgtgacatacacagggctacaggactccattcgcccaacgcagctcccaaagcaaataccccagtacctgagcacgggccacaatctcgtacttctgggcgaggatgtccaccagcttgcccttcccctcgtccccccattgcatcccgaggaccacaacgatctgggggtcaaagggctcctccgtctccactctggcaggcgctgcactggccgcagcgcgcaggcctcgccggggggcgctgcagggcggggccctcctcgtggaagcaatactgcatgtcctcttcagctcgacagctggcctgagacagcccatacgggttgagtactggcatgccgcatgcccgcgtctactgcaggtcgtcggggtgacggtggggctgagcaggagtgacgccatcctgccggcgtccgaggtgggttcggcaccaggagattattgatgaggccagacaaatctaatcagcatcctatcgtcgtccgtgctcacatattccaaatcgtgcaaacggtcggagctgggaagcaaacagcacgttgttgcatgcagtcacatgagtgccctttcctcaaggattgagtgcttggagaccaccttttgttccccaggggaagacatctttctggttccccaacaagacacgaatcgtcatttcaagctaagtaaaagttgcatcatgactgagcaagatttggcacttggtagacattggcacctggaatggctggcttagtgcaaagtatgagctgcctttagtccttcatttggacttcaactttagcacgacctggaggtaaaagttctcaagattgtctgtcaggcacatggataagattttcccaaggttcaaaatgagtaggagtgtgcaacgcgatcccattcgtcagtgtttatggacatgatgtgcactctgacatcnnnnnnnnnnggatttggcacttggtagacattgacacctggaatggctggcttagtgcatagtatgagctgcctttagacctgcacttggacttcaacttgaacacgatctggaagtagaacttctcaaggttgcctgtcaggcacatggatgagatttccccaagattcaaaatgagtaggagtgtgcaacgcgctcccatccgtcagagtttatggacatgatgtgcactctgacatcggtcgcatgagcagcttcctcagcgtataccgaaaactaccactcccacctaaaagattcagtcgtatcacgacgagaaggttctgagctgcttggccaatctgnnnnnnnnnntgtgtaccgaaaagtaccactcccacctagaaggttcaattgtatcacgatgagaaggttctgagctgcttggccaatctggtgccaaagcgtgtccaccttttcttcaggacagctgccaagcacatgcagcgggagaacgcgccgaaaggaaattctgcgagcgcggtaatgtgacnnnnnnnnnnggtacatgcagcaggagaacgcgccggaaggaaattctgcgagcgcggtaatgtgacttcgcaagttcccactgccctgatctgtgtagcactctgtacctattcgaatcgtttgaaatttcctataaatggtccgtatgcatacactctagttgctgcccccctcctgcttcagagggtgcaagcctagaattctgcccactcccctcgccggggcttggatgcttcagagcgcccgtacaagctcccatgttattatttgcatactgttgttgttagctggccccggcctggccgcggcagaggatgcggtgagtggccacgtcacatnnnnnnnnnnctcagagcgcccgtacaagctcccatattgtcatttgcatatttttgttgttagcttgccccggcctggccgcgtcagaggatgcggtgagtggccacgtcacattctgaccgccggggtgcatacgtgtgatctctggcatcctaccacttaggcgggttgccgcgcgacttcaccgcaggactccaagtgccagtcggttagggacctgcctgccgaccaggatcggtgtgcatacgccgagacctactgtgagacggacagcctgttcgactacaccaaggcatactactgccatgtataccccactccctggaagcaggggctcatgatcgtgagtcgtgttgctgaggccaagcatgaagttttgtgggcccaatcctcctgttgtcgtcaagggatggtcggccgtgctgggtacctctgtggggaatgcttgtgagaatagcagacgccgacaagcacgcagagccgtcaagttctgggcaagcgtgccagaggtcagcgcactggcttggtcattgttggcgacgtattctcacctccctctcccccctcattccctcattcccccgcaaccagactgcatgtgtcctcctnnnnnnnnnnagtacctctgtggggaatgctcgtgaggatagcagacgccgacgagcatgcagagccgtcaagttctgggcaagcgtgcaagaggtcagggcactggcttggtcattgttggcgaggtattctcacttccctccccccccctccttccctcatccccccgcaaccagactgcatgtgtcctcctgctactcaccctgttccgggtgatggccctggccgcggacgagttcttctccgtcatcctgtcccagatctcccaggacctgggcctgcccccgcgcctcgctggggtcactctccttgccctgggcaatggtgcgcccgacctctcggcgagcgtcgcggccgtcaagtctggcaatgtcgagtgagtgttgtcggctcgggcatgcttgtcatttgggacatggccatgggtgacttggcatggaaagcgggacaaggctggctcagcctggacatcgcaagaaagtgccgattatccaggtctaatccactgggccagttgcaacaaaccccgtgccgcccttttcccctcccacccaggctggcactcggcgccctgaccggcgccagcatgtttgtgacgtgcatcgtcgccggcagggtcatccgaatctgcggcggcgtgtctgcccgcggggcacagattcgagacatcgccttttttgctgcagccctcgtactgatcgccatcgtgggtgagtggatggagctatgcctggcatttatggaagcgagtcttcaagtggcgcctctgttactgcccagttcaaggccacaaaccttaccgctgggacggtcttgttggcgtagcatccagatccccagggcgtctgcccagggtccctttttgtgcacagcggtggctcccagccagcagcctgcttgcatcctgatgtccttcactccagccttccgctcaaatgcacccatttccttttcctgcatcgtgtgcagtggggtccggcagggtgaatgccggcgcggtggcggccctcctcctgctctacatcacctacgtggcggtggtggcgctggccgacatcagcaagcgcnnnnnnnnnnaaatgccggcgcagtggcggccctcctcctgctctacttcacctacgtggcagtggtggcgctggccgacatcagcaagcgcgcgggcgtggcctggacccgcctcctcgacccacgagtcatgtgcgcggagggtgggacccccagcccctggaccctgtccctggtgtcccgccggctgcccccggggtcgcgcctcgcggccccagcggccctgccgctgcccgccgccgcctgggcgctgctgggctccgggcccacaggcctgagccttgctgcccgttcccgccatgcccacccccgcctccccc

SEQ ID NO: 43507 - DNA, 61 bp, Chlorella protothecoides
gaacggctcacggctgattcttcttcttccccccagcaatctgaggtgccatgcagccgcc

SEQ ID NO: 43508 - DNA, 627 bp, Chlorella protothecoides
cccggcgcggcgcggtcgtccggcggcgacgcggcgcggccgcgcacgcgcttccgcgaggccgacctggcctgccccatctgcctggaggtgatgtacaagccggtggggctggtgtgcgggcacaagttctgcaagcgctgcgcgctggaggccgcggggttcggccgcgccatgggcaccttctcctccatcgtcagccacgtgccgcggcgcagcgtctgccccgagtgccgccagcccgacgtctaccgcggcgcggtgtcgctgcgcgaggtgggcaagctcatcgcggcgcggcacccgcaggcgtgggccgagcgcaggcgcgaggaccgcgagcgcgagcgcgccgctgccgaccgaatgctcaacgagaccatggactcgtaccggcccgtcctccgcgcctccagcgtctacgagctcctcttctgacgcaggcgcgggggtggcgcgcgctgtccagagagaagagaagggcaggggcccgcacgcccccacccccccaccctcacgccacccggcgatgttgccacccgcccactccgatcctcggcggctgccctggggtcgcaccagcaagacccactcaccgcccctcgagccttccgccaactgttgccc

SEQ ID NO: 43509 - DNA, 61 bp, Chlorella protothecoides
gagcctgagcggcatcgcgccccggcaccgaccctccaccgcaccccccgcccctgctgct

SEQ ID NO: 43510 - DNA, 137 bp, Chlorella protothecoides
tggcgctgcccccgtcccgcgcacgaagtcgggcgactgggccattccgcgtgggcacgaggagggcgcagggctcttccgttctgatggggccggggcgcgcttcacgggcaggagccccttggccgccgacccgc

SEQ ID NO: 43511 - DNA, 79 bp, Chlorella protothecoides
ccacgaccagcatcatgatgctggtcgtggatgagaagcaggatggtgaggggggggggggggggggtgtggggggggg

SEQ ID NO: 43512 - DNA, 79 bp, Chlorella protothecoides
agcccaccgtccttgcagatcgggccaggcagagcacttccccacctggccccactcgcagccgtgcctgcaggcccac

SEQ ID NO: 43513 - DNA, 13956 bp, Chlorella protothecoides
  modified_base (141)..(150): a, c, t, g, unknown or other
  modified_base (665)..(750): a, c, t, g, unknown or other
  modified_base (2917)..(2954): a, c, t, g, unknown or other
  modified_base (3129)..(3138): a, c, t, g, unknown or other
  modified_base (3213)..(3222): a, c, t, g, unknown or other
  modified_base (3604)..(3613): a, c, t, g, unknown or other
  modified_base (3984)..(3993): a, c, t, g, unknown or other
  modified_base (4759)..(4869): a, c, t, g, unknown or other
  modified_base (5531)..(5576): a, c, t, g, unknown or other
  modified_base (5836)..(5845): a, c, t, g, unknown or other
  modified_base (6000)..(6009): a, c, t, g, unknown or other
  modified_base (6821)..(6830): a, c, t, g, unknown or other
  modified_base (6919)..(6928): a, c, t, g, unknown or other
  modified_base (10607)..(10616): a, c, t, g, unknown or other
  modified_base (11374)..(11383): a, c, t, g, unknown or other
  modified_base (11501)..(11510): a, c, t, g, unknown or other
  modified_base (11883)..(11892): a, c, t, g, unknown or other
  modified_base (12228)..(12237): a, c, t, g, unknown or other
  modified_base (13374)..(13383): a, c, t, g, unknown or other
gtcgcgcccgtggcgatgcccgccgcgccggcggcggtgcccgccgccccgcagctcgacgcctgcgcacagcagcagccgcacggtgtggacgcccatgcacgccaggtcgcctggcgtcgtgccctccccgtcgccccnnnnnnnnnncgccgccccgcagctcgacgcccgcgcacagcagcagccgcacggtgcggatgcccatgcacgccaggccgcctggcgtcgtgccctccccgtcgccccggccgccgcccagtcccccgcgctgcgcacgctgaccggctcccgcagctcccccctgctcagcctggcctgggatgggcggcagcagcgctggatccccagcgggaagcaggcggaggaggtgtttgcgcgatcgcctacctgctccgactcgtcctcggcgtcccacgccgctcgggagcatgtggcgcccgggccctcgcccctggcgccggaggctcccgaactgcacggcatgctccctgctgaagcgctgcagcgggtgctgggcctgctggccgccaacggcggcagctctgccggctgggaggcagccgtggcgctggcccgggcctcgcagtagggcagagtagaccctgcagccacaaaggtgtgtgcggcgatgatttgatccagagtctctgtggcaggcctgnnnnnnnnnnnnnnnnnnnnnnnnnnnnnnnnnnnnnnnnnnnnnnnnnnnnnnnnnnnnnnnnnnnnnnnnnnnnnnnnnnnnnncggcgattgtgcggcaaagatgtcgggcagtttccatggaccaaggatggctctcataccgatgcacacctcttctgccctccactcccaggttgcgcacaagtgctagcttggaaccctgtacactttccttaggtaatcctcgtaaccccccctgttcccccttctctggcttttgcctgaacaccgtccgtggggcctggctcggctgctgtcggcgcgcaacaactggccacctgcgcgggcgagtatcgtgtcgagccccatctaccctgacgcgtgagcccgcttttggcccagccctcctcccttttccccgtttgaatgcttatccgccctgcccacccctccctggttttcgtgaggcagtggaggcagccctgtcccggggcttgctctcgcagaacagatactcggctgacagccctttgcgctcggcccccactttgtagcaggacccccccttcctatgaacatatccctgtgcttgaggagacagtcgtgcttcccaccccttctgcacccgccatctgccctactggactggtgggctgcccgttgcagggattccccccatgacttgcatgcaacctgaacagtgttgttggaaatccttctgtgtaccccatggtgcacttgcctgaacaggactggtcttgtaacttattaacagtgctcatggtgggggtcgagtctgcaaggcaaaaggggcttactatgctgacgctgtgcacttgctgttattacaagctcacaacaaggcaggacgcctgagcaatgttccacgacagcattgagggccggggaagtagcccagcgacacgtcctgcccatgcctctgtctatggcgacccctcagaaggaaaacgacagcgcacctatcctgggatcgtccgaaagggttccgtattcgaactttctagtgctctctgagactgtcgcggacccttacaagtatgggactcaagccgggcagcgctagcaccgcaagcggagacacctcggagcactaaagacaacgccaagtatccgaaccatagtccctcaggatgggctcaggcctcaacgcagctgcaccagagttccgacctgcctcggcacctgtcaccattcctgccctacccgatgatccctttgacctcaacaacccctctgaggtgagatggcgccatcgcccgtcatcccacagcggaccctgtatgacagtgcatgggttgaggggtaactcggaaggtgaccgaagaggaccctccggaaccccgacctcaccgcggacccgtgtgccgcgttgtttgagaccccagcaggattcgatggcgctcatcactcagctcctgtgctctagtatcctcgcgaacggccatctctgtcccactgctcacctggctgtgcgatccgaggcgcttcacagtcagcttctctcccggtgcaggtcgctgtctcgcccgatgaattggaggaactggagtcggtcgaggcttgggtgaacatgatggcgcagatcgaggagcaggtgggtggatgagggattggctggcatgaagaccaaggtggaaaagggacgtgcgctgggtttgtggagggggacaccagcggggcaagcccagacagcagccacagccattcccctgggctccttcaagccactggcttgcccctgtgcccaggaacacgagcacctgatcgcgctcggcctgaggtatgctgacaagcagaagctgcacgatctcacgacgcgtgtggcggccctcaagtacggccgctccaagaccagccccgggcagcaggcccaggcgcgctggggcaagcagcggggctgacggtggcgcctgcccgccacagacccccttgcttgtgcaatcgtgactgtacacatgtataggggatgaccctgcctcatgtaccacacctctctgccgcattggattcctccctgctatgcacgcactgtagcctcccgtgcatggcaggccagggcgcagggcctccccctggtccctcctcatcatgctatacctgcatgcctgcctgtacagatcacctggtgtacatccctttggcactgtattgcccacccctctgtgctgacatgtgctccacggattgatgcagtcgagcggaatgtatgtacatgtgtggcaagacaccgacgaggtgtagggaggannnnnnnnnnnnnnnnnnnnnnnnnnnnnnnnnnnnnnggatgggaactggacggggtctgcggagccaagacctgcatcaggcgggcaacagatgcacaagtgtctgtgaggaaaagcagggagactcctgtaagcactgcaacccccccttacaaggatcgccagggtgccgagtggtggcccccaacagctcctcctgcatgaccggcannnnnnnnnntgtggtgtcatggagtacgcaccctgtgcgcttggctgggggtatgcgaagcaatgagcactcgtccctctccannnnnnnnnnccagggagactcctgtaagcactgcaccccccccgcacaaggatcgccagggtgccgcgtggtggccccccaacagctcctcctgcatgaccggcagcccgcgccgtcattcatccccatcgggcagacgaggcacaggcttcagctcatagtgatctatgtccacgttggccctcagccggtccatctcctcatggagatcaaacttcttggagcgctgcttggctgccggtgcatgcaggttcagctccttggtttgagcctcctacgggtgcatcattcacggggagagttgcggataagatgtgatcttgtggtatcatcacaaaacaaagaccatcactgtgatgatccttggcatcatacacccgcatcctacctnnnnnnnnnntataacatgtgatcctgtggtatcatcacaaaacaaagaccagcactgtgatgctccttggcatcatacacccgcatcctacctgggcatcgattcggccttgaatggtcctcgagagaccgacccagccaccgacagtcagcacgatgaagggcagaccggctttggcgaatgcgaacgacttgttcttactcatgagctctcaaagttgcatcaccctcccgcgtgagcatgaggaagggggagtacaaacctcgaccacctcgctcacgggctgaaatagcatgcgtggatgtctgtggcgcccccagattatttccactgacttttaaagctctcgttatttcatgcacgcgttcgatggtcctaannnnnnnnnncagtacaaacctcgaccacctcgctaacgggctaaaatagcatgcgtggatgtctgaggcgccccgagattatttccattgacttttaaagctctcattatttcatgcacgcgttcgatggtcctaatcagagtccatcgaggaggatgctcagttgcagacctgcagcatgtgctccaggcatgagatggaaaggacgcctgttcgccgctggcgaatggagagcaataggcgactgagaagcgcattccagtgacaagctgccatctctcgtaccgagtgaagagggcacccccataacattgtcctgcgcagaagctggggtagctcagtatgttggacatcaacatcttcaggccaggtgcgccagccgcaatgaccgggcccgccgtacacgaggccgctgtgtatgaatgcgagtgatcgatcgggctacatcacactcccgcagagaaggggggcgatcccgaggtcgtgcgggagtcccagcgtcggcggtacgccgacgtggccttggtggaccgcgtagtggagctggactccgagtggagggatggtgagcaagaccttgcagcagagagctctgtgtagcaccaggggcatggtgttcaggcacccgagcgcagagctgaaggcgggagtttcgggctgccaacctcccaagcccctgctccttcgcagtgcgcggccgcctggacggcgccaagatggagttcaaccgcctggtgaacgagatcaaggagctgcgcaaggtgaatcgatcggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcctccctttcttacaactctgtaggccaagcaggacgccacagagctgcaggaggcctccaaggccatgaaggggggcatcaaggagctggaggacagggagaaggagctggcggaagcccgcgacagcgcgctgcttcccatcggcaacctggtgcatgacaccgtgcctgtgtccgacaacgaggtactacttccgggggggagagatgatactgccacagagcgcggggctggggttgggaaacgtggcggcggggagggtcggcgaaggcggccggtggagaggatcccttgccccccctgcagaatcagccagatgatgaaattcacattactcaaggatcaaccatcggactgcgcaagcacatgccgacacactcgagttctgatggctgcctgcttggcgttcctgccggggatgaccggcatcgtacttttctgtgcgcgatcgccccctcatgccctgagagtgggaccctgctcccgcatcggccgcaccctcttgacctcgtcccactcattcacacaccccgcaggacaacaatgtggtggtgaaggaggtggggacacccgcccccgcggagggcatgctcaaccacgtcgacctcgtacagcggctgggcattgccgagctggaccaaggcaccgtggtggcaggnnnnnnnnnnnnnnnnnnnnnnnnnnnnnnnnnnnnnnnnnnnnnntggtggaccagcagggtgtttggtgcccagccccgagcccggggaaggagttaaacgcgtgcccccaccctgcagccgtcgcagctcggtcacacccgcgcgtccatcgtcgcaggcagccgcgggttctacctgaagaacgagggcgtgctcctgaaccaggcgctgatcaactacgcgctgcaggtgcgtggtcgtgttttggcctcgttagattcagtgctgttcaggggggggcgtcgagccgtgcctcggctcannnnnnnnnngttggcctcggtaggttcagtgctgttcgggggggggcgtcgagccgtgcctcggctcattgccccacctgaccgagcctggccccacagccccatgcctggagctcacaacctcgaccccaccacctcacatcgcgcaccccccccccccccgnnnnnnnnnncgccccacctgaccgagcctggccccaccggcccatgcccggagctcacaacctcgaccccaccccctcacatcgcacccccccccctcgcgcagtttgcataccggcgcggcttcgttcccgtgcagacgcccttcttcatgcagaaggacatcatggcggagtgcgcgcagctgagccagtttgacgaggagctgtaccgcgtgagtggggagggagcggacaagtacctgatcgccacggcggagcagccgctgtgtgccctgcaccgcaagggctggttcgagccaggcgagctgcccgtcaagtacgtgggctactccacctgcttccggaaggaggcgggcagccacgggcgcgacacgctgggcatcttccgggtgcaccagttcgagaaggtggagcagttcgtcatcacctcccccgcggaggacgcctcttggcgcgcctttgaggagatgatcacaaactcggaggagttttatgccagcctggacctgccatacaggtgggggtggttttggttggaagggggcggggtgggcaggatggaggaggaaggaggtgtggggcagaggggggcattgcaagacgcagaggaaggcgaatcctacagccgggacgaacagcagcctggtttgctttgttcactgcccttcatgtgcaccatgactcacccactcgctgtcatggcatgacctgcctgttcacttgcgacccccgaccccctgtgaacagggtggtcaacatcgtgtctggggagctgaacaacgccgccgcgaagaagtacgacttggaagcgtggttcccgnnnnnnnnnngctctgttaccaagactggaagggaggtgctcatggggacctttcccctgcataggcggtgttactggtgtcctcacactgaggtgatnnnnnnnnnnacgacccccgatcccctgtgaatagggtggtcaacatcgtgtctggagagctgaacaacgccgccgccaagaagtacgacttggaagcgtggttcccggcctcccagacctacagggagctggtctcctgcagcaactgcctcgactaccaggtatggagactgctgtgggcaggggatgtgtgagtgagtggggcagattaaggcaaggaaccctggataattctggagggacatcccaaggcagttactctgtttccaagactcgagggaaggtgctcatggggacctttactctgcataggcagtgttactggtgtcctcacactgaggtgatgcacctggtggcgagcagccagcccgtcttataaaccccccaccacaagtcatgcagtcgcggcgcctagacatccgcatgcgcacccccaagggccccgccggcgagaccaaaaaggaatacgtgcacctgctcaactccaccctgacagcaacggagcggacgctgtgctgcatcctggagaaccaccagacgccagagggcatcaggtgcggcgtcggatttgctgtacctggggcgaaggtttagtgcatgccatcctgagggcgcaaatacactctgccgcagcagcccacccattctatttcccaaccgcaatacctgcagggtgcccaaggttctgcagcccttcatgcccgacatcgactttgtcaagttcagggcgcccctggacaccaagcgcaagtgagggatcggtgggggctccggctggtacccaaatcccgctcccccaaatctcttgtgaccttgtgcagcctggctgcgaccccacctctgccgccaacgattctccagcttgcacaacacaactccctgtattacaactctcggtacagtaccaatttgtcctatgtaaatggaaccactgccagcaagggatgggtgatgggtgggcaaaacttgggttgagaagtgggaggggcagcagcagagtagcaagggggggccatctcaagaaatgacgcgagatgacgctctccgatgggaagacaccgtggctggccccagcgcatacccgcaggttctaccagaagctatggcttctgtggtttgatgtgagatgaggggagggggggatttgagacacacacaaacaaccaaacaggattgtttccaacagcgcagtgcagtaaaacctgcgtaacccctccccacaaatccccagctacagcccacacctgccgcctcacctgcaggcgcgccgcctcctcggccagcttgtcaccagtgaacttgttctccgagaacagggagactgtggcccacaggcgggccttcaggtgtgggtcgttgctggcccctgcgacctcgtccaccctggaagaagggagaaatccatgtgagggacatcagcagctgccacatggtttggcagggcgcaggctgatcaatacgtgctgctctcacggcaacgatatgttgtgtcatgggtcccagatggggagaaacaccaaaatgtaacaacccttccctcctgcctcagataagcaaaaggttaccaaggcacaagagcctcacaccttcggcccacatcgcccaagtacttttttgtcttcatcgccacgaggctggcggccatttcggcgcccttgcgctccaaggtccgcagctttcgcaccagcgtcatggtctccccgcccagcaaggtctcggcctgctccagggttaggggcgacgggcccccggcgcccttctttcctgcagggtgtgcgctgccgggggcgcgcttgggcgccggcgatgcggaccccggccgccgtgccggcgcagccttgacgggccgccggtgcatcttctccagctggcgcagtagtgcatgcactctcgtctccaggaaagatgctgcatgggatgatgacacgatgggcaaaggtgggtccgcaggccgtggcttggccaagagacaatagcgcacaccgatgtcagcaacatcaacaccctggcaaagcgccgccgagcacctttgggcatggctgcgccggcctccctcccctccgcgctgggcggccccacggcgttcaccaaccatgactccagacccagctccgggtcctcaatcagcctgggtgtgtaaagagtgtgggttgtgagtggcaaatggcaggaacctatgcctgctgcctgagagggaaaggtgcattcatacagtcgtatacaagagctgcctggcgcattctcactcgccaggcgtcctaccacacgtcgtttgccacgccagccctccactctccatgctcacacacctgtcccagtgcccgatgccatgtcggtggacgcccaccagcaggcatgcatcctgggctgcgccccagccgcacgccttcatccactgcgtctgcggcgcggtctcccccggctccagccggaagccgccgggctggccacgcccctgtaattcgcaggtgtgaggcgggttggtaaagcagggtgacagccagactggccagtcacccaggtggaccctcccgacacacatctgagcgtcgcctcccgcccttgcgccgattggtcaagtgaaccagcgcaagagtccaaagcatcttgcctgagtgatgagctcagactgcccagcatgaagccctcccttcccccgtcctataaaaccaccataaaaaggaactcacccccgccccagccagcttgctattcagcaggaacatgccgacggccatgtgctcaaactcggcggccttgacatctaccccgaaaaagtccaggtgggcctccggcgcccgctcgctgccagacggcgacggccccgcctgcgcggcggctgcctcgattgcgtcgcgacagcccttgcgcagcccaaaccagagcgcccgcaccgcatcctgaggggcagcagccagcaggccccccgtgtcagctgcgtggagtgagggtaaggggtgtgagactgggaccacgatgagccagcagctcacacatcagtccctccatgtcccaaaagcacatgacagggagcatcaagacacaaacaagaaacccggtttcacatcccaaacaaaccaaatcatccccccccctccccacctgccatctcggccagcctgccggggtgcaggtagcggcgtgcggcacggaggaaggccgtggcgtccttcttagaaagcgcggagggccagccggagggcgggggccccaccgccgcttggtctggcgcaaaccccgcggcgtccaccggcggcggccagcgtgagatccgggcatgcgctccctccacgctggcggcggccttggcggccttgcccttctttctcggacccggattccaggccggggcttccccctcctccccgtcctcattgtcatcctcctcggcgagcgacttgccgcctggttccagcaaccgcagccgcgctgttcggatgcccggctcctcctcaccctgcgtgcggcagcaattgattgtcggaaccgggggcaggtcagggtgtaggggcttctggcttggaggaagttttagtcttctcccagacgctactctggggttattctcacgtgctcgtcgatgcctcataagctacaatactccccgcagaatctcctcccaccgctgccccatgccccgttcaccctgcaccacctggcaaacaggatcaacaccatcaccccaatnnnnnnnnnngtgcctcgtaagctacaatattccccgcagaacctcctcccaccgctgccccatgccccattcaccctgcaccaccgggcaaacaggatcaacaccatcaccccaatgacccccgcgcccacctgcgccgcctggctggcctcggcggcctccgactccggtatgagccgcttccagaactccgcgtcgctctccgaggtctggaaggtggcgacgttgaaggcgcccagcagctccgccccgggcccgccctcggcccccttggcgctggccaccacctcagaccgggccaggatggcgtcgatatcctcttcatacagcgcctggccctgggaggctgtggccgcctcgtcctccttgaacaggtcctccgccccgaagcgcaggatggcggccatttcgtcctttccaaacagcttggtgcccgactgaccgccctggggtccgcccaggactgtgcggccggaggtgtccatgcgctgaatgaccaggtggtccagcaccatcttggccttcgccctctccagaatgtcctcctccaccgacccggaggtcacgaagcggtagatgttcaccgtgtccttctggccgatgcggtgggcccggctcatggcttgcaggtcgttctggggattccagtctgagtcgaagatgatgacggtgtcggccgtggccagattgatgcccaggccccctgcacgggtggacagcaggaacgcaaagtccttcgaccctgcgcggtggtatggaggcggggnnnnnnnnnnatgctcggcatttcaacccccccatagaattctaattcagagccgagccttgccacggtatgagaacccccccgcgccccccacgtccacaccgccacccaccccggcacccacccgnnnnnnnnnntcctttgtgactgcagtgggtccatgcgccctagaagtcctcgttcctccacaggtgctcggcatttcagcccccccatagaattctacttcagaaccgagccttgccacggtataagaacccccccgcgccctcaactacacaccgccacccaccccggcacccacccggggcgttaaaggcctccatggcggcatgccgggcctgggctggggttgacccgtccaagcgctgcgtgctgtagccgcacaggcggcagtagtcggccaggatgtccagcaccctcaccatctggctgaagaccagcacccggtgccctgactcatacagtcgcttcagcaacttgtccagcagcaccatcttgccggaggtnnnnnnnnnnttcatgcagccgcttcagcagcttgtccagcagcaccatcttgccggaggtcagcaccaggcgcgaggcctcgtccatgtcggactgggccttgcgacggtatatctcctgtggtaaagaggggtggggtagagactgggggtagtgagagggggggggggctcaggaaaagaggaagttgggatgagccatcacgatgcaggtgtgcagagcggcacccacccttttccaaagacaccgtgtgagtcgggcccatgtaggcccccttcaccccaccgcacacaacacatacctcggccgagtcgaagaggaaggggtggttgcagcactttttcnnnnnnnnnnagtgtgagtcaggcccatgtagaccctcttcaccccgccgcacacaacacacacctcggccgagtcaaagaggaaggggtggttgcagcactttttcaggtccatgatgatgttcagcagcgtcagctgggccttggaaccctgtggtttggcgaggggagtgaagggggccgttttggactcagcatacacaaaagatgccagagattttaggcacggcacaacaatccctgtgccgcccgcacacttcactcgccttgttcagctcctggtagttcctggacaggatccacttgtagtactgcttctgcagcggcgtcatgccgacgcgcaggatgcgctccgtcttgggcggcagcgacctctccacatccttgatcacccggcgcagcaggtgcgggcgcaggatagcgtgcagcttccccacctgcaaaggcagagggattgggtggaaatggagggtgacagctggtgtcgtcatgccaggacagtctgcaatgcatgccacgttgctgatgctgtacctctgaagtgacagatgaggcccaccgccaatgaccctgccaagaatcccagtaacccacctgctcggagtcggtggtgtcgtacttggcgataaactcctccgcgctggggaacttggccggctccaggaaagagagcagggcccagagctcacggatgttgttctgcagttgggtttgcaagggtgggcagctcgagccagtcatcgggaggggtacggctaggggtgggcgaaacacacaatgtggtgggctgtgtacgcaaactcacccccccccatgcagccacatgtgcaggcctttgggaccatcaccccttgcctgctcccctttgacggcaaagcctgttactgcctcatccttcttcaatcccaacgacatttccatgcaccctaggatgtgcgtacacctcctcagtctcccccctcttggtaccacaggcacatcgcacccccaccctacccagcatcacccccctccccccttgaggggcttgcctggaggggtgttcccgtgaccaggagcttggacttgaagctccaggcggccaattcacggtacagcgccgagtcctcattcttaaggcgatgcgcctcgtccaccaccaggtagnnnnnnnnnngctcacggtacagcgccgagtcctcgttcttcaggcgatgcgcctcgtccaccaccaggtagttccagcggatggggcgcaggatggcggcgtccttgatcaccatctcgtaggtggtgaccagcacgtcaaaggcgggcacggcggcggcgccgccgcgccccgcgccgccgccgccgccaaactcgaactcgcggatgacctggcgcgaggcggcgtcaccgacgtagaccacggtgtccagctgcggcacccacttgtcgaactcccggacccagttggggaccacagagagggggacgaccaccaggaagggcccggagacacgctgggcaagggccagccagcccatcagcgcggcgcactgcaccgtcttgcccagccccatctcgtcggccaggatgcagttgacgccgcgcgcccaggagtaggacagccagttgagggagtccagctggtagtcgcgcaggcggccgccgcgcaggaaggccggctgctcggccagggccttggtgccggcggcggcgaactcgcgccgcgcggcggccacgccgacgcgtggctgggcgcgcg

SEQ ID NO: 43514 - DNA, 1086 bp, Chlorella protothecoides
  modified_base (331)..(340): a, c, t, g, unknown or other
  modified_base (443)..(507): a, c, t, g, unknown or other
  modified_base (644)..(653): a, c, t, g, unknown or other
  modified_base (840)..(849): a, c, t, g, unknown or other
ggcggtggcggggggggcggtgcggggaggggcctgggggaggaggaggacggcatcgacgagcccccggaactgagggagtttgccagggtgagcctgcgtgagtgctgtcgtagtgggagcggtggctgtgtttgggaatggtgttgtctgcgattgttatttgagaggacggtagtgtgcaatattcgtccccggcgctgacaatgtggtggcgccaggatctgggttccccagcaagccccctcccggcgatgccctgcgtcacacaatggagggcctcgcctgacccggcttgcgcggcccgcccccagtccatcctcactcccannnnnnnnnnggttgtctgcgatttttatttgagaggacggtggtgtgcagggattcgtccccggcgctgagaatgtggtgacgccaggatctgggttccccagcaagccccnnnnnnnnnnnnnnnnnnnnnnnnnnnnnnnnnnnnnnnnnnnnnnnnnnnnnnnnnnnnnnnnnagtggcggccgacatggacctcagctccctgctcccgccaccctcccccctcgggtgaggcgcctgagtgttgccgtgccatgatcaacaccgatgccaggcccgaggaatagccggtctcgcacctggagccgcannnnnnnnnntgggtgaggcgcctgagtgttgtcgtgccatgatcgacaccgatgccaggcccgtggaatagccggtctcgcacctggagccgcacctgttcctccccagcatccaccgccatcttcatcataccagatcccgtctactccagtcccccaacccccactccattcccccctcgcccacgccaggctnnnnnnnnnnagcatccaccgccatcttcatcacaccagatcccgtgtactccagtcccccaaccccaactccattcccccctcgcccacgccaggctggtgcggcgcggcctgggcctgctggcctgcggtaccgtctccctggtcggcagcctgggcctggccctggcccaggcggccgacggcgcgctggccgccgtgccgcccggggcgcgcgcgctgggcctggcgcccacctgcggcgtgg

SEQ ID NO: 43515 - DNA, 73 bp, Chlorella protothecoides
ctgagcctccagcagcgcgcgcgtgtccccgccgcctgcctcatgggggtggcgccgctggggccccgccgcc

SEQ ID NO: 43516 - DNA, 34518 bp, Chlorella protothecoides
  modified_base (118)..(157): a, c, t, g, unknown or other
  modified_base (3695)..(3704): a, c, t, g, unknown or other
  modified_base (5712)..(5721): a, c, t, g, unknown or other
  modified_base (6054)..(6063): a, c, t, g, unknown or other
  modified_base (6385)..(6394): a, c, t, g, unknown or other
  modified_base (6682)..(6691): a, c, t, g, unknown or other
  modified_base (6859)..(6868): a, c, t, g, unknown or other
  modified_base (7202)..(7211): a, c, t, g, unknown or other
  modified_base (7354)..(7363): a, c, t, g, unknown or other
  modified_base (7418)..(7427): a, c, t, g, unknown or other
  modified_base (7975)..(8207): a, c, t, g, unknown or other
  modified_base (8265)..(8274): a, c, t, g, unknown or other
  modified_base (8835)..(8844): a, c, t, g, unknown or other
  modified_base (11890)..(11899): a, c, t, g, unknown or other
  modified_base (12203)..(12212): a, c, t, g, unknown or other
  modified_base (13247)..(13256): a, c, t, g, unknown or other
  modified_base (13689)..(13698): a, c, t, g, unknown or other
  modified_base (14125)..(14134): a, c, t, g, unknown or other
  modified_base (14549)..(14558): a, c, t, g, unknown or other
  modified_base (14725)..(14734): a, c, t, g, unknown or other
  modified_base (15091)..(15100): a, c, t, g, unknown or other
  modified_base (15775)..(15822): a, c, t, g, unknown or other
  modified_base (15978)..(16135): a, c, t, g, unknown or other
  modified_base (16229)..(16238): a, c, t, g, unknown or other
  modified_base (16815)..(16824): a, c, t, g, unknown or other
  modified_base (17255)..(17264): a, c, t, g, unknown or other
  modified_base (18132)..(18141): a, c, t, g, unknown or other
  modified_base (18568)..(18577): a, c, t, g, unknown or other
  modified_base (19881)..(19890): a, c, t, g, unknown or other
  modified_base (20161)..(20170): a, c, t, g, unknown or other
  modified_base (20336)..(20345): a, c, t, g, unknown or other
  modified_base (20403)..(20412): a, c, t, g, unknown or other
  modified_base (20858)..(20867): a, c, t, g, unknown or other
  modified_base (22095)..(22104): a, c, t, g, unknown or other
  modified_base (23042)..(23051): a, c, t, g, unknown or other
  modified_base (23878)..(23887): a, c, t, g, unknown or other
  modified_base (24889)..(25007): a, c, t, g, unknown or other
  modified_base (25288)..(25297): a, c, t, g, unknown or other
  modified_base (25568)..(25577): a, c, t, g, unknown or other
  modified_base (25814)..(25823): a, c, t, g, unknown or other
  modified_base (25982)..(25991): a, c, t, g, unknown or other
  modified_base (26625)..(26634): a, c, t, g, unknown or other
  modified_base (26868)..(26877): a, c, t, g, unknown or other
  modified_base (28227)..(28236): a, c, t, g, unknown or other
  modified_base (28441)..(28450): a, c, t, g, unknown or other
  modified_base (28627)..(28636): a, c, t, g, unknown or other
  modified_base (28993)..(29002): a, c, t, g, unknown or other
  modified_base (29071)..(29080): a, c, t, g, unknown or other
  modified_base (29143)..(29152): a, c, t, g, unknown or other
  modified_base (32099)..(32108): a, c, t, g, unknown or other
  modified_base (32198)..(32207): a, c, t, g, unknown or other
  modified_base (32314)..(32323): a, c, t, g, unknown or other
  modified_base (32701)..(32710): a, c, t, g, unknown or other
  modified_base (32909)..(32918): a, c, t, g, unknown or other
  modified_base (33295)..(33304): a, c, t, g, unknown or other
  modified_base (33485)..(33494): a, c, t, g, unknown or other
  modified_base (34264)..(34273): a, c, t, g, unknown or other
caccgcctcgaccacgctcagcggcagcctggaggtgggtcggggcccggcgggcgcgccgccggccggcgcgcccgctgccgtcggcgacgccgagctggcggagaggctgggcagnnnnnnnnnnnnnnnnnnnnnnnnnnnnnnnnnnnnnnnngcccgcgctgctctgaaacatcgaccccggcgcccccggggggggcgtccccggcccacgtgatctcgacggcgcgtaggcttgttccctccgcgccccctcctgtaccccttttctgtgtaacaacaccttcttccagtgtcccaaggtcagggtcaatccccagccgtgggacgcccagcggcaggcgggcccgacgaggtgtgggaccaaagccacatggatgattcgccgggcttgctcgggcgcatgcaggccttgcgagggtgccgccctcggatggaggtggcagccacaaggaccatgtgggggtgctgcaaggggcaggaggagacgacatccagggacaggacctcaccaaaagcctgtcggatgcactgcatcagtcaggtatgcctgggttattatcagcatgtccacggctccattgacctcgcgtttcatgacagagacctgccaggccctggcgctcctccactccatcccccaagcgcccgccagcctctccacgtcatgccacacctgactgcactggtgggtgtgccgtgtggtgtgaggggcgcagcaccagcttgagagtcctgtgctcgttcactgccaccaccctgcacacccctctgcaggtggcgcaggaagctcatcgatgggcctgacggatgctctcgcatgaataaccctcaaacccctccacccattcccatgccgaccagttgccggcgccaacaatcgtgatcttctcgcggggcccccggaatcacgctgcaagcgtcatgattgctcgctgtcggcaggcatgtgcctggaagtgcagctggagaaatgacttctccatgccccactcctgcccaggtgcaatggcagccaatgtacctgccactcctcagctccaagcaggcttcgtggacgatggaccacagcatgctccagctggtcagcgcttttggcagccatctccatctggcctgtcatcttgtcagggggatgccgtacgagcttcaagtttggcagctgatgggttctgacctcctcctcacacgttcgttgggagacagctgtagactcagccaggagccaacctgtcagagggaaaggggatactgttggcgatgtaggggtcaggacccttgactttagggtctgaggaaaccttactctgtcaatgtccaacgtgacccacatactgtccaggaagagatccatataatgacacatcatggcagcttgtgcaaaatccaggaggataggatgatctagctctgtcggcaggtcaagggatgggggatgtgtgctttgcatgaagggggggcaatcggcatcgcaaataaaaagatatgcactaccaatgccacaagaacccccgctggacatacaccagctgcatgggggcttctgcagataccagcccctgcgcagttagttatggtcagccctgatggctgagtaatgggggggaggaagggggcgagagggaggaggggacgacgagggtgggtgcccaccaaaaattgcggggcgaggcacgccggtcagatacagcttgagcaacatcagaatgttgatcgcacctttgacgtcccggtcaacgaccctgacgtcacaggcccagttgtcgcagcgctgggggtcccaggcctccttcgtcccctccacgccctgctgcacctgcctgtcgcggtgggtatgcagggcggtgcggcagccgcagcacatctttgacgtgatgtgctcgtcgtccaccaccaccctgcataccctccgcaggcggcgaggaaagcgcgtccagggcgccggcggatgtcccccgcatctcccctccacggtcctggacggatcagtcgcccactccgatgacgttgacctccctgggagggacccggggctgctgggcgagctgttggatggcccgctcgcgctggtcgtgtccctggaagcacagctgccgaaacgacttctgcagcatccaggccaggccctgccgcagcttggggacgacccacttggcccgctccaggaacacctctgtccttgccacttcatgggtacgtcacctgtggaggtgcgagtgggggtgggatcacaagagtatgtgggttgacgttgctgagacaggccagaggatgcttgtaatgaggtacctgcccgtccacccatcccaaacgtgcattaattgtagaggtgttgcatgaagtcggttgcccaggcgtgccagcgcgccacggtcttcttgcgctggcgatgttttgctcgcgcgtagaactctttggacgtgcatgccagggtgttggcatgctcgtcgaccgcgattaccatctggatgcgctccaggtctatcccaatgatctcctgaatcttgaactcggccgggagggcacgcctgtggtgggataggcagaggggggatgagctgtgctgcagcgatggagtggatgttccagggtacaatgcatgggcaggttgcagcccagcagcgatccttccctgagaatgagagttggaagcatgagaagccacactggcgtccatccactgcagatggctacggggagccggagctgatcaccgtggccagtgctgctgcttctgcttggagcatgctgcgtggggcccaactgcgcatttaggttgtgcgctctgtttgctgtgcgtgtggcgaggggcgcatatgccaagcttactgacgtcagcgctctactgcatgccggaccaatactgggtgcgtgcttgttgtcctggctagatggaatcaaatagatccctcctcggcctgcaccctcctctcaaaacgaagacaggctagttccagcttgcaattggctgactaccaagatgcttcacttcatcatgttccagacgatgtgcgacttgcctagatgtctgcatttcggattccacgcttcccttgaggagttgaagacgctgcggagcctctcttcctagggtgacgatggaggggtcgagtccccgacaaggagagccccaccctgagagtggcagaagccttagccgtcaatatgagcaggtgcagagcaaaaagagatcccttgcaacacaggaatttcgggaaatgcgtggtccgtcaagatctggacctctcagctccttccgcacttcctgttgatgacgaagctgaatgaggggggaaaggagggcctccggtccggtgtaacggaagcaggggggccgctcccgaatctgggcgaggtagcgctggttcaagtgccactgtgtgctaggttttgccaagactgtcttttacaagccctagctcttgctcatatccaaggctagattgccagaatctgctcaccgggacaaacaacaggtatggcctagaaagtatggccgggggcagctacgcgtgagaagccccgtcatatccggcgctgtgcctcgacatctccgaattagatctagtacggcgaaatctatgcaaagtcgtacgcagcaaactctacatatccagcacacgggtactaaccctacccaatgaacattgctgcaataatttcgcatacaagacaacctctctgggcctagnnnnnnnnnnacgtgcccctggaagcgcagctgccgaaacggcttctgcagcattcaggccaggccctgccgcagcttggggacgacccacttgacccggtccagcagcacctctgtccttgccgtttgatgggtaggggacctgtgaaggaggtgcaaatggggggggggggatcacaagagtatgtgggttgatgttgctgagacaggtcagaggatgctttgaatgaggtacctgcccgtccacccaccccaaacgtgcactcacttgtagaggtattgcatgaagtcggttgcctaggcgtgccagcgcgccgcaggcttctcgcgctggcgatggtttgctcgcgcgtagaattctttggacgtgcatgccagggtgttggcgtgctcgtcaaccgcgattaccatctggatgcgctctgggtctatcccaatggtcttgtggatcttgttttcggccgggaggtcacgcctgtggtgggatggcaagagggtggatgagctgtgctgcagcgatggagtggacgtggcagggtacaaagctcgggcaggttgcagcccggcagcgttccttccctgacaatgagatgtggaagcatgagaggccacactggtgtccatcactgcagatgctatggggagccggagctgaccaccgtggccagtgctgctgctcctgcttggagcttgctacgtggggcccaactgtgcattgaggttgtgcgctatgttgctgtgcgtgcggcgaggcgggcatatgccaagcttccccatgtcatcgctctgctgcatgctggaccaatactgggtgcgtacttgttgtcctggctagatggaatcaaatagatccctcctcggcctgcggcctcctctcaaaacgaagacaggctagttcagcttgcaattggctgactaccaagatgcatctcttcatcatgttgcagacaatgtgcgacttgcctagatgtctgcatatcggattccacgctttccttgaggagttgatgacgagacggagtctcccttccgagggtgacgatggaggggtcgagtctccgacaaagagagacccaccttgagtgtggcagaggcttaagccgtcgatatgagcaggggcagagcaaaaggagatcccttgcaacacaggagtttcggaagatgcgtggtccgtcaagatctggaccttccagttccttccgcactttttgttgatgacgaagctgaatgaggggggaaggagggcctccggtccggtgtaacttgagcaggggggctgctcccgaatctggatgaggtagcgctggttcaagtcccactctgtgtaaagttttgtccagactgtcttttacaagccctggctcttgctcatatccaaggccagattgccagaatctgctcaccgggaaaaacaacaggtatgacctagaaagtacggccgggggcagctacgcatgaggagccccgtcacatccggcgccgtgcctcgacatctccaaattagatatagtacggcgaagtccatgcaaaatcgtacgcagcaaactctaaacatccagcacacgggggctcaccctccccaaggaacattgctgcaataatctcgcatacaagacaacctctctgggcctagggtttgtgcggcacgatggcgacgcacgtgcaggcacctgtttggagcgcgatactccttctgctgagccttggcgtgctctccagagtacgtcgaatggacgctctctcctattggtaaatctcattaggatgggagggtgcgcgctgcttgccatgtgcgccaactgtcttccgcacgcctttcccccttctcagggggcctgcacgacgaagttcttctccctcccggctgtcacgtgagtcaaggccggctgcacctggcttgcttttgtggactcttgctcccggatagggcgaagcctgactgacgatgcattgatgttgccgcgcgaagctggatagtccagcgtccggacacggcgcagctgcgttctcaaccttgnnnnnnnnnnattttgtggactcttgctctcggaaggggccaagcctgactgacgatgaattgatgttgccgcgcgaagctgtatactacagcgtctggacacggcgcagctgcgttctcaaccttgccacactctccgtcctcctctgatagctacgggccccatgtctatatgctggaggtcagcagcgcagacgacatctgcaggtgcgggctgggtcgtatcagcttgtgattttgcgatacaagtgcaagccatgtacatgccacaagtcgcggaccctgtgtaatgtcacctccccatcccaagcgacacaggtggatgggctacagcaagtctggnnnnnnnnnnagtcgcatcctatcgtgattttgcgatgcaagtgcaagccactcacatgccagaagttgcggaccttgtgcaatgtcacctcccaaccccaagcaacacaggtggatgggctacagcaagtctggttctatcagagataccaatctttacatcctcggtcttcccgtcaacgccatcaacatgagttcccgtgagatcagcaaggattggtccaccagaatcttggtggccgttgagtgcctcaaggctggacaggaggcttgcaccgcggacaaggatggcaatattggaacaggaaacaaggggaagtacaattttggcnnnnnnnnnngagcaatctctacattctcggtcttcccgtcaacgccctcaacatgagttcctttgagatcagcaaggactggtccaccagaatcttggtggccgtcgagtgcctcaaggctggacagaaggcttgcaccgcggataaggatggcaatattgggacaggaaacaaggggaagtacaattttggcgacaacaacgagggcgactggaacatcggtgagcaagactgggggaggtggtagggtgacagtggtgtccagatgctgcctgagatggagacagcagtttgccnnnnnnnnnnaactggaacatcggtgaggaagactggggggagttcgtagggtgacacaggagtccaggtgctgcctgagatggagacagcagtttgccgcgtaggaccatggcctgactctgaggatctttctggacatttttattcacagggagctctaacaagggaaacctgaannnnnnnnnnatagaaccatggcctgactccgaagatctttctggacttttaatccacagggagctctaacaagggaaacctgaactggggttacaacaataggggcaccaagctgcgttgcaacaatgcggttggtaccaggaaattccgtaacctgtgcagccttaaggaacttcgcatttctgttctcagggactacaaccaaccgctgccttcacccaccaagaatgtgtcccctcccttcccctctcctcctccctctcctcttttcccgtcccctcctttcccgtcccctccttccccatctcctcttccctctcctcctccgccctctcctcctccnnnnnnnnnngaaggaactctgcaagtctatgctcagggactacaaccaggtgccaccttcaccccccaagaaagcgtcccctccttccccctctactccgccctctcctccttccccgtcgcctcctccgccctctcctcctccgccctctnnnnnnnnnnttgccctcccctccgccctcccctccgccctctccgccacctccaccgactctgnnnnnnnnnnccgccctcccctccaccttctcctccgccctcccctcctccgccctcacccccgccctctccgccacctccaccgactctgcctgccccagttctacaggccgcttacaatgataattatgacagggtcattttcactgtgacggcggaatcctacttcctagactctatagtcctctacttcggtgacagcccaaccttcacctggagcagtccgaacacccgtacttatacggcaaccccggagtatgactacttaaagcaaacatactgtttcacttgcatagtgaccgactccaacggtgtgcgctcgttgccgtcaaatgaggtttgcctggattaggaagcctccccagagatggatggtctgctcaggcaaagactgaagctgtaggtccttcaccttccaacccattcatggggaattgatctggtgaccatgattgcccctttttgtgcattgcacgactttttatgatgagccatgctgcatggtgttgtgggggctggctagacctcacaacgtggactgctgtatatgacctaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntagcccacgcccttgtcagacgtggctcgcgggccatagacgcatcgatactgcatcnnnnnnnnnnaggcagccccaccttcacctggagcagtccgaacacccatatttttacggcagccccggagtatgactatttaaagcaaacatactgtttcacttgcatagtgaccgactccaatggtgtgcaatcgttgccatcaaatgaggtttgcttggattaggaagccttcccagagatggatggtctgctcaggcaaagactgatgctgtaggtccctcaccttcaaacccgttcatggggaattgatttgttgaccatgattgcccctttttgtgcattgcacggcttcttatgatgagccatgttgcatggtgttgtggggcttggctagaccccacaacgtggactgctgtatatgacataaagtaggaatgttacaggacaagaccccgaaaacagcgaggggcttgggtttcaagcactgtgccaggcgtcgtagacacattgcagggcacgaatgcaggtggaaagggtggaaggctacgaagagggtgcccccacagcaaccatgctgggctcctgtctcagaaccctgacgatgaaccatgccttgcagccctgctnnnnnnnnnnagatgcaggtggaaaggatggaaggatcagaagaaggtaaccccacaacaatcgtgctgggctcctgtctcagaaccttgacgatgaaccacgccttgcagccctgcttcagcccatctccttgatcagggtggcaggttccctcacgcttacagccaacgcccttggctgaggtgtgctgtggatgtagacatattgctactgcgtctgctctatgaatttctgcaagcttgggtgcccggcggtagtcggcactagggtgaaaggaggatcctctgacaccctgcctcctaacccagccctggcctcacctgagttcacccaagcttgttgccagtgaaggcggtggcgtgggcccgcgcctcgactagaatatcatcagggactcgtgatgtggggatgattgcgatgtgcacagttctgtgtggcgagaccattctcaccgtaggcagcaatgttctcgataggggaccaggcgtggcagggtgactggcccaacaggctcggtctctgccccaaccatcgggatctcgatctcttgggaggctcaggctggcatcacaggggtatcgcccggcaagcgtccttgcctcagacctttggcagtcatgcacagcataggggaggtgccaagagttttgatgtctgcacgttcagatgcaatgtcagtcatgaatgaggggtgcggatggatgactgtcagttcactactctgggcaagacatcgcctaccctttggcaggtgaagggttatgatccctgccagtgtgcacaaacttcacagcaacttggagtagaggcaggacagtcataaggttcacggctcagcggcatcgatcccccctctgcgatggtaggcaaacctgatcaaggtcatttgatgtccgagtgatgccgatcagaggtgattgactcgggatcagtgcttcacccacctgcagggattcgagggcggcacccttggaggcgcggggcgatggcctgttggtgggatcacgcaacaatgtttctatatcttcggcattcaattccggtgttttggtaggtgatggatgggattgctttctgggcacgatgtctacctcgcagtcgagatcgatctgagccagggcgcgacctggcatcaacacctgtggagcctaaagacccaaggaccggacagcgtcaccgccttccacctcgtgaacggtcatggcacaccgtcatcggcggtgagcatcccaagtaatccggtctgccaccagagggcgatccagaggtcgaccaggagcaacgaggctggcgaccaggatcaacctgattgcggagaaggcagtgcgtgcggagcatggaagcttctacgagtaccgtatggaagctgatccgcctgtgacgcccgcttgggcggctgataccatcccctacgagcggcacgtcaaggacagagcacgccgcacccgctccagtcctgggagaggaactggcaagatgcggcacactgcttcttcaaggagctgaaggcctggggaaccttgtttcctaccatggacaccacttcttgtctacaaatataccagcatgcaggcgagcagtgcgtgtgcggggcagcagtgctatcggacgggcaaaggatatgggggagccgccctcccctttcacttccccccatggccgcccaaggccccgacaggcggggctacgggccacgaccaatatgtgcagactgcccttgcattcgatgttttaacgtttctgtaataaattcacacaacaatttgcctcgtacggcgcgttcgcaccccaacgggacatggcaaagccccgcacgattcgaaaatcgatcgacctaacgagggggcttcgcaacccaaataagcattgaaggttctagaaaaggatcgtttaagaatgggccgagtggattggcggtagaagtgggcgttgggactcgtcccgggggtccgacattgtggcaggagacggtaagtcgatagaccggccccccgaacaatattctcgacatgcagagagcccctctgtcgcacacttctcccggatctagtaagcgattctgtgattgaagtgttccgggaagtcttccggtgccattcccttctaaactagcaactctgctctggccatgcacgcctgctactccggcagggcagtcgccgggccgtccctgcacacatttcaacgaaccacgcaccctaccacacgatcaagaggcctgaagcttaggctgtatgcccagagcgccgtgctgctggatgtacgggacttggaggcccgcatcaccaacacccagcagggcgtgctgaagggcgtgagcctgacggtccgggagggggaggtccatgcgatcatggggaaaaacggttctggcaagagcacattcagcaaggtgggtcatgggggagggaaaggatgcccgggatggactgacccaggatggcaatcacgcattcctcccatgccgcgagttgctgctggttggaggtccacgacgttcagcattgccgtttcccgagcaggtgctggttggtcatcccgagtacgaggtgacgtctgggtctgtggactacaaaggggagtcgctgctggggctggagcccgacgagcgctcccacatgggccttttcatgaggtgggcagtgtggagcgagattgaggtgtccaagttgcgctgcatggtgctcgatcatatcacagcatgcctcaggagggtgtcgaccccggtccaacccatatgcttgcgtcccaaagacggggaccccccagcctgtccgccgcagtttccagagccccgtggagatcccaggcgtttccaacatcgacttcctgcgcatcgccacaaacgctcggaggagcgcccagggccagaaggacctggatcccctagagttctacgcttttgtcatgcccaaggtgtggtttagtgtgttgggtcgctttttttctaggggggtggagatgtagccctctttccagtggaaaccggggtgttgcacttgtccaatggtccttcaaccccccgattgtgttggggcgctgcttcacaaggccnnnnnnnnnnagccacaaacgctcggagaagcgcccagggccagaaagacctggatcccctagagttctacgctttcgtcatgcccaaggtgtggtttggtgtgttgggtcgcttttgccctgggggggtggagatgtagtcctctttccagtgggaaaccggggtgttgcacttctccaatgggccttcagcccctgattgtgttggggcgctgcttcacaaggccatgagggctcctttactcccccatatgccattctgcacatcccttacatggttccgccccacacattcacagctggagctgctcaannnnnnnnnnagggctccttcactcccccatatgccattctgcacatcccctacacggttcccccccacacattcacagctggagctgctcaacatggacgccgccttcctgaaccgcaatgtgaacgaggggttctctgggggcgagaagaagcggaatgaaatcctgcagctggcctgcctggaggcggactgctccatcctggacgagatcgattcggggctggacatcgatgccctgcgggatgtggccactgctgtcaatggcttccggaagcagagacctgcagcgggtctcatcatggtgacacactacaaggtggagaggggcagatgtgggcagtgtgagagggagggaaagctggtatgggaagcaggaggggagctcaatcatggcgtgaggctggtggagcgatgtgtgagtcgccggagcctaggacatggaggaactcactgcttgagtttcaacataatgtctcgaggccaccacagcgttggggagaggcctatggtatggctgcccattcacactcactcaaggcaaccctggcgggtccgtcgttgccaactcataccatgagcatgcctgcccacccttcatccatgcagaggttgctggactacatccggccggatttcgtgcacatcatgcaggtgagcgagtggttgtgatctgggagagtgaaatgcgttctaatcacggtttgtcaaccagggatggagcatgggattggaagctcaatcatccctcgcctgagcgtgctcttgcctcgctcacgccgtgcaggatgggaagatcgtgaagacggggggcatggacttggtggaccagttggagctggaggggtacaaggtgctcagcggggccgggcgatgaatgcataatggtgttgcccagggtcccaaatggtgacggcatcgactgacgcttgtaaatgtgatcgacgggagagacgtgagcgtcagcaggggcagccgaggctgatgatgatgccggcctgcatgacgtggcaccctcgacaccatcacctccatgttgaaccannnnnnnnnntgatctgagcgtcagcagggacagccgaggctgatgatggtgccggcctgcatgacgtggcatcctcgacaccatcacctccatgttgaaccatcgcgtgcattgtagcgctcttgttggggtcaacatcatataaaactacactgtggcatggctccgaagacgtcccgcggccgtgccacaaaggcagcggcccagccgtccagggtggccactcaggggaagcgcaaagcggctgtcgaggatgagccgacccctcgtgtgacaagaccacggctagcagccaagcatgagcttgggaccgtggcgcatgccagtcacggcaaggtgtggggttgtagaccggggcggggatccctgccccctcccgggcaccagtgccaccgtattccaagacgggggccgcccaacgctgccatatgcacctctcagnnnnnnnnnnactcgtgacacaagaccacggctagcatccaagcatgagcttggtcccgtggcgcatgccagtcacggcaaggtgtgggtttgtagacctgggcggggatccccgcccccacccgggcaccagtgccaccgcattccaagacggggcccgcccaacgctgccatatgcacctctcaggttccaggtcagctgtttgtgtttggtgatggcgactgtggacagctgggcctgggagaggacgtcaccgagcggctgaggcccttccccctggatgttgatggcaacaaggtgggttggggggacagtgtgttgacttgggaatgcctgtcatgagaaggggtcaagcgtgggatgcatcctcaatgtccctcctgcacctgtgctcccccacgacgcaagcagatcctgcaagtggcgtgtggaggcnnnnnnnnnnagagaaggggccatgagtgggattcatcctcaatgtccctcctgcacctttgctcccccacgtcgtaagcagatcctgcaagtggcgtgtggaggcatgcacaccgtggccctgaccgaggaccatgtggtctacagctggggagtgaacgacgagggcgccctgggtcgcgagacaggtgccgcagcgcctttgcgggtgcaatgggtgggagcagcgggcacgggatgctcagcggcgctgcgcgtgagtctggacgccccgcctcccgcctgcccccctgcacccacgccccccccccacaccccctgcgtagccggggagctgtgggagaagtcaggcctgtccagcggtgtagcaagcgactcctactcgcccggccctgtagacctcccagcgtcggctgggaaggtgnnnnnnnnnncgtagcgggcgactcctactcgcccggccccgtagacctcccagcgtcggctgggaaggtggtccagctctctgcaggcaagcgatgcccccgcaccccttgccagggtcacaagggtcgcaccccctgtggtttttgtcgctgctccccctccaccccctctcccnnnnnnnnnntgatgccccgcaccccgtgccagggtcacaagggtcgctccccctgtggtttctgtcgctgctccccctccaccccctctcccagccccaccccaacctcttcccaggggacagccacaccgcggcactcacggagctgggctcagtgtgggcctggggcaccttccgcgacgcctcgggcgtgtttgggttcagcgcatgcacgcgcatccagctgacccccgcggaggtgtacagcccgcgccgggccgaggaccaggtcgtgcgcatcgtgtcaggtgagtggcggcggatggaggggggccggtgctgccctgtttaccggccgaccccacctgctccactcggggggggggnnnnnnnnnngggaccaggtcgtgcgcatcgtgtcgggtgagtggcggcgggtggaggggggccagtgctgccctgcttaccggccggacccccctgctccactctgggtggtgtgtgtgtgaggggaggggggaggggcacacaccattgttcctgtggacaggggtccgaagagtctacccggacaccagtctcgggatggagcccacccattctaccactgcaacccttgcttgcaggcgccgaccacatcgcggccgtcacccgtcacggcggcctgctgacctggggcaacgggcagcaggggcagctggcgcgggtgggcgagcgcctgtcggaccgcgtgcgggcggccacgctgctgaccccggcccccgtcccgctcaagcgccggcgctcggggcgcgcggcggtggtcgacgtggcggcggggacctacgccacctttgcgctgctggccgacggcggcgtgctggccgccgggctgaacaactacggccagctggggctggagaacggggcgctgccggcctacgcgctgacgcacgtcgccgcgctggacggacgcagcgtgcgtggtgtgcgcggcgggcagcaccacacgctggtgctggtggagccgggggcggggcgggggggcagcgccgacgacggggagggttcggagggcgccgggccctcggnnnnnnnnnnnnnnnnnnnnnnnnnnnnnnnnnnnnnnnnnnnnnnnngcgcgccgctgctcagcttcggccggccgacctacggccggctgggccaggcggcggcggcggtgggctccgacgccgccgcgccggtgccacgcgaggtggacggcttggagggcgtggcgctggcgggggccgcggcggggctggcggggtccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtggaggggggcttgtagatgtggggggggtggagagaagtcgaggccgtttgtggaaaggtgtgcgaggggtttggggcgcttgcatgggannnnnnnnnngggcgccttcagcgaggcgggcgacgcctggctgtgggggtttggcaccagcaaccagctgggcaagggcgacgacgacgaaggtgagcgtagagtgaaggggggcttgtggatgtagggggggggtggagagaagtccaggccgtttgaggaaaggggtgcgaggggtttggggcgcttgcatgggactgaattctgagtcggaatcgtgcgtgtaagccccgcagagtaccaatctgggtctgttgtgcggctgcgtactctgcactgcactccaccgccaatgcagtgttccagcagtcgtccctcccccccacacaaacctcctccagacgaggtagttccccggaagctggctgccaccaagaagctcgcagatcagagggtgatcgcgctagagtttggggggcagcatgccgcgctgctgtgcgtcccccgccccgcacagacgcaggcgggcagccagcaatgacacgcttcagtgcgggcaggcacacatgcctgctgggctcacagggatgcaccatggttttgaggctcttcttcgacaccctggtgccctaaacatctttgactnnnnnnnnnntcagtgacacgcttcagtgcgggcaagcacacatgccttcgaggctcacagggatgcaccatggttttggggctcttcttcagacaccctggtgccctaaacatctttgactcgctgcagctgaaagcttggtttgtgaggacattggatttgcacaagggcaccgttgatcagcccatcagccacatactgtgcagccgcaaagcaagaggcgcgcgcaaaggcacgcgtgaccgaggaattggcaatccacggaggacacaagggctcgacaatggcaacatatatcaacaaactgtaccatagcataacgcgggaattgtacccttaccctggccaatctcgaccggaacttgggcgtagagtgatcagtctgggacgagctgccgtgtgtcgcgttatccacgcgtgcgcacggcatggacttggcnnnnnnnnnncccatgggggacacaagggctcgacaatggcaacatagatcaacaaactgcaccatagcataacgcggaaattgtacccttaccctggccgctctcgaccggaacttgtacgtggagtgatcagtctaggacgagctgccgtgtgtcgcgtcatccacgcgtgcgcacggcatggacttggcatccagatacgatgtcattgtgttggggacgggtctggtggagtccctgcttgcagcgtgagtggtttccaggtggcggaatgcagctcaggattgtgtggaaaggtgctgcccatctccaggtgctacatggtcattcgcctccctccgatccaccaaccgagctgcccccacccccccatgcatgcatcctggcagtgccgcagccacatctggcaagacggtattgcagctggatgcccaggacttttacggcggtcgctgggccaccctgtccatagacgacttcctggcagccctgcgcccaggacaggccgcgggagccactggtttggaagtcgccggcagcacagaccccgcctgcatcggggagtcgcgtgccttcctcgtggacctggcgccgcggctggtctatggcggcgggcccatggtggatgccctgctcgcctctggggcccaccactacaccgaattcaagctcctgcagggcaggtgggagggtgggtgtggcactgctattgccggccacttgtgcagcatcagagctgatgaggcatcggacattcagttgcacctcttggcctgaaacacttcagatcctctgttcccacacccgcagctacgtgctggattctggcgacgcgccacgcctcatgagcgtgccctcgacccgggccgaggtgttnnnnnnnnnncttgatgaggcattggacattcagttgtacctgttggcctgaaacatttcagatcctctggtcccaaacccgcagctacatgctggattctggcgacgcgcaacgcctcacgagcgtgccctcgacccgggccgaggtgtttgccagtcgcgacctgtccctggcagacaagcgcgtgctcatgcgcttcctgcagcgcttctccgggctgctgccgcacgatgagggtggggaggtgcgagaccccgtccccgcagacacccacgaccccgtgctggcgacgccctttgccgacttcatgaccaacacaggcctcttgcgggcggacctgcgcgccaccatcgcacatggcgccctgctcctccccgacccctcgttgttatccaccggggtcgtgctggaccggctcgccctgctccagcgctcnnnnnnnnnnggagggtggggaggtgggagaccctgcccccgcagacacccatgaccccgtgctggcgacgccctttgccgacttcatgaccaacgccggcctctcgcggccggacctgcgcgccaccatcgcacacggcgccctgctcctccccgaccccgcgttgttatccaccggggtcgcgctggaccggctcgccctgctccagcgctcggcggggcggtacggcgcgggctccggcgccctcctctgccccatgcatggcgcgggggagctggcgcaggccttctgccgctcggcggcggtgggcggcgcggtgcagatgctgcgcagccccattgtggccctgcggctggaaagcgcggaggggagccggatcggagggggtgcggcgactgtgagcgacagcgctgggcccaaggtcggtgcctcgaggcctgtctgcactgggatatacctgggcacgggggacgaccgccaggaggtggcggcaggggtcgtcatcggaggggtggcagagattgcgtcggcactgcacctcggcgagcagatggccgatgcagcacagagtcatcctgatgggggagctgggggcgtcgtgcatggagctgggcagccctgtggtgaggtatctgatggcacagccggtggagctgggcagccctgtggcgatgcatccagctgtccatccagcgagcctgagaggccacgggccccgaccttgctgcgctgtgtggcggtgctggatgcgccggcgctgcttcctgggcaggacagggtcggcgtgtgcttgcctcgcccagagggcccggtggtctggatgctggcgctgggccacaccctctgcgtctgcccggaaaacaggtgactggagcatgctttgatgctgacgcctgtggctgggcggggtgtgaggctttcccaaggcaagaaacggactggaccactgcatggcgcccagggtgggaccctgggcctgcagcacggaacacccctgaccccctgcggacaccctgccttgcgcctcattctctcctccaaacgcccgccctcctcaggacgctggtgtacctgtggacagaggcagccgcagagcgcggcgcgcgaagcgtgctggagccagcgctccaggctgtactcagggcggcgtctggcacggccctgttcgcggcgcaaggggccgctgagggaggtggaggaggcggcgtcagcgctggccctgcatctcttctgacggccgtgtactacacagaggcgccgtctgacctccggccagatgcgctgccctcaaatgtgacggcctgccccgaccnnnnnnnnnngggcggcgtcggcgctggccctgcatctcttctgtcggccgtgtactacacagaggcgccgtcgggcctccggccagattcggtgccctcaaatgtgacggcctgccccgaccccggcagcgaagtggcggtggactcgtgcatagcatccgctcggcagctgttccacaggcagggctgtgaccctgatgtgcaagagggctgtacggcgcacaagcctagcgtcaaatggcgatgccccatgctcagggtgcattgacagctctaatgnnnnnnnnnntagggctgtgacactgatgtgcgagagggctgcacggcgcacaagcctagcgtcaaatggcgttgccacatgctcagggtgcattgacagctctaatgcaacatcaacccccgcaggacgtttggtgaggaggcacgcttcccgctcgatcctgatccccctgcgnnnnnnnnnncagcggtggggctccaccccttgatgtttaggtagagtgcagtctcgtgattatcccnnnnnnnnnntaaccctcgcaggacgtttggtgaggaggggcgcttcccgctcgatcctgatccccctgcgccggacgccgaggatgtggcctcagacgaggaggccctggacgcactgcgaaccgctctcagaacagtggatggcaccgaggaggcagccaaggagaatccggatcttggggagagcggttgggctccaccccttgatacttaggtagagtgcagtctcgtgattatcccctttccacttattacaaggtgaagagctccatttcctctgtttgctgtgagaccgcggcgcgcgctttcacgtggatcatcgtatacaacgggcaccatcaaactcttctcggcgcattgccctgtgcatgcccatgtgtgcaatattaagaatgtcctggaactgagttcgatagcattggttatggcaagggccctgaccagaatggggcctnnnnnnnnnngagagccccatgtcctctgtttgctgtgagaccacggcgcgcgctttcacgcggatcatcgtatacaacgggcaccatcaaactcttctcggcgcattgccctttgcatgcccatgcgtgcaatattaagaatgtcccggaactgagttcgatagcattggtcatggcaagggccctgaccagaatggggcctggccgaatggcggagtgtgcagaaaacttaccccggccggaagactacctcaccatcaacggctttcgtttcgtaagtgttgggagtatcgttcaaagtataggtgattcagcaagccatgctatcgctcttttgtgactggcacccagtgccgctgcgcccagtactaggtgaggtaaacccccagcacggcttaccctcgcaaccaacaggtgaagccctaccactttgacttcagctgctccgtgaagcagagatggggtggacaggcgctactggatgtcttctcaaaggtaaggctgtgctgagagtgtacatgtttggctctgggagctctcggctgatcagtaggactgctagtcccccttgcttggatcccccacccacctcccttcgccaatccctccatgccctgcctgcgcaggagtttccggccaggtcgcgcgactactaccgggctgccatagagcagggtcgcctgcgcctggagggcaagccctcctcccccgacaccatcctggcgccaggtcagcgcatgcgtcacgccatccaccgccacgagccgccctgcctggggggcgacatccccgtactcggcgtcacccccggcctggtggcggtcggcaagcccgccggcatgcccgtgcacgtgtccgggcagtaccgcaaaaacacagtgctcggggtactgcaggcgcaccgcaccgatctgggaccactgcatccttgccaccgcctcgacaagcccgtgtctggcgtgctcatcttcgcccgcagccccgccgcggctgacgccctgcgcctgcagatagaggcgggcagcgggggatgggggggtggaggagcgggagtctgggacatgcgtgtcgttttggagggatgcagactgccgaaccgagtgcatcaacagtgcatctgatcgtggcaccacttagccccactcctaccagttctgcgcatgacatttcatcctttccttccatcggcgtaggcccacgaggtgtgcaaggtctacgtggcgcgggtgatggggcnnnnnnnnnntagcgggggatggggggttggaggagcgggagtctaggacatgcgtgtcattttggagggatgccgactgccgaaccgagtgtatcaacagtgcatctgatcgtggaaccacttagccccactcctaccagttctgcgcacgacattccatcatttccttccatcagcgtaggcccacgaggtgcgcaaggtctacgtggcgcgggtgatggggcgcttccccgacaccccggaccccctggtcgtagacgtgccactgtcctgggaccagaagcgcaatcacgtgacggcctgtcccggagcggctgccgtgggggatgcagactccgacctcgaacggggcggcggcgctgcgcaggcgccggtgccggaggctggtgcggcgaacagccagccctcccccccacgcgacggcgccgaggaggacgtggcggcgcgcgcggtgcggcggcacgccttccgcgcccagcgtcgcgaacgggcgagggccaagcaggaggcgcaggcggcgcaggcggcccgcgccgcggcccccgacttccacatcaaggcggccaagcatgccgtgaccgaggttcgcctgctgggcgtcgcgccggacggacagaccagcctggtggagtgcaggtgactcgtgtgtggggaggggtgggggggagcgcagggcttggcgggctgggaatggaaggcacgaccgcatctgccgtgacagcaggtgcagagctgatgggatgtcgaatgaaggatggtgcctggctctgcaagtacctctgcaagggatctgcagagtgcatggggtggcactaccagtccataatcacgtccacacactggcgtggctctgcactccctggcagctccgacccttcctccctcgccctgaccccgtaggccgcggacggggcggacccaccagatccgggtgcacctgcagcacnnnnnnnnnnaacccttcctccctcgccctgaccccgcaggccgcggacggggcgaacccaccagatccgggtgcacctgcagcacgtgggccaccccatcgccaatgacgcacagtacgggggccggtacgcggggcccctggccagccgtgtcatggccgccgcgctgggggtggcctgggaccagatgcgggcggccgccggcatccccgcctggcagccggacggcggcccagcggggccaggcacggtgagcggaggcgaggcgggtcctgagccggcgagtcgtggcgtcagagggtctgacgcatcgaacgacggctgggcagcgccggaggcgtcgagtggcgacgcggccgccaccgcgtccaagaggccgcgagtggcggcagggaacctgggagcggccgatgcaaggggcgccgacgccttccccatcagagagccgccacgtccccaagcagtctttggctctgcacgcaatgcagacgcgtacgcgcagaaccaggcctttcgccagggagaagactacagggcgccggaggggagcctggacgacagctgtccgcactgcccatacctggctcccatggactaccccctggacctgcgcccgctctggctccatgcccgctcctacgcctgcgccgagtgggagttcgaggccccgctgcctgactgggccgccgccggctactgcccagatgcgcatcgccagggtgctggaacatgaggatgggggactatgcctgggatgcctcacaacatgcattttggtgactccaggcaggatcaaataaagtccctctgccattcctcatgctcttggccctgcnnnnnnnnnngtgcctgggatgcctcacaacatgcatcgtggtgactccaggcagcatcaaacgaagtcactctgccattcctcatgctcttggccctgccaagccgtcccgactgataccaatgggggtgcactccatgtgaccagaagcacggcagttcatctgtggggggtcacgagggcagccaaggccttgcagcagagtgtcacccgaccatgccaaagtagtcggaggggttgttggccagggctgtctggtgtgcgtcacccactgaacctggctcctctccgttctccagatccagcttcctcagggcttcctccacagcctctggcctggggaggggccggggtccaagcgcctgtggaggggtccatgggatcaggcgggctggtgggggagcctcaccgggtctgcgcctcttcctgtgatgcattgtctgttctgcacagcgtctccgcgcacgactcagctgtgacaaggtcagggtattgcaactgccctcccaagatcctggaacagtcaccccctcaggggcggaccttgctgccctgcaggccccaccttttgcgcgtcctgcagggtgtcaaagcggggcagggtcttcagacccaggacttcagggcgcctgctcaccgcgctgcccctctgcagggccgccatcgccggcccctccaggaagtcctgcagcgctgccgtgagggcccgggcgccatccggcagcgcccggtggcccatccccggcagcgtgacgacgccagctgccgcggcggcggtggcggcgcgcgccagggccgcgccctcgcccccgctcacccatccgctccttgcgccgaccatgacggcgatgtgcgcggtgacggccggcatgcgccgcaggaccgcgcccgggtcgaagtggaacagccaggcagggtcggcgcggaggtccaagggaccagcgagggcgtttgccgcgagttcctcgggttgggctccaggcggcagccgcacggccgtccatgcggcggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccctcgcgcatcgccgccatccacgccacgcaggaagcggcgtcgtggggccccagcgccgagagcgggtgccccagcagggccgccagctggatcaggccctcgaatcgagcgccctggcccgggtacccgccccaccatggggcgctcagcaggctggctgagatggtggcaggggttgatgaagcagcagcctcgccggcccggctgcgctgccaggcggggagtcgggttgctgggctgcgatagccaggctcataactcttggagcagcccggtnnnnnnnnnnggctgggttgctgggctgcaataaccaggctcataactcttggagcagcccggtccgtcctccacaggtgctccccccctccggtcgtcctccagctgctctggcatcttgccatccttggcgctgccagtctcctcaaatatgggaggggcgaactctacgacggccagggcccctaccaggcgggggcgctgctgggcaacggccatggcgactgcgccgccgacgcccactccaactagagccagggggcgagtgtagaggtccaggnnnnnnnnnnagccagggcgactgcgcccccgacgcccactccaaccagagccagggggcgagtgtagaggtccagggcggtaatgaaggccagcacatcctccgccagcaccgggagggagtagcggcggtcgctggaccaggtggagtcgccgtggcctgtggcgggggcggcaggggcaagagcttccgaaagggaggggggtggatgtaagttttgattcagcctgcacagaaaccgagtgannnnnnnnnnggaggttccgaaagggaggggggtgggtgtaaggtttgattcagcctgcacagaaaccgagtgatgccatgcttgcatctgttgcccgtgccattgatgcatgagttccacttcatcagacccctgtaattcccacctctcatgtcgacggccagcacnnnnnnnnnntcattgatgcatgatttccacttcatcagacccctgttattcccacctctcatgtcgacggccagcaccctcataccacgggcggccaagggccctgccacgggcgaccaggcctcagcaccggaaccagcgtcgtgcaacatgaggacggtctcgtccccgcccctgccccactccagatacctaaggcgcatgcccgtggagatggagaggtggcgggagcgaggcaggtcggcggcaggactacggggccaggcctggacctcgttggccagagaggggccggggctcaggctgtcccgtagctgctgaaagtaggcgcctcggtctctctcggcttcctcgggggtctgagggtctgctgcagggcccagaagggccttgtatgccgccagggcgtccctcaacccggcagccatgtttgacttgcaccttcggagtggcaagtattcagagtggggcactggtcgacaaagtcggcagaagatgagggcatagatattgcatcagtttgggtgtattgcttctcagagatatggctgtgcttcggatcgccgaccagcctcgagtccccatcatacctatgccccccgcaacctcattgatcgcagatcattgcgacacagcggacgcnnnnnnnnnnctagatatggctgtacttcggatcgccgaccagcctcaagtccccatcatacctatgccccccgcgacctcatcgatcgcagatcattgcgacacagcggacgcggtgcaatcgtattaaatgaatcctattgtatgaataaacgccgcagtcctaatgttagagcggatccagcctattcatggggacaaacctcgagtagcaggcccccggtcctccagggggcgcgagccnnnnnnnnnncatgaaatgaatcctattgtattgaaaaaacgccgtagtcctactgttagagcggatccagcctattcatgggggacaaacctcgagtaagaggcccccggtcctccagggggcgcgagccacgtcaggcccggcagcccagatatcgatggatccacagacgagcggagtcgcacctccaaaccatccactcccttaccgagtatatagaggagctgtgcagagcgtagctagtctgcgcggcaccgcaagggaagccccctctgcctgaccaggcctggggtggagggatggcgtacaacgcaggcaccacggctggggagcgggaggtccgcctcccccgcgcgactgcggtgaagaatcgacaggcagcgagcaagcaggtgggtggcgtgctcgttgggtgatgatctcagcttttgtacacgaagggcaggagaccatcccccaccgtccctcccctccatctcttcccaacagattactgcggagcaaatcctgcgtgaatccaaggcactacaagcagatgattttaaagcgcctgtggtcaagatttccgacccggaggagctcgcaggtgagcaggggtgtccctcctgagggggctgccagggtggtatggacttggtccagagtcagattctccctgaatgcatgcatccacagagagagcttgtgcactcaggtttgctccagccaaccagcctgtcctcaccgctgatccccccctccccccaccaccattccacgcagagtaccggctggcgaagcgcaaggagatggaggacgatgtgcggcgggtggggcgctggaaccccacggtctgggtcaaatacgcgcagtgggaggagcagcagaaggacttccggcgcgcgcgctccgtgtgggaacgcgccctggacaccgaccaccggaacgtctcgctctggctcaagtacgtggagatggagatgcggcaccgcttcgtcaaccacgcgcgcaacgtgtgggaccgggcagtgtccctgctcccccgcatcgaccagctctggtacaagtacatccacatggaggagatgcttgggaacgtggcgggggcccgccagatctttgagcgctggatgaagtgggagcccgaccaccacggctggacggcctacatcaaggtacttggggtggggctggggcgtttggaggtccatgtgtgcagtttagcgggcgattgtggagctgtgccctttcccagatggtctgtggccggcagctccgtgcatggccttgctgaccataccatgggcgaccgcctcttgcctggacggtcggcgaggtgcctgcatcgcagcgtttcacatcaccgtcgccccccccccnnnnnnnnnncagatggagctccggtacaacgaggcgggacgagcgcgggacatctacgagcggtatgtgcgctgcctgccggacgtcaagtcctgggtgcgctacgccaagtttgagatgaagcaaggtgagctgcgggtgatgctgttcttgacatgggtctctccttgtcgtgcgctgaggttgctggatgtccaagggaagtgtctgtgtnnnnnnnnnngtgttcctgacataggtctctccttgtcgtgcgctgagtttgctggatgtccaagggaagtgtctgtgtctcctgcacgttccatcgagcaggagcctcggactcgatcttgaagatagcttgctcgtaaccaggttgcctctttattttgacaggcgacgtggcggctgcacgccnnnnnnnnnnagacccaatcttgaagacagcttgctcgtaaccaggttccatctttcttttgacaggcgacgtggcggctgcacgccgctgctacgagcgtgccgtggaggaactgggcgaagactcgcagtcggtgcgctgccgactggctgggccttgcctgccagcttatagacttgagtcgccatgttcctgctgccatgctgtgctcagcaccctacttgtccccttataacctcacaaacacacctctcccctgcaggaggagctgtacattcgcttcgccgagttcgaggagaaggtgaaggagccggagcgggcacgcgccatcttcaggtacggactggacaccctgccgcgctctgnnnnnnnnnncttgagaatgcacctcggcccacagcttttggtggccacctgcttccccttccattcccctcgcccccnnnnnnnnnnacaagcccggaagggggggggtaagggtatatcgtgctttcccgggtgcccctcgcgcccacnnnnnnnnnngcaaccaactgcgcaagcgatatcccgtttgcgggaacaagctgctagcatccggcacaagcccggaaggggggggtatgggtatcttgtgctttcccgggtgcccgtcgcgcccacgtggctccccccttagtcattcccggctgacgacaccacagcagcacagtaattcacccgcccgcaggtataaaccccatgcccctcggccgtcacttgtcaattgcaatcacaaatcatcgacccacattgtatcgttattgcttcttttgtatcctgagcaccgcacccgctagagcgagagactgtcctcgggttccgaccagagcagacgcctgctcagctccacccagactccgcaccgccacccacagcaatggtgggcatggtggacggaaagaccgttgtccccgatgcgccgaaggaggagggccaggcgaccctgaagatgcccgatggttccgagattgttctgccggtgctcctggactccgccggtacccagttcatcgacatccgcaagctgcagtccacgtgagcgtgtgcctcatcggggtgggtgtcgcaatgtgcacgacgtgctcccagagtgctagcatcctcacgtgccctatgtcggagccgacggggatgctgctctgcacacacacggacatgcctcccaccttccatcctgctccccatatccagaaccgggatctgcacctttgaccctggctttgggtccaccgcctcctgcgagtcctccatcacctatatcgacggcaacaagggcgtcctgctctaccgtgggtgggtgacgggttggttgagggagtgtggggggggaatagaacgaggtccatcgcatggcaatcctcgccttggtggctctggcacctgcaccaagtggacatgcagcgcgggctccaccccccccccccccttccataaaccaacaacaggtaccccatcgaggagctggcggcggagggcgacatgctggactccaccttcctgcttctccatggcgagctcccttcccgcgcggagaagcgtgtgtttggccgtgagatcaagatgcacacgctggtacacgagcagctgatccagttctaccgcggcttccgccacgacgcccaccccatggccatcatgtgcggcgtggtgggcgcgctggccgccttttacccggaggtggccaacacgcgtgaccccgcccagcagctgcgcgcctgctaccgcctgatcgccaagatgccgacgctggcggccatggcgtacaagaccagcatcgggcagcccatcatctacccgcgcaacgacctgtcctatgcggagaacttcctgcacatgatgtttgccgtgccctgcgagcgctacgaggtggaccccgagctggccaaggccctggagatcatcttcatcctgcacctggaccacgagcagaacgcgtccacctccaccgtgcgcactgcgggctcctcccaggccaacccctttgcctgcgtggcctcgggcatcgccgcgctgtggggccccgcccacggcggcgccaacgaggcggtcctcaagatgctgcaggagatccaggacctgggcggcgtggagagtatccccgagatcatcaggcgcgccaaggacaagaccgactccttccgcctcatgggcttcggccaccgcgtgtacaagacctacgacccgcgcgccaagctgatgcgccaggtcacctaccgcgtgctggagaagatgggcatcaaggacccgctgctggacatcgccatggagctggagaagatcgcgctgcaggacgagtactttgtgaagcgctcgctgtaccccaacgtcgacttctactccggcatcgtcctgcgcgccctgggcatccctgtggagatgtacaccgtgctcttcgccatggcccgcaccgtgggctgggtggcgcagtggaaggagatggtcagcgagcccgtgaaccgcatcacgcgcccgcgccagatctacacgggccacctgcgccgcaagtacgttgccgacgtggaccgcaccgagagcgggaagatcgagatcaacggcaaggaggggcagggcgtgttcaggggaaacctcctctcccgcatggtctccaccaccgcccgcccctcggggcgctgaaagacaaaccgctaccgggatgcgccatggcgtggacctgcagcgccagcgaggaggattgggacgaccatcccaacctctggcgattggacgccagtggcctgaccctgccagccacccaaccctcccatccaagtcgttcacccctccctgtgttctgccgcatgctccgccacctcaaacccaaggaagaaacactcgctgttatgaatggccctcgaccctcgtggggatgccaccatcctgcgctcccccttttcacttttcgccggcatgcatgcccccccagtcgtgcaattttgctgcggtgcctgcgatgggacgccagggcccctcgcccccggcctggcccaccactcggggcagaccacgcgtgtttcgtgcacctcccccgcatgtttcccatacccctgctgcttgtagaccctgggcttctggtatggatttccgagagtcaaaggtcaagagggcgacgaggaggcagagtgcgcacgtgcagcaagactcgcctgtcaggcgtccacgcccgcctccatgcgcgcccgcttccacttgtacgccgcctccaggatcttgaggttgggcgccgccgccgcctcgtcctgtacgagggggtccgacaggatgggggatcatttcacatggtgggggggggttggatagcggtatggtggacggtgtgcatctggtcgtcggcaggccacaggcccctgctgtcccacccctcctccgctcgcggcggccgccggcacgccgccgcccgcaacctcgagcacccctctgaacccactcaccgggaagatgtagtcgtagtacnnnnnnnnnnccgcttcgccgagttcgaggagaaggtaaaggagctggagcgggcacgcgccatcttccggtacggactggacaccctgccgcgctctgnnnnnnnnnnttgctgtcccacccctcctccgatcgcggcggccgccggcacgccgccccccgcaacctcgagcacccctctcaatccactcaccgggaagatgtagtcgtagtacnnnnnnnnnngcgagtagaggggtgggccacaagctgtgttctgagctatgctattgaatgtgtacgtcgggattgcggccagcatcgcactggcatggtggggaatctgggggacaggagtgtgtttatggaggtccctgggctgtgccggtgagggtccagctgtcagacgcctgctgcatcaagcttctttgcatcaatcgttccccccagggctacaaccttctgaggaacccacccttccttcctctcacaggaggtgatcgtttccgagaggcggcagcagtacgacgccgaggtacgcgccaaccccctgtcctacgacacctggttcgactacattcggctggaggagggcgctggagaccttggcaggatacgggaggnnnnnnnnnngcgtgggcgagctctacaaacgcttcgtggcctttgagaagcagcagggcagcagggaggggatcgaggtgcgcttcgaaccgagggatgggccgcaagctgtgttctgagctatgctactgaatgtgtacgtcgggattgcggccggcatcgcactggcatggtggagaatctgggggacaggagtgtgtttatggannnnnnnnnntcctccgtgccgcccgcgggtgtgccgtcctccagcacgatggcgcgtttccgcttcacccgccgcggcatcttggcggccacggcggccaccgccgcctcggtctcctctgccgggcggcaggtgctggccgcctccatggcgcgccaggcctccagcaggagcaaggcctcctccttggcctccgcctggccttcgcgcagcgcgcggaagccgcgctcgtacacacgccgcgcagccgcctcgcgcgccgccacgcccgccgcgccgccctcggcacgctccgcctcggccctcctctcgccctcgctccccctgccctcctcctccccttcctcctcgcgcggcgccagcagggccagcggcgtggcctcgannnnnnnnnncgcgccggagaagcgatactggcagcgttacatctacctctggatcatgtatgccctgttcgaggagctggtggcaggtgggcgtggcgcgggttttattgggggttcaagatggagactgagagggccctgaaggtgtcatgtgggggtcgctcgacccgactgggtgctggggaatggnnnnnnnnnntccctcgctcaccctgccctcctcctccccttcctcatcgcgctgcgccagcagggccagcggcgtggcctcgaagcgcgcgtagctgagccagaccttgacgtggcgggtgcgggccagcaggcgctcatacagcgcgcgcgcagcgtctcgccgcccgctcgcgatctcgtagtcgatgaaagccttccacagcagctccgggccgtccagagcgggctggctcaccgccatctcgtacagcccgcgcgcgcgctcatcctcccccaggccccgctccagctccgcccagcgcgcccaggcccccgccgaggcggggttccactccacatacttctcgtacagggtccggcaccggtcaacggcgcccagggccagctccatgtcgatgtaggagcggaagagcttgtccttgggggccatgcccagggccatgcccaggatgcggcgcgctgcgtccaggcgcagctgccgcacctcgaactgtgcggccatgatccagatcttggagaaggtgaatgccgcatgggggatgagcttcaggcaggcgcgatacacctctcgcgtccgctcaacgtcctctgacgggacagggatcaaagggcggtgtgtgtgtgtgtgtgtttaagaaggtacatctgatggttgttcaagagatcaactcagccctggactgctgcactctatgcaccagtctggcacaagataccaggctggcgattgtgtgcgacgcctcacagtgaaccattccccagcacccagtcgggtcnnnnnnnnnnggtgtgtgtgtgtgtgtgtgttaaagaaggtacatctgatggttgttcaggagatcaactcagccctggactgcagcactctatgcaccagtcaggcacaagataccaggctgacaattgtgtgcgacgcctcactgtgaaccattccccagcacccagtcgggtcgagcggaccccacatgacaccctcagggccctctcagtctccatcttaccccccaataaaacccgcgccacgcccacct

SEQ ID NO: 43517 - DNA, 79 bp, Chlorella protothecoides
gataaccgagttgagcagcgggttgagctcgcgcgcaaactcgcgcccgcccgcgctgcggaactccagcaccacttgc

SEQ ID NO: 43518 - DNA, 13323 bp, Chlorella protothecoides
  modified_base (421)..(430): a, c, t, g, unknown or other
  modified_base (652)..(661): a, c, t, g, unknown or other
  modified_base (1219)..(1228): a, c, t, g, unknown or other
  modified_base (1753)..(1762): a, c, t, g, unknown or other
  modified_base (2190)..(2199): a, c, t, g, unknown or other
  modified_base (3295)..(3304): a, c, t, g, unknown or other
  modified_base (4908)..(4917): a, c, t, g, unknown or other
  modified_base (5659)..(5668): a, c, t, g, unknown or other
  modified_base (6535)..(6544): a, c, t, g, unknown or other
  modified_base (7937)..(7946): a, c, t, g, unknown or other
  modified_base (8932)..(8941): a, c, t, g, unknown or other
  modified_base (9278)..(9328): a, c, t, g, unknown or other
  modified_base (10695)..(10704): a, c, t, g, unknown or other
  modified_base (10764)..(10773): a, c, t, g, unknown or other
  modified_base (12543)..(12552): a, c, t, g, unknown or other
  modified_base (13128)..(13137): a, c, t, g, unknown or other
ggcggcgcccccgcgcgcgccgcgcgccgagccggagctgcaggaccgcgtgagcttccggcgcatccgcgcgccgcgcggcgacgcgctggccggcgtctacctgggccagttcgggccgcatgggcccgaggtggtgcagctggcgcgcagccgccgcgacggcgacgagtgggtgcacgccaccaagatcacgggcgaccgcaacgtgccggcaggggagctttcgttcaaggcgcgtgtggggcgggagcaccgcctgcccaccgccgtggagggctacccgccggagctgggggtgaccgcacgctacgctggccgcggccgcgttgccgagccggtgagtgagacacgattggggggcccccgttcgttgcgggcccgggactgttgttggggtcacggcttgccttggagtgtnnnnnnnnnnccccccgttcgttgtggcccgggacttttgttggggtcacggcttgccttggagtgtccaggggtgggtcaggagcgacagggagcacatccaagcacgggcctgcgtgatcggctcagcgccggtacccttggtcctgcccttcaccccatccttgaaaccctcgtcccgatctaccactcccctcccttcgacgtcaggggttcaagaacccgcggtggnnnnnnnnnnatgatcggcccagcgccagtacccttggtcctacccttcacccccatccttgaaaccctcgtcccgagctaccactcccctccctccgacgtcaggggttcaagaacccgcggtgggtgaatgccgagctgctccagtttgcgtcgggcaaccccatgacccgcggcgcggagctgggcatcgtcttcagcgtctcccgcacccagcgctacctcatcctcttcaaccgcgtggacttggagtccctggaggaggacgcttcctccctggggccctgatgttttcggcgacgcgcttgcgggggcggccgctgccttggattttttgggagcctcgacgctccccccctttctcgttgccgtttccctgggtcgcaaagcccgtttcccctgtcacccgcgtcgcgcctgctcctggtgccgcctgcacactgattttgtctacatatactcatcgacgtgagtgtgtttgaagggtctggggattctggaaaggagggtgatgaggccggggaggttgcaccattgttagtgcacgcccatgctcgccgggaagaannnnnnnnnngtactcatcgacatgagtgtgtttgaagggtctggggattcttgaaaggagggtgatgaggccgggggggttgcaccaccattagtgcacgcccatgctcgccgggaagaatcacacgccagcggcctcaggcggcaccatgcaggggctgtacgcccggccgcgccgccagctctgcgttggcggagctgacctggcgcgccaccgcggcgcctagcagtcgccgggccagggggtgcagcgcgggcggccgctccagcagggacaggtccaaggaggaaagatccaccacgtgctgcagggctggggcgggcgaggcggcgggtgcgggggtggcgggctccttgggagctggggccggctctgcgagaggatgggtcggtgagcatggaggcgtgtccggctgaagggaatgtcgctcagcctgccccaccgaccctcaagatcgcgttgcgcacgcgacggcccacccccgcccattgcgaggaccatcaacgcaccggaggccgcttcggcagccgtccnnnnnnnnnntttgcgcatgcgacggcccccccccgcccattgcgaggaccatccacgcaccggaggccgcttcggcagccgtccctgcctcctcgccctttgtgctccagtagttttgggggcgggtgacccgacgggagaaggggtccaaggtcttgctaccctcggccttggtagcgccaccaggcccttccagcaccttgttcgagacattgttcagggcattctgcgccagggggaggcgcggtgacgaggtgacatcttgggtcggcgatggatgccagggtacaggcatgctgcacggcggcaggggcgccattccccaagggtacctggcaagcctgctgccgtagcactccgcgtgctgtggggagagcgcttccttgatacaaacaaacatgccctcggccccctccagccccacctggaagttgatnnnnnnnnnnacatggtggggagagcgcttctttgatacaaacaaacatgcccttggccccctccagccccacctggaagttgatgttcctgttcttcttgttgatgtcctccatgcccacacccagaccccgtcgggccgaggccacctcgatcctctcctccaactccttgagctccttctcaaggctgcgccgatgtgtgtttgctgggtgggtgcttccatcgtgccacagccttggctctcggccagagtccgagcccttctgcccaccggcaatccctgcatctccttgtcgggaagaaggccccatcactcatcctgcaacccccctcactgccgggcacccgcggctcactctgcatgtcggacgacgtcccccgcctctgcggccgcgtccctttcccgctccagccgcgccctctccagggcggcattccgggcgccctcgcccttggcgcgcttgcgctccaacaccgccgccacgtcggcggcggtgtaggtatacctgtgtgcgtgtttgggtcgagaaggtaaagcgtcggcgcagggtctggacgatgcagagcatgtctaggaatcgccctgcggcggtgcgcgcagccggatcgattcgccatgatgatcctgccgccgccgcctggacctctgccacaatgcatcctcggcctgggcctgcctcgggaaccccacagcctgcagctcacgtctcggcgtccttgatgcggcgggcaacctcggcaacctccgtgcgccccagctggggccggcggtctgcgctgcaggcgcgctgccaggcctcgaattcggcctcgctgacagccgagttggagaccagggccaggggcatgccgcgctcgctgaagccgcgcgccacccgcagccaggtgctcgtcttctcctggttcggcccgaaggggtaggggctgcgccagggctgcccagagtccctgcggcgccgggcgggagtgcgtgtaagggttggctcaggccctgacatacgggtacaggctcagaggaatgaagcgccgcccagaacttgttggcaaccctgatggcttgcaacaacagcctcgcaactgcctttcccatccgctgtcacaacnnnnnnnnnngtgggttggctcagggcctgacgtacgggtacaggctcagaggaatgaaccgccgcccagaacttgttggcaaccctgccgctgaaatatttcccccttgcgaatgggttgcaacaacagccctggcaactgcctttcccatccgctgtcacaactccctgtcccaggcgacctcccctcccgccgctcccctgtgattcccaatggcaccccccccccccactgcgctcacttgtagactcccggggcgcgctcctcgacgtccacaacctgcgccagcatgtagtggggccgcgcgatgccgtcggagcatgtacgtgtacccagagagacgcggacctgagcaagaaaggaggagggggaggggcaagaggggaggggcctgggaccaagcaggccgagggtgtggaaagggtggagcgacggtcacagcgcagcggggtgacggggggtcccttgagctctcacggcgacccctgctggaaaaggtcatgcagcccagatgccccagccctggaaaataactcgctccaccctcctcgctcctcaccatgcagccgggcatggtggcggcgaagaagggctcccccagccacttttcgagcttgtagcgagggacgatgacgctgcacacgtcctcaaaggcggcctcgtcctcctcctcctcgtcctcttgccgcggtttccacccacccgccgcgccgtcctcctccaggtctgatgggggagaggagagcgtggcgtgatgttctgtgagttgacactgatgagaatgacagcaggaccacttcctttgtgtcgtccagcggtagacgacagccacctgacccagcctcgagcccggctgcccccccatgcatgcctgacagtgcctcgtcctcatcatccgacggcagccgcgcacggcggggcgaaggggacctggaaaggctctcgtccctctccgcctcctcgtcggcagccgggcccctgcttgaggatgagagcagggcgtgagaaactgggcgggacgggatgatgctgaacatgtacccaatctcttccttgacctcaagattgcacacaagattaaaagtttccccaggagtccattctcccctccctcaacttgtaggatcaggaagctagggcgccaccagaccatcaactggaatcccatcacagctctgcgccccctgcaacaactcgacaagattcctcgaacacacctgccctccgtccgcgccttcctggcagccaccagctcctgcatggccgtcttcttggcggcctcctccctctcctcccgcccgctgcgcatggaccgccccgcgccctcccccgccagcgtctcgccccgactccgggtccccgccactgtgggccccgccgggacggggccgtgcgccgcctcctgggccgccttccccgtctgcttcagcagcttgcggcgctgcacctcctgctgccgccgctccgcacgctccgccagctcgaactctcgctctagctccgtcatctgggctagcctgtacgtcgggggaggcaagccacgtggagatttggggacatgggcgagccagcaacccctgctcctgcacattgcagctcagatgtgatgtatnnnnnnnnnncagcctgtacgtcgggggaggcaagccaggtggagatgtggggacatgggcgagccagcaacccctgcacctgcacattgcagctcagatgtgatgtataggccccagaatgcaccatctcgtaatgtcctctcccagattagattccagcatgtgtgcgcaccgagcggcgtcagcctcgtcctccacaaggtcggcctcggtgaaggccaccgcctcgtcgccgctgtcgtcctcgcctcgcgtcaaggcatcggccttcctgggacgaggcttgctgccgcgcctggggaggggtgtggagggagatggaacacagaagggctgagccaatgccccactggaggagcctgcactgcgaatccatgcaacccagtccatggcctgcgccacacccctcactttggggctggagcgggctcctcctcctcatagtccatgtccgactcgtcttccgaggaaagctcctcatcggaatcggacagggcgagtttgcgagcccgcttgcgactgctgcccgcatccgccatcccgacgaaacagtggctgaatgaacgcgttggtatggtcgatgcaaaacagtcgacgtgcgttgtgcacgaccgagtaaagctgcgcgcccaggagcctggtgagctctcggtgtccggtatgcgggcgcgcgagcacaacctggtgctccatcatgccccggcgcatccttgcgacgaaccgtgtggaatgcagagatctcaccgccctnnnnnnnnnnaatcatgccccggcacatccttgcgacgagccgtgtggaatgcagagatctcaccgcccttaaccttcttctacatcatcaccagcctcgatgatagccccgagggacatgccgcgcctctcggcttgcctgcactttgaacgaaagtgatccctggactatgagcggactgacgggggtgtgggatcaactggtggatgctgtctgtcgaccaccccgtgatgactcctacaccgacgaggaccttgtgggtgggcagcgggcctcctttcgcctcggcaaggcccggtactatcgccaggacctggaggtgggggtgtgtcaaagggccggtggggagcatgccaggccagtggctcagccaccttggcccggccccgtggtgttggatgcgtgcatcgtgtacactgcattacgctttgttcagaggctgatagcgtgccacctgcatctgcattttcaagaggatccatgcaccgacactcgcctgaagctcccccgccaaatcaccagcctgcctgacctccccccgcagctgcacaacgagcgcggcgagcgcctgctgtgcagccacttccggccctgcatcgtcgctagcaaggacgggcgcctgccggtcgtggtgtactgccactgcaactcgggcagccggcgcgacgccgaggagatcatctaccacttcctgccccgccacgtcaccgtcttcagcctggacttttcggtgcgctgggtgggtgacacactctcagtgggctgcatccttggtctggggcacaggcggggcggaggttgtcgtggtaacaaggagggtctccctgcctgagcaacaggggtcatgcccgggtagtctcagccaatctccttgcnnnnnnnnnncatctccctgcctgagcgacaggggtcgtgcccgggtagtctcagccaatctccttgcttgggagacatcaacaggtcgctagacaggcctcaccagcgctatccagatcgcgaggctcagggctccaccttcccagggcacccaccaaccccctttcgtccctataaactcgcgctgacctccagctgcacccctggaaaccctcgtcttgcaccagactgtccatgcctcctcccctcttcacacaccctcagggctccggccgctcccagggcgagtgggtgaccctgggcgcgcgggaggtggacgacgtggcgacggcggtgcgctatctgcgcgacgaaggctcggccctgaccatcggcctgtggggccgcagcatgggcagcgtggcctccatgctctacgcgcgcgccgacccctccatcgccggcctggtgctggactcgccctttgccaggctgcgcgacctcatgctggagctgggctccagcgacgacagcctgcgcatgccgcgcgccatcgccaaggtcgcgctggcggtgctcaagcgctccgtgcgccggcgggcggggttcagcatcgacgacgtggcgccggtggaggcggtgcccgcggtccagtgccccgcgctgtttgggcacggcgcggaggacacctttgtctcggcggagcacagccggcggctggtgcgcgcctacggcggcgaggcgcgcctccgcctcttcgacggcgaccacaactcgggtgcgccaggaggctgctgggaaatgtttcctttgtgtgtgtggtggggggggtgaaaggtgtggggatgggggaggaccggattggtcggggtcgaaaggccagctaggtgatgggcaaggccatcgcagcggcaggccaggcatcacagggcacggcgacctcggccacccacttccaatccttgcagtgcggcctgacgacttctacgaggaggcggttggcttcatgctgagcgcgctgcgtgtggaagagctgctgggcttcgatgtgttcctcatggaccctgcggctgccggcgccgcgctttcctcaggcgccggcgcgccccgcgcccggcggcttgggcggggcggggcggcggggggcgggggccccacggccgccgccgccgagctggccgcggacgaggaggacgacgcgctggcggccgcgctggcgctgtccatgcaggagcgccgggcggggaggtgcgtgctgctttgagtgctctatttcgtgcggggccagcatggttatggggcctatgtattcaatgagggaggggctgtgcgccacagtgggtgtctgagggtggcgctggcgacagagggcgctgcactgggccatgtttgcatccacggccatgctggcgggcgagcgtcnnnnnnnnnnaccgggcggggaggtgcgtgctgtgttgagtgctctgtttcatacggggccatcatggttagggggcctatgtgttcgaggagggaggggctgtgcgccacagtgggtgcctgggggtggcgctggcgacagagggcgctgcgctaagccattttgccatccacggccatgctggcgggcgagcgtccttccggcctcgtcataatcccacctcccttccctccttttttgactccacccaaccccccatcactgtccccagggacgcgggcgcgctgccactcagcgaggaggccgagctggcgctggcggtggagctgtcgctgcagacctcgctgctggtgcgctgcacggagccggagccagaggacgagcgggggccctcgccacccacctcccccgtagcgcagcgcagcgcggcgcagcacgcgtacaaggaggaggccgccgtgcgggcggtggtggggtccggcgagggcgcggcgggcagcccgccgccaccccccaagcaggagcatgtggaggacggccctggctcggcggggccccagcaggcttcatgaatttttcttgcagatcccaggaccttgctccctctttgcaacttccttctgaaggactcgccttgtgcgctcccaagttaaaagaatcggcgtgtatgcaagtgcaaggggattcaagtcaggggcccggtgaggccggccgcgccgcccccgcccggtcaggacctcccaggtccgcagcgggcagacttccccccgtgtgtccggcgggcaaggcattcgatgtgggtactgcaggcgagtcagccggcgcagggctggcagacagactacccggcgcaggaactgcaggcaagtcgcccggcgcgggaattgcaggcaagtcacccggcgcgggaactgcggggaagtcacccggcacggggactgcaggcaagtcacccggcgcggggactgcgggctcgcccccgctgtcgtcgtcannnnnnnnnngggcctggctggcagattacccggcgcgggaactgcaggcaagtcacccggcgcgggaactgcgggctcgcccccgctgtcgtcgtcatctacctccatgctgaacatggggatggccggcacgccccgccttccgtgccgccgcgacctcctgccgtggcggtgccgcgcgccccgctccgccatctccagcgaggaggcctgccgggcggcgagcgcgccggggctgccatgccacgcatcccccgcaagcgcggcgccgggcaggggggccgggtcggcgccagggaggggcgctggggcggcgccggagcctgcccgagctaccgcccccgcnnnnnnnnnnnnnnnnnnnnnnnnnnnnnnnnnnnnnnnnnnnnnnnnnnnccgcccccccaagggcgacaccctcctcggatttgtcctggcggctgcgcccgtcctcatcctcctcagcgtcggagggcccatccaccacgctggcggtgcacagcgtggtcccgtccggcatgaccacgacgatggggggtttgatgggcgcagcgcggaccggacccaggcgggggagcccccccggctcgccgacgctggacatgcgggggctggggggcagtgccgcctgtggcgcccaccgcgccgacagcacggcgcggacgaggggccagccgcgcgactcgcgcggcgtggcggccgcgcgtcggaacaggatgacgcggcgccagcagcacatgatgacgatgaggagcaccaccaggatggcggtaatgacctggcccacgagacccagcgagaagctacctgcaaggtcgggaaggtttgtggggggggacagaggcaaggctgagactccgggatggatggagggcagcgtcgggctcgagcccgccagcgcaagcgccagggctggcatgcaggtgggatggtgtgggggcgccggacaggattgcagccccaagaaccctggcacggaccggccggtctcaccacgcctgcagttgctggagctgcactgccagccgaggttggagccgcgggagtagatctgtgcagggcagggatgagatgacagggcagatggtcagagggatgcaggcggctgcaagcaggggtgcggtggcggtggacgcccccctcttccccgacgcaccccacacccttctcaagatcaaggagcgcagtgctcctcccgtcaaccgccccacccagacgcgtcgcaccatgaggtccaccccagagctcgactggaaaggaggaacgcccccgcagatgccacagttatatcgtacatcgagcacctccagggatgacatcatgatccaggcatttggtaagggcccggttaactgattaccacctgggcaagcatcagaggagggagggaaggcatggggtggactgcggtgcctgggagattgttgattcccggcaccaggcagcaggacacatcagacgccagccacccgacactgtggtgcccatcctgtcatttccttgcccatcgagtcaccgccgcgcaccaagcaaaagctgtgacaggctgcgaagggagccccaggagtaaggcaggccgcctgatgtgaagggatgcgttgatatgagattggggatcggttgtaacaaggccatgcactttggataccatgcccgcatgccgactactggggacagctgagcgtcgccactgacgccttggcacccagtgctccccacccataccccggcgtctttcccgggcctttactgcgcccccgccnnnnnnnnnntcataccctgcggcggcccctttgtacccccccaactcgcctgaaaacccagaggacgannnnnnnnnncggcacccagtgctccccactgataccccggcatctttcccgggcctttactgcgcccccgccccgatgcacgccacccacctgccagggcgttgctgctcaggtccagattctgtaggctggacattgaggcccagctgggaggcagtggtcctgcaggggattgagatcaatgggacacaggaggggtcagagtaggattgctgcagcctatgagcaggtcgaggtacaccacataccctgcggcggcccctttgtataaccccaactcgcctgaaaacccagaggacgagaggtccgccacggtcagagtggacaggttgccgtaagaagcggggagcccaccctcaaaaaaatttgcagcgagggagaggaccgagagacgcggcatcaggcccaggccgtctggcagctggcccccaagctggttcccggccaggaggaggctggagaggtcggtgaggttggcaatgaaccccggcagagggcccgagatgcggttcccccgcatgtccagctgctgcagcttggtcaggtcggtaatgccggacgggatggaccccgtgattcccgccgccgcctcgcccgagctgttgggcagggcgatgccaaccacccgcccgcggaggcaggcgactccctgccaggtgcaggccggcgctcccgagccggaggagcagttgggcgaggagcagggtggcgtgctctgcaaccaggacggcgggagcccctgccaggcggcgatgagggccgacatcccggctgtttgggtggggtagggggtggggtgggggttgttgtgggagggggtgaggaagggggcatcgtgctgcctgggcaggggatgcctggccaccatggtctggagccatgtgtggcccaggaaggggccccgagcccccggcccagtcagccctcccaccttcatccgagtcctctccagcttgctgagccagcgccgggaggggaagcgcggcgatgagtagagcgaggcatagcagggtccccggaatccggtgaccaggcatgcaggatggggagcgcgtggcctccgccacgagcgaggcgccgggggagagcctgcgggccagactaaatctatgacactcctgtgtggtcgaggtcgcacagaatcttggcagggaccgtcgtgcgggcacacagtgcgcaaggcgcgctgcggttgaaaacccctggtgcggtggcagccctacctgatcacaatcgtggcttgatgaaactccctgcaagagagacaagaggacgcattacgaggactgaaatgtatatctggccaggcatttgtttcggaagagctgcgacgaatgacagttcatcatatgagggaagctaccagcgcacatttcgcgagagggcatcaagcgacgtgcaccaacagcgcatacatgccaggcaaacgtacgtcgctcccgacctaagacgatcgtacaagccttttataatgactgaagcaatacgtaggaaatatttggacactcttactggatctggacccaatgattgtgcaatggggtgccaggctgtgtgcctgcaccttccaagcgtgtcggtcagcatcgcagggggtggtgcggcatcgagctcgtagcattccgagaaggagaaccccaccagcccagcatgaggctcagcgagctcaactctgtgaccgactttgaacacaaggcgagtgggtacaccgcagctggggcatgttcaggaggctgacactagcctcgagttgggagtccctcttcccgtccctgttcnnnnnnnnnnctgaacacaaggcgagtgggtacgccgctggggcatgttcaagaggctgacactggcctcaagttgggagtccctcttcccgtccctgttctgttcgtcaggcctgtgaagcgattgctgccgagctctggaagaaggggagtctacacagtgttgtgattgcaagggagtgagtgcaagagggccctcctccacacggggctgtcagatggcatcaggcgcaacactgtcgtgcacgacctgtctcgagcgggcaagggtcaaaaagaatggcagaggtttcggttaagaatcaagcgcatgggatggctggcatggtggaggttgcatcttgccccgtggcaccccagttgccgggcgcgccagcctcacaatcccgctgacaggtaggacgtcacccggcccggcggcgcccccgcacaaccctcctccaggtccggggcgtggcggtgcgaccccagcaccgcgacgtcctccgcccccttccccccctcgcccggagcgcacacgacgccggacccggggccctcggccagcgccacgccgccgtccggcgcgaggaccacgaccaggggnnnnnnnnnntcccccctcgcccggagcgcgcacgacgccgtacccggggccctcggccagcgccacgctgccgtccggcgcgaggaccacgaccagggggcggaccggcgcagaccccggcgcgaccttgacctccgccgcccagcccgggcccgagccccggcgtgggtccaggcgcagcgtgcgccacgccgc

SEQ ID NO: 43519 - DNA, 459 bp, Chlorella protothecoides
  modified_base (92)..(322): a, c, t, g, unknown or other
cgcaatctcggagggggtggggatggagtcgaccaggttggtcaggctggagggcagggatgagacggaggaggtgagggtgctcagggccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntccggtcgctgaaggcgggtaggagtggggggagtggcagtcagcatcgtcgcacacacattcattccgacggcaggtgcacgggggcatctctgcgggtacagctcggacatcctctcagccctcgactcactcca

SEQ ID NO: 43520 - DNA, 61 bp, Chlorella protothecoides
gcgatgcttgcgctggcgttgaagcggggggggttgggggcgtcgacgccgccgtcgaagt

SEQ ID NO: 43521 - DNA, 61 bp, Chlorella protothecoides
ctgctcggccacgcgagccgcctccctggcgtgcctagcgtgggggaagggggaacttgct

SEQ ID NO: 43522 - DNA, 417 bp, Chlorella protothecoides
  modified_base (138)..(298): a, c, t, g, unknown or other
gccgagtcgcgcgccgcttcgcgcgccgcgcccagctgggagccggtcgaggcgctgcgcccgtgccggggggccggcggccaggcaccgctggcccgccccgcctccgcctcaggctcctcctcctcctcctccccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagaagctggggccagaggacaccggccgctctcccatcgcagcgcccgcaggcggcggcggtggcggcgcgcccgggaagggccgcacctgcagcgccggcgccctgggcgccggcgcg

SEQ ID NO: 43523 - DNA, 99 bp, Chlorella protothecoides
cacccgaagccgtcgaccggggaggggacgaacctcccctccccggtcgacggccccaaacaaccatcgtcctgtcccagcaatcatctcgcgccgcct

SEQ ID NO: 43524 - DNA, 6062 bp, Chlorella protothecoides
  modified_base (122)..(131): a, c, t, g, unknown or other
  modified_base (528)..(537): a, c, t, g, unknown or other
  modified_base (2610)..(2619): a, c, t, g, unknown or other
  modified_base (3350)..(3359): a, c, t, g, unknown or other
  modified_base (3875)..(3884): a, c, t, g, unknown or other
  modified_base (4063)..(4072): a, c, t, g, unknown or other
  modified_base (5619)..(5628): a, c, t, g, unknown or other
cgccacccaggcgggcagggcgggcggctgtgcgggctcaaaggccgcgctggagggcgtgcaggtcttggccagcaacgtgcgcaccgcgtcccgcgcctccaggcccgcgtcggtccagnnnnnnnnnncgcgggctcgaaggccgcgctggagggcgtgcaggtcttgaccagcaacgagcgcaccgcctcccgcgcctccaggcccgcgtcggtccaggcggcgcccgggctgctgtctctcgcgcaggccgcgggggcccagggcggggccggggcccgggagcacagggcgtggggagaggcgcgggcggccagcgtgagccacccgggtctggggcgctgcaaaggaagagggtggaggaagggaaggaaactgtgagtggggatcggtgctcgtccactcagggaggtgcaggtgtgcgatcggcgggccagactcgcgcaagggcggtgggccgcttgcagcgcgaggagaagggaccccacaggaggcacaccgtgcctcggcgctcgacactgactnnnnnnnnnntgaggaagggaaggaaactgtgagtgggaatcggtgcttgtcgactcagggaggtgcaggcgtgcgatcggcaggccagactcgcgcaagggcggtgggccggtggcagcacgaggacaagggaccccacaggagacacaccgtgcctcggcgctcgacactgactcgacctgccgagtccagtgtgcatggcctcatagcttccctggcccgacatgttgcacccctccaggcgccaaacaccccgcaactcgccaagagtgtgaccgccgtgccaggcggcgacgcctgctgctgctgctgctgaatggggctgggtgccgggcaaccagacgcctccgccgtcttgctggcagagtgcgggccggacccgggtccattggacgcgagcccccccaaggtcgccatctcctggcggggcctcgccgactcgccggagccggccgtgaagtcgctcgtctgtagagttctggggctggccacataggcccgtgactgcggcggcgccgcggcatgcgtgtcaacgcgcgagggcgaggtcaccgcctggtcgcccgcctcctccccgccccacgtctggatcgtgggggcggcagaggggtctccgccgacctccacagtgggcgcgagcgtcggctggctgcgtgcgatgtcctcctcggggtggctgtcgggcaccggcggcgagagcggatggggcgccggcggtgcctccgacgagcacgcctgggcggcatgcgtctgcgcggctgcaggacacgtcgcctgcagctgtgttgccagggggcccgtcgcctgcgccagcgttggctcggggctcggtgcctgcacctgcgccgctggactctgcgtcgactgcactcgtgaggccaacgctggcgtcgccagcgcctgtgtcgccagcccctgcgtcgccaatgcctgcgtcgccggtggtgttgcccccggcattacagcctgggagctggcgtcaggcaccatcgccgctggcgtgggctgcacctgagtcgaggcaggccccgacgccaccgggttcgactccccgacctgtgtcaggccagccatgagaggcgcgctgcctggcgcctggctcgctggcatgccctcccgtgtcgtggccgtggcctgtggtgtctgcgtcgccggcaccatctgcgtccccgcatcgaagaccggggtcgggggctgggtgcacagccctggcgctgcctgcacctgtggggtgggccaatgtggggaccaggggaaatgttcatcatcaggtgcatgcagaggggtcagggagcaccaggaggtgacagggtgaggagggcggggcagcgcagcagcagcgcccgggggatgagacacactaccaatgtggctcccagtgtcaacctgctcgtcgtatcccagtcccttcagagctcatgtgccggatagcaggcgccccagatcacgggcccaccctccacagaacctcatggtcgggcaccccgcttgccttcctcgatctgaccggggagaagaagggggagctggcgacccaagcagcccggccccctgctgctgggtgccaggcgaggccgtttgtcggtccagcggccccgaagggcccctgccgggcgggggggctgagcagcctgctccctccctcccagcctgcagccccggagccttcgggggccggtcgcttgccgagccagccgccgatgccctttgccggctggctctggctcggggactgggatggccccgcctggggggaggggtcccgaggcaacgccccctgggtcaacctctgggtgaggggggactgggggttgggcaagccccggctggctgggtcggcgggggccgggccaccactccccccgctgccggccctccccgggctgagggtagcatttgcgctggggcgcggggaggtgcggagcagagtcacccctgaggtggcccggcgggcatgagcggctgggtgcctaggagtgaggaggggccggtgggggggcccaccaacatctcctgcgcacagggagcccgtggagtatttcaaaaagcaaaataaatggagcagagaagatggggcaactnnnnnnnnnnacgcagggagcccgtggagtgtttcaaaaagtataataaatggagcagagaagatggggcatctcacgggcgaggtctccaaacaacttgaacaggcgcaccagtagaaaactggggtgtcgaggtcacactgcccaccggcgactcctcactcctcgccatccgcatcctcactccttggatgcttcaggaccatggctcaagccctacatccatctgtgggccgggccgggcacagaccgggccatgcatggcatccagcagcgatactctgggcgtcaggggcgagcgggagggggtgctgtcgacgacccactcttcgtacagcgggaacctcgacatgcaatgctgccaatgatgagggtgatggcgcgcgcgtcccggtccctgcagtataccttcttcgatggtgaggatggctggggggtttgatttcccctcttcgcgccctggcgacaccgacactcgggcgacccagatccccgcacccctctccaggcgcctctgccttacagagcgggtggaaaggtgttattaataccgaagacgtgcggccggagccagaatatttaaagtgcccaggctcacccctgctgcatggaggaggcgggcgtgctctcctccccctctgtctccatcccctcccgttcgctggtccccccagtgaccatgtcggaggcggcccccggcgcgaccgcgttccctgcgtcgccgccgggcgcggcccccgnnnnnnnnnncgtgaccatgtcggaggcggccgccggcgcaaccgcgctccctgcgtcgccgccgggcgcggcccccgccgcggccgccagctcggcgtaggtcagcgggcaggtcctggccagatgctggaagaggaccttgctgagcgtgtccgcgcgcccccgacgcgcccccgccacgccgagcaagcgcaggtcggcgcccacggggcggccgtccagcaaggtgaacccgcccggccccagctcgaagcggagcagggtgcccggcccaaggcctcgccccgtgccggcctggaagccggggggcatgcggcctagggcgcagggctccacgtccccagtggccacgctgccgtccatgcggtacgccagcaccagccgctgcgcgggtagggggacgcctatgaagggaagggggaggggagggggaaagggagcagggtgactgggccgtgctggacggggggggccgcggattctggtggacatgggcatgcctgccaggccctacggtgtctcatnnnnnnnnnncaggggcaaagggagcagggtgactgggctgtgctggatggggaggctgcggattctggtggacatgagcatgcctgccaggccctacggtgtctcatccttggtcacgcccacacacctgtaccagtcagccaccaccaggcagaaccctgtccttcccccactccccgcagccttcnnnnnnnnnnccctgtaccggtcagccaccaccaggtagaatcctgtccttcccccactccccgcagccttccttgctcagcgccatgtccctgccgcgtcggtgtcgatgacgtacttgctgcaggcctggtccttccacagcaggctcagcggcgactggcccggggtgtagtgcgcctcgcggtgcaggaaggcgaggccgtcgcgcgcgtagggcgccgcccctccgtaggccgccgccagccccgccgcgtccgccgcgagccagggcacgggcgcgaattgcggcaaggccgccccgccgccccgccccggccccgcctcggccagcttggaggcggtccagaaggcgcggaactcggtggtgcaatggtacaaggggtgcccgttccaggccatggcgtccagggcgtagtaggtggcgtcggcctcgtggtgcacgcagtccagcaggcagtagctgtcctcgccgcgggtcgtctcggggctgccgctgggcagcgcgctggcgaagcgggcatggaccacgccatttctcagccgggcggtggtcaggccgcgcgaggcgatcaccagacagcgcacgccctcgggccgagccgccacgtacctgtgcagcgtggtagggacgtgagtgcgggagcgagagagggtgggcggtgccgtcgtggtggcaggaggggtacatcgaccctaggaccctgctggcgtcccgtgaaacctcgaggctcaccagttggtggccaggtctgcggggacctccagcatccactccgggagcatgagctgctgcgcatacgcttcccgaccggaggcagccgccctgcggctggagggggcctgcgggctcctggtggggctggagacctcctccccttcagcctgtgggtggggaggcggaactcatctgcactcaagtcctgtcaaggaggcgcaccagcctcccattcctcatgcatgcatccagccagccacatgccctccgtcagcacgcacctcctgcgtggtggaggcctgggagctgtcactggctgatgccagggctagccgtcgagcacgcaccgtctctcgcctggcgctggcctgcttctccagagctacggcccgatggcggctctggtagttcagggccagggatctaggattctccctacaccccatcgtcgctgtggccggccccggcccgatccacggcctggccccctcccttgacgcccgctacccgggatcgggcacgctcatcgcgcgacacccatgccgagtcccaatttgatcgttttatggaagtgtatgtgttgaagcatgcttgcgagggggtgtcgccatagtgcatgttacagggatcgaggtggcccccgacatcgcgcgcctggaagggccaggagcgcggggagggtacaaagggggtgcagggggtgcaaccctgcaattgttgagcaaggctgcggactactgcgagaagaggcttagctgagaaggcagggctacaaacacatcgtcgtcctactgggcctgagggccccgtgagggtcttaaggggctcagaactgctgcnnnnnnnnnngctacaaacacattgtcgtcctactgggcctgagggccccttgagggtcttaaggggctcagaactgctgcgtccttgctccaacgacacaaccgtgaggttcatggcacgcgccacgctccgcctcccacaagctcagtcctgcagggctgccagcgcgtgctgggagcctagggccaggaaggccacccgccccagcccgggcaccagggtcgggcggggggcgcccagcccctgccactgcccggccgcgcccgaatcctctcggcccgggagtggcacacggggcgcatcagcggctgtggcccctgcggccgcggcctgtgccagggcctcgcctgccgcgcgcgacaggacgctgccccagagccgcacgccgccgtcgtcatcgaccacggccgtggcggcgccgcccgccgccagctggcgcaccg

SEQ ID NO: 43525 - DNA, 118 bp, Chlorella protothecoides
ggggggggggcttttcccaatgttctgtggcaaaggaaacagcaggcccccacacagtcgcacactcccaaacttgcatgcccaccagcgcccacccctccacccacccaaaacacac

SEQ ID NO: 43526 - DNA, 4017 bp, Chlorella protothecoides
  modified_base (115)..(271): a, c, t, g, unknown or other
cagccgccgcggcggcgttggcttgggcctgctggtggtgcgctgccgcggcagccaagatctgctgctggtgcatcatcagcgccgcggccgtggcctgctgctggggggtgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcagctggaagcccggcgggaactggaagccgggggggaactggaagccggggcggaagtggaagaaaggggggccgcgggggcccgcggcggccagcgcggccgccgcggcggcggaggcggcgggggtgccgggctgcgggacggccggcgctgcgggcgccgagggcgccgatcccggcgcgggggacgcgccggggtggggaacttgggcgggcacggcaaaccccctgcctgggcgcggggagacggcgggctgggcactcagatggaagccggggccgggtgggagcgggggcgtcgcgcccgggcctgttgcccccgggcctggcgagggggccgccccgctggcagcggctggaaaggcgaacccgggctggggggagggcatgaccatgtgggcctgggggcggggccctcctgcgccgggtgcctggggatgggtcggagggggcaggcggtgaccacaaccggtgtacatgtcacgtgtcgataagtcgggccttcggcgcccgggtcatgcggcatgcacgcagaaacacctccatgccctcaccgttggtgggttgggcacaggggaagggttctccgtggattgtaccatgcccgggaggtccaaggcgcgggctgagcgatcttccgcgtgtttggggtcgggctggcgtgggagccggagtttaagccgaccaaaaccaatatattagagcctaagtagggctaccagattgagaagcgcgtttctgtggcgcttgtggaggccctggttggcgtacatccgcgcgccggtgctgaacgagctgagtgtggggccaccctccgcgaacacctggtgttcggtcggaatgggttcttggttccaagtcgtatacttgtgagagcgcgttgcaccgcgagtggggctggaggtatctggttgttgggtcccactaccccccgcacgggaaagaaagggactctgcgcatcggagctcggccatcccgggacaagtcgccaaatatccgccttccaacccaatccatgattgtgccttgcgaatattggtaatttctaattttatggggctccaaggatggccaagacggtacaacccgtgtgggcaacaccgcgtagcagtgttgtgccccaccgaggacgcgcacacaccgcactcggcagattgtcatgtttgggtatcatagaaacggaggaacatcgagtgcaagggcgatagaatgtggtgggcacacatccatcatgccccgtggtcccgtcgtgctctttggtcaaggggacccacgaccatcgccctcccctgggcctcaatgccccgcacacatgcaacctgtctagttactggtaaagtcttagccaattccacatcggggccaagctctccctggccttctcctcattgctgttacactttgccacctcgtgcctgtctccttctcaagatgggacgggatgcggtgtgcactacccttgacatgccgcttccaggggatagtctcagctgaccaagcgggcacctcaggcaacacaactactaccaggttcttgtgcagtgggttgcgctcctcctgcactcccttcactgcaatgagggagcccctggtagccagccgcaggagggcctcaggaagcgcaaggacaccccctggtgacaggaccaggttgcctgggatgctagctgacggtggtgttgtgacgtttttgcctaggagaagcagggcgggggagctatttggcccttaggatttacatgattgttaaagccaggtctatagcgatatttggtagctggtgtatttctgatcctgactgcttgccctgccctcctgccatggctggctgtggatactgcaaagtctccttatcggtgcacagtttttggttatatcagctgtccggcgtcgaattggtgggatgatgggcgcccctggatgacaacacagagggcagacacttgcaagtgtgttgacattcaaatcatggagctcacctgtgtttgctgcagctttactgacctcctgcacagccgcccacatgcgcccaaggcctttatcaaaggcgcccattctccaccccaggaagcattgcagatggtggtcggcaagggctgggcatgtggtgtgccagaccttcaggccgtgctggcatggcatgtctatcccttgcaccggtttgcttcacctttgtcttcagacccatgtttgcctgggttatgagcacgctcctaggactccattggcgcggtggccgtatgccctctggcaatgagtgcccccacacatgccatgtccagattctatggaagatggggctgatttgcctagaatgctacagcttgggttttgtgcatgacattttgggctaacatcaccatccggagaaggtgtccccggagagcattgtattcctaaaaagcaaacagccctgctttgccgcatcatagaatctatccatcttcgaggatcaggcaacgaatcgcacggtctgctgcggtcttggccctacacgcgccgcagtcagccccaaggacaggaggggtgcctgtcaggagcagcaagactataccttttgcgtgtggaggatgtggatgacagccatctccttggacccgacgtctagtaacccttgctgcagggtcagggcatgagcccaatgctggccctcaggttgggtccaagctgtttcctgatgcccttgtaccccacatttgccgtcattggcagcaggacgcatggcatgcagtgatgtccaagttatggcatgttcatgctctgtgcacatcctgggcactggtacccagaaggagtcgcagccattcgcacacctgagctatggatgattcggggttgtccatccatggagggaacagggcccctgtcataatttgcggcgcatgtggctggaggccgcatgtcgtcaggggttggggctcaggcggcacctgcccaggcctgaccctcctggccgtgggaacatcgccctgggatccacatgttgactggaaagttccaggcatccgtaatcgatacctcttgtgctcgacaagttgtgatgggtccgtcacatccagtgaacctgtttgaagcgcgccggaaccggagagtctcgcgccgttattgaagtcgttctcaccggatgtcctccgcgtggattcggaggtactgacggcacagatgaggcgccgggagctaaatcggttgactcttgtcttgcacgggctggctgcattggggtggaacctccgttggtggtatgcaagcttgtggttgttggctgggaaggatccgtccggaggccctccatagaaacgttcgaagcactcatgctttataccgcgaaaccgataaagtcaggaaccggtgcatgtggccaaaattcctctcaaatgttcacaagattcaagaacggcacacagatgttaaagtgcagtctatcctaggcgttgcatctctctcaggccgcaggcgcaccaagcaggcggcagactgcacattgccgtagggtttaggatggtccgccggccaggaactctgctattttgagtggactggtgctgctgtccgccagatgtgccttcgcggtgagcctggctgcactcaaatcgatgacgaatctgatccagcccctacaatgattgcccctgtaccagtttcctcatcaactttcctctttcaaagcaggccacctgctgctcgacattcattgcggtacctagtgctttgtgagtcgagtggaggagggggtgggggggagg

SEQ ID NO: 43527 - DNA, 63 bp, Chlorella protothecoides
cgggggcgcacaacattctgatcctggacaccgcgaatgtcacacagaagacgtacagcgagt

SEQ ID NO: 43528 - DNA, 11391 bp, Chlorella protothecoides
  modified_base (535)..(544): a, c, t, g, unknown or other
  modified_base (2646)..(2723): a, c, t, g, unknown or other
  modified_base (2828)..(2837): a, c, t, g, unknown or other
  modified_base (4347)..(4356): a, c, t, g, unknown or other
  modified_base (8063)..(8072): a, c, t, g, unknown or other
  modified_base (8477)..(8486): a, c, t, g, unknown or other
  modified_base (8552)..(8561): a, c, t, g, unknown or other
  modified_base (9589)..(9598): a, c, t, g, unknown or other
gccgccgcgccccctgccgcgcccccgccccatgccccgcccgcgcgcggcggtgtagctcagcttgggcaggccgcgcgggcggccagagatggtgcgctggccgaagccccagggtccgctgtgccccgcgccctccttctggtacagcgaggccagcgcgtacggcgcgtcgcgcccggagtagacgacctcgtgcgccggcgcccactgcccgtcctcgccgcggaccatcaccacgcgccggatgcgacgcgtcttgcccgggacgaggccggcctcgtttgccgcgccggcggccggagccggcgcggcgccgggcgccgaagagccctcccccagcaggccctcggtcctcatccgctccagctcccgcagctcctcctcggcgctgagctcttgggaaggctgcacgagttggggggccggcgggtgggtggagggaaggatggttcgtggtgaggatccagtgctggattcaggccatgaaactgaggcatggcggggtgggcgggaatggccgtccaggggaggnnnnnnnnnnccgtggtgagggtccagcgctggattcaggccgtgaaactgaggcatggccgggtgggcgggaatggccgtccaggggagggggtgggttgcaagaccgcttcgatgacgaggaggccaaggaccgctgtgtccaccctcgcccgcagcctggtagcggtgaggcgggaggcacgcaccatgtgacacatgcccatggcaatgtttcccccatgcccagcgtgcaccttcttcttctcggcctcgcccaggagctcccgctccagctcggcctccaactcctcctggttgccgaggtcttcctccgccgtgtcatgcagcaccgccatctgtagagtaaaaagaggtgcgcggagaggtgttcatggcacgagatcttgcctgcccgacttgtccctgccacggcaggtacgcccttcctgctgtcaagaccaccattcctgcccccacaaactcccacacctgcttttcgaagatctcctgtgccttctcccgctgcttcttctgctgctccagcagcgtggtcttctggtgtctgacaaacttcatgttgccccccacgccatcggccgctgcggcgttggcaaactggcgcacctgtgggtcggggaatgcgaagaggttgtcgggagatcggctgccgggcagcggtcggggcccagaccgccagcagcgagccccccccccaccaccccactcccagcgcgaccagcgctgcgtatgcccatcaaaaaatccccacgcaccagatcgatgcggacccagcggcccaggggctcgatctctgcaagggtcaggccgtagtccatgagccgcttcttggcagcgtcggtggtcatgcggcgcaggtcggcgtccgtcccctgcaccttccccgcctgcttgcgggccaggctcttggccaggtcatcccccaccgccttgtgccgcacgtcgcggatgaaggagtagcccacgccgcggccggtggggtcggcggggcccgccagctgcaggttgccgcgcccctcccgcagccccgccaccgcggcgtcggtgagcagccagggcgcggcctgcatggccgcctccacataccgcgcggcgcgctgggtgggcgggtcgggtggcagcatggccgccgccatccgcagcttctccaccgtcaccgacccaaagcgctcgttcagcaggatgcccgccgccttcaggcggtgctccgccacgctcgccgcctccagcgtcaccgcctcctcgggggacagccgccggcgcagctcgggctcggagggcagccgcgccccgtccttgagctcgtacacctcgtcgtccctctgtgggcgggagggaggggtgatggggatgaagatgggaggggtggaggacctggacagaggctgaccttttggatggaggcagaagcccgagggacactgcgagccgcagtgcaggaccagtcccgatgacgcatccccaaccctatcagctgccttgcagctgcatcagtccctcgcacccacacaaacaagacgaagaaagtgatcccaggccctccctcgcgccttgtggctgctgcggctgatctggaggtcgcaggactccttgaggtagatgcggatcatggactcggggcggttggggaacatctcgtgcagctgcttcagcgagatggtggccttcgtccccggcgccttccgatcctgtacggcctggagccggcgcaggcgcttgaacacgtacacatacagccgccgctcctccaggtccctgagaagggaggaaaggcagcacgcggcggggtgggatgtatgtggtggggggtgagcagggtgatgcgttcgagcatggacaggttccgtgtcatccacgatgaggatccctccccgatacactgtccgacgctgcagaccaagcctgattggtccatgccgccgcactcaaagcccatggtcccctcctgttcccctctcgacgcacttgacgtccctggagttgggggcggggatgcggtggtggggcagctgctgccccagggcgatcgtccccgtcatggcccggagccgcatgatcccggtctgcggcgatggggtgtttgggaggggggggggggggggcagcaagggnnnnnnnnnnnnnnnnnnnnnnnnnnnnnnnnnnnnnnnnnnnnnnnnnnnnnnnnnnnnnnnnnnnnnnnnnnnnnncacccgcctcggttgcccctgctcaactacataccccccttccaagacgcaccgggctgcggaccaggaggaaatctgtgggcggcacgtcgtagggctgggcgnnnnnnnnnngacccgcctcggtggcccctgcccaactacattcccccccttcctaaacgcaccgggctgcggaccaggaggaagtctgtgggcggcacgtcgtagggctgggcgggtgctcggaacagccccgtctccaccgccagctggcgtgccccgggcttcaggtcgccgaggaagggggattcgtcgtcgtcgccgagtggcagcacgctcccaaccttccaccgcgcctcgtcgccgtctgcgatgagggtggcaccggcggccttgtgcttgatgggcgctgtcggcgcactgaaggtgcaccgtgacaggtgccatgatccgccgtcgacccccgtgcccgatccctcacccacccacccaaggctccccaaggtccttgctcccctcctgttccacttgcctgtcagctgcatgtactccgtgtcattgacgttcttcctccgatagtagagctgcagtcttgcccccatccccggccggttgaggagcaagggctgtgtgtgaggagtatgaggagggggaacgaggtcaggccatcgttgacgatccggaaaatctcccgtgtacagtgctgagacacctatgcaggtcagacgcgtccctcagcagagcatgcaccctccgcctgcaaccaccaagcggagcccctggcaagcggggaaacagccaagtacgcctagccccttgcctcaccgtctgttccaggtactccagaaggatgaggtggccatcgtctgccgccaggctcttcctcttggaaaaggccatgggtggtctggggaaggcgaggcggagtggcacggggttgaggcgtggtcggaaggtctggcgcggggcttcaggtggtggaaccttcgcctgggctgcctgcaatctcccatgctcgacgtaaccccagccacgcatgtcgccgcccctgcaccccacctcagcagcgcagggttggtctcgtctgggtgggcgttggcgagcacatttggctggaggatgagctcctggaatgccaccatgaggttcacctggtgcacgaaaagggtgaggaggataccctcaggggacacttcaaacaccaaacacactttcacaggcggccaagtcatgcatgtgagcttccctcaccccaggatgccctacaccgcccccaccttggtgtcgcctgctctgatcccggcctcctggaggggcacgtcggtgcgcagagcctggggcggcttgcccgggaggagcatgaagggggtcagacccttttccctggcctcctcaaacccgttgctcagcagctggcaggggatggcggtggagggtggagggagtgagtcgcagtgcggtgcagggaatgggcgaggctgccctttcttccccttgaggacaggccagccacccatgcacgactcgccagcccgcggtgcacacatgacctccgtgctcaagcgtcacccttggacacgggccttctcctcccgcaccctctcctcctccccctcccccttccctcaaaacctcacatctnnnnnnnnnnggggtgaggctgccctttcttcccattgaggacaggccagccacccatgcatgactcgccagcccgcagtgcacacataacctccgtgctcaagcatcacccttggacacgggccttcttctcccgcaccctctcctcctctccctcccccttccctcaaaacctcacatcttcccagagctgactcagcgaagtggcgctgacgtccacgttcaggtaggacttggcgaaccccggcagcgcagtcaggttgacgctggccaccgaggtaggcccctgcggcgccttgagctgcagccgcgctttcttggccaccaccggccaccacgtcgcgcgcgggcggtggtaggcgtccttgtcgtgcacgctgagcttgacggggatggtcagcaggtcggccgcggggcgcgcgtgcgcgccgggccgccccaccgtcccgcctgcagggttgggtttgtgcgcgagatcgagtgtgcggtggagggaggtcatgagggagctgcacgatacccaatgtgtcccgaccgtttgttcacctctgggcccccatcacggcaggaggacctagggcatccccagcaccccccactccctcctccaccaatgtaccccttacacacctgcacgcttcttggtgtgctggctgtacagggagtccagggacacattgagcctggccagatccgcagctgctccgtcgccggggtcggcggaagccgcactcggcgacggacggcccgccggcttgtagggcaggatgcgcgccgccgcggcatgcagacccagccccgccagtttcttccccgccgccgccgtcatcgcaaaggtcagccccgggtcgttcaggtccagccacagcgcggccggcgccggcgggcgcgaccctgcgccgtcccagctcacgcggtgctcccaggccagcagagggggcgcgctgcgtgcgccggcgccgggcgtcggccgccagccctcctccagccgcagcacgggggcggggcgcaggatgcgcacctcctccacgtcgctctcctcgctgtgctcctcggcagccaggcgccacgtcggcagcgcctccacgcgccagccgtcggggggggtggcgctctgggttgctggcgccgggcgcggctcgccgggcccggcctcctcctcctcctcgtcactgctgctgcccccgccccaccggacctgcgcctcccagtccgcctggcacaggctggagaacacctcgtcggggaggccgggcagggcctgctcgcgccaggcgggcggcggggcgccgccgggcgccggcgccgtgggtgaggcgggctgcgaggcgacgcccggggcgtttggcgctgggccgggctccggggctggctgggcggcctccgcctcctccgtgccctcgggaacctcccagacatcggggccctccggcaaactcgcggccgcgctgccccgcagcgcttcgctctcgtcctctgcctcggaggggggcccggtcgtgccaggcgcgggagcggccgccaggggcgccactcggggagtgacgcggtccgaagggaagatggacgtccccgccgactccagcgcgggcccaaagagctcggagaagcgcagcatgggccggccgtcggggccgggggccagggctggcagccgggcgagcaggcccacggaggaaggctgggcgccgggcgcagtggccggcggggcggggcggggagccccttgctccggcgcctgcacggagctgctgcggccgggggccgcctcgcttcctgcccctgccaccgcaggctcgaccggcgggactaccggctgacacagcgcctccggctcgctctccatgtcatagtcgtcctcctcctgctctgctgccccacctgcagggggctgggctaccagagcagggcctggggtagagaccagggaggcctgcgtgccggccccttcgtcggcgatgagctcgacctcgttgccatagtcttcggcatctgccctgggaccggtgacgccgtcctcggccccctgtggtgcactggtgcctggtgtctctgtgtcttgcagagactcctgcaaatagggcattgaatgactgcagatgggcaggtgctgtatgttttacaaggctgtcgtgggaaaccaacaccaggagccgacccatggacagcacctctgctccctgcccacacgagccacaccttgaggcctaggtccccttgaatcctggccaggccagccagctggtccctcgcgtcctgtgcaagcgtggaaccgagaagggagcgtggtgttgagcgagggtggggaggggggtgttcggtgagcgttgtgcctcggatggcctctcgcacgcagatactggcatactcacatcatccaggtaatcggcatccacacggttgtgctggtccacgttcccgaagaggaagcccagcaggggctcctcgttgccatcgtccatggactgcagtgtcgcgtccggctcacccccctcccatcgccagtgagcgctggatgcaactggccatgcaggcgataaaatgcggggtagggcggtcagatccctgcgcaagtgctgacgtgccatggcacatgcacaccgacaccgccgtgcctcgcacgctgaatcgaaattccagacctctgtgaaagcacaccccggtgcttttcccccctcggtgattgcacatccagccaggtatggatctacagaacgagtcaaggtctggttaactccaggtgcccattggcattgctatgaaggttgtttggaactgggaaaggtcatattaacgtcaggtgtgagtgtgaagaggatgtcatgtcagggatggaggtcatcaaagtgtggtaagtcagtggagcaaaatgtcttttgcagccattgcggtgtcaatctgtcctgctccagcctggcagggtgtgatgcttggtatggactggcacggtgtccccatgcgtgcctctccgcgagagcatgtagcagctcccaccctggacccctgggccatagctcaggttgctcctggcaggcagactctccaggtgtgtggacactaccacgcagcctctggcaggtgagtatgtggcgcatcgtgaagcggcctctactcctccaggaacctgccatgggtgcccgaggtggggggcgtgtctgcatagtcctgtgcaggcgggtctgcccgccccaggtacttcttgtggaagcgtgcgagggaagggtcgtggcgcagcatgttgcgccacttgtccttgaggtccacctgttgcagggaggggaagaagttcactggggcggggcggggatgcttgctgtttgggccgcccccctggtcccctgcatcccgccatgcagcaaactgtgttcatcccccccgatcaatcctcgctcacgatgctgcggtcaaacaggtggttgccgttcacccggtcgtggtccttgatcatcctccagttccccgccttgtacatggggtgctggcagtacttgagcagcacatcctcctcccgcgcagtccacggcgttttctgtggccagtgaggaggcttgagagcggtgagggaggagagatctaagcttgcgctccagctgtggatccccaatgcgcatgtgggcattggcacgggacgcgaggcccctcgactcccgcccctcccctctggctctctgtcacaggaaacgaagtctcccccttccgcccaggcacccagacgcnnnnnnnnnngatgcgcacgtgggcattggcatgggacgcgaggcccctcaactcccgcccctcccccctgcctctccgtcacaggaaacgacatctcccccttccgcccaggcacccagacgcaccttgcgccgctggccgtactctggtgtgaccttcttcagcgggggcagggagtcggggtcgaacaccgcctcggccctcctggcctggggcgtgacctggagagcggccgaggggcctgcaggcgcaggctcccgcggcagcggccccggcgtggccgtgggcgagcgccatggcctgatcacccccgggccccgcgagaggggctgccccacctagaggcgcatggggcaaaggggcagggggtgaggggacgggggctgatgcacgactccaccctccagcgctgcnnnnnnnnnncccgacccaggccacctgggctggagagcgtgctaccccccctccccgcccagtcctgcccagccnnnnnnnnnnggaggcgcatgggggcagggggcggggggtgagggcacggggcctgatgcacgactccaccctccagcgctgcgcctgggcaggggagctcggcgcacaccacacccgcgcaggggtgggctgcggtgatgcaagcaatgccacgcagcgcaggtacccacccactcccagtgcaccaccagtgctcacacacgcccgagcctttccgagccaggccacctgggccggggcgtgtgccaccccccttccccgccgagccctgcccagccccacccccgcacctcggcctgcgcgctggtccccgccgccagcgcccccagcagcgggtcggcgccgccaatgcctgccagctcacctcgcaccctgcccaagccctgcagcactccggcggcggtgtgctcgtcggctgaggccggtgcggcgcggggcgaggccgggtccgcgggcatggggagcggggccggggcgggcgccgggctggcgatcggcagccccgggaagcgcgtcgtcaggcccgggaaggagtacgccccgctgctgatgtcctggctcaccatctttttttgtgcacggggcggggagggtggtgagtggagggccaggcaggagagcaggcgcggcagcgccgtccccgcacaggcacggtggtgcgccattcaagggcgacggtcaggcccatctgacctgtaggaaggtggggcctaggctggagcgcagggcggcggcgtactcggtgagctgcgtctggatctggcgcctccgggggttgacgatgcgatgcgctttcctccgtgggttggctgccacctcccgcagctccttggacctgggcaggtgagggcggggagaggtggggtggggagcggcgagcacgcacagcagaatgtgccaagcgagctgcaactccgtccacttctcggtgcagagaactcacacttccagctcctgtgccgtcggttcggggaagaagctcagcacgatttgctcgcgctcagctaagttctcctgcccagcggctctgagcgccnnnnnnnnnnaaagaagctcagcacaatctgctcgcgctcagcaaagttctcctgcccagcggctctgagcgcctccatggccgcatgggtggacacctgggagggggagtcgggaggaaggtgggcgagtgagtgcgactctgagcaaaggcgcgtggttccaagatgcagcgacctgacccgggaacatccgcaatagacacttgcttcccggagacaggacccacacatgtcatgcgggttccatatcaggcagccgaaagcggtcgatcgcctccatgggcaaccattcccccctcacagtgcaccaatagctacaacccgtcggttgcgagtgcatggctgcatggaaacgcacatctgtgtggaggttgggtggaggtaccaggcgctccccatgagggacacggaggggcaggacggcctccagggagcgcaggatcatggctgtgtgggagttgatccggtgggtgccaatgtggtcctccagcgcacggaggaagacccgggcctgcagcggctccagctcctcctcgggaaatgcctccaatatgcgctccaggtcatcgaaggacagctcggggtcggccacgagctgctctagggcccacaagcgttggtacttctccgacactgccgacattatggccggaacacctcggaacccctcgcccctgcagccaacgagggaaggacctcggcaagaagtctccgtgtacggaaaaggattcccggcgtgcgtttatgtatgtctgtccttttaatgaagtggtggtgccctttccataaagatggcggtcatggggacggcctaggtttagggtatgaaggatggggttcgcgacaggtgggctgcaaaacacgcgcgcattcgaggcctctggtcgtgcagaccagaccgagcccaaatgcacagcgatcgaacacttccagctctgtgtcgcaacatattgttacagtgccaattacagacgaatcgagggagcagagatgtgaagcccagctcaatcgattgataggctcactcgttccactcgcgccagcgaggctagtgtgcgacacagggaggacatgcaccgtgctactttgggcacctgattgcacagtatgcgctaagaatgtcgaaaccggattcccgttcccaccagaccctcgttgccttgctggagagagatggtgcgtgggtctcaacccccgactacaccactcccttcaagggcctggacgatgcgctcgaccgactcctaccctaccatgtgaggatggggtcagctggaggtcggagtcttcccgggtggcggtggcagggcggggctgcccggcactggtcctgtgccagcatgggggcggtgtgtccagagcatcaccatgtcccggcacgtgcaccggagcagccctgagatatcttgccgcccctgtctcctcctccccagatgctggccggggagaaccctgctgaggccgatgcagaggccgcggccggagcaagcagggggatcctggccgcgccccgtagcgaggtctggcgcgcgcagctggcggcgcgggcgttggacctgcatgccatgcagcatgcgctggacgggcgcgtgacagctgccgagaaggcgctgctgaccaagtcagagctgccggccctgatgctgcagtcatacgccaccgccgaggcccaggcccaggtccaggcagagctcaggctgaggcaggccgctgacgaggccgcgcgcgccatggcgcgcggggatgcggccccggcccctgtgccgccccccggcgccgccgccggcccggcgcaggccccg

SEQ ID NO: 43529 - DNA, 177 bp, Chlorella protothecoides
tattttggggtgggggggtgggtgggtgtttggtgggtggggttggggggttcctgggaaagggtggggggccgcataaatggatgccggcacccatcacccacacgtccccgccctcagaggtccatacacacaacccccccccccttccaatcctcaccagggcgtgaggctgat

SEQ ID NO: 43530 - DNA, 6686 bp, Chlorella protothecoides
  modified_base (761)..(770): a, c, t, g, unknown or other
  modified_base (4097)..(4106): a, c, t, g, unknown or other
  modified_base (4595)..(4604): a, c, t, g, unknown or other
  modified_base (4975)..(4984): a, c, t, g, unknown or other
  modified_base (5101)..(5110): a, c, t, g, unknown or other
  modified_base (5270)..(5279): a, c, t, g, unknown or other
  modified_base (6200)..(6234): a, c, t, g, unknown or other
  modified_base (6292)..(6301): a, c, t, g, unknown or other
  modified_base (6450)..(6459): a, c, t, g, unknown or other
cctgcgcgcactgtcggccgcgggcgcggcggcgctggcgcagggcgcgctgggcgcgctgcgccccgcgctggacgccgcggcggccgccgacctggggtccggcgccggcgacgactccggctcgcccacagcatgggcggccgacctggccggtgcgctggaggtcacactcctccccctgcgcccgtacctggtgccctccctgcaccagagcgtggtcatgcgcgtcctggacggcgtgctggcgcggctggaggcggccgtcgccgcgcgccgcttctcgcagctggggggcctggcgctggagcgggaccttcgcctgctcgcgggccgcgcctcggagcttgcggggcggtcggtgcgcgatcgcttcgcgcgcctggccgccgtcgccctgctcctgggcctggaaagcgtggcggaggcggccgacctgtgggccgagcccgggggggggctggccctgcgcctgagcgagggcgaggtgcgcgccgtgctggcccagcgccgggagtggtcgcaggacgagatatcgcgcctgcgtctagcctgatgatgaggggtctgtgcgtggcctgcatcgtccctttgcggttgacaactgagcaataagcacacatgctccttaagaacgccacaaattaggcatcgggtcgagttgaatggcatgatcatggtcctgatccccggtcccgagcagccgaaccgatgcgacgccgaagaaactcctaccgagtggatgagggcggggcacgcannnnnnnnnnctcctgatccctggtcccgggcagccgaaccgatgcgacgccgatgaaacacctaccgagtggatgagggcggggcacgcacgataccctccccttgccacatcagatccagacgggtgcatgccgcgatccgagctgcattgcaaaggcaacacattgcaaaatattaaattgtatataatcctacatgcaatgcaggccctgcgatcttgctgcgtgaggggcgtggcgccggtgctctcgagccagggcgtccgctcgtcgacatgcgccctgcccagaacggcgtggttcctgtccacgcctgcagctcccaaggtagggaatcaacgaataagtactgcattgcgctgcagggcatgtctttgttggaaatgggtgggcacattgccccattcatcccatcttggcctctccccctccacctctcatccatcgcctctcctaggtctcaaagacatgctccaccaggtgaagagtggcacagagaatgaatttgacccttgctcatggtttcccatccaaaaatgccgaaggcgtgcaaggaacatatataactgatcgtgatccccgctgctggtcacaggtgtggagtcatttccagggccagtgcgtcacttgcagctacagatgagcagactcgccctgctccctctcctgcagagggtggaaaggtgttgctaggtggtgacgaggcgccctgcctgttcagtcaatgatgcattgcttgattgcctatatagagtgtgatcccaatccaagaggatctccctgtgatctacccacttgaacccttgcccacaggtgcgtgtgcgcttcgcgccttcccccaccggtaatttgcacgttggaggagccaggacggcccttttcaattggctgtatgccaagaacacacatggcgaaatggtgctccggtaggggcctggggtgtgggaagtgggaaaaagggagctccacagtttgtaggcccagggatgctttgcaagcatgcatatgcgttggcagcaaatccactttgggcctgtggccacttggaggactgatctcctgcattttcactctgaccagtgcatacatatacatgatcgggaatgtattattccatctcacatggcaggatcgaggacaccgatgccgcaagatccacagcagagtcggaggcagctgtcctctcggacctaaagtggttgggcctgaagtgggacgaaggtaggctgcaggaacgggaggcagggaatgtcgagtatgcgcagggcttgcacggctggacccctgcagctttgacagcacagcccctgccaaacgctccaatctcagaaaaggcagcgcaagcatcccaaatctgcctattcattgacattctactaatcgcaccccccaggtcccgatgtggggggtccgcatggcccttaccgccagtcggagaggcgggagatctacaaagagtatgttgacaagctggtcgagcagggccttgcctacccctgcttctgcagtgacgaggagctggagcggcagcgagaggaggctgaagctgccaaacagccgcccatttacaggggaaagtgggcacaggccagcaaggaggaggtggaggagcagatgcgggccgggacgccctactgctaccgcttccgcgtgcccaaggatgaggtcattaccatccaggttggtttggtgtttggctggaaggggctgcctggcatgaactggtaagctttctcatgcttgtgcttggcatcttggaatcagagtctaggaatgtggatttcagcttgctgagagcaggtgtgcctgggtgcactgtgtaaccgtccccccttgcccccctctttcatcaccagcccccctcaggccacccccccactgcccctcgtaataccaggacctgatccgtggggaggtgtcgtggaacaccgacacgctgggcgactttgtggtcctgcgttccaacggcctgccggtgtacaacttttgcgtggcggtggacgacgcgctgatgaagatcagccacgtcatccgcgccgaggagcacctcccaaacaccctgcgccaggtgtgccgtggcggtgtgcgtgattgtcgactcggagcatcaccacccagtgcaccacaccccccttaacccccaaagtgacgcgagcaaagcaagcccatgatgcaggtgctggtatacaaggccctgggcttccccctgcctcagtttgggcatgtgtccttgatcctggcggcagacaagtccaagctgtccaagcgccacggcgccacctcggtgggcgagtttgcggggcagggctacctcccaaccgccatgatgaacttcctggccctcctgggttggaacgatggcacggagcgcgaaatgtttgacgcccgggagctgtcggaggccttttccctggaccgcatcaccaagtccggggcggtgtttgacacaacaaagctggcctggatgaatggtggggcgggaaggagtgggttgaggatcctgggcgtggagacctgtgcttgctcttgaaagggttttggatttgaggctgggctgccggcgtggacgactggagcaggcggtcctgcaggttcccgtgtcatctggaaggaggtgtgacctttacgctgctttctggccgacagcaagtcctttccaggccttttgaaggcacacaccaggccgcacgacctgcaccatccctcctctcttcaaacaggccagtatctgcgggccctgcctcaggaggagatggcccagatggtggcggaggtgggggcggccaaaggcctgctggcacgacccgcggtcacgccctttgtacaggcggccacagagctgacgcaccagtcgttggagctggtgaacgatgccgtgacccagatccagtggctgctgcagtacccgctggaggagactctggctagccccgacgccgcccctttcatcgaggacgggtttgccgacgtggctcgcgccgtcgtcgccgcccacgccgatggcagcctgcaggccgccatcaccgggggacccgacgcctacaaggtagggatttttgtgtgtgtgtgtggtggcttggagtttgagtaagttgggggtatctatggacgatgtcctgtcctgggtccgggccgacctgagtaatccatgaaggttgcctctgacttgttgactgcgagcagggcatctttgcacccgttgcagtctttggccgtgtgcggtcctttcgtgttcagtcctcctccaccctttcgtcaaacctgctccccacacacgcacacacactcgctgccagtcctggattaagggcctgggcaagtccatgaagcgcaagnnnnnnnnnnccccccccacacacactcgctgccagtcctggatcaagggcctgggcaagtccatgaagcgcaagggcaagcgcctgttcatgccggtgcgcatcgcgctgacgggcagccaggcaggcccggacgtgggccaggccctgcggcttttgaccctggaggatggggacctggcggccggggtcaccgtcgtgcacctcgacgaccggatcaaggcgctgcaggcttggctggacgcccgctcctgaacgcggcggtggcgtctctcttaccatcgattggcctgactggtgtcttcaagcgcactgccttgttgtttcctgtaaccagacactgcagagccgagtagaccccccgccctgtgataggcccttcttggcttgcactgattctcaatagagggaccttgagctggtgcatgcctcgttgaggcgagagggaaatggcaactctgtagacatgttccctacgcggtctccatcacgccagggnnnnnnnnnncagggggaccttgagctggtgcatgcctcgctgaggcgagagggaaatggcaactctgtggacacgttccctacgcggtctccatcacgccagggtcacccgctttcccttgtcgcgcggggagatggggtctgaccccacccccggcgttcgccccgcctggaagcgtgtgtacaccgcgtccagcctcgcccgttcagcctgcggcaccgagggccgggcggccgccagcgccgcctccaggtgccgctgcatgaccactggccgcagcgccttgtcgggcgaagcggggggtgcatcgccgccatgttcaccgttcccatcgatcacgcctccagcagcctgcgcgcgcgcctcggcgcgctccagcnnnnnnnnnncgatcacaggccgcagcgccttgtcgggcgaggcgggaggtgcatcgccgccatgttcaccgttcccctcgatcacgcctccagcggcctgcgcgcgcgcctcggcgcgctccagcnnnnnnnnnnaagaccaaggtgccgacccggcagaaggtggggggtgctggggtgtgtcgccccgtcctagcacggcagggatgcaatattctgccctccggacgatgcatcacccccccccccaccaccaccaccatcgtcagggcgcggccgggtgggaggacgtggnnnnnnnnnngcctcgtgcgccgccgccagctgggcctcggaaagcagcgccgccaggtcggcgccggtgaagtgatcggcgtcgtggcccaggcgctgcagttccacgccggtctccaggggcatggaccgcgccagcgcggacaggatgaggccgcgctcgcgcggcgtggggaagtcgcagagcaggaggcggtcgagacggcccgggcgcagcagcgccgcgtcgaggaggtcggggcgggaggtggcggccagcacgcagacgccgcgcaggccctccacgccgtccagctcggtgagcagctggttgaccacacggtccgtgaccccggtgttgtcgtgcccgcgcgccggcgcgatggcgtcgaactcgtcgaagaacaggaccgagggcgcggcggccgaggcgcgggcaaacacgtcgcgcaccgccgcctccgacgcgccgatgtacttgttcagcagctccgggccgcggaccgtgatgcagcgcacgcccgcggcggccaccgccgccgccaccacgtgagtcttgccgcagccgggggggccgtagagcaagaccccggtgcggaggcgcaggggggcctgggtgcgatcgttttttgggggggggttggatgtgagcgtacacgcatgacagcctcacattgccgaggtcatggatccccacgccctgtgcatccaaccactcctccccgcttccctcacctgggccagcagggcggcatgcttgatgggcagctccagggactcgtgcagaacctcccgcacctcctccatgccacccacgtcctcccacccggccgcgccctgacaatggtggtggtggtggtggtgggggggttgatgcatcgagcggagggcagaataatgcatcactgccgtgtcaggacagggcgacacaccccagcaccccccaccttcnnnnnnnnnnnnnnnnnnnnnnnnnnnnnnnnnnngacgcccccccacatcaccagcacgccccccccatcggccccacaaccaaaatccacnnnnnnnnnnaacgaccccccccctcaccagcacgcaccccccatcggccccacaaccaaaatccacctggcgggcgggggcttgggtgcccgcgccccagtaggcggcggggaccatgcctcgcatcgcctccagcagctcctcctcggtgggcgccnnnnnnnnnnctgggtgcctgcgccccagtaggcggcggggaccatgccgcgcattgcctccagcagctcctcctcggtgggcgccgtggaggacccatcgctgcgccctcccttcccacccgcgcccaggcgctggccggcggcacgtcgcgccgccagatgcagcgcccggtccgccagcgtggccaggtcgtcggcgtcgtggccctcggcgcggcgcgccacctcgcccagcg

SEQ ID NO: 43531 - DNA, 423 bp, Chlorella protothecoides
  modified_base (130)..(327): a, c, t, g, unknown or other
cgcgcgctggcgggcgctgagtcggacgccgtgctccacctgcgcggcctgaaccccctggtgcagagcctggtggcggggtccggggcggcgcgcgccggcgcaccgcccctcctgccgcgggagcgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggccttgctggaacgggcgcttcccagcggcagcgcccccaacctgctactgctggagagctcgccgcccggcgtcggctgcgctttcctcatgga

SEQ ID NO: 43532 - DNA, 61 bp, Chlorella protothecoides
gcatccacgcatgaagggacgtgcatgaaggacccacgcatgaatgggcacccacgcatga

SEQ ID NO: 43533 - DNA, 431 bp, Chlorella protothecoides
  modified_base (113)..(259): a, c, t, g, unknown or other
cccacggcgcccgacgccccctcgccccacctccctccccaccttctgcgcggagttgatgccgggcacctccagggcgcggctgacctggccgccgtagaagaagacggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgctccgcgttgctgatgaggtccacctcgcgcagctcggccaccacctcgttccagacgtcggagaagaggacccagctcggcgcggcgtcgccgtcgggcggcgcgcgcgcgccgggcgcgctgccctcgcccagcgagcgcagcaccgcctcgcgcccgtcctccagca

SEQ ID NO: 43534 - DNA, 61 bp, Chlorella protothecoides
ctgcgcgccgtcggcttcctgcgccgcctgtcctgcttcggcgagcgcgagctgcgcctcg

SEQ ID NO: 43535 - DNA, 13187 bp, Chlorella protothecoides
  modified_base (387)..(396): a, c, t, g, unknown or other
  modified_base (9549)..(9558): a, c, t, g, unknown or other
  modified_base (10041)..(10050): a, c, t, g, unknown or other
  modified_base (10212)..(10221): a, c, t, g, unknown or other
  modified_base (10407)..(10541): a, c, t, g, unknown or other
  modified_base (10874)..(10883): a, c, t, g, unknown or other
  modified_base (11747)..(11756): a, c, t, g, unknown or other
  modified_base (12216)..(12225): a, c, t, g, unknown or other
  modified_base (12884)..(12893): a, c, t, g, unknown or other
gtgtcggcgctgcgcgccgaggcggccgagctgcggcgcgagcggcgccgtgcggcacgcgcgcgcacggcctccggccacgcccgcaatgcgctgggctacctgctgtcgctgtactgcgtgtaccgcatgctggcggcggccaggagcctgctgtggggcgagccggggcgtggggcggacccggtgggcaccctggtcagggtcgcggtcggggtgctcacgcgcggggcggtgcaggtggacacccacatcctctcccaggtgggattgtgtgtgtgtgttaagaggggggcaggcgatggtcgatggggtgtcatatggagagtttccccgtggaatgtccgacttttccctgccacttgcctgtgctccgctactccaacnnnnnnnnnncggggtatcatatggagagtttccccgcggaatgtctgactttttcttgccacttgcctgtgctccgctactccaacatttgcatgcggattctgggcaggatgggcccccaatgctgccgccatgctgccaatcctacgccatgagcctcccccccatcgctcatctgagcagccgccagggcgcatgcccgcctgcccatcccctcaccccccccattcccctttcttcacccctccctcgtgcaaaaacagtacatgacgctggccttcgtggcggccatctccgtcacctccctccgcggcttcctgctcaacgcgcagcgcgcgctgagctggctgaccggcgcgcgccgcgccgcgccccccgtcttcctcctcaccgagctgttgggcttccacgcggtgtccaccctcctgctcctgcgtcgccagctggcgccggcccaccgcgcggcggtgaccgccgcgctcggcggcagcggcagcgagggcaccgccgacctgcccctggacgccttcaacgcctggttcaaccgtctgttcctgggcgcggcgctggcctccatcgcgctctactggacggcggtgcgccaggctcgcgccgaggccgccgaccgcctgcccctgtacacaccgcaccgccgggcggccgaggagtgagcgtgaggagtgagcggtgacgtcgtggggagcaatgccctgattgcgctggagatcccctctcaagaatctctggcattgtaggtttcttaagttaggagaggaggagggccaaggtggcatgccatgactcaggcaggggagagtcgcatggcgcaaggagcagtcgatgcacattgtcgtgcagggagcagggacgtgcagcgggggtcgcaagggcgtcagggagcagggaggggcagtgagggaaggcgcacatggctaggtgagagcgtggcacccgtcaagagggggtgtagacgcgcggtgcccgcattgccatccacatcacgcagtgcggctgggctgcgtggcggcaacccgggcgtcggccacgggcaccgccacgtgtggcaggacgtgctgctcaaaccagtccagagtgaactgcatgtggaaaccggggcagttggcgagcgtcaggcgcccagactcgttcagggtccgcagccccaggcggtcgtcgcggtacgctgcggtttcctccatcgattcctgtgggcggcaggcggtgggaaggcatgggccccccggctgtgcaaggctgttgggagggggactgcacccgagatgctggtccagccacaagagaatgccctgatcgcaaaggggcgccgcaggtgaacagtcactaccactgcgatgctgccgccccatccacgccattccaccgccctcttcccagcaccaagcccagctcaccgtgtgcgttccgttgtaaaacccaaactgggagctctcgcgcgggaccacggtgaggtcgttgtcaaactggtacaggaccaggctgcggagcgatgtgagggcggccacgtagctgctgttcctcgcatcccgatcgttgttgatgtcagccagaaagccggaggtctccctgtaccagtccaggtggtatgggtcctgggggcgcgggagaggggaggggtcccctcattggcggcgcggcctgcgctgaacgagttccatggaagggaaccctcgaagacaaggggttgcgaggcagggggaggacggcgagcgtgcatgtcgggccgttctggaccatgcgaacagtgaatatccagcaatcactctctgtggtgaacaattgagggcccctggggatcatgtctgctcagaatctggaacccactccctctgatcaccctcaccttgaagtactgggcctggaggaggttgtgctgcagccaggagtagtacaccccatgccccaacagcgcttgcatggcctgtgcggtggcagggaaggaggggatcggggtgtgctgcggcgaggggaaacgcaggcgtctgatagaaccacagcagcaatgctaccaaacacccaacagatgccttgccctcgattctggcgtgcaaggcatctcaatcaaagacctatgctcccacagatgatccgctggcattattgctctgcccgagaccctcgtccctggccccaatgcatcccttcccctcctgtccgccaccccccaccccccacacaaccccaccaccagagttcacccctctgtcagcgcaccttgcaccagctccaggcgacccccgccccgccgcccacgtcccagcagccggggacgtccatgacgccctggtggggcgagcccatcgtgatcaaggtgtgcatggccggcgcgcctttccccgtgcagcgctccagcaggccgcgcaggagcaggccgccctggctgaagcccacggccacgtagccgcccgccagctggggcagcgcgcgtagcgcgtcgcaggcggcccgcacctgcgcgtttgcgtcgccgaagtaggtggaaagcacgtcggccgactcagtggcgccggtggccacgctgtgcacaaacacgccgggcagggcacgctggatgcggtcctgcaccgcgccgatgccctgggggttgcagcaggagtcgcccatgcctgatgtggggagcgagaagggaggtctcgacgatgtggggcatgtgagtgacgccggcaggccctgggcgaagggctgctgcagggagctgctggcaagatgcacaggggtcaaccaactctcgcatcatgaagctcaagtctctgtgacgtaccatgccagagaacgatggggaggtatgggccggggggcagcgcgaggcgacttgctggggtgtctcggatagctgcaccgagcgaggcagaagacagcaggagcaccgccaggatcaggcacccgtgacccattgtggcgaaactcgagcgtctaaaacggcacccaggggcagttgtgaccatgcgggggagggcccgagcgtggtcagacgcctccgaaccctaacgcggaggagttcaacgcacactgcctcacagccccacgagtctcgagtgctgtcacaacagtagagttgcgaacagcatgatgcatttcattgtaggggagagaatggtagaagagcatgtacggtatcatgtgtggccgcgcgaccggggtgtcgggcgatctggccgagacagcgccaggagcaggttccggcagggctcgcgctctgcccagctcccggatgccgcgtcgaagagtaccatagtcaggcgcctcactatcgaggctttattgggtggagatcaggctgcgcctggtcaggtggatggcccctgccccgcctcggccgccatttgctcgtaggtggcctctgcaccgttggccaccgggatccactggttgagctggcggtagtagggttccttgaggtcgtacctgccgacagaaacgggggaggcgccgctggacagctccagcgtcacatcgtacgactgccgggagtgtgccagcaggtgcaggcggccggtcagggtgtcaccagccttggccacctgcacaggctcctgcagcaggcatctcagctggaacctgtgggcgccgagggggtgggggaccttattgcacgggggtgatgcggcatgtcaacagggcaggagcgggtgaagaagggggcatgcagacccggctccgaccctggctgagtgcatcgtcacgggcctagaccttgccatactcgtaccacacgcctccaggtgcctcgggccagggcatgcacttccctcaacaagaagcccagcgcgcaccagtgcgtcgtgggcaggccgggcgcggtggagagccaccgtggcgcctgcgacccctcgaacagcacgtcaaaccagcaggcgaggccatgcaccggccccggcgctgccacctgcagactcagagggatggccagctcgcgcaggtcctcgggcgccgcggtggcaaagtcgatggtgcgctgcgcggtgttggagaccagggcgccggaggggatggcgtccaccaccacctggccaaagtagccggccgtcgcctcggcctccaggcagctgaggtccaggccgaagaagtcggtggccttccagaaggccgaccgcgccatcacctcggcgtgcaggtatgggtccgagaagccggccacgtggatccggcccaggctctttttttatgtaagaggagggggaaagggaggttgtgggtgctggggactgggaatgggggggagcgtgtggcatcgcagcgggggggttggtctgtcacagccgttccggcacatcaacaaccctggtcaacaccccagcgccccatcagtccctcctcccggactgcgggcaactgccaccgactcacggggaacatcttgcccccgggcttcatgtgtttgtcccgggcggccaggtacgactctatcatgcgctcattcacgagcagcgtgcccattggctccgagatgagcacgtcaacctggcggcccaaggaagagggaagggttggaaggggcttgtgcgtgcttggcctagggtgcctcagcatcttctcggagtgtgcaggccgcaggcaggctgtgcagccctgccgtgcagcgcaggtgcccccgccagagcgggccccgctgctgccgctggactcaacccattgccccacctcttccacattctacacccaaaacaccacccaaagcaattcgtccttgcacaccttttccggcagctccacatcctccacccggccctggatgacatggactatgcccgccaggcccggctgcgcctggaccaggcgccgtgcatactgcgcggcgggggaggcctccaccgcgtacacgacgcgcgcgccggcccgcgcggcgaagagcgagagcacgcccgacccggcgccgacgtccagcacggccttgcccgcaaagtcggcgctgttctcggagatggccgcgtggtaggtgccggtgcgcagcgcgtccgccagcatgttctgctggtgctgcagctggccgtagtagtggaagtagagctctgcggacccggcgtcggtgcgggcgtcaaaggtgctggggggggtggggcagggggtgggggtgcccggggagccggttttgggggagcccgcccggctcgcccttgggaggggagcatcctgaccgggtgctggcgccccgagggcgcgcaccagggcgaccacctcgggagaggggtcggggatggagtactccagcccgcccgggcccatggctagacggacctccggccccacaaagcgaaccttccgaggtgtgaggagcggcgagtcatgctgattctggagtcgtcaaagaaggtaatttgggtcaaataagtgtacttccgcccgacatctcccctgcgcgtacctccgtgccctgcagcgtgcgcgcattgacaccgtccacctggacttccagccggtgggctccctcgtggaccgctcccaggcggagctgaacgttgctcaaaacaggaagggtgccgtccaggggcaagagaacggcattgactgcgccggctgccactcctgacggacccatcccacccaccgggccgtccctggccgtcgacactcccgactcgagcaccggaacccaaactgggactgaaaatctaatgtgagatattttccgacggggcctgcaaagaacgctccgacgggtcatagtcgaaatgcgcgcatgcgcaaatttgccagcgtgtgattgttcacttcccgaaagggagatgcaccgaccctggcagcgtgcggtaggctggggttcttcacagatggggcattcaaggagataggattgctgaagctcagcttctttccctgggtaggggaggcattgtgctgaacctccagacaccagcattggccgacatcatctgtgcagtgtgagttgtccctagaatcgcatcgacctccttccgcacacccacaaacactgtgctagagcatgttatgaacgtccaagatacatgggtattggttgatacaagcaggtcagtctgggaatgcgggcgctaagccatgcacagtggggtggcatgccctgcacaccactcccatcaggccctcccctggcgcaggagcctgaaggcctgcaggtctgcatagggggccccgctcactggatcccggtagcgggccaaggcgcctgtgacggcgcagcgagctggcggggggggctcgggcgccacttgcctctccagctccggcggcagcgccatgtttcgtacctccagggtggtctgtgtggagtgagttggcctgggctaagccagcaagcgggccacaggcaccgccaacaggattgcgcttgcagcagtggtgtttcgtagggttcctggaggttccgcacggcaggcgcacaatgaaccagggaggttccctgcccgcttcggagacagttcaggtgcacagcctcgtctggctgcacatcagctctgcagaacctccccaacctccttcccctcccgccccgcaccccctttgagtcacctgttctgtgtcgcctacacgccgtgaggcccagcgtagcatgggacccacgtatcgcgttcgttggacgtcggccgccgccctgacctcggccgcggcggcctccagcgccgcaagagagcgcaggttttcgatctcggtgcgcgccgcctctgctagcagctccgcctgcgtcaaagcgcgcgggcccgtgccggcgcgggccggccggcgcacccgggcctggatgcaccgacagtgggagggttgggcatggagggggggtttctcgtgacatcagtcaaagccagggcggcaggacgttcagttgtcacagatccatatggcctggggaaggatgcagcattgcgacccagcactgccgccgggtcctggctgcttcaggcccctcggacctcccctgccctgtgaagccacccgcaatcgcttcactgcactctacaggacagatttcagactacagctgctactcctcatactccactttgcccacgggattaccctcctctcccacacctgaaccttcctcgcacctgatcatttgccctcctgcgctccgcctccccatcctccacccgcgcgcgtgtggaggcgcgcacgcctcgcctctccccagggtctagggacggggagggggagggagccagggatcggcggcgcggggcccctgggatcgaggcaggtgctggccgctttgggcccaaggcgcccgacctcgcacccggcggcttcagcgccttcctcctgcgtaacgaattgcatagggagcatgtggatgttggtccagccttctgcattcatccacgcagctgcacacggcatcattccatcaccgacattccaagacaagctctactctgggccaggtgcaacagcatccacccacttgggttcgcggaccgccgcctcggctgcatcgctgtcctcgccggaaccaggctcctcctcctgatttgagcgagggggtgtgttgcagaggatggagagcggggatgggcaagtagacggggaaaggggcaggcagctgaatgaaaactcgctcattggctcttcctcatctcatatggcaaggaggaccctttcgcagatgcatcagcaaacccctccttctgtacgtgcccttgcacccccttcctgctccccaagcaccgtatcataaacagtcctcatgacccattctcctcgaccatgtagcttccatcgccaccattcgctcaccggctcgtcaaagtcttggtccaacctgtcctccggctcactctcggtttcatacgcttcatctgccgcctcctctgcaaagaactcctggcccctgtggtagggaggagggtgagctttgggcagcagccaggtgacagtctccagacgcaacagatcgctacgctctgctctccaacacaccaaacctcctgcgcaccagaagtcctggtcgccatcctcgtcctccgccaggacttcccccgctgcgtagcgattggctcgcgtcttgcggtctggcatctctcgtgtggtgagtccgcccatgtccagtcgcggcttacggcctggccggcgagggggtggggagtccgagccggaggcctcgctcccgctcggcccctcctcttcctcctcctcctcttccccttcgtcatcgtcatcagatgcttcatcacttcccgacgccccggcctcctcttcctcagtgccgctccccccctccatctctacatcgcctgaagaaggcgtcaattcttcctccccgatgtctccagcggtggcctggcgaggaggaggtggtgcaagcgatgctcaacgcatacacgttgcaacgcgctcgcgaccgactgagctagaataaaatactcctacctcttctgactcggcgcccgttcccccgcgcatcccccgctggaggcggggtctgcaggctcctggaggcaaccggcaaccagaccccagcacaggactcaaggcatcggcgggtgtcaatacatgctctggtgcctgcatacacgagtaccagtgatgtctctgcgaatcgtgcatcgccaaggacagtgtagatcgctgatctccccccccgaaatcgggcgcgccctgcccaccatgtgtcggcagcagcttgcacattcgatttgctgaatgtctctgctccaacgcacgctcacacgaagaagctacgatgcatgtgatataacacatgcttgcctccctgagaggcgggccgtgagaccgttcccaagcttattgtacgggcacgccccttgatcacttactcggccgggcgccatggcggggggttccagcctgatgcggctgatgcagcagattgccgacaccctgattgtgggacgagacagctccagtcaggaatcggatgggcctgtggcccgtcgtctgcgatccgtgctgatcagtctcctggatgccatggcggagtcccacccaggtgtgatctggatggggagggaggcaggagaggcagcgctgctgattaccaacatccttgtacacatgctatgatcctgcgcttatggcatacgagcaccctttcatcatcccatggacgaaaagtactggggcgagggtgcacatcttcatgctcatctgcaaccattccgagccagcaatctgacaccggctcaccacctcctcttcccttcaacccctccccgnnnnnnnnnntcctttcatcatcccataaacgaaaagtactggggcgagggcgcacatcttcatgctcatctgcaatcattccgagccagcaatctgacaccggctcgccacctcctcttcccttcaacccctccccgcgcaggccagcgggagacgtcctcggtgctcaaactcctgctcctggtcctcacccaggcccccgccctgctcataagccccggggacgaaggaaatgccgccctgacaaacatcatcgcgcggctgctggccctggtggccagccccgagtttgcccctgcccggccggcgctgggcgacgccgtccgcgccgctctggcggctgcccggaagctgtcccagcccacacatgcccgtctggcggcggggctggcgactctcctgcagggtgggtctgagtgaatgggggtgtttcacgtgcgggaggttccagggtgcagggctccggggcctggcagccgctgctgggcatcnnnnnnnnnntgagtgggaggttccagggtgcaggagtccggggcctggcagccgctgctgggcatcattcccggttgtcgctcccagcaaaacagtcctcaaaccccgcaaagacctcgccgtgccctacccctggcccattgcatccaccgctagcagacgtcctggcgnnnnnnnnnncccccgcaaagacctcaccgcgccctacccctggccctttgcatccaccgctagcagacgtcctggcggccagcgcgccgcccggcgccccgctcgtcatcccgctgcccttcgcgcccgatcacaccctgcgcctgcccgatgccgaggcgcgagggggggtgctggcagccgcgctggccgcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccggccctgcgtctgctggccggcggcagcaggaggcacgccgacgcgctgcgcgcgctgggctcgctgcgcgccgccctcgaccgccacggccggctctggggggcgggggaggcggaggccgcgctgtgcctgctgcgccgcgccgcccagcgcgcggcgcgtgggggcctcggggctgtcctggtccctgatcttctagctgccggctttcggctggcgtccctgggattgaggagtgaggttcagggcccaggcgggtgcggggacggccaggtgggggccgctggcgtacgagaccccgaggtggggataggatcccatcatggcgnnnnnnnnnnttagctgctggctttcggctggcgtccctggggttgaggagtgagattcagggccctggcgggtgcggggacggccaggctggggccgctggcgtacgagactccgaggtggggataggatcccatcatggcgacgcggaggctcttaagaaagcggcgcgggaggccatgcgctgcctggagcgcctggccgcggcctgccccgccgccgccacctggccctgtttgatgaggcaccgcaccgagttgctcgccgtgcttggtgcgcgcgacgccctgttggtggcggctgcggcgtcgctggtcgcgcagtccgcaggagagcaaggcggctgggttggtgcggcagaccgaacaccatgtgatctggaagcagcccggcagctgctggaggaggcgcggcgcggtgcgtgcggcgcgaatcgctgggactgcgcggtgcccatgctcgccgccgccgctgcaatgggacatgacgaggatggcaccgcactgcagcgtctggccgccgcggtcgcggccgacattgaaggaggggtctgccgcggcaacgcacggtaccctagctccgcagcgagcatggcgcggctggcggcctggggcctggcctggctggaccccggcagcccaccgcttcaagccgcggcgcagaggctgctggcggcgcctggatcaatcggtgacccagcaacagaggacagggtcgtgcgtctggcagcagctcacgccgcccttggcgttgtggtagcactttcgccggcaagtgcgtcgcagagcgccccgtccgctgcgagccacagtgcctgtgcagcagccctggcggctgtgcaactggcgtggggcttaacaagtgcgaggcctgcnnnnnnnnnnggcagctcaggccgcccttggcgttgtggtagcactttcaccggcaagtgcgtcgcagagcgccccgtcaactgtgagccgcagtgcctgtgccgcagccctggcggctgtgcagcgggcgtggggcttaacaagtgcgaggcctgcggttgccttcttggcgccctttgcgtgccacctggcgacggcggcgggtggggacggccccgcggcaatcaatctcctgcactcggcgaccgaggagtgcccccgcgcggcggccgctggcctgcaccgcttcctgagcgccgcctgccggccgcctgaatgcgccgacggcggcgcgaccctggcgcgggcggcgctcggcgccgtggccaggcctgcttggcgtggcgtaccccggcgacgcgaccctctcgcttccacatttgactccgggccgctgtccctggcacggcgcgggtgggcctggctggcnnnnnnnnnncggcataccccggcgacgcgaccctctcgcctccacatttgaccccgggccgctgtgcctggcacggcgcgggtgggcctggctggctgccggcctggagcgagccgttgcaggtcccgagccttccgccgcgctttcctcgtcgtcgctggtcctggccgtcggcctgttcctgcgccactgcccgccggaccgactggagggcgcgcgccctctggcagagtatacccttaatgtcttggcatcgggcgacgccgccgcaagagcagcggcgctgcgcgtcctgctcgccacggcttccgcgcagctgccgctggcgctggctgcgcgcgcgccgcacccggtgccgacgccggagcgggaggcttgcgccgcgcggtgccagctggacctcatccaggtgtgcgtatgttggagggggttgtcgggaggatggaggttgggagggaaaggagggaagttgggcgcacgaggggcgggaaggaaggggccttggtgcctggcgcttggctggcgggctgccccatggcctgcgcaggagcacctcttctgaacagggtaaccctgctctccctccgttccacgtctctccctccgttccacgcctctgatgggcttccgaccatagtttcttccctcttcacttctatcccccgatnnnnnnnnnnaggtaaccctgctctccctccattccacgcctctgatgggcttccaaccatgttttcttccctcttcacttctatcccccgattccaacaccccccaccttcaagccaccactctcccgactccaccaacaccccctccggcgcaggccctgcgcgcgtcgctgcaggatggcgccgcccccgcccgggcccgtgccacgctgctgaccgcggtgggcgtggccggcgagcgcgcgggcctggcccccgcgcgccagctggcggcggccctgctgctgctggggctggacgacg

SEQ ID NO: 43536 - DNA, 69 bp, Chlorella protothecoides
gccaggcgccgcggcgcagtccagcgcccgtgcgcgtcgacctccgcctcgggcacgggccggcgcccg

SEQ ID NO: 43537 - DNA, 61 bp, Chlorella protothecoides
cttctcgtgcatgtgccaggccaggccccgccgcaaggtggggacgatccacgcgacccgc

SEQ ID NO: 43538 - DNA, 61 bp, Chlorella protothecoides
cgcgctgcgccgcgcggtgccggccaagaccctgacccagatcaagaactactaccagaac

SEQ ID NO: 43539 - DNA, 61 bp, Chlorella protothecoides
cctccagcgactggtggtaccactgctcccaccccgcctctgccgcctcgggtgcgcatgg

SEQ ID NO: 43540 - DNA, 6412 bp, Chlorella protothecoides
  modified_base (461)..(470): a, c, t, g, unknown or other
  modified_base (543)..(552): a, c, t, g, unknown or other
  modified_base (1544)..(1553): a, c, t, g, unknown or other
  modified_base (3767)..(3776): a, c, t, g, unknown or other
  modified_base (4002)..(4011): a, c, t, g, unknown or other
  modified_base (5350)..(5359): a, c, t, g, unknown or other
  modified_base (6009)..(6018): a, c, t, g, unknown or other
  modified_base (6218)..(6262): a, c, t, g, unknown or other
ggcccgcggcggcgcgcgccaggcgccgcggcgcccacgatgccgcggcggccgtctgcgcccccgacgcctcccccccgccccagcccagggccaccgtgttgggccaggcggggaggcccttgaggaagtagaggttggtgacgcccaccagggtgggggcgccctcgggctgagcccccgacgcgccatctccctccgcaccggtctgcggcgctccgggagccgcgccgctgccctggcaggtgagggccgcgaaaccggggtcctggatggtaaggtagggccgcacatccccggcgtacggcagggggctaaggagcgagaggagggcggcgatgccctccgagcacacgcctgcacgctccgtgggtttggggggagtgggagtgtcgggagagtgtgcgagtctggagggcttacagtcaagggggggggtcccattgggctggaaactgagnnnnnnnnnnttgcccagacccatttgcactcgaccaatcccagcaggttttgcacctgggctggcgccgatgacggccagcnnnnnnnnnncgtgtcgggagagtgtgcgagtttggagggcttacagtcaaggaggggggggtcccattgggctggaaactgagctactccgaggtgatgcagatgcccaggaaggagtgaaacgggaaagcgccagcattcactctatcaagccagctttgcagagccacaccccgtgtgcccagacccatttgcatccgacaaatcccagcaggtttcgcacctgggctggcgccgatgacggccagcctcctccccagcaccagcagctcccagagcgtccacaggtgttgcagcacaggctgcaacgcagagtacacatccacctgcagagcagggcttgaatggaccgattcatgatggtgagctgagatggtatcccatggttcgcccagtgcacaaccgctctgcagggacaatcaggcaggcttgcaggatgtctgcgactgcacagggtggaccagatccatacccaatagagctcagccaactcctgcggagcagtgtcatgctcgtaattgctgcagccacttgcccatgtcccggcccatcacacccatgggctgtggctcatggtgtacaccctccccagcacgacctcccttccctccccgtcatccctgccgcgcacgtgggagtaggggccggcggtgagcttgtggctgtccgccagcagggcctggggcaggccggtgcccgggtccagcgtctgtgtggccgctgtgccggggatggtggcggggtcaggcagggccagcgtcagctgctggccccggatccagacctgcgcctcgcggtctgccagaggcagcgcgatggggaagacaagcgccgcctcgtatacctggagggaggggggggcgggaaagggaagatggacggatattccaggcctccgacagagccacgacgcaagggtctgacaaggagcctcacaaactgagtctgccaggggaaatccgcgctggcagccactttgcagcctgccccacacccacgcnnnnnnnnnncacctggagggagggaggagcgggaaagggacgatggagggatactccaggcctccgacagagccacgacgcaaaggtccgacaacgagcctcacaaactgagtctgcctgcggaaatccgcgctggcggccactttgcagcctgccccacacccacgcatctgcccccaaggaacgcagtccactgctgctgctcggcgagagcgcacccccagcgcgctcacatccacgacggcgtgtgggccgtaggcgaggcagacggggccggcggcgcaggccagcgcggtccacagcgcatgcagggggaggggagacagcaccacaaagctgcgctgctccgcaccgcggcgcagcgcttcgtcctggcgctggcggcagaagacgaagccgtacagcgagcttccccggcgcggcaggcggaagaagaagcttgagtcgcggatggaggcgggcgccagctgcttctgggcggtggagtcctgcgggtgaggcgggtggcgtgggcaactcgaggatgttaaggagtggggtgaagccgacatggctctgggcacaccaggcctgtgcatccattgtaaagtgcccaggacatcagcagtgcatgtccctcctcgtccccaggtctcactgggaatgcatggtaggcgacccgctgctgatcgccctcactcagagacgcaggggggtgcagactctcgatcttctgtccctgatccagatcgaaaatcacggtgcacaccgctgtgatcagttgctgggaccccattccagcaaccacccagtcagcccttggggcctgatgactcacatggcgggtgaggactgctcggcaccgttcctatactataactataaggtaaacataagggcttccgaggcaaggcactccacaagccgctgcgtgttgatcgcgcatcgcgtcggatgttaccgagatcgcgctctccagggacagcatgcggagcatcgacttgactccaagttcgaattttttctgtcgatgcctgcgcaccacttcgattcaaactcgagctgcgaaggctgacctggagacccgatttgacaaagagacgtaaggagagccccgcacgaaggatctggtgcctgcggcagggtcccgagagggtctgttgggacctcagtgatgggaagggtgaccgtggaggaggcattggaggacgtattccggcgactacagaacctcaaggcgtgtgcatggcagagtgcgaggaggggggtcccgtgcctggcaatcgtccaacggtcgttacgcctgctcattgccgggggccggctggggtagtcggcaaaccgatttcgtgatcccctcccatcacctcacttcgtaggagaccttgcacccgggcactctggactacgccggagccccagcacccctgttcgcattgcaaaaggcaaccgccgacctcgaggctctcgtgcacggcagccaggcttcgaatgacgcgagcgaaacggccatcccatcacccgccgacccagcgtcccagagatcgagccagctcgatggtcctcgagatgcgccaaggccggcacgcaatcgggagtccgctcctctcccccaaacggcttcgtgggaacaaggtgcgaggcaatcgggtggcgacgacgacatcgaatgactgtccgtcacaccagcccgctcgatcatcgactgacctcggccattcctctttccgccacccgtccagccggcaaactcgtaaaggtgcctaccaagcagaggagcgccgtccggtctgctgcggcaccctctaacttctgcacggtgcgctgatagaccttgaattatgcgcctattatggttgcagggttggtagaaggtacctgggacagaaggcaccctcatgatgtatgtgcctggggcgtaagtatgcctgcaggagcagcctgaagttctcatggtcgggcgataacaaactcttggatgtacttcttgaacctctggcacccactcacataccccgtcctgcaggtgggattgccagcgacacccttggctgccgcccaggggcctggggagcaggatggcggggctcagcccccagccaccactcccatggccatcgaggccctggccttcctgagccgggccgctcgatcgggcgcatctgtcacgggcagtcccattgtcgccaaggtaccaggatgcgtggggtttggctggggaagtggatcggatgcacttgcccnnnnnnnnnnagctcgatcgggcgcatctgtcacgggcagccccatcgtcgccaaggtaccaggatgcggtggggtttcgctggggaagtggatcggatgcacttgccctgctgtcctgcccccttgcccctgtcgagactgccatctgtgctgcactgatgcgcgttgcatgcatcactcccagcctcagacctcccccccccggcacccccactcgcacccaccacaggacgannnnnnnnnnccctcagaccttctcctccccgcacccccactcgcacccaccacaggacgagccatttgccgccggcatctcccccgccagccgtgcggcagcgctgggtgccgcgacgcccctggcttcgttcggctcccagcatgcgaatcaggcggccctgcctccatcccggccccgcgcgcccggctcggtcagggcgtggcccctccccagcgaccgcgccctggacggcggcgggccgctcaccgagccgaccctggccgccaagcgctgctcctgcaagcgcagccagtgcctgaagatgtactgcgactgcttcgcggcgggcggcttctgtggcccgggctgcggctgcttgggctgctccaattcggcagacgcggtcgatgccgtgcaggaagccaggagcgccgtcctggccaaagaccccactgccttcagggccaaggtgggcggatgggggtgatgcctgggagggggttgcttcgtgtcctggagggggggtgattgaatgtcaggtgcacgactggcaggcggcaggcctgagcaagcccaggccctggttgggaggcaccctggccttcttgtcgtcacattggatgtcctcgggttgggaggggtttgcgagtgttgcaagggcgtgtcaccacaggcctaccctgagccgctgcccccgctttccgaccatgtcaggtgctcagcggcgagggccacaagaagggctgccgctgcaagaggtccaagtgccagaagaagtactgcgagtgtttccaggccggggtcaagtgcaaccccgacatctgccagtgtgacggctgtgagaactggtgcgccgggtggggggtggcagtctggtggtggccccgcgacaggaagatggggacagccgcctggagtggcgaggctgtgggaactgttcattcatgccgggtcgccaaggggaagggagggagatgtgcagcaggcgcaatcccactctcaaacaggagccctgtccaacaccatgcagtgagggtggtgcacccccgcgaccgcagcctgagggtcgggcctccggacagcctgccggcatccccgcccatggctccgagttcctcgctgccatggtgcgtctcctggggttggtgggtgtcctctgggaggccggcagggcacgcctggtacgctgtcaactcggaggccctgcgactgggtgtccaaagtgatgttcaaagaatggggactgcggctgtcgtggaggttgggtgcttgtaccacaccacatgcacctcttggtgcctgccccacgcgcgccccttcccgtttatcacgaatcacaggcggccgcgctggctgtcgcccccannnnnnnnnnaagtggggactgcggctgttgtggaggtgggtgtttttaccacagcacatgcacctcttggcgcctgccccacgcgcgcctcttcccgttcatcacgaaacacaggcggccgcgctggctgtcgcccccaggcagcaagtccctggccctcctggagcccccctgggacccgccctgcctgtctccctggcgcctcccgtgtttgcgggggtgccgttgtcgctgggcggcgcttccgggcagtggcacgaggggagcctgctgtcggtgcaggcccccctgcccagccccgaggtggactccaacgcgctgcccggggcggggcggccctcgctggccaggcccggggacgtgctgctgggggcgtgtgcggctgccaccgccctgctccagcccacccgggacacggggggtgtgggcaccaccgccggcgcccccgaccgcgacgtcgtgggtgagtggtggaggggtgtggggagcgaggaggggtgcggggggtcgaggaggagtgtggggggcgaggaggagtgtggaggccaaggaggagtgtggggggcgaggaggagtgtggggggcggggaggaggggtgcgtgtcgagccgtcccaccgggtcgcctcggtgtgtgccgcctcgtcttgcagctgctgnnnnnnnnnnccaaggagtagtgtggggggcaaggaggaggtttgcgtgtcgagccgtcccaccgggtcgccttggtgtgtgccgcctcgtcttgcagctgctggctggcccaggcgctcgatggggctctggctgcgcgcggcgcccgacctgggccctgcagccacggactcgccgcacaggctcagccccgcaccgccgcccccccnnnnnnnnnnnnnnnnnnnnnnnnnnnnnnnnnnnnnnnnnnnnngcagacacggccagctcccccgccttcaacagcggcgggtcggacgccggcaccgacgcgacccggctcggcaagaggccgcgccgcgcggccagccagggcgtggccggcgccgtggcggccctgagcgccgcctggcccgccggcccg

SEQ ID NO: 43541 - DNA, 41195 bp, Chlorella protothecoides
  modified_base (178)..(215): a, c, t, g, unknown or other
  modified_base (375)..(384): a, c, t, g, unknown or other
  modified_base (588)..(597): a, c, t, g, unknown or other
  modified_base (1105)..(1114): a, c, t, g, unknown or other
  modified_base (1219)..(1228): a, c, t, g, unknown or other
  modified_base (1769)..(1778): a, c, t, g, unknown or other
  modified_base (2098)..(2107): a, c, t, g, unknown or other
  modified_base (4426)..(4449): a, c, t, g, unknown or other
  modified_base (4663)..(4672): a, c, t, g, unknown or other
  modified_base (4739)..(4748): a, c, t, g, unknown or other
  modified_base (4815)..(4923): a, c, t, g, unknown or other
  modified_base (5352)..(5361): a, c, t, g, unknown or other
  modified_base (5560)..(5569): a, c, t, g, unknown or other
  modified_base (8388)..(8397): a, c, t, g, unknown or other
  modified_base (9290)..(9299): a, c, t, g, unknown or other
  modified_base (9910)..(9919): a, c, t, g, unknown or other
  modified_base (10418)..(10427): a, c, t, g, unknown or other
  modified_base (10629)..(10638): a, c, t, g, unknown or other
  modified_base (11067)..(11252): a, c, t, g, unknown or other
  modified_base (11353)..(11535): a, c, t, g, unknown or other
  modified_base (11605)..(11614): a, c, t, g, unknown or other
  modified_base (11688)..(11836): a, c, t, g, unknown or other
  modified_base (12820)..(12829): a, c, t, g, unknown or other
  modified_base (14947)..(14956): a, c, t, g, unknown or other
  modified_base (15405)..(15414): a, c, t, g, unknown or other
  modified_base (15835)..(15844): a, c, t, g, unknown or other
  modified_base (16212)..(16278): a, c, t, g, unknown or other
  modified_base (17207)..(17216): a, c, t, g, unknown or other
  modified_base (17394)..(17403): a, c, t, g, unknown or other
  modified_base (17641)..(17650): a, c, t, g, unknown or other
  modified_base (17929)..(17938): a, c, t, g, unknown or other
  modified_base (18270)..(18279): a, c, t, g, unknown or other
  modified_base (18835)..(18844): a, c, t, g, unknown or other
  modified_base (19947)..(19956): a, c, t, g, unknown or other
  modified_base (20980)..(20989): a, c, t, g, unknown or other
  modified_base (22023)..(22032): a, c, t, g, unknown or other
  modified_base (23584)..(23593): a, c, t, g, unknown or other
  modified_base (24291)..(24300): a, c, t, g, unknown or other
  modified_base (25228)..(25237): a, c, t, g, unknown or other
  modified_base (25535)..(25544): a, c, t, g, unknown or other
  modified_base (27491)..(27500): a, c, t, g, unknown or other
  modified_base (28836)..(28845): a, c, t, g, unknown or other
  modified_base (29559)..(29568): a, c, t, g, unknown or other
  modified_base (30815)..(30824): a, c, t, g, unknown or other
  modified_base (30906)..(30915): a, c, t, g, unknown or other
  modified_base (33071)..(33080): a, c, t, g, unknown or other
  modified_base (34092)..(34101): a, c, t, g, unknown or other
  modified_base (34524)..(34533): a, c, t, g, unknown or other
  modified_base (34786)..(34795): a, c, t, g, unknown or other
  modified_base (35512)..(35521): a, c, t, g, unknown or other
  modified_base (37522)..(37531): a, c, t, g, unknown or other
  modified_base (39265)..(39274): a, c, t, g, unknown or other
  modified_base (39420)..(39594): a, c, t, g, unknown or other
  modified_base (40123)..(40132): a, c, t, g, unknown or other
  modified_base (40545)..(40554): a, c, t, g, unknown or other
  modified_base (40895)..(40904): a, c, t, g, unknown or other
caggcccagccacacaggcctgcaccgcaaaagcagctgtcagcaccaggcacgatgttcctccccctgggaggcagggctgggcctcggacatgatgtccccgattgccacaggacttggatccaggaagcgacctggcggcatcttcggtaccaggcacctcctggcgcggctccnnnnnnnnnnnnnnnnnnnnnnnnnnnnnnnnnnnnnngaggcgggcaggatctcgaggtccaggccaggtgtccctgcggccgcctggccgccagcgtggccctcgcttccggcgtccggtgagcaggtgatgctgtgcagggaaacccgtggcacatgcagcatgaggcgcagcgtcgccgcagcagaggccacgnnnnnnnnnngaggatggaatccctgatcacggcctggacggctacgctgggcccgatcgccggccctgtcaaacctgtcagcagcccctacaagaccaggagccgcgccaggaggtgcctggtaccgaggacgccgccgggtcgcttcctggatccaagtcctgtggcattcggggacattgtgtccgaggcccagccctgcctcccaggggnnnnnnnnnnaaggcgggcaggatctcaaggtccaggccaggtgcccctgcggccacctggccgccagcgtggccctcggttccggcgtccggtgagcaggcgatgctgtgcagggaaacccgtggcacatccagcataaggcgcagcgtcgccgcagcagaggccacggcggccggccacagcgcgggcaagtcgctgaggtgcgcccacggccgcgccgccggccgcagctgcaccccggcgcggccggggcggggcaaccaggaactcgaccgcatgctggagcaggccaggaggtgggcgggcccatgcggcgtgcgctcccacgccagccggtgtgagagaccgcggggtctggtacctggggactggccctgacagccttgcgcagagcgcaccagggcatgcgcgttggtgccctgtccaaaggagggagagaggacgatgggctacttcaagaaagcagatgcaaggggtccgggcaatgcttgcccccgatggctgtgcccagcgctcnnnnnnnnnngaggcccacggggtgtgcccgctgcgcctgtcgcaccggcacccgcctgcctggaccacatcttgtgcggcgcagagcacggcgtgacatgtgagagccacgggnnnnnnnnnnaaggcccacggggtgtgcccgctgcacctgtcgcaccggcaccagcctgcctggaccacatcttgtgtggcgccgagcacggcgtgacatgtgagagccacgggaaccgcatcgccgcttttgctgacggcacggcgggggttgaggaccactccacccgggtggcaggcctggttcttcgtggccggcatgagggcgacgctgagatcctgggcccaggcgcccaacccaagcccctgtaccatcgcgtttggcgggccagcgccatagtggagggagcggcaccggcgcgaggcgctggggcgctgggctttacgttcaggctgacgtcgtcgacgagtgacgtcgagtccgtggtgctggccggcttgcctgtaccccaatcgaatgtttccctgccgccagcaatcagcgcaggtgccctgctggccttggaggtgctgcagcagtcgccccacctgacggccctgcatgtccacgcacgtggaaactctgccggcgtgttgtatcggcggcaggatccggcgccggcgctgcgctnnnnnnnnnngcgacgagtgacgtcgagtccgtagtgctggccggcttgcctgtaccccaatggaatgtttccctgccgccagcaatcagcgccggtgccctgctggccttggaggtgctgcagcagtcgccccacctgacggccctgcatgtctacgcacgaggagactctgccggcatgttgtattggcggcaggatccggcgccggcgctgcgctgcttcgccgcggagagagtcggcaggacggccatcagcctgaccggggtcggggtgcatgcagcctgctcgccagcaactacttcggccagcccgacgtccagcagccactnnnnnnnnnntcggggtcggggtgtatgcagcctgctcaccagcaactgcttcggccagcccgacgtccagcagccactgcctcgtcaccggcgccgtcctgaatgtgcgcgcgctgcaggtgcttgccgcgccggcgcatgcgcatcccaagccgctcctcggaccgggggcatggatcatcggcggcggggcgggggcgctggggctgctcgctgcccagctggtccaacaaaccgggcgcccaggcgtggagattgctgtgcctgcgcgctccggcagggtcagcggcttcggccaggaggtcggcgcacgagacctggcatggagcaatggcctccttaccatcctcatgtaggtttgggagggggaggcggcaggggactggcgttccacgtcgcctgaggattaagtctccgacctcccaagcagcgttcccagcatccccccaccacatgcactcactccagcacctcactgaccccccggccaggagtgatttggcgatggactgtcacggactggaaagcgtggccagtgctcgcctgggactggtgcacgccgccggggtgctgagggacgccggcatcgcggcgctgcgtccctccagcttccgcgtagctgcagctcccaaggcgtttggcatgtggcggctggcaagggtgaggcggggccatgaggacacgaacaaggcggggtcgcgctctggaagccatgtgcagcagggggatcacatcctatgccaggcccgtccctccaccaccagccccctcaccaaggcacaccttgcgcccgacagatgacgtttggatctgcactggaggcttccatcctgttcagctccattgccagtgtcactggaccctctggcagtgcggcctatgccgcggccaatggagcgctggacgaccatgcatccgcttgtgcgcacagaggcaagtgatgacatgaacgtgaccgctgccggccaagactgggaaatcacacatggtctctaacaagctgagtatggatccagctacaccgtgtcctcgtcgtccctgagccagtggaaggttcatattacctgatccgctcccagcaccttgccacaggcactccttgcgatgtcattcaatggggaccctgggctggcgttggcatggtcgcctccaaccgcgctgtgcacgctgccatggcccgtgccgggatcggggccgtccacccccctgttggcttggacattctgtggggggtcatcaggggtcgatacgccggcgaggtgggctttggttggggcctcactcctttgtttggcgggacggcgcaacgtggtgttgcatgcgctatctaccaccaatgtctcatgtagtatggcattgtggcccgctgtcttgtcacccaccatgtcagatcaacacatacaacatcttgtatgcccacagatcactgccatcgatttcaagtgggcgagcttcatgcgcatcccacgccaagcctcggaccagttatactctgacttctccaccatgatgttgccagagtctgcaacctcttcacttgttggtgcacagatcgtcccagcacctgccgcagccccagcaacgcaggccgtcaactcacacagctcatgggatggaaacacagctgcgttgctggaggaggtgctggctgctgtgcaggctgtgcatggcgacaggcccgccccagacatgccgctggtccatgcggggctggactccctcggcacggtggagctgagccagcgtctggcggccagatttggcctccgcctgcagcccaccctggtgtttgaccacccgacggctgccgcgctggcacgccacatcgcagagctgtgtggggttgcaaaagagcacggccaggggcctgaaggtgactgttctgctagtctgggactcggccggctggagagtttggttcctcccacagcggatgtcgtggtgctcgagcatgcacatgcccgcctggcagcgccgatggatgggggccatggaaggtttgcccaggacacctgccggtgagcttgtggagggaattgatttcctgcgagttatgtctagggtggcttgtcgtaggagggggtgtgggatgtgtcagaagcgagtcactgtgcccagctggggctccagcagataaattctcaggcacgcccatccattcatcccacctgcagatccacacccttgagtcgttgggatgtggatggatccaggatccaccctgtccctggtcacagatttggcaggcaggacgtgctgtgttgtagttgggaaatggggcacaacagcgattcatgcctggcttgtgcactggtccttggactgaannnnnnnnnnnnnnnnnnnnnnnngagctgtttgacgcctcggcattctatgtttcagcggcagaagcgcttgtcatggacccccagcaacgcatgatgttggaggtgggtgatgcacactgatgggggaggtggggtggtttcatcctcctcaaaggatctggctgagggtgaggacataagaagaccttacagagccttgatccggcatgttctctcgcctcagtgccatgcctcnnnnnnnnnntcgagggaaacgaaactgatcccctcagattcagatcctctctcaaacaggttcttgactggcgtgnnnnnnnnnnccaagggaaacgaagctggtcccctcagattcagaccctctctcaaacaggttcttgactggcgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgggggagttgggggtggtttcatcctcctcgaaggatctggctgaagatgtggacataagaagacctttcagagcctcgatccagcatgttctctcgcctcagtgccatgcctctgccttgcagcactgcaacatatctcgcctttcatggccaatcccctgcaaggacactcacccctgtgtccttttcaggatgcttcccatgccctctcggcctggagcgggcaccccaaccgcgacagcaccgcgatcatcagcgcccagtccttctgggactatgcatctgaggcagacagggccatccctggcctgggggcagcctaccgcgcgagcggcagatgcttcagcgtcgccgccggccgcatctcctacacattcggcttgcaaggtgacgcgttgatttgatatgcaatgcagggcttgctannnnnnnnnntgcagccggccgcatctcctttacattcggcttgcaaggtgacgctttgatttgatatgcaatgcagggcttgctatgaatagagtgttcaggattggcacaccatgctgtgtggtgcacgctgttggggcatgatgagactgcagcgtcagtgccggccgcatccaaagcagcggctacgactcggctcatgataggnnnnnnnnnnacacagacatttgcatgacttgcccccatgtctcttccactgcaggcgcctgtcttgccctcgacactgcttgctcaagcagtttgtcggccttgcacctgctgcggtcagacctgacctcaggcagatgcccccagggcctcatcactgcaggtgggcattgccaggatgatgatgatgatcgcaacagtgtcacgcatgctctgatgcttgactgacatgtcattgagactcccctggacaaggagcaccaccagtacctggctgtgcaccgaccgccagctgcaattccccatccatcgcccccttgcctcaacttcaaacgcagcgctgctgacgctggacccctccacaatcaacatgctgaccgccgccggcatgctgtcccctgacggtcggtgcaagaccctggaatctgcggcagacgggtccgtgggcctagaccctaaccctatagtgctttggggaatggctggagtccagtgtgcgcaaggacacatgtgtgtgcaaacctggttggaagccatgtacatgccatgcgtgactcgacccacaccatcctgcaggtacggccggggcgagggctgcgtcacccttggcctcacacgccagggtcaaaacaccgatgccctggccgttctagcggggaccgccatgaaccaggacgggcggtccagcagcctgacggcaccccacggtcccagccagcaggctgtcatcagccaggccctggccgcggccggcgccccgcctggcgccctcacggggctggaactgcacgggacggggaccccgctgggggaccccatcgagctgaacgcggcgctgacggtgctgtgccccaggctggggcgagggagggatgggcatgaccccggaccctgcctgggcctgcatgccgtcaagacgctggtggggcatgtcgagcctgcagctgggggcgcaggccttcacagcacgctgatgaggtgggttggcgcagaagggcgcgacgcgcatggcctgctgaacttttatcatgaagggcacgacacatggcttcccgcctcggagactgctggtggtcgtagactggttttcctcctttcccaacccttctggagcatcacattgcaggattcgctcgctggtgctcccccccctgctgggactgggcgtcctcaacccgctgatgacggacagcttctccgcagcttcccgcgggctgcacgccgcgaagcagcccgggccccaggcctgctgcgcccccgggacgctctcgggcaccagcgcctttgccttccagggcaccaacgcgcacgcgctgctgacagtgccaaaggtgctgacgccgaccgaggcgcccgtccgcaggccagcctggcggcgccagcgctgctggttcgggccccgtccccacgccctgctggtccgggcgggggcgcccagaaatgcgacctgccagctgcgggccagcctggtctcgcgacggctggcctacatctggcagcatgccgtgcgcggcaggcccctcctgcccggcgcagccatgatggaggcgatgcacggcgctggggggtctctgaacgccaacccaggtgtttgatgaggggtgccatggtggacggacacagcgtgcacgatcggtggggtggaagcagggaggactgtgcgtcacgtcagcggtgactgggtggcattcgacagacgtccttgtggtaggaacgccgggctgctgctccgttctacacacgctgcaagtctgctttcgtccccaccgatatcaagcgtgctgatacccccatcacctcttccgtcaatttccagagccccagtccagggatgcaggcgtcctgttttccctggcaataacagcaccggtcctgctgcccaggcacacaggactgccgagccaggacctcttgctgaacattgccgcaagcatggcgcatggcaccctggttctgagcagcgccgaaggggctgcacatcagcaggctgccaccacccacgccacggccatgtttggcctggcctgggcaggggcttcactctctccagcacaggctcccgcgccggcctggcatgcaagtttggccctcctgctgctccctcgccctcgccctgcaaccccaggctgcacaggtatcatcaaaccagttgacggcgtcgaagtggatggctatggctgtcaccctgcggtgctggatgccatcacccacttgggtgctgcggaagacatttcggcgggcggggcgcctggcgttcctgttgcagcaggagcctaccttccggacggaaaccaggaggtgaggaacgtgtagtggtatggtcttgagcaggcaggcccttttcccttgcctttgctgtgatgctcaggggtgtgcgctctgtactacccaagcatgtgcaggcgccactaagcctggagtgcagcagtggccgcccgctgaagcagggcctgggtgttgtgcagcgcaccttcgccagctgctccgggctgtgcctggcatcgctgtggtcccaggccctgcaggcggccagcgcgcgtgctgggcgggacgtccgcgcctacgtggaagttcactgcgccgcagaggtcgcctgccatggcgatcaagtactctcacgatgtgctgcggctacgacaggctggcaggacatgcgtgtgctcccctccagtccccaggggcccagtgtagctatacgcaggtcggcgctggcacccctggtcagtgccctcagtgactgcatgggcagagatcgggatgctcagctccggctggatgcgcgttcttctggcctccttgccatgccctgtgcgatgggatcccatgccnnnnnnnnnnagtcagtgccctcagggcctgcatgggcagagattgggatgcccagctccggctggatgcgagttcttctggcctcctcgccatgccctgtgcgatgggatcccatgccggaccggtggttgaaagtgatctgatgtgcggcgccatgctgcgctgccttttgctcgaggcatcgctgggcaatgcagcgctggacgtctgcagcccacttgaccccgcccctgctgcgccgctcgtgcctgctgggtccccgccggccgtacgacggcgagcggtcgctgcgggtgtgaccctgattccacacctggtcgagagtaacccaacgcggcctggccatctcaacaacttctcgcacagctccacacacaatcttgtcaccggcggcaccaccggactaggccggctggtggctggctggctggcggtttgccgcggaggagcgacacgcttgagcctgctgggcaggagtgggcgaggaactggcgggctcgcatccatgcatccttggcagaatgtccccaccgtcttcacggtgacatcctgcgacattgggtgtcggtcggacgccagctgcctcgtccgccgggcaccgcctggctcggccctcttccatgccgccggggtgctgcgagacgggctgctggcggccgtgacccctggcgccctgcgccacgtggccggcccaaagactggctgtgttggagacctgacgagcccagcagccggatccaggcaggggactgggatccttgttgcagtgtgtatgtggatttgcatgatatcagaaccacaggggatcctgacgtgcccatgccagctgaaatcctcatggagctcctgatggtctatctaatttgctaatccaggtccacactcactcctcgccctcgtcnnnnnnnnnntagaaccacaggggatcctgacgtgcccacgccagctgagatcctcatggagctcctgatggtctatctagtttgctgacccaggtccacactcactcctcgccctcgtcccgtcgcagcatgctggtgctgttcagcagcgcatcggcggccctggggaatgcggggcagacagcgtacgcggcggccaatgccatgctcgatgcgcatgctgggcggtgcttgactcaaggatcgccagccctcgccctgcagtggggcccctgggccttcgtcggcatggccgccgccgcgcccaacgttctaagcacccttgcgcgccagggtgcgccgaggctggctgagggggggggggaaggatgaatgttctttgcttggtgccaacgatctcaagaaggaagatgggttacttgctgtgccatgcctgaactgggatttgttttggccggcaaggtgcatacgacacaatatacatgccagcgcatgagatcaatgccctccgcaaccgcaggcatgcacgccatgagacctgcgcaggggctgagggcacttcagggctgcctagcagtctcctacccgcccgtgagggtggcgggggcctttcagtgggnnnnnnnnnnggggcctgagggcccttcaggactgcctggcagtctcctacccggccgtgagggtggcgggggcctttcagtgggatgcgctgcgccgccggccactcctccctcactataatgaggaggcttctgaccctgcgggtgccatcagcgaggcaagtgagcctccagcggcacgcagcaccgctcctaagctccccgaaaccaaggcagcagcgccgaatggcatgcaagaagtgctggatcggatcaccgacctggtctgcgccgtgctgggggcctcggtcacgcccgacgccccgctcatggccgccggactcgactccctggcggccgtggagttgcgcagcgagctgggcgccgcctttgggctggagctggcgcccactgtggcgctggactacccgaccgtcgccgcgctggctgggcacatcgctgccctgctccgagaggcaacggtgtctgacagagtgaggaatgagcagggcgaggcggtgtgggaccnnnnnnnnnngtgccctgctccgggaggcaatggtgtctgacagagtggggaatgagcagggcgaggcggtgtgggaccagcatctcgaatctgtccagcatcttcggctaccggctgacccaaccaggacccccgcaaccgtctgcatcgctgccactggggcgcgattccccaataacatcacctcaggtgagcactcgcaaatcagttnnnnnnnnnntcgcaaccgtctacatcgctgccactggggcgcgattccccaaccacgtcacctcaggtgagcactcgcaaatcagttggggcctgcctgaattggcagataacggcggcgcggactggtctgggaagccccgttcctacatgagttgggggcacaattatcttgggatatccattaaacctcacttgcatccctcaccccagtggcctccccactccccctatccacatcagctggagccttcatggagacagctgtacaaggtcgtggcgtgcagaccaccatccctgccgacaggtgggacgtggatgccatctactccgccgccagcgcacccgggcgtgcctacgccaggttcggggccttcatccaggtgggactggctgcgtgtgagggcagcagcagttggatcttgcaatgttgcggaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacaggcccgactcctgctgatgtcagcttttgagaccctctgtggatcaggtgcgagctgcatgggagcgtgcaggtccccaaggctgatcagccagatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgactacatgagcctcgtgcatggaactctcggccagcccctcagtggggctgtgatgacaggtgggaannnnnnnnnnggagttgggggcacaattatcttgggatgtccatggagcctcccttgcatccctcaccccagtggcctccccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattcggggccttcatccaagtgggcctggttgtgtgtgagggcggcagcagttggatcttgcaatgttgcggaaaatttccccatatgcgactccagagcgacccatcgcatgcatgactgcccaccaagcacacccatgccgactcaccccaaccccacatgtgcccccattccaggatgttgcttcgtttgaccgggtcatgtttgacatgagtccgggcgaggcggcatgcctggacccccaggcccgactcctgctgacatcagctctggagaccctctgtggatcaggtgtgagctgcatgggagcatgcaggtccccaaggctgatcagccagatcagcggccccatagaccgccaacttcatccccttcctcctgcacccaacagactctgtgtaccagctggcacgaatgggtccccagactggcacatatgccgggtgcatgtttcacgactacatgagcctcatgcatggaaccctcggccagctcctcagtggggctgtgatgacaggtgggaatgagaataagtaggggacctgatggctgcaccgcctggatgccaacatcgttggctgaagggatggtattgcatggtatgttttaactggcgttatctcgagcactgcgaaggcttggcccactgtcgacttcattccgtaatcgcgtgccttgatgcaggaaatggcgcaccttaccagtcaggccgtgtggcctatgcctttggcctgtgtggaccctgcagtggcatcgacacagcctgctcatcctcgttggtggcagcccacagtgcccgcgcaggtgggttcaaagggttgccagggtgtattggttctggagcctgaagtgcgcatggaatgcccagggcattggcaaaagatctctgacgctccagaagtctgccagcccaccttctagactccacaattgcatcccgttcaccccaggtatcctcgcgggggagtgccaggcagggctgnnnnnnnnnngtgtattgcttctggatcctgaagtgctcctggaatgcccagggcattggcaaaagatctctgacgctccagaagtctgccagcccaccctctagactccaaaattgcatccctctcaccccaggcatcctcgcgggggagtgccaggcagggctggcagggggcgtgaacgtcatgctctggcctggcactaccgtgggcatctgccagctgggggccctctcctccagcgggcgctgccgctctctggaggccggggccgacgggtatggccggggtgagggcatcgtcactgtgctcctcgtcttggccgcagcgctgggccagggtagacacagtgacgcacagcagcagcggccgctggccgtcctggcggggacggcggtgaaccaggacgggcggtccagcagcctgaccgcacccaacggccccgcccagactgcactggtggctgccaccctggccgcggccgggactgggcccgccgacgtcggcgtggccggcctgcatggcacggggaccgcgctgggggaccccctggagctgggtgcccttctagcagccctgcgtgcgccgcgtggggtcgccgctcgccccattgccgtgtccgccgtgaagagctgctttggccacaccgagggcgcggcaggtaggttaagtgggctggtgtgctggctggctgctgagtagagactgtgagcgtttgcatgaggtctggcttacctcgattcacaatctcaatcctctgtttaacgcctaccacctctttgcaggcttgacagggctgctgttgggggcagccacgctggcctcaggcggcgcgccccctgtcgcgggccttgccctcctgaacccacatgtcgcgtctgctctgtcccatgggtggggccgcgacgggttagcggccatgcacatcccccgggagtcggcgccggtgggaagttccggcagcctcaccggcaccagctcctttggaatgagcggcgtgaatgcgcacgccatcttgagggggggtggcgtttgttcagggtcgaatctgctggcaggccaggcagcgctgccttgtgtgcctgcggtggcctggccctgccccctgctgtgcagtctgatgacaggggcgttgccgggggcgaagaagggcagcctgcacctggctgccaccccggccgctgcaaagcatgcctggctccatgaccatgtggtggcgggtgagaggctgggtgggaggaggctctgcatacgatgtcaggcgggagatgtaagaaacggttctatgatgccaacatgcacaacagcccaaagacacacgcctctctgccgccagtgtttcacactgcaacctctcttacatcccatcacgcaggcctcggcgccgtgctacctgccaccgccctcctggagctggcggtgagccccgcaggggccctgccattcggcctgggcccaagcagcgcctgcgccatcctggacgcggccttccaggccccctgcagcctctctgcaaaacggcttgttgtttctctcgacatcgccggcgctgggcgtgtcaccatcggctcccaggagggcgtgcgctatgtcgtcgcccagctctgccacatcggccctcccgcgcttattgatgcaaggcatggcaggcacaaatctcctggcactggcaaggctgccattcgcctgcttggccagcgcagtctgcgccttcctcctagcaagccgcccgcctttaacacggccgtcctcgccagcccaccttccggccaggtcccatcctacggcatgcaccccgccaggctcgacgccgcgctccacctttccgcgctggccggcttaacgggcaagggcggcgctgtgcgcgtgccggtcgcgctcagcgctcacagcgtgccgcgccccacgccctgtggcttcagtcctgaatatgaggctgtctccgtgaaggtggggagcaggggtcgcggtttgccctgcgaggaggacagggaggatggggctgcagcacccagcgttcttgccgcgtatgccgtgctgtatagcctttgcaccactgctctcactgaacccccctccacacccctctgtctactgcataggtgctgcgccacgccaggctggcatcannnnnnnnnnattgcaccactgctctcactcaccccccctccccatccctctgatcactgcgtaggtgctgcgccacgccaggctggcatcacagacagacacaagtgtggtggtgcccggcgtgtgcagcatgcagggcctggtatcggcgcccctgctgcgcctgaaaggaccccttgtgcctcctcctacggtatcagcgcaaccgagcccgctgtaccacatcgccaacttggctgaccggcccaccagggcatcagcaagctttactgatccaaccctcgccagcttgccagctctgagcatgcgctgggctggcaatgctgctggccctcctggtccctccatcatgatcccggaacgccgagacagcgctgagctctgctccagatatgcgccaaccctgtcggcgctgcgcgctgccggcactgggccatcactgcaggccgccgtcgccnnnnnnnnnnaagacagcgctgagctctgctctagatgtgcgccaaccctgtcggcgctgcacgctgccggaactgggccatcactgcaggccgccgtcgccggtgcagggtgcctccctgtccccatgccgggccaggccagagagatggccctcgcctccctggccctcctcatggtggccggcaacgaggccaatgaggtgtcgaagccggcagggccggccttcgccctgggccccagcatcacctgcctggatgcagggactccactctaccggaggaatgcagaggaggaggctcatgatacccagccggtccatcaccagagcgccgtcacctgcctgcccaagctcattcgtggcctcccgcccggactttgctccgcaccagagatgcagcctctgcaaggatgcacgctcgtgaccggtgnnnnnnnnnngcccagccggtccatcaccagagaggcgtcacctgcctgcccaagctcatgcgtggcctcccgccaggactttgctccgcaccagagatgcagtctctgcaaggatgcacgctcgtgaccggtggaatgtctggcctggggtggctgactacttgcttcctcctttccaaagggccggcttgcccagaggtcttgctggcgggtcgcagcgggcggctggcggggcggcttccaggaggcgggggcgttttcgccactccagaccaccttcaccttgtgcagtgggacgtcgggaggcgtggcgatgttgcatccctctctcacatcgcacggcatcctctgtccaacacggtgcatgcagcgggggnnnnnnnnnnnnnnnnnnnnnnnnnnnnnnnnnnnnnnnnnnnnnnnnnnnnnnnnnnnnnnnnnnncccccggccgcttcaggacggtggccgcgcccaaactgcaaggtgcggtgatgcggattgggtgttgtgttcaagagaaaggctgccatcctcttccagccctacgcgatgcactgagaggctgtcatcccccactccatgatcctccatggcaggtttccagctggtggcaggcgcagccgccggtcaccctctgcagacccttgcggccttcagcagcgtggccgggcccttggggtcggtgggccaggccaactacgctgctgcaaacgccggcctggacaccgcctgcgggcggctgcacgcatccgggatcccctcccaggccctgcagtggggcccctgggccgtggtgggcatggccgcccagtcccggggcctgcttccactgctggcgcgccgcggtttccagggtctggccccggccacgggtctggacgtggtggccaagaccctgcttgcaaggcagacacccgctgcggaggcgagcctgatggtatgcctggtggagtggcagacctacgccccggcccgctcaggctggagccgcggactgttctcggaggttgtgggaggcgatgcgatgacacctgcgaaacctcgggcctggcagtccatgggccatttggcaggaggggacgagcagcctgcactgcagtatgggcatgccatggagactggcccaacctttggaaagccgccagcaaccctcgccggcagccttgatatcctaggctgcgtgctggaagctgtggaggctgcaacggggagcgctcttactccggacgtgccattcatgtccaacggccttgactcaattggggcagtggagctcaggtgaggtggtgcgcaaactgcacagcagcagcagatttcatctttgactgcacttctccagcctgagggacatgaacacatggactgggcgnnnnnnnnnntgcaaactgcacagcagcagcagatttcatcgttgactgcacttcgccatcctgagggacatgaacacatggactgggcggcctcaaaccccggagatgcaccacctcggcattgtggcccacaacaacatcccactgcgcagaaacgtcctggctgacatgtttgagctggagctgnnnnnnnnnnatcgacattgtggcccacaacaacatcccactgtgcagaaatgtcctggctgacatgtttgagctggagctgcctgcaaccatcgtgtttgaccaccccactgcaacaactttggcgacggccattgccgcagctgtgagggagcaaggggcgaaccctagggaagttccctctgcagtgccagccactcctgcaacctccagcctctccctccaggacgtgtgcggcgctctgtcgnnnnnnnnnncttggcgacggccattgccgcggatctgagggagcaaggggcgaaccctagggaaattccctctgcagtgccagccactcctgcaagctccagcctgtccctccaggacgtgtgcggcgctctgtcggagctgggtgctgagatcactggaaagctagtaccgctaaacaccccgctccaacaggtcaggatgaggacactttggagaattgtgagcgcattgcacaatcgtggcgattgtgcatatgaaatctctcacttcctgcgcctcccaatgcnnnnnnnnnngattttggagaatggtgagcgcattgcataatcgtggcgattgtgcttataaaatctctcacttcctgcgcctcccaatgcttgttctcaggcggggctggactccttggccatgggagagctggcggcggccatctctgatcggttcggcctcgacatcccgcccaccgccctgtttgacttccccaccctgggctccctgggcacacgcatccacgagctgagaagcatagtccggcccagtcgcagtggtcaggactcagtgccagtgcaccagctgccagagctgaggggtagcgtacagctcatcagcgatgccagaggtgatttcnnnnnnnnnnatatccagggccagtgcaccagccgccagagccgaggggtagcgtgcagctcatcagcgatgccagaggtgatttcccgggggtctacagagatgacagctcgacctcttggctggcatgcctcgccagcgcccaggaagctgccgcacccctgcacctcgcccgctgggacatggacaggacgtacagcccagaagtgtctgacaccggcactgtggcgtgtcgcttcgccaccatgttccgaggacaggagcatctcctgtttgatgccgagctgtttgggctcagcgcgagagatgctgccctcgctgacccccacctccgcctcctcctccagcatgcccaggtggggttcgggggatcgacacacaatcaagatgcttgcccggccacagtgcaagcttacattctgttacaagctgaggtggtggatggtgtggcgttccagtcgccaattccatgggcggccaagcgggcgcatcaagcgtcgcccccctgaagcaaccatcctgctccctcctcgatgccctcccgtgcagatgctgctgtctggtcnnnnnnnnnntaagcggacgcatcaagcgtcgccccccggaagcaaccatcctgctccctcctcgacgccctcccgtgcagatgctgctgtctggtcagccggaggcacaccgcaccaagcacgtgggcgtgtacatcggctgcatgtgggcggaggaccacaccgcgaccttgccacctgccgccgccgtcaaccctgtcgccagcacagggaatgggctgagcttcatggccggtcgcctggcttttgcctttggcctccgaggcccagcttcagctgtgaacaccgcctgctcctcctccctggtggccctgcacttttccactcacggtgagtatgcttgctcaagagcttggcagcgctcgggagtccctgccttcatacatggctctccctgatcatgcactcctgaacacatcctgccctgcacccctcgccaggcctgcgggcaacagactgcgaggcggcactggtgggcggggtcagcctggtgctcgactccggcagcgcggccaagatcagcgcgctgcaggcgctgtccccctctgggcgctgccgggccctggacgaggcggcggacggctacggcaggggcgaaggcgtgacggcgctgctgctgaccacggccgaccctatcgaggctgtccgctcactcaaagcggcctcgggcccgctggcggtgctggcggccactgcggtgaacagcacggggcttgccagcggcgtcacggcgcccagcggccccgcccagcagcgcctgctggcagatgccatgcggcgcgcgggcgtggcagcggatggcgtgcagtccctgtccctgcacgggacggggacgccgctgggagaccccatcgaggtcggcgcagcgatggcccagctggggcagaggggcgccgcctgcttgtccctggctgccaccaaggctgtgtttgggcatgcagagggcatggcaggtgagagctgactttggagaagaaggggggggtgggcaatagggtttggaagagaaagcgtcaagggctgtcaatgatcatggtaaagagcatcgacacggacagttcacaccaattcagatccagtgcctcccaggctccttgcatcgcctcaaggcnnnnnnnnnnacatggtaaggagcatcaacacagccagttcacatccatctgatccagtacctcccaggctccttgcatcgcctcaaggcacccacctcccatttctcacgccgcaacccaaatcacgaccctttccaggcctgctgggggtcttggcggtgacagccggtttgcagcagcgatgcatggcgccggtggtgaacctgcgatccctcaatccctacgtctcgcacgccctggcgtccagcgcttcgccgggggggattgcggtgcctcgacagccagccccggcgagggcctcctccagcgtcgcaggtggcctgacacggtgggagtgctgcatgcatcaggaatgcagaggcaaccatgctcaccgccgcaactccatggcccatgtcccttcattcctcacacaagctccgctgcatatatgcaggcaccagctcgttcggcatgagcggcatcaacgcccacgccctggtcaggccgctggatgcacctcccgcagtgctcagtcaccctggcttgccgtggcagcagcaggtgtgccggttaggccccgcgcctcaccctttcctgtcctcctgggttgaggaaggggcctttgccatgcgcctggtccagccagggctagctgcaatctgggaccactgtgtggacggacgtgccctgctgccggcagctgccatgctggaggcttcatgggcggccgttgccagcctaactgggagctcagccgggcagctgctgggtcgggcagccttctcggcgccactcctgctgaccagcggctcggggcaggaggtctacctgcggctcagccccagcctcgaaagcatggtgctggaacccagaagtcatcagccctgcttcagcgtcgaggttacgacagcaaggccgtggcagggaccaggagttgagcatcttcgtatgaagaccaggggtctggcgccgcatggctggagcacagagctggtgccgagcgtgagcctgcccccagcatcctctcccgcctctgtcggcttcttctcannnnnnnnnngttcgtatgacgaccaggggtctggcgccgcgtggctggagcagagagctggtgccgagtgtgagcctgcccccagcgtcctctcccgcctctgtcggcttcttctcagaagccagcggtaccgcgacggagatcctgtctgcacacatcgacgccatgttccatcttggggctgttccagtgggaggcgcgtcggccgcagccctccacgtgcccactcaggtgcaaggctttgccctgcccaccaaggacgccggcgggcggctggttggccactgctgtgtgagggggacgccatgcagccccgccagagggtctatcaccagctgtggcggcgcacaatttggcccagagggcgcgggaatggcagtggaaggcctgacggccaggccactgcggcggggtagtgacgcccccggctctgccgggccggctacgagcaagacaggtcctgaggatgtcctctatcagatggactggctggccagcaatgcctcaaccatgactcaccctgatacagcgttgcaaagccgagcggtccccccaacatcaatctcggccaggagctgggtggtcaacctcgtcgagccggcagcagcgcgctcggcggccgctgcctccctccagctgctacagtgcttgaggatgaagggtgccgacaggatccatgggaagaaagcaggagcaagcgaagcgttcgggaccgggtgcgctgggttcctcttgggacaggtagcatgcatgctgcatgctggagatggcactgctcatccctgagacagcctcgaccaagcgtgcaaccccgcctgcctacccctgcaccatctgacaaccccttgtcagggtctcgcaagccggtagtgccgcgtcgatgctgcacgctgccgccaaggtcgccgcagcagagcagggtgaggccccctggccgctgcacctggtctccgagctgagcgccagacagggttgcaggggagcccctctgcacggcccgccctcgagcgcggcacgcgggcaggtggtgcatgccgaggtcnnnnnnnnnnaagactctctgcacggcccgccctcgagcgcagcacgcgggcaggtggtgcatgccgaggtcctggctcgccacttcacgacgtaggttggcactgggttatgagtttagacacctttatcccagcatgacggttgctgtggcacatgcagggtctggggagtcttggtgttgtcactgatccccttgctctcaaacctcctcgacacccaggcgcgttccagaagggcccctgcgcatcgctcccacccagcgtgggagcctgggctcgctggcggccctgcctggcaccctggcaccccggcctggagactctgtgaccctcaaggtcctggctgtgggcctcaacttcagggatgtgctgaatgtgctgggcatgtaccccggagaccccggggagcccggcagcgactgcgccggcagggtgacttcagtggcctcgcccgcctgctccctcaggtgacagcggatggttgtaatggatgtaagccatggttcctcagggcggatggtcacctcacaactactcaaagtggtcacaaggagtgccagcccccagcacaacccccctctctcatctgcaggcccggcgatgtcgtgtttggccaggccacagggtgcctggccacccacgtcgtggccagccaccacacactggccccggtcccccccggcgtgtccctcgccgaggcggccgccctgcccaccgtcttcctcaccgccatgcagtgcctgtggcatgccgccagtgtcaaaccgggccagcgcgttctggtgcatgccgcgacgggcgggctgggcctggccctgacccagctcttggtgctgcagggggcccgctgctgtggcaccgccgggagcccgggcaagagggcggcgctgcggggcagcgcccacgtcatgctggacagccgcagcacaggtggcgggatggggtattattctgatgagggaatgttgatctcggttgccaatagatggtgctgattgcattggtgccaatacttgcaatccttgcatgctcatcgcctcggtgctgccttcagcgtcctggtgaaaggatttgtatgaagacgcgaagtctcaaacctctcaccacgctcacccaaaccatagcatttgcaacggaggccacaacccttttgggcaccattgacgtggtggtcaactccctgacctcccctgggatggtggcagcctccctggcagcactgtgccggggcggtgcctgggttgaagtaggaaagcgcgacatctggtccccgacacgcattgcgcaggagcggcccgatgtcagggcgtccctggtggccatcgactttgcgccgccgccggtgctggcacccggcatgcagcgcatcgccgccctgctggcagctggtgggcagtgatgatgggagtgtgttctgaaattggggagagggtgttccccatcatcttgccattggtctggccctggtatgatccatgatagcaccctcctatcctgcccatctcaccctcacattgcttattacactcccgcccacttcaggccacatctcccccatctnnnnnnnnnnaggtctagccctggtatgatccataatagcaccctcctatcctgcccatttcaccctcacatttcttattacattctcgcccacttcaggccacatctcccccatctggtcctgccactacgggctggggtccgtggctgctgcactgcgcacgctgagtgcggcacgtcacgtgggcaaggtcttggcggccgcaccggcccctctcccgggcaagcagggctccgcagggacgtggctcgtcaccggcggcaccggcgccctgggagcgctggccgctgcacacctggtgacagccggggccacgcacgtgcagctgtcctgccactcgcggcctgcgcgctgggagggcatcgacgccggctcagcggcctgcgtcaccgccgtccagatggacgtggcggcgtgcgccgacggcgcgggctggttgacgtgcacgccagctgcggggctgctccatgccgccggcgccgtgagcgacgccctcctccccaggcagaccctgcgaggtgagagcgtcgtgggaactgttttgtagagcggtggcgcatgagtgctcctgctttgtttgggggttctggttgccagatgactacatgttctgtatgggaactctgctgcttcactaagttgctccctcatgggaaccgggtgcagaaaccgggagcaacaatgacaaacgatcccagccccatcannnnnnnnnnagttctggttcccagatgactacatgttctgtatgggagctctgctgcttcactaagttgctcccccaagggaaccgtttgcagaaaccggtaacaacaatgacaaacgatcccagccccatcacaatccccccaaaacaacccaccccactggcaggcctagccaaagtctgggcgcccaagccggccgccacggctctcctcctggaccgcctaggttgccaccccgccgagacggtgcagctcttctccagcatcgcctcctgcctgggcggccctggccaggccaactacgccctggccaatgccgcgctcaacggacttgccgcgggcggcgcggcgcgcggcaggccggccatcgccgtggcctggggcccctgggccggcgccggcatggctgccgccgccgggctggggcggctggagcgccagggctacggcgcgctcacgcccgcccatggcgcgggcttggtgctggccctgatgagagcgcacgccagacccggcgtcgggtcgttcctcctcgcggcgcgcatgcactggggccgtagggataattggccgattgtgctgggatctgataccaagtgtccgggtattatggacgtggcacttgatgataagaaggggatgcctgcaaaggccgtcgcaagcttccctggcgccgggaaggtggtgtcccaagctgtgatcacacagcaggttgctgactgcatcgccgccgtgctgggtgcagcccccgccactgatgctcccctcctggccgccgggctggactccttgggtgagtgcgactgagtattttgcaaccttggtcaccaacggcaatgagaaccttgcatgtccttgctgctccaccataataacctcatgccccacaacccgctcacccgaccaaaaggtgccatcgagctgcggaatgcgctgnnnnnnnnnncgagtattttgcaaccttggtcaacaacgacaatgagaatgttgcgtgtccttgctgccccaccataataacctcctgccccacaacccgctcaccccacccaaaggtgccatcgagctgcggaatgcgctggccagcggcttcggcgtcagcttgccagggaccctggtgttcgaccacccgacgatgggtgccattgcgcagtacctggcggaggccctggctcagacgcaggccgcacccagtggattgcccatcgccatccatgtcacggccggacagcctgccacgccgaggnnnnnnnnnnctgggtgccattgcgcagtacctggcagaggccctggctcagacgcaggccgcacccgatggattgtccatcgccatccacgtcacggccggacagcctgccacgccgaggcccctcgctgaagccagggccctccccgtctacctggaggctgtcactggagacctgccgtgcacggggaggctgggcatcacatccatgaccttccccatgcgcgatgcaatgggacccgttcccctgagccgctggtccctggacgacccgccggtcaagggcttggtgctgccacgcttcggggccttcctgctggactgggagagatttgacgccgcagcctttggtctgagccctgcaggcaagttgttttgttctaggaagttgtggtgggcgttgcctcacagcgcacccctcccacatagtttacctgtgggagtccttcaaggctgaggtcgcgggcccgcatggatgcccgatcacccctccccagccgtatgcatcatcctgtccctgccacagaggccgcactcatggacccgcagcagggctccctcctctcccacgccgccggcctggtgcgccccgacacctccaccgccctccccaccgcggtcttcgtcggcatcgcacgcgtgatcgactccgccgccgcgtccgcatccactctggcagccatcgccgcaggcagcggacacgcagctaccggcaaggccctgagcgccgccgcggggaggctgtcgtacacctttgccctgactggcccatgcgtctccctggacaccgcctgctcctcctccctgctggccctgcaccttgcggccggcgccgttcgggggcgggagacaggtactgcgctggcggcgggcgtcaacctgcccatggtctgcgagaccacggccgcctttgccgccgcaggtgacactgagtaggaaggcaaagggttcggtggctgaagccgaatgaggggcctggagtggaagggaatttgccagcagcactgtgtctactgtgtgccgcctgtcctcgacacccgtttgtactactgccccatcctctttgactcaattccatcacttctccgcttacaggcatgatgtcggcatcgggacgttgccagaccctggacgccgcggcagatggctactcccgcgccgaggcctcagtcgtcttgcggctgggacgaggggaccctgccgggtctgcaagcagcgccccgccccttctgatcatgggcagcgccaccaaccaggatggtcgctccagtggcttgacggcgccccatggccccagccagtccagggtagtggcggctgctgcaaggcaggcgggggcctgcccaggagcctttgagatgcacggcactggcacacccctcggcgaccccatcgaggtgtccgcccttgccaccgtgatgtatgccctgggaaggggagatgctgaaggtgagctggtgcatccctgattgaggctctcttgtctgataaatggacttctacaagggcaggcacgtcctggcatgcagtggtccacgcatcaagaaacatcagcaacgctcacctcgtccgccatcctcccacatactcagcaccagccacgctccaggccctcaagtccacgatggggcacgcagagacggcagcgggagctgccagcctgacacacgctgccgcgtgcctgggcgcaggcctctgtccgtcgctgctgcacctcaggttcctgaacggctacgtgctggaggcgatggagagaggtggccttgccccgccccggcaacaagccccatcccttgccgtcggccacccatcctgtggcgtcagcgcctttgccttccagggcaccaacgcgcacgtcgttctgggtctgggacccagtgaagagacagtgtgggcatctgtgttgccaagtattgccgcgtcagcgcgttccctgctccgagccaggaggtggacnnnnnnnnnntgtcgttctgggtctggggcacagtgaagagacagtgtgggcatctgtgctgccaagtattgccgcatcagtgcgttccctgctccgagccaggaggtggacggtcgtaccgaggccccatcccctcgtgcaaagggcagccaggtctggcggtgcgggtctggcagagttttacaccctccttgatcaaccatcccttgcatacctcgctgatcatcaggtgggtgagggcagatcggtgaatctctggtggccgccaattcctgtacagcttgctgggttgggaggtctgcttcactccatgacaagcactcctccatcagctatctccacacaaccccattgccgacaggtcgaagggcgtgccctggttcctgcaaccgccctgctggcctgcgcctgggcgggcggcgccgcgctctcccccagcggccccgcgccctgtgtcctggcggccacgctggctcgcccgctgatcctgggcgaggggccgctgacgatggtctgcacagtggacctagaacgccaggccgtaatggtcggcagccagggagcggcagggagggaagcaaaggggcggatagctcatgtccaagcaagcctggctggcatggtggctggcctgcctggccaacaatggacccgcaccggcgtggcaaagcgatgccttacggcatgccttgcagtgacctccgcaccggcacgcccgttgcccctggctcgcctgcaggctccaacgcagtctgcggctgccgacgctgatgctgcgcaccccgcagccgcagacgccacgctgcacctgatcgcggcgatgatgcagggtgtagccccgctccacgtgccctcaggcgccgctgccttcaacgtcggcaccgcagggcaacccgcagggcacgtacccgagccctgggcgcacctttcggagcactcgcggccgttgggcggcgcgctgcgtgccggcgcgaccatccactggacgggcacggcccggctcgagggcctcgtgctctcgcccatgcatggccggccggcaaccgaggaggccgcccgcctgccggcctacatcgaggagctgcaggtgcacaggtggctggcgcaggacgctgatctctcaagcagcatgtccggcctgggtgtcaggctcacacacggtgacctccagatatgcatgaggagtagaggtgaccaagaaatcaccgaagcggcgctggcagccccagtcctggccacggtgcaactcctccgcgcaactaggagcaggctgaagctgcaggccatcgacgacgcttgcccctcgcctgcgccgctccgcgccggcccctccaccctggggctnnnnnnnnnncgccatcgacggcgattgcccctcgcctgcgctgctccgcgccggcccctccaccctggggcttcaggcggccaagatcctgggttgcgccgtctctgaagcctggctgaccgagggggtgggtgagcgctggcactccgccctcagcggggttgccacagtagcaaccggtgacgacgacactctctccccggcgctcgctgagcgcgcggcggccggccatatagaccgccctctcctgctcaagctgcatcagctgccggagaatgtgcatcccatccccctgtaccatccttcgagtggtgaggggggccggcggtggtatcaagcggccttcctgaaagccgtaattttgtttgacatgcatgcacactcagccggcagggccgcgctgtagtccagccgaggtgcaacccccttaaaccccccctcctcctttcttcctcggccacgcagtgctcatgtccggggggacggggtccctgggacggctggtggctgcctggctgggcgaaggctcccagtgcgtgaccctgcacgcgcgccgggccctgctcacccagcttccagcgctgtccgcttcaaacccggcctgcatctggaccctgctccagggtcataatgccctggcggccaatgcccacgaccgccgcgctgtgcacgctgtgcacgtgctggctggcggcgtcctggccgacgccgggatcgcaggcnnnnnnnnnnctaatagtgccctggcggccgatgcccacgaccgcctcgctgtgcacgctgtgcacgtgctggctggtggcgtcctggccgacgccgggatcgcaggccagtcaccctcctccctgcgcgcggtcgccgcgcccaaaagcacagcatcggcctcccatcggcaccagaccgccgccgagccggtgaacatctgcctgctgttcggctcggcggccgccctggtgggcaacgccggccaggccgggtatgcggccgcaaatgcgactctggatgtcctcgcgcagcgcgcgcagcgtgagggcctgcgctggcacagcacgcagtgggggccctgggcccacggtggcatggccgacgcgggcatcttgcgccgcctggcaggccagggcatggtcggcatcgcacccgcgcacgggttgcacgcgctggcccgagcaatggcaatggcgaggcctctgccgccgcccgtcgtgctagccatgcgtgtcctggactgggcccgggccctggggccggtccatggccagcgtccccggttcgctgaggtggcgcctacgaatggcgccacaatcgacgacttggctgagagcatcggggccctgatcgcggcgcagctgggctgcaggcccctgcccaaccagacctttgccgcggcggggctggacgccgacggcagacgtgcgctctgctccgcgctgggcgctaaatacagcgtaccgctggagccacaggacctggtggatcaccccgacgccctgcgcctcgccctgctcatcgccgagcgggcgggtgagacgcctcgaagcaagcctgccgagcagcttgcacgtcaaagcctgggctctgcgggcacccaccagccactgacgcgagcagacacgttgcgccgggtgcgggacaccgtcgccagcgtcctcggctccctgcccggcgacggggcgcctctgcgggaggtgagccgccgactgggcgtgtgggatgggggctgtgagcgccagtgctgacatcaccacgccctgcccagatgcccattgacggaggagcggaagagaggttgcctgggagcgacagcggtggaattaaaaccaggcacgaaaatctcctgacacactctccgtcccttgcctcgttccacaaacaggccgggctggactccatcggcagcattgagctgcagaaccgtctgcagacccaattctcggcgcagctgccctcgacgctcagcttcgattacccgaccctgtccnnnnnnnnnngccccagagtcgcagcatgccgtggtcctggccatggcgtcctttgagctctcaggatgccgcgggccacagacagagactnnnnnnnnnncgagctgcagaaccgtctgcaaacgcaattctcggcgcagctgccctccacgctcagcttcgattacccgaccctgtccagcctgacagacttcctcgagtccctggggagcgcagacaaggaggtggctgtggagcgaccggcgctggaggctcccccagagtcacagcatgccgtggttctggccatggcgtcctttgaactttcaggatgccgcgggccacagacagagactgctcggtgcgctgccaggggctggcattcgcatggtctccctgctctcacaagtgtcgacagcgtctccttccggcatgtctgctgaagttgcgagatctgagcgaccaccttcaactcccatcactgcttccatgcagggcgttcagtgccggggtggacaatgtacaggtggtgccgaggagccgctgggacatcgagcagcactaccaccccggaggagcagcgcacaggatgtacgttcgatttggccagtggctggacagggcgtacgagtttgacgcgcccgccttcaacctgagcaagaggtgagagataggggtcatggatgtgcagtgctctgagccagctgctccgtgcagagatttatttgagatgggagttgacaggtctagctccttgtgaccaagcaaggcaaccctgaaggctgtgtctgatccttggatcaactataccttttcccctgatgcacctatcactgcaccgcctgccacagcgaggcgaccaccctggatccacaaacccggctcctcctgcagcatacagcagccctgcagccctacatcccgtcagacgcaacaggagtctacgttgggtgcatgtacacaggtgaggagcggtgcatgtgattcagcagcgatgtactgtttgtgcaaattctgcaaacacagcaatctggcatgcacatgggcatgcattccagactgacaaccgcttcccagcaggacaactagtaaacaaccctgaacaccgctgccacacctgcaccgcagagtaccttgattctgtgctgaaggctgcaggtctggcagatacccaggcctcctccattacaggccatgggctgtcattcatggcgggacgcctcagctacaccttcgacctgcgggggccctgcgttgcccttgacacagcatgctccagcagcctagtggctgtccatcaagggagacaggtaggggtccggcatgtcgaaagggctgattccctggagctgctggaagacaaattcctcaccgatggctgtgttgctcccacagcacattcttgcttgcctcaggttctttgtttgataaatcccaacaccgtaaaccctcccatgctgcaccactgtcgcagggtattgccagcggggagtcagtgtccgctctggcgtccggcgtcaatctgatgctcgacccaggcacgaccagccgcatctgcctcctcaaagccctctctgcggtgggcaggtgccagacgctggacgcctcgggcgacggctacggtatgtgggttgggggctcagagggtttcgtgagagctgcgcccgcaccgcaggtactaattgctcgtgcccggcccagccacaatatcacccactgaggtccctacattatctggtcagggcgcggagaaggtgctgccacactcctgctcaagaggcaggctgcccagggtcaagaagcacacgccccgggagctgacctggcactgctgcaggccagcgcggtgaaccaggacgggcgatctagcagcctgacgtcgcccagcgggccctcccagacggcgctgctggcggcctgcctgcgacagggcgcaggggctttgaccctgtctagcgcggcgatgcacgggaccgggaccccgctgggggaccccatcgaggtcaatgcgctggaagctgccctgaagggcagcggcggccagctgaatggtgacgacgtcgcggctcctcgggtgctcctgacctccagcaaggttggtgttgcctgtttgtggtatgggagccttggaatactccatcaagcagtggggttcattgtggtgatatggtgagaacgacatctcctgaccttgagggcactgtgcatgctacatacaaagctgcatccaaactccacagttgaaccggcctgtgccacacctcggaattgttcctnnnnnnnnnnggagggcactgtgcatgctacatacaaaactgcatccaaagtccacattcgaaacggcctgtgccacacctcggaattgttcctttcggttcaccccctgagcgcatccccaactctgcatccccttcacaccctctcctcaggcgctcttcgggcacactgagggcgtggcgggcgtgaccggggtgctcctggcagcggcgaccaccagcacccgccgcgcgagcctgatgcccacccttcggaccctgaatccctttgtcacggcagcgctggcgtgcttcagcgccgcacgccagacgggccctgtgccggcagtcttggggtcagagcctgccgccggggccaccagctcctttggcatgagtggcgtaaatgctgccgccctgctctccgccccgaccggtggggacttggaaggcgccggggtcccggctgcacagccctggcagctccaagcggtgcagccgctgcctgcctgccacgcctgggtccggccggggccatgcgtgggcgttgtgctgctacggcacgccggcgcctctgccctcgaggactgctcgatccatggccagaaggtcctggtcctggggggcgggcttgagatcctggcggccggttgcagcatgcactttggtgctggacctgaaacggagtttgccctgcggaacgtcaccgccgcctcgctcttgcggtggccaggggaggagttggcgctgcgcctggacggcgtcaccggcacggcccagctgcaagggctgggaaggggcgctatgctgcagaccagcgtggccaccctgcccatgcgtgctcagtccagcacttccccgccaggcgcaagctgtgcgcgtcggcgattgcgctcctggctcgtgaaccctgcgtgtcctgtctcggacgccggcgcggtggccatggtgcaggcccgggctcgtgccgcctcccacctgaggtgaggtggacagccattctgtgctggagtgattcacatctcacaacaatctgtccaaannnnnnnnnnacctgcgtgtcctgtcttggacgccggcgcggtggccatggtgcaggcacgggctcgtgccgcctcccatctgaggtgaggtgggcagtcgttctatgctggattgattcacatctcacaacaatctgtccaaagactgccatcccccctcaagctccacacaggttgcacatcgatccttggatgctgcagggtgggacagacctgcagcatattaatgctgcacaggagcgggccgttgctgtcgaaggcatccttgcaccaggtggctcacgatgggagccatgaagggaggttgatccaggatcatgcgctgggaggtgcatggaacaagagttcagtatattgatgagattctaagcaatacgtctgccctcatctgcagccccaaagaccccgcgcgcagcctggctggttgccggnnnnnnnnnnggtatggaacaagagttcatttccttgatgagattctaagcaatacgcctgcccccatctgcagccccaaggaccccgcgcgcagcctggctggttgccggctgcaatgcgcttgcctgccgcagcacatctggcgatcgtcccaacctgcatgcctccacaaaacccatacttgaatgcggcgtcgatggcatgagggctcgaacacagccatctcaggagtctcaacaccccatgtatactgtggagtggnnnnnnnnnngctggcgatcgttccaacctgcatgcctccacaaaacccgtacttgaatgcggcatcgatggcatgagggctcgagcacagccatttcaggattctcaacaccccatgtatactgtggagtggcaggcaaggagtggtgccgtgtctctgcccagtacgctacaccaatgctcaaagaccctgcggcatgcgggcgccggtatcattgaccagagcacaggagcctctttctgggtctctccagcgcatttgagcaccacagccctgcaagcaatgcagctggtgagcgagagccctgggtcctgggaggtggccttgcatgcgcgtgagcgattcctcgcatgtgttgatcctggcagcttgcttccgcgcaacacctcctgatcgccaattccagatcctggccagcactggcttcagtggagctggcgtgaggtcggctggccctctgctccccgggccgcatctgcactgcagcctcagtacgactgcatgggcaggcaccaaggtcgccaacctggagtcggccccgcagtggtcccacacagcgagtgaccccatgtcccaggtgagctcgctgagatttggaggaaatgtagggtttgcgacgggaatgcagggtgtgcggtgcagtgatgagcttatgttccaaaagcatgctggacacagcttctagatgcatgcatcgacccacacatccgtcaattcatggcaggnnnnnnnnnnaagcgagtgaccccatgtcccaggtgagcgcgctgagatttgcaggaaatgtaaggtttgtgaagggagtgcagggtgtgcggtgctgtgatgagcttatgttccagaagcatgctgggcacagcttctggatgcatgcatcgacccacacatccgtgaatccatggcaggagggcaatcattccctaccaaagaacccggctgcagcgagcagatccgcattcggaaacgccgaacgggcccgggttctctttgagcccctcctgctcagctcagcccctcagctcagctccgactgcttgaataccatttcaagggtccccaggaccaccaacacccgcctgtccatcctggtgggaggcacgggcgggctgggcgccctggtagccgaccagctgctgcacagccgggcggcctcgcggatcctgatcctgggtcggcgagcctcgacccgcgagccaacccgcctggcggccaccctctctcgtcaacccctcgggcttgattcgctggtgtccgtggccagcgtcgacggcgccagcgccgccgacctcgccgggacgaaagcctggcttgcggcgcagggctgggtggtgcaggacgtgctgcacgcggccggtgtcacggccgacgccgccctcccgcagcagtcgccggggcgggtgcggcgggcggccgccgccaagtccctggccggcgtgctggcgctggggcggggagtgcaggctcaggggcgcgtggtgctgttcagcagcatcgccgggctgctggggagccggggccagtacagctacgcgcaggccaatgcgtgcctggacgagctggctggaaagcacgtgcacgaggtgggtgcgggccggcagtgatcgtctgatgcaccctggcaaacgtcgtccatgccacaacctctaccatgcccccctcaccgacactcgccaaccccacccaactaacagggcatccccgccaccagcatcgcgtggggcgcctgggctggggccgggatggcggcgagcggaccggcggtggcgcgccagctggcgcgcatgggggtggccctgctcagcccggcgcaggggctcggcatgctgtgggaggtgctgggcgacattgccgggcccccgctggtcctggcggcgaccatgcgctgggccgcggcgatggcggccgtcggtgacgcagaccgcgccttctaccgggccgtggtggcatcagaaatgtgcgacgagggcagtacggagcccgatgcctcgagcgaaggcccgagcggcagcgagattgtttcagacaacagagctcccacagatgtggcggccagcacaactcacccagaccaggcccctcagcggcaaaggatctggacccaggaggcggtggaagcgttggtcctggcgctggtgggagaggtggtggggtcgtcggtggaggccactgcccccttcatggctgcagggctggactccctggcctccaccgacttcctggcaagtctcgcgaaagatttggggctggaggtacccgtcaccgtcctgtacgaccaccccaccgcccgccagctcgccgccgctctcttccgcgagctctcttccaaatcaatggttggggaaggccaggcgagcgccgcgccaaaggcgggagtcccgagcactgcagcgcccgccgccgagccagcagcgccgaccagaggccagacggcagccagcaaatcgacagccacagcgccgccccctaacccggaggcccccaccctgtcggcgccgggctacttctgcatccccccgccccaggcgctggcacgcctgtcctcggcgcagctggccgccctaccgcgattcgtgctggggcatagggaccacggcgagttccagttcctgcagccggtggacctgcgcggcgcgaggctggacgccatgctcagaatggaccggggacgggcacggttcgtacccctgcttccagacggcgccccagcgccccggggcgccgcgctcaaccggcccnnnnnnnnnngcgtggaccaccaggagctggccggcctggccgagccgctgttctccgccgtgcccggcggcccccccgccccctcaggcggctccgcctacaccggcggcgagttccggcgcgccgcccccggcggcctcacccacgccatcctggcctttgagtttgccggcggctggcgcgacgtgcagggatcggtggcggccaccgtcctgcagtacctgctgggcggcggcggctcattctctgccggcggcccgggcaagggcatgcacagccggctgtaccgccgcgtgctgaaccagcacggctgggtcagcaactgcaccgcgctgtcatccatctacaacgacacgggactggtgggtatctttgcctccgcagacgcggaccgcgccgaccacctcgtccgcgtgctggccgacgaggctgcggccttggtgtcggacctgaaggacggcgaggagctggagcgtgccaaggccgccgccctgtcctctgtgctcatgaacctggagagccgcgcggtggtggccgaggacatcgggcgccaggtgctgacctacggcagccgcaagcccgccgccgagttcgccgccgccatccaggcgctcaccgccaaggacctgaaggcctcggtcaaggccgcgctggccaagccgcccacgctggccacgctgggcgacgtggcgcgcgtgccctccctggaggccgtgcgcaagcacctggcttgagcggggacgactgtggctttaggccgtgcaattgcggaaatgaagaatgaaggctactgttacaaaggggctcatgtgcttctcaaccagggggtgatcggcgggaagaagcttgggggggtgggtgggagtgcttctcaaaagcagggttggggggttgtccagtggaccagggggtgtgcagggcagggggaggaggacactgagcaaggtaggatttttcccaacgggggcattggctgctgttgttccccagggaacacatgtgtggcaagctggagggtgagaaaaacagcatgaccccagcagcgctggcctcccgcccctaggctccagctgagcagagcctcgcctgcaacaacagtgccaggggctggggcgaagccggggttggggactccccctctatggcgacggagccctcccatcaccgcccaccgctgccgtagttgtagtccacctgatcccggtccagcatgctgtttggggaatatggacgccaggcattgctaaggcactaagatgagtggtgccgaccccgcatcaacagactcagggtgaaggcccaagtctcaacattccccctcaccttctagagtgcctgacgatggccctacccacggcattgatccagtcctccttgtcctgtggaggcgcatagcagctctactccagcgggatcgtaggcacacaggacaagatgcagctgcaacgaacaggcgttgaccaacacatctccctcctctccttctgctcgccctgcacaccttgtcagagtcggcaatgaagtacatgctggcatccgctgtggagatctcaaacgcatggggcttgttgatggcatcctcagcgcccttgatagacaggcagtggttgacctgtgaagaggttcagtgtgcaggccagggtcagtcatgcggccgcagagctgctgctgcagcatcttgacagcgtgcattcagcgtcaaaaccagacatgggtggcagaccggcacagctttggagcaannnnnnnnnnacagctcagctccagcgggatcacaggcacacaggacaggatgcagctgcaacaaacaggcattgaccaacacatctccctccccctccttctgctcgccctgcacaccttgtcggagtcggcaatgaagtacatgctggcatccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgcgtgcattcagcgtcaaacccagaaacgggtggcaggccggcacagctttggagcaaatggcagaatgcttcgccgtccgcaaccggaacaccgactgacctccaggatgccacgaggctgtgagtcctgcagtagagaaaggcacaccaacctgagatcatgacaatagctagggttgacgaccaaaacgcagcacccacccccttgaataggcaaacactccatgcaagacttaccggccgcacgacgtccgatttgaaccagaaaatcttgccgtgcttgaggacaaaccacctgcaacgcgtgtcataaccaacttcagcaaatcggtcttgcatctcgtggcacaactgagtctcgcactacaaggcaccctcaccttctcctccaggacttgattacttcccctgcagtgaggacaatgtggagcagcgaatcaggtgcgctgtgcggcgctggcctcctcacaagttgcgaaacccaacatgagtactgaacatccaaatcacccccttggatgcttgcnnnnnnnnnnggcagcgaatcaggtgcgctgtgccgcgctggcctcctcacaacttacgaaacccaacacgagtactaaacatccaaatcacccccttggatgcttgccttgcttcatcagccatcctgcacgctctgggtgctcccagaactgcacaccccccgtgtcctgatttcggcccagtgccttgttcacgagctggctgaagtcgcccatgatgtgtcgataagtagttttgcaataaactcagcctgtagcgaccgcttgcgttgtcgcacaggtctggcccgtgcctcgttttcgggtcaatgcagaacccctcctggcgcgcggcgcgggaatcgcgaccttcccctcgccaccggttgttgaaaggggtgagcaaatgtgcaactccatcctcacaagcaagcaaaacaatnnnnnnnnnncgtcctgggagggggccgacctggcagcactcaggaagaagctcgcggcggcatctgccgccatgggcggcacgttcatcgactacttcccagacagcgggcagtggcttaccaagctggatggctttgaaaagggcaagtgtggcaaggaatgatatgctcgggccccctgttcattgttttgcttgcttgtgaggatggagttacacagttgctcacccctttcaacaaccggtgacgaggggaagctcgtgattcccgcgccgcgcgccaggagggggtctgcattgacccgaaaaacgaggcacgcgccagacctgtgcgacaacgcaagcggtcgnnnnnnnnnnacccgagcatatcattccttgccacccttgccctgtccaaagccatccagcttggtgagccactgcccgccgtctgggaagtagtcgatgaatgtgccgcccatggcggcagatgccgccgcgagcttcttcctgagcgctgccaggtcggccccctccaaggtcccagagccgatgcccttgagcatgaggaggcagggccggttgagcgcggcgccccggggcgccggggcgccgtctgggagcaggggtaggaggcgcgcccgtccccggtccattctgagcatggcg

SEQ ID NO: 43542 - DNA, 267 bp, Chlorella protothecoides
cctggcggcggtggggacggccttggaggaggcgagggagaaatttcaggtggaggggggggagaaattaggggaggagatgggaaaggggggctgggagggggggggggatagacctctggcgagggaggaggagaatgtgctggagagggggaggccacgggactgctcgccggggatggtgacgccgcagggctggtcgccggggacggcgagggcgcagggctggctgccggagggggggggaatgcagggctggccgctgga

SEQ ID NO: 43543 - DNA, 174 bp, Chlorella protothecoides
gggggggtggagggagggggaaggagtccactctcgcgctatggggattctagatcaggccaggggctgtccactctgggcctggagcctggatggcagggtttgggctggtgtggggtgactgaccgcgtgtcagggtccgctggctgtgcgcaggtggcctccctgctgccg

SEQ ID NO: 43544 - DNA, 722 bp, Chlorella protothecoides
  modified_base (117)..(126): a, c, t, g, unknown or other
  modified_base (316)..(325): a, c, t, g, unknown or other
caaatgatgtgacggcccacgtgaagcaacgccccgccccgctcggccccgtacgcccatccttctccgctacctcacaacctctgcaggttgtcggcctttgggggcgtgacctgnnnnnnnnnngcaatacgctcgggatgggtggggtttgggcgaggggtgcacgcggatgatcatacctgattgaggagggacgcaaatgatgtgacggcccacgtgaagcaactccccgccccgctcggccctgtacgcccatccttctccgccacctcacaacctttacaggttgtcggcctttgggggcgtgacctgnnnnnnnnnnccccatcccccccctgggccagaccgttgcggtgcacggcagaggcggcggcgggcacgatgcgcgtgccgcccagctgtccctcctctcggccacgcgcgtccacgtcctccctgccctacccaccctggaactgaccctggagcactctgacgcggcatccgctcgcctgccggagggcctgggcctgcagccgggcgcggtggcggctgcggcggcgggaggatcggcggccgccgcctccgagccttggccctgcctccggctgctgggcggccagcgagcgtctctgctcctgcgcgtgcgcaaccgcggccgcgtgcccgccgcacgcgcggcactggaggccacctgcgcctcggcctcggcctcaggcacggcggccgctcgctctgag

SEQ ID NO: 43545 - DNA, 61 bp, Chlorella protothecoides
caccgcgcccggctgcaggcccaggccctccggcaggcgagcggatgccgcgtcagagtgc

SEQ ID NO: 43546 - DNA, 71 bp, Chlorella protothecoides
gtcctgggtgggaaagaaacgagcggcgcggggcaggcgaagcctgctgcgaccgaagccgggcccgctgc

SEQ ID NO: 43547 - DNA, 68 bp, Chlorella protothecoides
cctcggcctcgccctcggcggactctgtgtcggtgtgtaggagggggggggggggggggggggggggg

SEQ ID NO: 43548 - DNA, 148 bp, Chlorella protothecoides
cgtagtggcgcaccagcgcgggcggcgcggcgtggcccgcgcggaagcggagcaggcgcggcgcgccgtccgcgccgtccagcacccactgcttggccgcgttgtcgcgccccgccgacatcagccgcggctcgccgacgaagaagtg

SEQ ID NO: 43549 - DNA, 67 bp, Chlorella protothecoides
tgtcggggcagcagatcaaggacctgctgggcgcggcgggggggggggcggggggggggcggggggg

SEQ ID NO: 43550 - DNA, 61 bp, Chlorella protothecoides
tggctggacgcccgctcctgaacgcggcgggggcgtctctcttaccatcgattggcctgac

SEQ ID NO: 43551 - DNA, 61 bp, Chlorella protothecoides
tgaacgagtggcggacggcgccaggcgaggggggcacgacaggccgatacgggaaggtgtg

SEQ ID NO: 43552 - DNA, 61 bp, Chlorella protothecoides
cggaagaagttgggttgttgttgtggtggggggcgatggcaaaacgaatgaagaccatatc

SEQ ID NO: 43553 - DNA, 61 bp, Chlorella protothecoides
cggcgccacaaacggcgcatgtggcgcggcggcggcgctcaacgggctggccctgcgcggc

SEQ ID NO: 43554 - DNA, 5437 bp, Chlorella protothecoides
  modified_base (228)..(237): a, c, t, g, unknown or other
  modified_base (988)..(997): a, c, t, g, unknown or other
  modified_base (2091)..(2100): a, c, t, g, unknown or other
  modified_base (2757)..(2766): a, c, t, g, unknown or other
  modified_base (2854)..(3070): a, c, t, g, unknown or other
  modified_base (3864)..(3873): a, c, t, g, unknown or other
  modified_base (3927)..(3936): a, c, t, g, unknown or other
  modified_base (4504)..(4513): a, c, t, g, unknown or other
  modified_base (4912)..(5029): a, c, t, g, unknown or other
cgctcgcgcgcccactcctcgtcgctgggctcgggcactgtggccaggggagggaaagggatgactggaatctgacacaacttcctgtttacagaccagctcgtcgcctgcctcgctccggagcaggcacacgcggaggacgatgggcggacgccctggcacggccccatgcccccgccaccacaaaagcgccacgcctccccagcaccttggagcagggtggggagnnnnnnnnnnatgggaggagggcaaggatgggatcgcccgacctcagcttcgaaaatacatcgagaacgagggcgacaactcggcagcgtgggggatgtgagatgcgcgagggccctggcggggagcaaggtgcccaacgcagagatgcccctgggaggagggacctcgccgccacggtctgctcccgccgggttgaccaagtcgtcagcgcctgaggagcctacttggcacggagtttccgctgcttgcaggcccccccccacccccttgcaaatgtgtgcatagaagctgaattccctgctacccccatatgagccccccggaccccctcccatccccacaccacacacgaagctcaccagccgggccagacagcgtccacgccggtgcgcaccgccaccgacgtgatgaggccgacgttggcgtagttgttcacgttcttgcccccgggcacctccacaaactggtcggccatgcggatgtgctccgcgtccgcccgcatgtcctcgggcgtggccatcgcgatgagcttgactgcggcggtgcggggaagggaggaggggtcgaggttgtggggaatcggggggagagtggcgcagaggcgaggacgccgagggaggagaggcagggggatggcgcgtgcggggaggaatgggaggcggggagcgccttgcgccagcaggataccgcctggcgagggaatcccacggactcgcgtcgccactcgcagccacggcctgcccggccgtggctgcgagtnnnnnnnnnnaaccgcctggcgagggaaccccacggactcgcgtcgccatccggggccacggcctgcccggccgtggctgcgagtggcttggggagagcaccccaccaggtgggggcagtccccaccatcccggccccccgcgccaccaggcggtacctgtgcgctcattgccaaaggtcttgtacgcccaggagcggatggagcggatgaacttgacggcggcgaggccgttgttcgccaccaagacgctgcaaggaagtgaggagggcgtgggttatcgtgaggatcccaggtgatgcagttggccgtgcaggtccaggcatggcgcggggcggagagctgcccgcagataacctgacgttttaccacagagggcgaggtctcacgtccggggaccctcgaccacttggaatagagaacccggactgtcccctcatgtcagcctccctctcagggaagcaagcagtccagcccatcgcaccgcacctgtggatggccctgtcgccgccccactcctggatacgctgctcgagtgcagccgagacgtcggccgtgcgacggggcaccccccttgaggaggtggtactgtggattgggagggggtggagtgggagtcttcacggtcatttctatggggcagcatggcatgtgcgacgattgcagaggcaggtacaaggggggtgaaccctgtttggcggtgcaggccaggtcagccccaggtccctcaactgccgcacctgctcagctcccggtacgagaccgacaggagggagcgggtggagttagtcttggccaacttcgctgccccgttatccgccatggcggatggcttggacggattgatggactcgggggccgagtctgccggcttaggcaccgtcatagcccgggaccatgtacggggatgtgagaccaagaccgggtgagggggcctgctttgggaccctgatcaccctcactctatgcaaggaggcgtctgcaaggtagactgtccaactctgggggattgatacaagatgctgctctgcaaagcagtctgtgaagacgaccggacgtcagtggggagccgggcacggcagggtcaggcgtcgataccttcccannnnnnnnnnttgggggattgatgcaaggtgctgctctgcaaagcagtctgtgaagacggccggacgtcagtggggagccgggtacggcagggtcaggcgtcgataccttcccacacaacgcttcggtatgtgactcgcaatctgcgcacaatgcattacgagagcagacctgtcatgacatgcagtcggggggttcgttgcagccatgcggtgctctcgaggctgacggacgcgcgcccccgcgtggtgggttcaaatggccgctggctttctgccacgtcgagcaagggaggccctgcccagcgagacgatggtgctcatcacacacatacgctgaaatactcttccacatcgcaaaatttcccggagggcgaaggtgggtgccggaggagggcatcatggtgaacgccacccccactcccgcccccgactccaggacccagttcattgatgccttgagagacgccctggctgcccctccagagcccgtgtccgatgctcgaagagctgcagctgctctcgagaaattgcaattcgactatccggtacgagggaaaggcatgccacgaggccagggcgcctcctgaacgcctgggggagaaaacccccaacccctggatctggtggcgagctgaacagtgctcccctccccctgcccttcaccannnnnnnnnncgctcatcacacacatacactgaaatactcttccacatcgcagaattcccctgaggacgaaggtgggtgccggaggagggcatcatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccccccaacccctgggatctggtggcgagctgcacagtgctcccctccccctgcccttcaccaggatgcgacagactcggagctggaatgctttctgaacgctgtgctgggctcgcaacccccccccatcacccatcgcctgttggaggtggtgggcgaggaggcgggtcggatggagctgcaggacaaggaggggcctgcctcccagcagcacatgtaccgccgggtgcacagtgcctgccttctggtggccctgcagcattgcctgcacggcaggccccttccactgaggtccggggaccaggggggtccgcccgacgccgaccccgagctgctcctcgatctggcggaccggctggcggcggctgcgtcgcagatggggcccggggactgggagcgggtggagctggcgcaggggctgcagcagaccctggtgctgtgcacctccccggcgcgaggcgtggcggccgacctgctgcggcggctggaggcggcggtggtccgcctgctgcgccaggcctgccaggcgcgcccctgccaggcctccgcctgcgtcgcagcaagcctccccaccctactccaaggtgctggggagtcgtggcgcttttgtggtggcggggccatggggccgtgccagggcgaccgcccatcgtcctccgcatgtgcctgctccggagcgaggcaggcgacgagctggtctgtaaaaaggatgtcgtgtcagattccagtcatccctctccctcccctggctacagtgcccgggcccagcgacgaggagtgggcgcgcgagcgnnnnnnnnnntgcaaggcatagcggccgacctactgcggcggctggaggcggcggtggtccgcnnnnnnnnnnttcggagctggccgtccagctggcgagcagcgccgccgccgcgtgtggcgccggcggcggcgccggcgcggcgctctggcacgtcctgcagacccacctgggccccgccctggagcgcagcctgcgcggcggggatggcgcggcgcggggcgcggccgtctcctgcctcgcgtggttggcggcgcgcaccccgcgcggcacccgggccccgcagctcctggccgactgcctggtggccagcggggcgatggcggccctggtgccgcggtgcatgcgggaccactgcgacgccgagggctggtgaggaggagtgggggtcctgcgtgctttgcccgctcccgcggggtgaccgtcgggcgcctggaggagggtgtcgcgccggcgctgcggcggccggaagacaggggggcgcagggctcggacgccgcgtgtgcggctcctgcaagccccacggctcctgcaagccccacggctcctgcaagccccacggctcctgcgagccccacggctcctgtccccaggccgcgccacggcactccgcgcccagagaacgccgcgccgcgccccnnnnnnnnnncgcccggcaagtgtccccaggccgcgccacggcgctccgcgcccagagaacgccgcgccgcgccaccgccacattcccaaccccacggacccctcccgaacacgcggcccccgacgcaggcgggccctgctcctgctgtgcgcggcctcgccgcccctgcgggcatgggccgaggccgtgcctgggctcgtggcctcgctccaggggctccccctggccccacacgccgcactgctccagtacgccatggggggcggatgcgagccgctcattgccctgctggacggcgcgtgccttggcacgggggtgagcgggatgggtgggtggcacccaggggccggcgctggtgtgggaaggccgagaaggaggcgcatggggggggggggggggggggggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcacggacgtgcgcggtgcattggggggggacgagctggcagcctggcccacccggctgggcgctagcctggccgccctgcaggtccgcctgacgggggggcgcagggcaggggccacagaggaagggtcgcgggcccggggtgagcggcttgacgccgagcagcgaggggctcgcctagtggcgcagagggatgccgcagcgcacgcggcgtgccatgcgctgctgaaggacctgctcctaccagcggactccgcggcagccaagaaggactagggggggggccgtgggccgtgggccacgccatggcgaggagtagggttggcaccggtgtgggagggcagtcgcgggcgtggacgcccctgagtcacggccacatattctgcagggccgcgtcccgccaccccga

SEQ ID NO: 43555 - DNA, 63 bp, Chlorella protothecoides
gcccccacaacaagaatccaaccctctccaaatacacggcagggggcggcgatcagcttcccg

SEQ ID NO: 43556 - DNA, 61 bp, Chlorella protothecoides
ggtggaaagggtggaaggctccggagagggggcccccacaacaggaggtgtgcagtaagtg

SEQ ID NO: 43557 - DNA, 61 bp, Chlorella protothecoides
tatagtaaaacaaaaaaaaaaaataaaatcggtttaaataatttaaaaaataatttaaaca

SEQ ID NO: 43558 - DNA, 61 bp, Chlorella protothecoides
atgagtgcataccatgaaagtcactggctggcgtcgtcacatgtggtacctattgggtctg

SEQ ID NO: 43559 - DNA, 147 bp, Chlorella protothecoides
ctggccggctggtgagggcgagcgtgcaatggaaggcgcgccgtcccagccctgcctagccgcgcgcctcgcctgggccagggcccggatgctggaggcgcggggcgaccgcgccggcgcgcgctctgcctttgaggccgcgggtgc

SEQ ID NO: 43560 - DNA, 61 bp, Chlorella protothecoides
cagggcgcgatcgaggtgctgcagggagacacccacccgctgctggccacgcacaacacgg

SEQ ID NO: 43561 - DNA, 61 bp, Chlorella protothecoides
ttgatggtccgatgtgggaggtaggccccccccgccttccacaggcctgaccgggaagcct

SEQ ID NO: 43562 - DNA, 61 bp, Chlorella protothecoides
ccccagggccgccaggctggcggagggcactcgacaacctggtgggttgccggcacggggg

SEQ ID NO: 43563 - DNA, 119 bp, Chlorella protothecoides
ttggggttgggggttggggggtggggggggactgcgaaggggccccttcaacacggcagctggagtaggatccgagggccaaggtccaggcagggaggacgagctgatggcagcagaga

SEQ ID NO: 43564 - DNA, 61 bp, Chlorella protothecoides
ggtggaccacatcttatccaaaggccggagcctaacaagctgcgcccctccaattgccatg

SEQ ID NO: 43565 - DNA, 61 bp, Chlorella protothecoides
gcagaggcactgcgcatgtggcacagggctccaggaccaagacttgaagctggggtctctt

SEQ ID NO: 43566 - DNA, 61 bp, Chlorella protothecoides
gtagagggaagcttggagtgacttggcggggcagcacgcaatcaaccccccaggatacact

SEQ ID NO: 43567 - DNA, 61 bp, Chlorella protothecoides
atgggaggggaagaagcaggcttggaggaacgggctggtcattggggcggcagggacggtg

SEQ ID NO: 43568 - DNA, 61 bp, Chlorella protothecoides
cccagtggccatgcagcttacggcggcaggggcgtgcagccacagactgtgcgacaatgga

SEQ ID NO: 43569 - DNA, 61 bp, Chlorella protothecoides
ctgaggcatgcgaaccgcagcgggtgctgccgtgacggctgggatccagcccgtcagggtt

SEQ ID NO: 43570 - DNA, 86 bp, Chlorella protothecoides
cggggacgcttcgcacctggggggtattgagggggggggaaggtgtgaggcgaggaaggcgtccctgagagtataggggttgaaag

SEQ ID NO: 43571 - DNA, 540 bp, Chlorella protothecoides
  modified_base (144)..(153): a, c, t, g, unknown or other
  modified_base (480)..(489): a, c, t, g, unknown or other
accccccagcgctccaccatccccatccaataattgctcgagtgcacccgtgatgaccatggccgtatgtggcgtgggattttaccccggcatctgcgccctgaaaggtgtctccaccgctgtgtgcctcccaacagttccagnnnnnnnnnnggtgaccatggccgtatgtggcgtggggttgtaccccagcatctgcatccagaaaggtgtccccaccgctgtgtgcctcccaacagttccagtgggtgtctcggtctgcccgtcattgtacctcttcacaaacagcgggatatgcgatgaatccaccttccccacaatgctcatctgctttgtagaggaaaaccagcaaaacctctacagtgctgtgtgtgtacaaagccccggcccaccgccctttcccccaccgctgtctgcacctccaggccctccaacaacccccccgccattccccccgccgccagctccaccccccagccnnnnnnnnnntcagggctagggctagggttaggctagggttagggttagggttagggttag

SEQ ID NO: 43572 - DNA, 28177 bp, Chlorella protothecoides
  modified_base (186)..(253): a, c, t, g, unknown or other
  modified_base (1540)..(1549): a, c, t, g, unknown or other
  modified_base (2645)..(2654): a, c, t, g, unknown or other
  modified_base (4065)..(4074): a, c, t, g, unknown or other
  modified_base (4301)..(4310): a, c, t, g, unknown or other
  modified_base (4645)..(4654): a, c, t, g, unknown or other
  modified_base (5108)..(5117): a, c, t, g, unknown or other
  modified_base (5558)..(5567): a, c, t, g, unknown or other
  modified_base (7204)..(7213): a, c, t, g, unknown or other
  modified_base (8221)..(8230): a, c, t, g, unknown or other
  modified_base (10544)..(10553): a, c, t, g, unknown or other
  modified_base (10643)..(10652): a, c, t, g, unknown or other
  modified_base (11924)..(11933): a, c, t, g, unknown or other
  modified_base (12134)..(12143): a, c, t, g, unknown or other
  modified_base (12323)..(12332): a, c, t, g, unknown or other
  modified_base (12706)..(12715): a, c, t, g, unknown or other
  modified_base (13442)..(13451): a, c, t, g, unknown or other
  modified_base (13702)..(13711): a, c, t, g, unknown or other
  modified_base (14177)..(14186): a, c, t, g, unknown or other
  modified_base (15930)..(15939): a, c, t, g, unknown or other
  modified_base (16019)..(16028): a, c, t, g, unknown or other
  modified_base (16894)..(16903): a, c, t, g, unknown or other
  modified_base (17390)..(17399): a, c, t, g, unknown or other
  modified_base (17581)..(17590): a, c, t, g, unknown or other
  modified_base (18082)..(18091): a, c, t, g, unknown or other
  modified_base (18750)..(18759): a, c, t, g, unknown or other
  modified_base (19070)..(19079): a, c, t, g, unknown or other
  modified_base (20124)..(20133): a, c, t, g, unknown or other
  modified_base (21091)..(21124): a, c, t, g, unknown or other
  modified_base (21618)..(21627): a, c, t, g, unknown or other
  modified_base (22263)..(22272): a, c, t, g, unknown or other
  modified_base (22795)..(22804): a, c, t, g, unknown or other
  modified_base (23079)..(23088): a, c, t, g, unknown or other
  modified_base (23777)..(23786): a, c, t, g, unknown or other
  modified_base (25206)..(25215): a, c, t, g, unknown or other
  modified_base (26417)..(26426): a, c, t, g, unknown or other
  modified_base (26933)..(26942): a, c, t, g, unknown or other
  modified_base (27147)..(27156): a, c, t, g, unknown or other
  modified_base (27909)..(27961): a, c, t, g, unknown or other
ccgcggctcgccgccggggtcgctgtcgctgggcgcgcgcgcgcgcggcgacttccccgcctcgcgcgacatgcccacgccggacgtgcggctgtaccaccgcgccgtggtcgtggcgcaggacgtgcagggcgagctgcgcggcctggttcgccagctgtccatcgaccagttcgagaacgaggnnnnnnnnnnnnnnnnnnnnnnnnnnnnnnnnnnnnnnnnnnnnnnnnnnnnnnnnnnnnnnnnnnnngcgcgtgtcgctgggcggcgccgcgggggacgggccgccggggtcggggcgcagccgcaccccgcttttcgaacgcgcgttctccatgccggtgagcgcacgtgcctcgctgtgttggggcggggggggaggcgaggggccggcgtgggcgaggcgaggggccggcgtgggcggggctcccgccagggccagagggtgggccggacctgggggctgggccaccgagccgccgacgtgtcgtcggtgggaggtagactgtgcgcgccaagggggaacagggggcgcggcggaatactcgtatgagcatggggagggtcggcagcgaacagagacacaggctggatagaagcctgggattcgattcgaggtagcccatgcatctcatcctgtgcccctccagagcatcacacacacacccttttcacccctcccaccaccaccaccctccccacccccaaacaataatatatgcagacgcacggcatgcacaagcaggtgctgcgggagctgctcatcccacggcactggcgaccaccggagtcgcgcgacttcttcctggacgccgacgccatccacacattgtgcgatcaggcagaggccatcttccaggcggagcccaccctactgcggctcaggggtaggtgtggtgattttggtcggctagaaagggggaaaggggaggggggcacgcggggtcagagagacttgccatggggctcgggagtctgtggtattggaagtgcacggggatgtatgctggtcaccggtctcgtggacagctccaggtcacgccaggcctgcccgcctgcacatacaaccacactttcacaaatcccgcctaaacttcctgaaccaacagcgcccgtcaagatctttggggacctgcacggccagttcggggacctgatgcggctgttcgaggagtacggcacgccctccacctccggcgacatcacctacattgactacctggtgggagttggtttttgggaggggggggttctctggcaggagaattaagacagggagggagtggggtccagccggtcaggcagcgggccaagggcaaaggggtcccaccataaacgttgggccgagtgccattccaaacatgggacgactgggtgagccacgttgaacccgcatcgggcggcgcaaccttgccatttcagccttcgccatggttccaggccctaccgttgaccggcccacctgttttgcctgtgcaattgcctcccccaatccctcactgttcagcaccatctcagatcccccttccccctctcnnnnnnnnnnttacatcgactacctggtgggagttggttttttgggggggaattctctggcaggagaattaaggcagggaggagtggggtcccagccggtcaggtagcgggccgggggcagaggggtcccaccatacaccatgggccgagtgccattccaaacatgggaagagtgggtgagccactttgaacccgcatcgggcggcgcaaccttgccatttcagccttcgccatggttccaggccctcccgttcaccggcccacgtgttttgcctgtgcagttgcctcccccaatccctcactgttccgcaccatctcagatcccccttccccctctccttataaaaagttcctgggcgactacgtggaccgcggcgctcactcgctggagaccatgtgcctgctgctggcgctgaagatcgaccaccccgagaacgtgcacctgatccggggcaaccacgaggcctccgacatcaacgccctcttcggcttccggttggagtgcgtggagcggctgggcgagccggagggcctgcgcgcctggaaccgcttcaaccagctcttcaactggctgcccctggcggcggtgatcgaggacaaggttctgtgcatgcacggcggcatcgggcgctccatccacagcatggagcagatcgcggagctggcgcgcccgctcaccatggaggacggcggcgtggtgctgatggacctgctctggtccgaccccaccaccaacgacgcggtggagggggtgcagcccagcccgcgcggcccgggcctggtcacctttggccccgaccgcgtgctggagttctgccaggcgaacgagctgcagatgatcgtgcgcgctcacgagtgcgtgatggatggcttcgagcgcttcgcgcacggccgcctcatcaccctcttctccgccaccaactactgcggcaccgccaataacgcgggggccgtgctcgtcctgggcagggacctggtgggtggccagagatgggggaagagggtttggggggaagggccgggtcgtcggacgatgagggcttggtgtggggggggtgcagaggctggaacctggtgatgtgcagaagctgcaggaggggtcgatnnnnnnnnnnggagggtttgggggggagggccgggtcgtcagacgatgagggcttggtgtggggggtatgcagaggctggaacctgatgatgtgcagaagctgcaggaggggtcgatgggaatgtgcagacaacgacatgtgggccaatccaggctgccatcccgggcctggctgcgcagatcgtagagccactgcatgcattcatgcatgcggctgcacccgacccaggtaccccatacgacgaaagacccctgtcggaaaccccccccccactcacacatgcacccaccacaggtgatggtgcccaagctgatccacccgctgcccccgacgacgccgcgacaaccgcacagccccaccctggcgggggaggagatcatcgaggacccgcccacaccccacccctcctcgggcgacatgtggatgcaggtgggctggcgctcttggaagggggtcggggtgatattggtgggtagggtgcatgcggcctatgggtaaaccccattctgctgtgtcgtgcatggcctcattctcaaaggccccgagcctggcattgctgggagggaaacttgatgaagggacctcccatggaagttccccgatgtgcgaatggtgttgactcccaccctctcttccccccattcgaccatcattcacctaaacaggcggtgaatgccgagagaccacccacgccgccccgcggtcgaccctccagtccgcagtcattcttcgactgacaccccgtcctttttgccccctcgccgtcacctgtgatgtgccatgccacaaacctgagtcccagcttgcaagcgcatgatgtagcagaaacaaagttgcggcggcgcctgggaagcaggggcggctgcaatggtgttgcattgcactgtgtgccgcaggagaccggggtgctgccaagcactgtgctgagcaggtaggctgacagtctgagaaagtgaacagtgggccaccaaccccttgctcttcttggggttctcgcaagcttatatgaggacgcagcacctagatgagcaaagactaagcaggagactgtttcacaaagggacatcgggaagaaagtgtgaggctcgcactgaggatcttcatgctgctctcctgctctccagcacaccttgcagggaggggtgcagctgggctaggtggggcatgcccgtccgcgcccccagctcagtgcacttggccgcagcgacaaccgtgcccagcttcgcggcagcttccaggctggcaccaacagacacactgaccaggagcgagcccaggaaggcgtccccagcgcccgtggtgtcaaccacctcctgagggagggagggaaggcagggcagggggctttgagacgtgcccgcaggaggctagtcctcttaataacgggatgtacacttcatcacccaccgtctccaggctnnnnnnnnnnagcgggaggactagccctcttaacaacgggacgtacacttcatcacccaccgtctccaggcttgcggcttgatgcaccaggacgccaaaccccgtcccatcctggagttgtagatgccctgaggcacaggcgcccaccctgcgtcaaggtgttgggttcgcatgtcaggataccagccagggcactgattgtgcaggcatgcgccctcgctgcaagccggccctgcnnnnnnnnnntttgggttcgcatgtcaggatacaaggcagggcaatgattgtgcaagcatgcgccctcgctgcaagccggccctgccatcccatgctgggtgcccttgctgtcgttgcccatgcaccgtgtcgagaaagcaacctgtcttgcttcttcctgcctgtcaatcagtctctctcgccgattcgcaatatttccccatcatcctcacacctgaccagtgatccattcagcgctgtgcaagcggcctcctcggagcctccggtgcccttcctgcgtgcatcggcctcgtcccagagcttttgcatgagccggtcgaggtctgccccgctgtcgatcggcnnnnnnnnnntcgatgcccttcctgcgtgcatcggcctcgccccagagcttttgcatgagtcggtcgaggtctgccccgctgccgatcggctcaccactgccttcctgccgttggaatgccaccaacccgctcggacccagtgtggtgaccagccagcgggctgaggtcagtctcctcagcatgcacagcagggcggagcccagcgagagttcctgggtccacgtcttggggtgggggtggggggtattgggagcgaggagcgctgttcatgctgagcgaaggttgcaagagagccatgaaggcctgttcaggtggtgtccccgacagtggacaatggcctgacaatgccatgcattgctgtccatgtcgcccatcgctcttgaaaactgtggccaccctggtctctacggctgcacctgcatcccctctgcgatgcgatgctcaccttggggaaggtggcgtnnnnnnnnnntcatgaaggcctgtgcaggtggcgtcccgaggcagtggacaatggcctgacgatgccatgcatttgctgtccctgtcggccatcgctcttgaaaattgtggccaccctggtctctacagctgcacctgcatcccctctgcaatgcgatgctcaccttggggaaggtggcgttggtgtacacatactgagcgccttgcagcaggacatcaagccccggccgtggcttttccgcctccaccaggacaggaacgcctgttgatccatttgtgaggaggggagaaaggatggtgcaaggcgcctctgctcagctgctcagccaacacatgcctctggagaggccatggtaacaccatcaccgaccgactcacgcacctctcgcatgcgcaccgcccagaagctgcaccgctgcctccggatgtctcccatccaagaacaccagcnnnnnnnnnngggccatggtaacaccatcgccgactgactcacgcacctctcgcatgcgcaccacccagaagctgcaccgctgcttccggatgtctcccatccaagaacaccagcttggtggctgaggaaagcaccaccccacgctccaaacccagagcctctccctcaacagccgtcatgtcctcgccaggggaatggatgcacgtcctcgttccacctggggcatcacagattgtgacacttggaacactagagacaattcaggttccctgcaacacttgcataatgacgaccacaactgacatcatgagctcgatgaacactcgattcggcaaccagcaagggccatttctcggccccaacccacctgctgcatccactatgatgtaggttgtgggcgaggggccggtcttggagaacagaaggcactgggtgtcgatgccctccccctgcaactcagcctcaatgctgcttccagcagcgtcactccctgccttgctgatgatggccacgggtgcacccagacgtgcagcggcagtgagggcgttggcgcagttaccgccgccctggatctgcatccacttgaaaacggatgctgccggtgagacgagtaccccacctgagggggtcacattgcagcacaggcctctcttggcaccatcaagcactggcgaataccaacacgaatccaatctagctcaccaaaagccgtctggcgcggatcttttcgtcaggggcggggaaggagtccacgagggccagggtgtccagaccacaggaccccagacccaggaccgcgcagtcgagctgagccgggcggggctccttcatcgcggagccgacgatggggtaacgcgatggccgatggcggtatgcacaccggttctcaggctgctgatgctttgcaccccgctgtctgtccgctgccgcgctggagctggcgatgccgctcatggccgcgacatggtccggacggggtcccactgcatgaaccaccatgcgcgtatgctagcccgggaattcctagcagtatgccaggacctggatgtctgtcgcggcaaaatggagctcttgtcgcctcctgtattcgtaatggtccggcagaagggcgacagactccccagccttgtcctggtggtccctcgggatcaagaagataagaggttcaaaaacacaccattccattacgaaactacaatgggatgatgtttgggtattccgatcagtttgctaccatattctctttgccaattgctcatgcataggcatgtcgacagctggctttgtgtgcctgtgagatcagtgtctttgcattgattcagcctcctctcaccaagtacttccaggtgaccttgctgaatcacttctatcaattgagtcgactccacgcatatcagtacaccctgggtgcttcatgacagtaggtgccacttgtggatttgacacagtcttcacaggatctgctcggtctggcgccggcgccctcgagctcgcgttactccaacttgcaaatgcttcgcgcccgctcatagcgaggaattgggcgtcgcatgcatctcagacagtattttataggtgttcccattcctctcgtgcccaggaagacgcaacgggaccccgtactcacaaaacttcgcacctcgtgnnnnnnnnnnctttaggtattcccattcctctcgtgcccaggaagacacaacgggtccccgtactcacaaaacttcgcacctcgtgccagggacccgcgaggcacgccagcatgggcaggccacgaaagccttttatcgacaagaagaattccacaacttataatctcattcatagaaatacagatgctggcgaagtggtggatgcttctggtcgcgtgttcgtggacgccggcaagggagtgggactgggccgggtggacgaggaggctgcagctgcagcgcgcgcagcctctggaactgcgaacaggaggtattcagaggcgcttgtttgggcttgggagtttgagagggccaggtgaagagcccaacgagggtatgtttgggcacggagatagggcaacacagctgagtctttccagagcgcccatggcaagcaagaacctgcatgcccttggaccgtggccttggtgatccttgcagccatatcatgtccatttccataccactgaatttgtcaataccgcttacatcccaccagataccccccgggacacccccttgcctggctggaggccgaggagagcggcccctccagctccctcacccctgcgcggcgtcgcgagctgatcgagctgggcttcccagatgacggctacgactacctggcccacctgagggcgctgggcggcggcagcaacgccctggagggacccgacaggagcgagccggccgcggcggtcgggcccggggtcttcgtcccagcgcaaaagcccctggcccccgccgccgacgtggcgctgtacgatgcgcacgccctggcgctgccggacggggcggtgaaggaggaggaagaggaggccgagggggccatgggcggcgtcaccgccttcacgcgccggcgcgagcgcgcccccgctgccataggtgagggtaattgacaggcgtcggagggttttaggttgcagggtatggccagggggctccttgcattctggatcggctgttcttgttcatgannnnnnnnnncgccataggtgaggggaattgacaggcgtcgggcgggtttaggttgcagggtctggtcagggggctcctcgcattctggatcggctgttcttgttcatgacagacgcgcagaaccgagtgtcaagagtttattgcgacagacttcatggatgctgttcatggctggtgctaatctttgagagctctataccgagcctgatgccctcatcgtgtccccatctgacatgcatgcctgcgccccgtgctgctgcagatcgggaggagctcgccgagctggatgccatgctggcgcaagcagaggcggaggcggaggcggaggagatcggggaggaaggcctgggagacctgctggatgacttcatcctcacggcagtcgggcggcatgaggaaggcacgggcgccgacgaggccgacgatggccgctcctgggaggggaaggagtcatctgcctcggaggtttcctccgcgtcaagtggcagtgagtccgaggacgaggactttgagtctgaggccggcgacggtctgggggagctgaggggcgagggctccgtccagtctcggtggccaggccggacggcgcccaaggcgggcagcatcgcctccacctactggcgggaggagcgccaggatcggaggggggagctgaccaccctggacgacaggtgtgaggagacagggatggttctggcctttcaccttcatgagtgggtgggatgcagctggtccaccagtcccctgcccctttgggagatcgtgttggcaaccaaggtctactggctgtcgggccaagcatgcagtcacctctacctctagcaagaggtcctgaacccctttctggacgatgcggcttggaggaacaccttctcctttccaaccaccccccggttccaggtttgagcatgtggcgctggagtacgacgaggacgagatcggggacctgtcagaccacgggtccgacctagagggggacaccgcgccagaggagctggcgccgcagctggccttcctgctcaccatcgacgagcgggacaaggccgcgcgcctgcgtggagtgagtgggttttggggagcgggggggcggaatgctgggaggggcagggaatcctgacagagaggtggctggcgtcgtggagaggtcttgccttgcacgacagcgccatctgcgcgcggatgaggcgaagcgagggcatgatatgctgtccatagctgcatgtgttgctggaggcacagtccaccgccatgccctgctcaagactgccacattcacatgatgtcaggagggccaagcgacccgcccctcggcgctggccgcacagctggagaggttcggcatgaccgacgacgaccacgaggccgccgttcgcaaggtgagtgggtgatcggggtggggcacctggggatttggcgtggcgctggagacgggctggaggtcctgtctgtccttgccggcatgcggcgagggtctccatgctggctgaccatggtcctgtgctgcgccgggatggcctgcgctggccctcaccgccgcgccctcccctctccacactgcaggccaaggatttggtgcaatgggccgaggcggaggaggggccagacaccagcgtcccccgaccgcacggcagcatctacgtcccggcggagcaccacgagcgcgagcgctgggacgccgagaccgtgctgtcactgcgcagcaacctggacaaccatccggggcgcatcgcggcggacaccacgcgggcgcggcggcgcggcccgcaggcgatcgaggaggccgcgccggtgacggagcccatacggttgaatgcggccgggttcccgctgggcctggggcccgcccgccggcggccgggggcggcggcgatgcccgagcctgcggcggccgagtcctcgggctctggggaggagggcccggagggcgatcccgagacgggggccggaccgtcgctgcagaggcacaagggcgagacggccgaggagaagcgcgcgcgcaaggcggccgtgaaggaggcggcgcgggcggcacgggcggcgaagaaggagctcaagggcctcttcaaggaggagcggggcaaggcggccaggcgctcggccacggcgcagccccaggctgccctgcacatgccctgagcctggcaatgagtggtggagtgcggcattgggacccacaggcccccagtgtgattgcatgttctggccaaaacttcctttgctgtgacaggcggagttcattcaagctcccaaggcaggcaaacagtgtctgctggtgacacacagtgctgcgatcctgggataatggtgagccccacgctgctcnnnnnnnnnnctgagctcatgcaatggctgattcaagccaggcactgaagcccatgcttgcaagagctctcgggcctcaccattgcaaacatggcacatnnnnnnnnnngaagcttcctttgctgtgacaggcggagctcattcaagctcccaaggcaggcaaacagtttctgctggtcacacacagtgctgcgaccctgggataatggtgagccccacgctgctcagtcctggtgacccgcagcagcggccagagccaggcgcgacgggcgggcggtcggtgccctcggccgcttggggggcttgggcgggcccagagctgctggagggaaggggagagaggaaggctcgacagtgactgtatgagttcagcacaatgagctcctgcaatggctgattcaagccgggcactgaaggccatgcttgcatgagttatcgggcctcaccattgcaaacatggcacatgcaagacgccaagcagcctcacctgctgcttcaataggatcgagtgccccaaaccttgttggtatcgcccgcatgtcctccttgaacagcacttcggccagagctgcattttccctttctcgagttgcttgcctgtggatggggtccggccttgaggaggagaccaggacggctgctggaaccttcatcattggcaacaacataagcctgagaggccctgtgcatccattgtggaaacatggccacgtattacgacaaaggcccaggccgtgcctgagaaagtcgtcagagactgcagcgtcctcggtgtatgcagtggtagctgcttccagggcggcacatttctccacccgaggccctgattgcatcgtctcccctgcctgtccccttcgtcgaaaggctttgtagttgggcagccctgcatggggttggaactgtggctaaggcaaatggcaagtcacaagaaaggagctgctgctgggagggaggcaactcggacgtcaaggctggatggcccaggaggcaccctggacatgatcacggcctggagctgacatacctctcgtccaaccctcagcccctcctccacagcacagaccctagaatggcccgagtacctgtggcccctgcactccctcccatgcgccccaggcttcccctctccggcacgacaacgtccaggatgaggggcgcaaagctgatggtggcctgtgtttcctccactcgttcccccacagcctccgcctgctgctccagtgttgagctcgccggcgggacggcttgcggtgtctctgcgtggctcatcagctcgtcctccccctgcagcacctggcgccgcttcctcggccgcgctccctcgtccgccgtcgtgcccggcctcgagatgctggctggcgcctgcctgaccccagctgcnnnnnnnnnnatgccccctcttccgccattgtgtccggccccgagaggctggctggcgcctgcctgaccccagctgcagctggatgctcctgccgccctggcctcttccaggcccgctgcgaggccacgggagcgatagggctggccgccacactgcccccccgcctcggcgcacccgctgtgccctcatcctctgacgcctcggtggtgnnnnnnnnnnaggagcgatagggctggccgccacactgccctcccgcctcggcgcacccatcgtgccctcatcctctgacgcctcggtggtgtcgcccgtgtgctcctctgccgcgggcacgtctgtcgggggccgtgccacctgcagggctcccagcgggtctgtgcctgcccatagtgcgtcctgcannnnnnnnnnaggcacgtctgccgggggtcgtgtgacctgcagggctcccagcaggtctgtgcctgcccatagtgcgtcctgcagcgagggggagaggggaatagctataatgtggagcccaggtgcccccctccacgacccagctccggggggtgacgaatcgtggcagcctgagcgagcaaggatgcatgcagcaggcatgccgcggtggtgtgtgcacgttgagccacacttcagatcaacaggcccccaacagtggaccaaagcgctcggcacccagccgcaggacaagggcgcaagggctggtatcgacacgagcctgccttatcctgctgcaagcacatgctccaaccacctcgccgcagcagcaccagcctaggaannnnnnnnnnactgataccgacacgagcctgtctcatcctgctgcaagcacatgctgcaaacacctcgccgcagcagcaccagcctaggaaccccgacgcaccaggagcagctgtgccgttgtccacgaagcttggaactcagtcccagttgggtcagcctccaggatgcgccatgccttggcatgcctgggcagtgcaggttcgagaaagtgcccacccagccgctgcagcaccgcttgcaggtgctcgtcctttcccaaatgtgaattgagtggcacaagaacagggctgtgagttcctgccgcggattcacgagagcttggaggcagtcacctgaggccacttccacagagctcgtcctgccgagcccccccctcacctttgccttcccctcccacgcaaacgcctggtccttgagtgcctgctgcgcctcgagatccctcagggaggagttcatgtccgccactgacctgctccctgccagctttggaggatgggccgcctcgtcgggggcatcgtggcgccacaccccttcatgctcatcccaggcgcggagcctgttcaggggcgtggcgagaggaatgttgcttgctgggaggatgacccagcaaggactgcggagggagtcacaaccgaccttggcgttcctgacctgccatcctcatctttccacgaacccagcgcggcccctccctcaccaatcagcagtcacgactggcagctcggagatcaacgnnnnnnnnnnaagcttggtgttcctgacctgccatcctcgtctttccacaaacccatcgcggcccttccctcaccaatcaacagtcacgactggcagctcggagatcaacgccagcaggagtactgggctgggagcgacaggcgccgtgctcgcagctataaccctggtgccagggtgtcgcaggtccgacgcaagaggaattcctgcgcgtgtcagatgagtggggagttggcagccaggcttgcggcaatgggtgacgnnnnnnnnnnacaagaggaactcctgcgcgtgccagatgagtggggagctggcagccaggcttgcggcaatgggtgacggccggcacgtactgcatgtgcatgtggcctgagctcagccttggccccagaaagcagaccagggaaacacgactgccaccatccccaccaagtttcacggccaaacgagctgcagcctgtgcctcatcctggggaaggttgggtaggaggtacgccacccattccaggttgtacagcctgcatggtgagggatgcatgagcttgatgcgcacaacattggctcttgggaggagccgccggcatgcagctcacctgaatggggacttcaaaccaaactgcacagcggacgtttggcagggaaagggttgatggggcatggcactagggaggggaacagtcggcaacatgatagccacccacttcatcacatggcaccaaaccgtaccgtccctcctcnnnnnnnnnntgcatggcacaagggagggaacagtcggcaacatggaagccacccacttcattacatggcaccaaaccgtaccgtccctcctcgccgcaccttgatgtagaattcatgccttgccacggcctccttgtccttccctctggcgagcattccctcattggtcggggtcaccagggtgccatagcggctcgtgtctgcaggttggtgccgggcatacaagtcggatcaaggtctactggcaaatcatcgatacgagttccatggccctgcccagtcccagtcaaggcgcgagcacagaatctctgggcgcagtcatctcaccagagacacgaataaagggcccttgggcctcgctttcccaggcttcgggccctggcacccagaggtgtgcatgctccctcgaaatgctcttgtcgtctgttacagcgatgtcgcactggcccgccagacgacccacgctataggtccctggtttcaggaaatacttgactgttctgctttccagaggtcggtcatcatctgcgaactcttttgcctccaggagccagaggctcgtcatggacggcagagctcgcgcagagtcgaacgcacgtcatccaggggccatgagcctttgcacggctttataaatacggtgcgatgggtttgatattgctgccaatgctagcgtgtctgagcactgctcttgacgagatcgcgtgctttggatgctttctaattgcgcggattggcgatgctcttacatgccgcgcgaccatcagattaagcctctgacgcctacgttggcctgttcatcccgcagcggagaggtgcgcgacaaggcaagcgtgagggcgtgacgacaatcttcgcgaagatccgggggtgctacagcctgctcacaaacgtcagcgataccctaagtagcccagcataccgtggagtgttatttaatgacgagaccagtagtggtttgccgggatcctggtcatgcggcggtgtgtcgtgtgggtggggtcatgccaaacatgaaacacctctcaagtattctcttcactggaatgaggggtttcagcaccagaccaccaccaggtgacgcatgcaatgacctgccagttcccgcaatccacgaatgggttgctggatgctcgtcaaatgatccctaattggtcgtatagacggccagaagctatggagtcggttcctgatcgccagcgttcgctcgctgtgctgagatgatggtataaagtccgacgagggatggagaaagtatggcagcacgtggccgtccctctcgagtggatcaacatgatcccaaagttcggttttcattgccggaaacagtcccggtgctgcatggacaagaacccggagccatgctttttgccgtggggtcaaggtctgtttccattccagatcacggtgtcgcgcaccgtgcaggcacctcctcggagcacaccgtgccgccaacacaccgagtgaatcatcgacgcagcttgcttgccgccgtaccgggcttcccaattttgcacttgcttctgcctcgtttggcagcctctcaagaagccgagcttgtcaacaaagtttcacccctgtccaaccttttacagtccccagcaggcatgatggcccagtactggcaggggattgaacagtcgtagttctggctcaccccgaatgtgacgtacaggtggcatatgcctgaatttgatagcccattacacgcagtttggagacctgcactctgactggacatccattcctgccnnnnnnnnnnggtgaatcatcgacgcagcttgcttgccgctgtgccgggcttcccaatcttgcacttgcttctgcctcgtttggcagccnnnnnnnnnngagttctggctcaccccgaatatgacgtacaggtggcatatgccggaatttgatagcccatttcacgcagtttggagatctgcactctgactggacatccattcctgccacaaatgcagcattctaccgatctcggcagcaggcgggtggcggagccaagatcctggcacccatccgcgggtccagagccggcctggaacgctgccgcttcatattgaatgatgggggtcccaacccgtacgtggccatgctacggctggcaaggagtgcctccatgaactgctatctgtacgaacctaacgctggggaggggtgggaggcgcgcgcatctctcatccaacagagcctgccattcagcgacccttgcacgcttcgcttgatgtgagccttgtgtgggtggtggtgggaggcaaaggggtcggcatgtgtcagggttgtagcattgcacccagcaaattggtcgggtgatgctcgtctcccgcagacccataacacattgactatgggcacgccctgtcctcttggcatgcaggcgatcactgaagcgatataaaagagagcagttgccatatttgagcctcccatccttctactgcacacttcattcacagatacaagaacagcatcaccctgaacaaggaccctgcgctccagcagcaagggaaggtgcaactagaacgtctgatcaggtgagataaattggcaccgggcgctaaaatgttttgcggcaagaatgtttaaaacggcaccatgacttcaaaattaaggctgtaccgggccatgcgggagtacatgttgatttgctcaagtggtgctgtagttgccttctgtctgaaggttgacgatcaccggtcgtctcaccagcnnnnnnnnnntacatgttttggggcaagactgtttaaaacggcaccatgacttcgaaattaaggctgtatagggccctgcgagagtacacgttgatttgctcaagcggtgctgtagttgcctttcgtcttgaggttgacgatcaccggtcgtctcaccagccgctctttgcgatcctgtccaaaggaacttccagcttttggatgacatgctggagcgggcgtcgcagggggaccaggcagcagtgcagcaggtgcccaaaattcttgatgacgccatcgagactaatgctggttttgaggccaccatccttgcatgcctggggttgtgagatggccactatgtgtgtggattcactagcagatgatcgcttggcagccattgagcaaggtgtgtcgtaagcatgtttgattgagtgctcccaaggaggatttcaagtccagcgcctcatgctcactcgttgacgaggaatgcacgactcacagggcaatacacccnnnnnnnnnntaagcccagcgtctcatgctcactcgttgacggggaatgcacgactcacagggcaatacacccgtgcgattggagcacgaagccgatagccgtcgggcaaacgtcgcgcgaaagacctgccgtgatacttgaacatgaagtggaacaataggacactgttccaaaaccgcatgctgaagagnnnnnnnnnnagacaaacgtcgtgcgaaagacctgtcgtgatacttaaaaatgaagtggaacaatacgacactgttccaaaaccgcatgctgaagagcacccatcacaagcatcccgacggcattattgtcgaacatatggtggcggacttgtacggggcgtttgaaattcccagcgtgaagagagtggttccgagcggcgcggcatgccaccccaataccagacgcaacatgacacgcccaaagctggcctctcacggacgacagaggttacggcaaaggctgaactaaaaatcccacgtgatgctagggtttgaccacacgggtgtcctgaaggatggcagtcggccatcataggctttgtgaatggaaactcaaatgcatgcaaagtcttccgcgcctcgttctggatctgtcgacattgcgcaaaggcagcctcgtccttccggctgtggtactggacgattttccaaaagcttccgttcgaccccgaccggggcagnnnnnnnnnngaggctaaactaaaaatcccacgtgatgttagggtttgactacacgggtgtcctgaaggatggcagtcggtcaccataggctttgtgaatgggaacttaaatgcacgcaaagtcttccgcgcctcgttctggacctgtcgacagtgtgcaaaggccgcctcgtccttccggctgtggtacaggacgattttccgaaagcttccgttcgaccccgaccggggcagcggactaaggaacgagggttgcgaaaacactagggcaataggatcatgcagcgtgaggactgtcgtcagaagtttcagagtgatttggaggcacaagaaagctgcctaccaaatcagaaagtttcgttgcgactttgcaccacttgccaagagcacaaaccccatacccagtccctcaggatggggtatgccgaaaagatcaatgcgagggtggagaatagcgtgagtggcgccagtttattaaaagaacatgcctaaatacccttgggccggctgatcccgccatgcaccaccgatttacagcctcggtctagggctttactgccgatgcatcgcatggccgtgcccgatcgccgggatggccgaaatactccgctccctcactcgacgcccccctccccctctgcagatcgtggggcgctacttcaaggtgannnnnnnnnncgcatcgcatggccgtgcccgctcgccgggatggccgaaacactccgctccctcactcgacgcccccctcctcctttgcagatcgtggggcgctacttcaaggtgaaggagaggaacaccagcttcacccaggagctgcgcggtggcagtgtgaccttcctcacggtgcgctggcggcctggcatttgtcagtcgagggacacatcggggcgggctgtcggggtacagctcgctcgcttgttcctcgagggatgaatgagtcctgtattcttatcatcccgctgggattggggacctggtctgttgacagnnnnnnnnnnagagtcctgtattcttatcattttggctgggattggggacctggtctgttgacaggaggtcgcacgatgagactggcatcaggtgttgctgcgcgttaaccgtgtcgtggattttccttccgcccgcgtcctggctcaaccaggctgcgctcacacacctgggttcccgcttccagcccgatccgcggaccccacttccctctctgccccctctctcaaagtgcctctttgcctgacaaaccctcgcctgctcatgccaggtggcgtacatcctggcagtgaacgctggcatcctggccgacaccggcggcatctgccccaccaacggcgcctgcccgctgggccccggcagcatcggcacggcggcctgcgacgactgcgtggccaacaccaagcgctccttcatctccgccaccgccgccatctgcgtcatcgccaacttcctgatgggcatcatgggcaatctgccgctggccatcgcccccggcatgggcctgaacgcctacttcacctacaccgtggtcggcttcttcggcacgggcatggtcacctaccagatggccctggccgccgtcttcatcgaggggttcatcttcgtcttcatctccgtcatcggcctgcgcacctggctcaccaccatcgtgcccaagtccatctggctggcctcctccgcgggcatcggcgccttcctggccttcatcgggctgcagcaggcggagggcctgggcgtggtgacctacaacggggccaccgccgtgggcctgggcggctgcccccccggctaccgcaaccaccagtacaccttctccaccgcgcagctggagtcggcctgcatcctgtccgacggcgcggccatcgccaaccccgccaactcgggctggacgccctccagcaactacttttgcgagagcgcgggcgtcatgcgctctggccagacctggctgggcatcgcgggtgggagggggggaaagggacgacgtcgtgaggatgggttggggaccatggggttcgctttggcggtggcagctggagtggcggcggcgcnnnnnnnnnntggacgttgtgaggatgggttgggaaccatggggttcgctctggcggtggcagctggagtggcggcggcgcccgcttgcggtgtgatgcgtccccaggaccctttggaccccctgccccccctcgcatccacccctgacatcaccccctaccgtacctcaccactccaccatccacccccaccccactcccaccccacccaccgccaggtggcatgctgatggcggtgctgctggccaagaacctgaagggcgcgctgatggtgggcatcctgttcgtcaccttcatctcctggatcccctcctccggcaaccacgccgcatacctgggctcctcggcggggcccgggggccaggagcggctggactacttccgcaaggtggtggcggtgcccgacaccagctacaccgcggcccagctcgatttctccggcttcaagaccggccagctctggctcgcgctcatcaccttcctctacgtcgacttcctggactgcacggggaccctctactccatggccaacttcctgggcctctacatccctaacttcattgacaagaagacgctgcagttcgagcgccagctccccgccttctgcgtggacggcgtgtccatcaccgtcggtgcagtgctgggcacctccccggtcaccgtcttcgtggaaagcgcgtcgggcatcagggagggcgcgcgcacgggcattgccgccctcatggtgaggcaggggtgttttcgtgtttgggagtgaggcggtggcggggatggaatttctcaacctgtgctagaggccagcgcggcttgtttctctctgcgccttgcatgccagagcaccggccttcgcatgtcatagcatggtcccagcggtcctgcataccgtggtgactgatactattctctggctacttcaattaccctctcacccccattcgctcaaccccccccccccccccccccccccnnnnnnnnnnnnnnnnnnnnnnnnnnnnnnnnnnccacacacacacacaaacaccccgagcagataagcttctggttcatcgtctccctcttcttcaccccgctcctggccagcatcccgccgtacgccacgggtcccgcgctggtcctggtcggcgccatgatggtgatcaacatcgtgaagatcgactgggccaacatccaggaggcggtgcccgccttcctcaccttcatcgtcatgccgctgacctactccattgcctacggcgtcatcgcgggcatcatgtcctggatcatcatcaacggctccgtggccgcctggaactacgtgagcctcaagatctggggccggccagaccacgtggaggaggggtccagctggaagatggtccgccaggtgggcgtggagtgggaaggcgagggtttttgggggggggaaatgggggtggaagctctggcaggccggacattgatggaacagcttggaccaaccgggtgggtggatggcactcccggacattccgatgcnnnnnnnnnntcgccaggtgggcgtggaatgggaaggcgaggggattttttggggtaaatgggggtgcaggcactggcaggccggacattgatggagcagcttggaccaaccgggttggtggatggcactcccggacattccgatgcctgcactgctggcaccatccatacccttgccctcactcctctcacctccttccccctgtccctccctccaaaacacacagatgaccttcaccctgaacgccgacaggtccctgcaggagagcgaagccctgcacaccttccaggacccctccaccaggggcatgaaggatggggacgagtcgccctctgcctcccaggccgccgccgaggtcgagctgggcggcaagtcggtggacaccagcgtcaagccctgaggcctgggctggccaggcacatgtggaagcaggcacgggagccgggcgccctgccctgctcccggggaaactcacagtcaggcccaccctgccacgcaggcacagggcctggaacattaaattatacgctatgcaagaaacctcgaaagcaccctcctgttgttgacatcttcgaaggggttgtacttaccccgtttgccttccctatgatctgttttttgtactaatgcaatgtagctcctctnnnnnnnnnntgaaggggttgcacttaccccgtttgccttccatacgatctgttttttttgtactaatgcaatgtagctcctctttcccagcacccgcatgtggaagcagcctcttgtaaaggcaaaactccaggaatcaaagcggaagtcggagaatttagaagggtgaaatctcaatgcgagcaatggccctacagatggttgagttgaggtcctgcatctttcgctttcttgttgagatttcggtcccttctcacgagggttcctgcctggcttggtacgaacgaggcatgccgtctctcatttcactttccgcccttcaattcttgagcaatattgctgtcgtttccaccgtagaaaggcgcagccttcgtgacgactccaaacccttccccttctctcggccgagggtttgtaccatgactgttccccaagcttgcgaagccactccggtacggcagacattgtgtaggaaccaataatggctgactccccctaatcaagcttactcatcggccgcatgtccataccnnnnnnnnnncatggctgattgctcctgattaagcttactcatcggccgcatgtccataccttcttctccagatcccggtggtcgacttctcggcggaggaagcctccgtcgttaaaacatggcgccgggcctgcatcgaccatggcttcctgtattgtgagtgacggtcgcgaaatcgagaacaaactggaaccttggcccttaatttctgtcgtggttggtcagtgggcagttgtcaagcttgccccaatcgcaaaccctaccccggcagtgacaaaccacgnnnnnnnnnntttcctgtattgtgagtgacggtcgtgaaatcgagaacaaactggaaccttggcctttaatttctgtcgaagttggtgggtgggcagttgtcaagcttgcccaaattacaaaccctaccccggcagtgacaaaccacggcataccggagtcgctggtgtcggagtttttcgagcagcagcatgctttcttccgcctccccctggaccagaagatgaccatcatccaggatgagaacaacaggtgggtcgcttccagggtgtttgaaggttcatgctggcgcgatgacactgagggttaggttcaagggaggtcttaaaacattaacaccttgaccgccgcccttccaaatcgtgcaccttccctacaagctacaggggatacacgccgtacaaggagtctaccctcgaccccgagaactccaagcgccctgacacccatgagggactgtactttggccgcgaggtggcagccgacagcgaagaggccaagctccccctgcatgggccaaaccagtggccctctgaggtgcgggagtaagttggtcagcgggggtgaccttaccacttgcacgctggaagcttccagcgacgttgtgaaaggtcctggcggggaattcgtgcgaaactgtgcgcatgactccctgccgtcatcatcactgatgctcagcatcccccccattcctctaccnnnnnnnnnntcttccagcgaaattgttaaaggtcctggcggggaagtcgtgcgagactgtgcacatgactccctgccatcatcatcaccgatgctcagcatcccccccattcctctacccccaggacctgctgcccaactaccggagggtgacccaggcatactacgacgctgtgactgcgctgatgcgcaggtcgctgcacatcctggcgctgtcgctggacctgccccgcgaccactttgacgccatgtttgccaagcccatcgcctcgctccggccactgcactacaggcacgctgctgtgctgggggtcccgtgtgatggtctgaggatcaaggtggatgtcttagggtgacggcggcttcccttggccctgctgcgcagctccaacgcgacctgagcctgtggggacgagggtggaggcatcactccaggccatgccagtcgctcatgctcctgatggtgtgcgttagaccttcacaacacgctcatcctctctgactcacctttgcgcagcgccgaggtggcgtcgcccgaggacggtggcttcagcgcgggggcgcacaccgactacggctgcctcactttcctcatgacggacgggacgccgggtctccagatctgcccagacggcgagtgggtggcggtgccccacatccggggtgctttcgttatcaacctgggtgacatgctggagcgctggaccggcggactgtaccgcagcaccctgcaccgcgtcgtctgcacgtgtggaaaggagcggttctctgccgcattcttcgtggagcccagctttgagacggtcgtgcaagtgtttcccgaggtgcgcggatcatcgggagagggattcctgggagggaccagcgcggtgcgcatcacgctcacggcgtcggtgtgcgtcggcgctggatatgggcgtaggatgagaaggaacaatgtggcctggacacccgatgcaaatcccccaccattcacctatgtgtgcagtgcctggcaaagggcggcaagagctacccccccatccagtctggggagtacctgctaggcaagtacagggccacccattcggggtacagcctggcaaaggagggtcatgctatcgcggcctgaggcatgtttaccttggccgcttgtggatggcccttcccctgcccgactccagcattgtagcctcttggcagggaatagtttattgccatcggcaggatctgctcaggctgctcaatcccctgaattaacagcaacgaattccggatctccatatgcactgtaaacatgcgcattgtgctggttctctggcagtgttgatgagattcgggtctcgagatccatacttgtaaaaccctacacaccgcaccgttacccacacgcgagcctttctgtgccattcgagtggtcgacatggcagggaagcagctcgacgtcaccnnnnnnnnnncgtaaaaccctacacaccgcaccgtcacccacacgcgagcctttctctgccattcgagtggttgacatggcagggaagcagctcgacgtcaccaccccagcgcgcgatgggggtgatcgcgaagaaagagagtgtgtggagtcggagcctcgaggccggtgcctcgttcgaggcagtacgcacggccatgtcgtgggctgggcacgggctccctgccgcaacagtgcacccgcaaaactccagtcacgatacccaccatgtctgcctggtgcatgcgaacggctgcgccggtgcagtgaggtgcgcctggctggggtccggtgggtacccgccatcatggactgttccggggtgtgccctgcaagccctgcgaccctgatttccgccccttcccgcacatttcagacaaaacacagggtacgaccgttgtgggctctggggacacccaggcttcccggcgcatctcggaagagaaccgccggacgcgaggggaggactgccgggcgccaagtgatccaggagacgcgcacacgcctgccgttgcgctccagcttgtcgagccagagaatacaggtgcaggcgggccatcagtgtctgctcccgtccgaggtccgagctagtatatagagggcgagcttcatgcagcatgacagcatgaacggcacacccggttcggatccgggggggttggatttcttggatttcccctccagtccgggttctcagcccaggtgtgtaggtcgttttccattccggcggagagggaatgtgtctggcttaactgacttactctcttggtgacatcttgtaccagccggtctgttggattgggattgtgctggcagctggagctgctgctcagattgtatctccttgccacaacccctccattggccacaggagcgcgccccatcatggcctgcccgagggcgacacgccgcccagccaccccaaagccacgccaggcgtgaccgccaactccaccctggaccatgccatccacaagctggccagcgacgacttcacccgcctcctgtgagttgttttgaaagggcaacacaggtcgctgccttccttctgcccctgtgcagcatccctttggactactgtagagcccgctggtcgtcaggcgcctggcaatccccctttccccactttccgcggcaggcatttcgaggcgatgtgtgagactgacggggacnnnnnnnnnngaaagggcaacacaggtcgcttccttccttctgcccctgtgcagcatgccttcggactgctgtagagcctgctggtcgtcaggcgactggcaatccccctttccccactttccacggcaggcacttcgaggcgatgtgtgagactgacggggacctggacgacctgtcccgcgtgttccaggggaatgagggggccgagctcctagacccaggcttcttcaacgacctgatgtcccccgaggacccggcccacggcacgccggcgaggaacggccacccaggctatgcgcagccccatcccgtgcaccgtcggccggcgggcgccgaggcggcggccgcgcgctcggtgctggcctccctgggggaagacgactcccccggctccatgaggggggagaccagccaccaccaggtgggtgcatgcaaaggagggtgggatggagtctgcgttcaggtggctcgctggcgtggagcaaaggcctcagcctgggtaagtctgtccacgcnnnnnnnnnnggtctgcgttcaagtggctcgctggcatggagcacaggcctcagcctgggtaagtctgtccacgccatggtgtctgactgtggaccgaggccgctgctcccaagggccaggtcaaacgctgcaccccgacagggggtttctccagatttaacaaaaacaacaacaacacccccttacaagttccaaaccgctctccctccctccnnnnnnnnnnacgaggccgctgctcccaggggccaggtcaaacgctgcacctcgacagggggggtctccaggtttcacaacaacaacaataacaacaccctacaagttccaaaccgctctccctccctcccccctccccacatgttattttctcaggctgacttccgcgggtccatgggcatgcaccacgccccccagcaggcgggccccgcccccgcttcacacaccagcgaggcctacccggcctccccgccgccgtccacgccccagcgtggcccccccgccccgcaggatcccccgcccgccggcggcgtgtggctgctggacgcccaggcctcgcccagccccgggtcggtgcccatgacgcccatgcacctctaccccttccagctgcagccggcggccatgtttgtggaccccggcaccggccaggcgctgcccatgcagtggggggttcacggggcgggggccgcgcccggcccacagctggtggccttgccgggggcgggcggcgtgcccggctactaccccggacacccccccgccggcatgcagctggcctacatgcccgggcagtacccctacacccccccgcccatgcaccacgtcgtgcacggcatgcccggttccggggcgggcacgcccagcccctcgcgcaaggggcccaagcggcggcggcccagccgcgggtcggcgggcacgccggcggagacgcctggccagcgctccgcgcgcctggcccagggcttcacctacgaccccnnnnnnnnnnnnnnnnnnnnnnnnnnnnnnnnnnnnnnnnnnnnnnnnnnnnnccaccggcgccatgctgcagcacggcccggcgctgctggcggcggcgcggcacgacaagcccgtgcccctggtgggcgcgctgttcgaggcgcacgccgcctcgcccttcggcgccggccccgcccccgtggagtacaccatcatggcccagcacagcgcgcgcagcgtggccgacgcgctggccgcggggggcggggcgcgcggcgacgaggcgc

SEQ ID NO: 43573 - DNA, 96 bp, Chlorella protothecoides
cccccccccggcgccccatcaaccatgccatctcttcatcccataaccccttgcatacctcctcacgtcacctccacaggccagtcccctgatgtg

SEQ ID NO: 43574 - DNA, 69 bp, Chlorella protothecoides
tccccttgctcccccatgctgacactccccacccctttacccctcacatcgcgcacagggctcctccat

SEQ ID NO: 43575 - DNA, 61 bp, Chlorella protothecoides
tccaccccctccacctgtcacagaggtgattaaatcgtgccggttcctggggtgcgccgag

SEQ ID NO: 43576 - DNA, 61 bp, Chlorella protothecoides
cagcgagttccacagctcgttggtgtcgccgtgggcctgcaccaggtacccgatgatggcg

SEQ ID NO: 43577 - DNA, 61 bp, Chlorella protothecoides
ggtggtgttggacgctgaggcaggggagggggaggtagagggggacagcggcgcgcaggtg

SEQ ID NO: 43578 - DNA, 392 bp, Chlorella protothecoides
  modified_base (104)..(319): a, c, t, g, unknown or other
gggttgggaggggggggtgttggcgggggaggttgggagaaggggggcgccggggcggagccgggcaaggacacgacggccttcggacggggacgtggcgggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctggcacccctgcattgaaggcctggcaaatccccccgggttgggcagtgtgcccacagaccaacaccccccc

SEQ ID NO: 43579 - DNA, 87 bp, Chlorella protothecoides
agactgcttggcgggtgggggtgcagacttcttggcgggtggcggtggcgactttttcgatggggagggtggtgacttcttggcggg

SEQ ID NO: 43580 - DNA, 61 bp, Chlorella protothecoides
aaagcagcaccgagcacgacctgtcggcgggggcagaccagatcctggtcgccaccggggt

SEQ ID NO: 43581 - DNA, 61 bp, Chlorella protothecoides
cagggccatccctggcctcccccgccccggactccccccccgcggcgacggcctgccgcgc

SEQ ID NO: 43582 - DNA, 80 bp, Chlorella protothecoides
tgggcggcgcctgctgcacggtgaggcctccagacgcaagcacacaagaccgcctcctacttactgctccatggatgccc

SEQ ID NO: 43583 - DNA, 12248 bp, Chlorella protothecoides
  modified_base (134)..(143): a, c, t, g, unknown or other
  modified_base (422)..(431): a, c, t, g, unknown or other
  modified_base (502)..(511): a, c, t, g, unknown or other
  modified_base (596)..(605): a, c, t, g, unknown or other
  modified_base (1345)..(1354): a, c, t, g, unknown or other
  modified_base (1544)..(1553): a, c, t, g, unknown or other
  modified_base (2624)..(2633): a, c, t, g, unknown or other
  modified_base (3456)..(3465): a, c, t, g, unknown or other
  modified_base (3881)..(3890): a, c, t, g, unknown or other
  modified_base (4026)..(4267): a, c, t, g, unknown or other
  modified_base (4359)..(4549): a, c, t, g, unknown or other
  modified_base (4612)..(4621): a, c, t, g, unknown or other
  modified_base (5374)..(5383): a, c, t, g, unknown or other
  modified_base (6210)..(6219): a, c, t, g, unknown or other
  modified_base (6871)..(6880): a, c, t, g, unknown or other
  modified_base (6968)..(7135): a, c, t, g, unknown or other
  modified_base (7510)..(7519): a, c, t, g, unknown or other
  modified_base (7699)..(7708): a, c, t, g, unknown or other
  modified_base (8352)..(8361): a, c, t, g, unknown or other
  modified_base (8559)..(8568): a, c, t, g, unknown or other
  modified_base (8875)..(8884): a, c, t, g, unknown or other
  modified_base (9028)..(9037): a, c, t, g, unknown or other
  modified_base (9112)..(9121): a, c, t, g, unknown or other
  modified_base (9445)..(9454): a, c, t, g, unknown or other
  modified_base (10111)..(10120): a, c, t, g, unknown or other
  modified_base (10648)..(10657): a, c, t, g, unknown or other
  modified_base (10717)..(10726): a, c, t, g, unknown or other
  modified_base (10820)..(10829): a, c, t, g, unknown or other
  modified_base (11258)..(11267): a, c, t, g, unknown or other
  modified_base (11535)..(11544): a, c, t, g, unknown or other
  modified_base (11910)..(11919): a, c, t, g, unknown or other
cagcgccgcgcaggccgcctcggcgccgctaggcggggcgggggcccctgtgaccccagcggacccgagccgcagacaggccagcaccgtggcgtggatggtagccaatgagcggtccacgttggtgttattgnnnnnnnnnngggcggggcgggggcgcctgtgaccccaggggacccgagccgcaggcaggccagcaccgtggcgtggatggtggccaatgagcggtccacgttggtgttattgaccaccgggatgaggtgtgcgccggcgtcgcgcaggaggtggtcctggatgacgcggatggagcgcaggtaccgcacataccgattggctgtgatgaaaggggggtgggccatcggtggggagatttggggggaattcatggggatgatgggtgacagcggggcgtgggcatgagnnnnnnnnnntgggccattggtggggggatttgaggggaatacatgggggtgatgggtgacagcggggcgtgggcatgagnnnnnnnnnngttctaaaacccaggatcttttccacaaagttcaccccttaaaccctcccccccgcctcatccccaccgtcagggcgcagggtcnnnnnnnnnncatgctcaagggcggggaggtttgcgagggtggcaggcggctgcccgcttgctctccccaccagcagcatggcaggtggtacttcaataattcttccaacccccaagatcttttccacaaagttcaccccttcaaccctccccccccctgcctcatccccaccgtcagggcgcagggtcatggtcttggagcgcacggcaaagcgctcggcatgcttggcctcgttggcgatgcagaccaggaaggggaggacgtggtgggtgggagaggccaggcgcgcggccatcgccgccgcccacccggggcgcaggtgcacgccctccaccaccatggactggcggcgcacggcggccgcggcggccaggcgctccacgccgggcaccacgcccgcgcactgcgccttgaacccgcgcactgcagccccgcgttcgtccccgggcgcggcgccggcgccggccaccaggggcccgcaggcgtagctggaggcggccaggagcgggtcggtagagaaagcgcggagggcgtgccgcaccgcgtcggtggagagcagggcggggatgcccaggcggccggccagcagggaggccagcgtggacttgcccgtgccactggtgccgcacagcaggatggtgacggaggtgcgccgctccgacaggctgcgggtaccatcggcggtggacggatgcaaggggggggtgttggtgaaggcgaagaggggaaatggtgaaggggagaggacnnnnnnnnnnacatcggcggtggatggatgcaaggggggggggttggtgaaggggaagaggggaaatggtgaaggggagaggacaatgccggggaacaacaggggccatggccaaccaggccagcatgctctgcccttgcccggcgccggcaggggggcactaaaaatccacaccaacacgcacctcatggccgagcggnnnnnnnnnnttgcccttgcccggcgtcggcagcggggcactaaaaattcacaccaacacgcacctcatggccgagcggaggtctgggaggagggttgagtccggggcctgggtggtgaacccgcccagcagcagggcctccaggtcggagcggggaaggctgacctcccagagcccggggcaggcctcccttaggcccccgaccaggctggccgggtcagcgggggcaagggccaacctctcctgcaccagcaggaacaccctattcacagccctggaagccaatttgggtttccatcccgccaggagtaggcaggtgcgtagctggtcggcggaatacctcacaggcccgggctcgtgctggccaacctccaacaggttcaggtatgtcgggcgagggatggaccccggcatggccctcccgttgcatcatggagcaagcttcatttcgaacattggaatcggtcacggcatgcgactcggcgtcccaaatcggctccgcatgggtcccgtgcatgccccccggtcaaggcgcgcgagaggctgcacgtctgacaggggcaagggagggggggtgatgctctgtagtcgcagttacgctccggcatctggagacatttgtacgtacattgaagcaccaagggtatgaaggcatacaactaagcctgtacattcatcccttgcttctcgttggttggggaaagtggacgcccagagctgctggaccggcgggcaaaccctcctccgccaaacaagtcccaagtcggtttacggaatgcaaattcgagggagacccagatctctttatcatcattacttcagtacaacagccctgcatgatcatctgcgtcggaacgaacaggcttgcggagctcctccgaggccagtgactagaagagatggtatccaaacgcgactcctaaagcaagaccgcaatgtacaggcacgaatttgcacacgaaaagtaccagacacgtcgcaactgtgttgaaatcgtggggtggcattcattggcaccctataacagccccccacgctttgctggtaagccgctgaggatgagcgcgtgtgaacgagcggnnnnnnnnnncataacaggccccacgctttgctggtaagtcgctgaggatgagcgcgtgtgaacgagcggggtgtaggtgaagttggccgggaacgacttcatgcacctgccccacccaggatccaattgtgcaagtcacagtgcatttgtggacacattatagtactttgagaccgccctgtcccgcccgtaacgctcgcagatctcatctggatcccattggaggaacgaggcagctggggtgtcaacgccgacccgctcgaggcggtcgcactcagagtgtcgcccaagtccgagaccccgcccttgccgtttatcagacggtgggattatacctctccacattacagccgcgacgcacaaagtaagacctccggtgctcaaagtacagctgtggccgagcacccgccccgcccccgcccctgcaccgtccgtttgcctcccggtgcccccaggaagccggcgccatgggcacccggagcataattctgacatgcatgggcacacggggggacgtgcagcctttctgcgccctgggccagaccctcaagaaacgcggctggagcgtcacgatggccgcgcccgcggagttccaagagttcgtgagcagctttgaaggcctggagtttgcggacatcggtcgttcggtgcaggtgaggtcctttgcggggagggaaggcgcgggcccgccaggccggggctgccggcgtgttcagggggcggggttggtgccgagggctcccgggcctcgcgcatgttggaggaggccgcggcgacaggcgtcctgtgcacacccctccccctcctcccaccgagcagaaggaggtgatgnnnnnnnnnncgggcggggttggtgcggagggctcccgggcctcgcgcatgtcggaggaggccggggcgacaggcgtcctgtgcacacccctcctcctcctcccaccgagcagaaggaggtgatggagacacccgagggcatggccatgcgtaccgccggctcgctcaaggtcttctccgccgcccgcgccttcttcaacgagggcctcctcggctcatggtgcggcgggggtctttggagaaaggtggtggtggtggtggtgatggggttgcttgtgcccgaggagtgcttgctttgtcctctgtcacctggcgtcttgtacgcaccgccctcctgtaatcgtgcgtacccgcgcgcaccccaccgcgccattgccccgcctcccacgccgcctcatttgattcccccttcccctcacccccccnnnnnnnnnncacccgcgtgcacgccaccgcgccattgccccgcctcccacactgcctaatctgattccccttcccctcaatcccccccccctccatcgcccaggttccagagcgtgctggcgctgtgccagtacctgcagcccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggccgacgccgcggccgcacgcctgcacgtgcccgccctgcgcctggacgcgcggtttgggtgcgaggggcgcaccacgctctacgtctacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgtgtcgcggcgcgcgacgctcaagcgcgccgccgacccgcaggccggcggcgccgccccccnnnnnnnnnncattgcccaggttccagagcatgctggcgctgtgccagtacctgcagcccacggtgctggtcctcagctcattcgtccaactgtgcggcgcaggcctcatccccgacctgctgggccttcggacgcgggtgctgctggtgcacaccatccccatggacctcacctccgagttcgcctgcccgacggcggggtggggcctgggcgcgcgccgcggcctgggctgcctcaactccctgtcctgggtggcggggcagaagctggtggtggagcgcatctacctccccgtcgcccagcgcctagccgacgccgcggccgcgcgactgcacgtccccgccctgcgcctggacgcgcggtttggttgcgaggggcgcaccacgctctacgtctactccccctccgtcctgcccaagcctgcggactgggggccccagctccacgtcgtcggcgccgtgtttgcgcccgcgcacttcaccatccgccccgacgtcgccgcgcgcctggctcgcaagcagagcgtggctgtgtcgcggcgtgcgacgctcaagcgcgccgccgacccacaggccggcggcgccgcccccggggccgcgctcagccgcgcgctcagcatccccacgcccgcggagatggcgggggagggcccctccgacgaggacagcccggggtcggggcgcggcatcaccaccgccgtcgcgcacgtgactggccatggcaacagcgaagcactggccggcgcgggggccagctcctccnnnnnnnnnnccgcggcattaccaccgccgtcgcgcgcgtgactggccatggcaacagcgacgcactggccggcgcgggggccagctcctcctcgctggcctcctccacgctgccctcgccggcgctggaggcgctggaccccggcaccggcctgcccctggggctgcagcgctacctggacgacgcggcggcggcccgagtgcccgtggtctactttggcctggggtccatgctggccaccgcctttgacggcgaccgcatcgaggagatcctgggccaggtcaaggtcaccgtctgccagctggcgcggtcggggacgccgctgcgcgcagtcatccacacgaccccgggggcggcggctgggggcgcccccggcgcgcccttccacatgctgacgcagcccgtggatcacggcacgctgctgccgcagtgcgcgctggcggtgcaccacgggggcgcggggacgctgcactcggtgctgctggcggggaagcccagcatcgccatcccctgcatccccatgactgaccagcgcttctgggcggagctgctcatccgccaccgcgtcgcgccggggcccctgctccagatcagcgccttctccgcgggtaagtggtggtgaggggtggagggaggcgggccgggaggacaggcaggaatggacgggggttagagtcgagctgggctggctgcatggcttgctggccctgctgagcctgcggtgctcgagtggagccaccctggctggctccctgatccctcgccattcccatccatccaaccgccccatcctgcccctcccttgcacacacacagcccgcctgaacaagctgctnnnnnnnnnngttgagttgagcttggctggctgcatggcttgctggcactgctgagcctgcggtgcgcgagtggagccaccctggctggctcccggatccctcgccattcccatccatccaaccaccccatcctgcccctcccttccacacacacagcccgcctgaacaagctgctggtcaaggcgttggggaacctggaggagtacaccgccaacgccgagcggctggcgcggcgtatctatgccgaggacggggccggccgcgccgcagacctcatcgaggctgagatcagctgaagagggcgattcggagggtttcagccggttggcgctccgcccatccgccccccccacgcaccaaggaggataccaggcttccacctgacgctgagtgctgccccccctgtcctaccagatacaaacagcgaagcgagggctctcccaccctcgcgggctttcctctacccatcatgctaccggcagcgacgctctttccctcccccccacacacgagagtagcgcagcgtgcaggtcgctcaaggtctgccacatgtacttgcaacgcctcccgatcgccacccgcacttgaacacaccctctcctggcccgtccagccccctcaggggccacaccgccttctgggccacccttccaccccacannnnnnnnnncccacccgcacttgaacacaccctctcccggcccgtccagccctcctaggggccaccccgccttctgggccacccttccaccccacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgccgacagtgccgtttgcaagcgactcacaggcctttggacaaggggtgtgcacgtgcagggaggaaaggcggaacatcaagcgaaaccaaaaccctctgagccctcgtgcagcgccatcatcagccgctccctcagctgctccttggtcgcgtactccaggatgtccagctggttgaagcaggtgtgcgctgttgggaggagggggtggtgaggggtgggtgagcctgcgctgttcaacggtgccggccgcaaacgcccgacgacacccaccgccccgccccccacctgtgggcagccgctccacgtccccgtaggccttgtggatctggaacttctggggtccgtggacgccctgcagcgcggcaaagccgnnnnnnnnnngaccccatccccgcttgcttctcgcatgtatcgccacaccaccaacctcaagccgcactgccagacccgaccgtgtaaagccgacagtgccgttcgcaagcgacgcacaggcctttggacaaggggggtgcacgcgcagggaggaaagacggaacatcaagcgaaaccaaaaccctctgnnnnnnnnnnaggggatggtgagaggtgggtgagcctgcgctggtcaaacgtgccggccgcagatgcccagcgacacccaccgccccgcccctcacctgtgggcagccgctccacgtccccatacgccttgtggatctggaacttctgggggccgtggacgccctgcagcgcggcaaagccgtccagggggaccttgctggtgcccgtgacaaactggaccagcagcgccaggtcctccttgtccatgccgtccacaatctcccagaaccagcgcaccaccgcgctggcagccgtgtagcctggtccggggtgggtgggtgagtttgagggggagtgcaggtgaggggccctgcacctgatgccaggccgacacatggcgcggcacggtgccctggacacctgcccatccacttcagacgctcacaaacccctgcaagcacacacgcgccatgccccttctcacccgtatactcggtgttttttcgcagatcggccacatcgatctcgggcagccccgagatgagcagctccagctcgtggtcgttgaacatgctgcaggatgggggggttggtggtggaaggggttgaggggggggtgaatatgccgtggtgcatggcggtgttgatactgagggttgtgactcgcacatcannnnnnnnnnaatgggggggttggtggtggaaggggttgaagggggagtgagtatgccgtgttgcatggcggtgtttgatactgagggttgtgactcgcacatcaaacttgtaacacaatggcacttcagatgcaatgcaggctgcctccatcaggggacccctacccctgcaatgccccaagttccaccgacacaaggcgccacacnnnnnnnnnngttgggggaccccttcccctgcaatggcccaagttccaccgacacaaggcgccacacccattacacacctgatgagctccttcgggacgatgtcccagaagccagtcaggaaagcagtgatctgttcccgaatggcggtggtcatcctgtgcctcgccaccaggttcacatactccttcttgttctcgttggtcacctgatgacagcagggggagagcggggggctcatgtgtgtgagggggagaagggtggggacacggcccagggagacccaaatgcgggcaggctcaagccagcgaggattccnnnnnnnnnnacattgccccagggagacccaagtgcgggcaggctcaagccagcgaggattcccagggatgcttccattctgtgcccttcatactctcaacaccaccacagatgccatcaccaacccccccccccccccccccccaccaccccnnnnnnnnnnctctgtgcccttcatattctcaacaccaccccagatgccctctacaacacccccccccccccccccccccccccnnnnnnnnnncacaccttgatgccagacccccccggcttcagctccaccaggtttttctgcccgaagaagtctgtctcctccgcaaacgtcaggtccagaacatctgtgatgtcattctccagcatccacctgcagggcatgggggggtgggaaggacacggccagttgggttcatcggccttaggagtgttcctctgcgcaggtcctgccatggctgacccttccttcacccacaagaaaatgctcccaactcccaccccccacccccccctcacgtcaggttcttgtagaagtcggggtcgacggcctcgatgtcgtggtaggtcagctgcnnnnnnnnnnacgcaggtcctgccacggctggcccttccttcacccacaagaaattactcccaactcccacccccaccccccgctcacgtaaggttcttgtaaaagtcggggtccacggcctcgatgtcgtggtaggtcagctgctcgcccagcatgtgcttgtagaaagagcgagtgaagtgcgcgtccacgaactggccatcgtgcagcgccttgccgaccacgcgccccacgaacttgaagaagtcgaggtggttggtgccgcgcgcctcgtcgttctggaccacggaagaggggttgggctggaaggtggtgcccccctccggcaccggcgcaaagagtgagaactgggggttgaacatctcgcgcgacatgacctgcatgagggggtggggggggggtgatcaggtgtggagggtggtgggtggctgcattgtggttggctgggtgatcgtggaggctggagatgggtaagaaaggggatgctgaggggagagggggggccctcaaggagcatgtgcagagtcgatgcatatcacagcgcaggcggctcgacgtcctggtgagcgcagaacgtggtggatcccccccaaacttccatgtcctccgtcgccactgtcgtgcacgcgatccaccgagcgcacctggtaccactcccgcgtgacnnnnnnnnnngcaacgcaggcggctcgacgtcgtggtgagcgcagaacgcagtggatcccccccaaactcccatgtcctccatcgccactgtcgagcacgcgatccatcgagcgcacctggtaccactcccgcgtgacgccgccggcatccacgccctcctcgccctggaacagcaccgacagcttgtgcttcatctccgccggactgcgcatgcgcagctggtagaaggagtcctcgaacgcgtggccgcgccggatgtgcagcctgggcgaggcggggggggctcaatgggtattatggtgcaggtgcgcccatgatcgcaccccacctcaagttgatcaaatctgcacgcccatctcctcagacgcccgaccaaaaacatgtgtcaactacggagggctggcgcatgcgcgagttcggagcagacacccatcctgagaaagggcgtcctgcacccacggcaagggttcccggcaggcaccacgcacctcagcgtgccggtctggacgccggcctcgccagacttgaccttggtcnnnnnnnnnnccagcacgcaccttagtgtgccggtctgaacgccggcctcgccagacttgaccttggtcnnnnnnnnnncaccaccctcacatcccacaaaagcacacgacgccagcactcccgatcaccgacaccaccagccccctccgcgcacttgttgtcaaagtcgagnnnnnnnnnncggaagtaggcgcgtctgcatggtcataggtgggtggtttggctcacacatgctgctgtccctgggtgcatctgccccaaccaaccctcgaaagcttaggcccccaggaccaccctcacatcccacaaaagcacacagcgccagcattcccgaccaccgacaccaccaggcccctccgcgcacttgttgtcaaagtcgagcaggcgatgtgccttgagcaggaacctgaaggagttgaggagcagcttgggctcgttcctgaccagggcattgaccaggcgccggtgccgctcagcaaacttgaggaacggaccctgcagggttggggggaggggggtgcgaggggtgtgtgacttggataccgtgggtccaacaaaggatctgaggccggggaatataacaggcgcaagaaattggggatgcctcctnnnnnnnnnntgtgtgtgacttggataccgtgggttcgacaaaggatctgaggctggagaatacaacaggcgcaagaaattggggatgcctcctgccctttgcaatgaggcgcaggtgcgctggactgggcttcccgacacccgagtctggggtgtgcctacccgaaagtgcaaaagcaccgagccatggcaagtaaatcccatccgatccagctgtcgtgctcaccgaatgcaagaggaacctgctggtccccgcagcctccagctggctggtgccnnnnnnnnnnggtaaatcccacccgatccagctgtccggctcaccgaatgcaagaggaacctgccggtccccgcagcctccagctggctggtgccgctggaggccctggccggggacgcggaggggctgggccccgcgggagcggttggcccgtccagcggcagccccaggctgcccgcccgactcgccgacgccgacctggttgatgggcgggcggggaaagagagatgtgtgagtggacaggtagcggagtgaaagggttccaagggaggctgccgtgccgccaggctgcacgctgtcaggaggactcccactgccggcaccactcattttgcgtcctggttaaagtacccccacccccacccacccacgcccnnnnnnnnnnaaggactcccactgccggcaccactcatttcacgtcctggttgaagtacccccacccccacccacccacgccctcacccctcgtccccgggctggcgccgcagcatgcccagcgcgtcggcgagcacgaagaagctctccagcaggggccgcagggccaccgcgccggcaggcagcaccttgccggcctcgtgccgggtggcgccggccgcctccaggcgcagctcctcctccacgtcggccgccgcggccgacagcgcggaccacagcgggcccagcgcggcctgcgtggcctccacggccgcgccggcgccggcgcggcaggcggtg

SEQ ID NO: 43584 - DNA, 71 bp, Chlorella protothecoides
ctgggcggcggcggcggcggcggcggggctactgctgccggagggtcaactgccggtgcaggcggggcagg

SEQ ID NO: 43585 - DNA, 116 bp, Chlorella protothecoides
caggccgaagatcatgtgctcatacacgcgtttcacccggctgtgatggtggttgtgcgaggggtttggtcggggagacgctgctgccacaagcagggctgcctcgctgtgcgact

SEQ ID NO: 43586 - DNA, 63 bp, Chlorella protothecoides
ccaccatttttcccctttctccccccccccaaaaatcacctggacaggatggggtcggtgagc

SEQ ID NO: 43587 - DNA, 424 bp, Chlorella protothecoides
  modified_base (143)..(292): a, c, t, g, unknown or other
gcggccgccacgctggcggcgcgcatcgagggcgatgcggcacggaccgcggtggtgctcgccggcgtccaagaaagcgccaccgatgccggcgcgaggctggacgcggccgcagaaggcgcgcgggaggccgccgacgcggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngccaggcagcggaccaggctatccagctcttcggcgacaacaccgcggccgaggacaaggccggcagcgcggcgcgcgaggctgtggaccgtgcggcgtgcgacgcgagcgagcagctggccgctgcggccg

SEQ ID NO: 43588 - DNA, 70 bp, Chlorella protothecoides
agcacccgagacctgcacccactacccccctgcacccaggccccccccccagcacccaggcctggacgcc

SEQ ID NO: 43589 - DNA, 91 bp, Chlorella protothecoides
tccctccagccactgtgctcttccccgggcaccaccgcaaccctcagcactcacccgcagaacgtgggtggtctcgtcgtagtccttggcg

SEQ ID NO: 43590 - DNA, 61 bp, Chlorella protothecoides
ggggggggggggggggggggggggggtgttcggtcggcgatctgtcgtcgggatttgacta

SEQ ID NO: 43591 - DNA, 73 bp, Chlorella protothecoides
ccgcagggaatctgcgctgggcaagggggggtggagagggggttggaggatggctgagcgaaggacgctgaaa

SEQ ID NO: 43592 - DNA, 61 bp, Chlorella protothecoides
caggggcgcagcggcgggccaagcggggggggaaacgctgcactggctccaagatggtgca

SEQ ID NO: 43593 - DNA, 15970 bp, Chlorella protothecoides
  modified_base (513)..(522): a, c, t, g, unknown or other
  modified_base (1517)..(1526): a, c, t, g, unknown or other
  modified_base (2170)..(2179): a, c, t, g, unknown or other
  modified_base (2592)..(2601): a, c, t, g, unknown or other
  modified_base (3109)..(3118): a, c, t, g, unknown or other
  modified_base (3772)..(3781): a, c, t, g, unknown or other
  modified_base (4673)..(4682): a, c, t, g, unknown or other
  modified_base (4904)..(4913): a, c, t, g, unknown or other
  modified_base (4986)..(5139): a, c, t, g, unknown or other
  modified_base (5794)..(5803): a, c, t, g, unknown or other
  modified_base (6652)..(6661): a, c, t, g, unknown or other
  modified_base (6870)..(6879): a, c, t, g, unknown or other
  modified_base (8320)..(8329): a, c, t, g, unknown or other
  modified_base (8394)..(8609): a, c, t, g, unknown or other
  modified_base (9091)..(9100): a, c, t, g, unknown or other
  modified_base (10398)..(10407): a, c, t, g, unknown or other
  modified_base (10970)..(10979): a, c, t, g, unknown or other
  modified_base (11517)..(11526): a, c, t, g, unknown or other
  modified_base (12169)..(12200): a, c, t, g, unknown or other
  modified_base (12439)..(12448): a, c, t, g, unknown or other
  modified_base (12978)..(12987): a, c, t, g, unknown or other
  modified_base (13807)..(13816): a, c, t, g, unknown or other
  modified_base (14875)..(14960): a, c, t, g, unknown or other
  modified_base (15141)..(15150): a, c, t, g, unknown or other
tcgtgctccgccccgcaggctgcgcgcgaacgggatgcgcacctggaggccgagcagagcaaggtcgtcaggctggaggtgaggcagggatttggggcagacgggcctgaagcgaagcaggcatcgccctcacggccgccacgggcggagtcatctcctccccatcgctgcaccggtctggccccgacatgcgccgagccagaccatccatgcatcgcaggtggaggtcgcggagctcagggcctccctgtcccgcatggccgagcttgagcgggagctggactcctacaggtacggttgggaggggtgtggagggaaggggagtacgtacccggcacggcctctgaagttttcgaggcagtgcgacgggaagtctgatggccgccagggcatggctgggccagggccgactgcctgaggcccccgtgcaatccctctctcccctcccgaaccgaccgtgcaggcagcaggcgacggctgtagagccgcgcaaggcctcagggctgtggggtnnnnnnnnnngggcccctgtgcaatccctctctcccctcccgaatcgaccgtgcaggctgcaggcgacggctgcggagccgcgcaaggcctcagggctgtggggtttcatcagcggggcggacgccaacgcctcgcccccacgagactgagctggcgcggtctgacacgtggcccacgcccaaaccctccccaggatgcctccttttacagacccgcacgcacgtcgtgctttgcccttttgtgaccagcagaacctcaagactcggtgggagtttcatagagagaggggggaagggtaggaaggagcagggtcgtcaaggccagagcaaggggcggagggggcacagtgttaccaacatcgggcaagggttattgcatagagtgggcaacgagactggtggaacagacaggggcttggggcacccgcattctgtcaaaaccacgacgcccagaaccgttctgccacgactcccttgcccagaacccttctgccacgactccctagccctggcacaacgatagatgtcgtcagttacagacagggggaaacgctcgtgccaaaatggggcggggcgggggtggtcaagaattgcagggctgccgtgcagggccagcactttatcagcattgcgggagtgcagcatcactgctgagtggaggggttctccagctgccagacctgcgaggtagtgccggaccggtgctccgagatggcctggttggacagcgcatccgccaccgcattcatgctcctgcgggggggggatgaagggagaggggtaggtagttgccaagaggggcgctcaggggaggacagcgtgtcattcaatcaatatccactgccgggcttggacaagggcatgggaagataccatctcgtgcaatttgcgccacgtcgtccctgacattccaacaagcaatgccacaacccccccacctttaccagatcctgttgctcagccccagcccgcggtcacgcacctaggcacctggcgcgcctccannnnnnnnnnggcgccacgtcgtccctgacattccatcaagcaatgccgcaacccccccaccttcaccagatcccgttgctcagccgcagcccacgatcacgcacctaggcacctggcgcgcctccaccttgtcaaaggagcccagcagcgaggtggcgacggcgtggtagggcttcagaccctcgtgctgcacgcgccagtcccccttcagctggttgatgaccagaagggagtcgccggagatgtggatgtcgcggcagcccagttcctttgccgcctgcagcccagcgatcaggcccccatactccgcctggttattggtgcggtggcccatgtagtggcacacgcgcttcacctcacgcccgctgtcggcgtcgtacagcacggcgcccagacccgccgggcccgggttgttcttggacgcgccgtcaaactcctagcagttgaggggggcaggggccgaggggggagacatggaaggggggtggtctatcgtggacattttccgggtcaatcccagtccatggggggtgcacagcacattccaaagaaaccaacgcaccatccaatggcaaatatcgccatattctgggattatgaagtgggcctgatatacaccccagtctcaccaggcgtatggactttggaggagnnnnnnnnnntgggggtgcacagcacattccaaagagaccgacgcgccatccaatggcaaatatccccataatctgggatcatgaagtgggcctgatatacgccccggtctcaccaggcgtatggactttggaggagggggctgtggctgggcccgagcgacgggcgcagccgagtagctggagtgcggcggttggtaggagtcgtcgtcgtcctcttccgtccaggagtgggagagggtggccccggcttggtggtcatacgcgggcgccgagctgaaggagcgccccggctggtagctgtcatgcccatatgagggctcatgggacgacctcgcctgggaagagctggaggaccggctcccgctcctggcatacgagcttgagcccccaagactgtagctggccccgtatccactgctgcnnnnnnnnnncgcccatatgagggctcataggacgacctcgcctgggaagagctggaggagcggctccccctcctggcatacgagcccgagcccccacgactgtagctggccccgtatccactgctgctggcaggctctggtgcagagggcgcggcgccacgagactccatgtacgcctgcgcagcttccacggagtggaagcccttgtactggctcccggaatactggcggacctggctctccgtctcgccccaggagctgtacaggccgagattccggcccgaggccacggcgtacaccgagtactttcccatgtggcgtagagacaggggtggccggggggcagtgagtgctcgcagcacggggcgacaggcctgcagcatgcaggggtaggtgcccgcctccaggccgatgctcacgacagcctcctgtcgattccaaaggtatatttggtggtgtgcgcaacacgatcggtgcttacaacggagcttgtctggtgcgacgggacccttggagnnnnnnnnnngtttggcggtgtacgcaacacgatcggtgcttacaacgcagcttgtctggtgcgacgggacccttggagtggatcagtcccatcattttccgacaggtcagacaggacccccacgtggttgtatatctgaacaggagggggtgccttctcacaccaggctcgcgatcgtcaggggctggcaagtatgtatacacccctcagcaggtctgcaggaggtgcaggatctcggagccgggcaggaggagctgctgcaggcgcaactgaaaggcgggcacgccggtgctggctgacagcagctccgggaccagcgtgaagaaggcgtgaaactcctcgccatgctggaccagggcggggcacccccgcagctgctccagcacgtccagctcccccctggcctccagcacggtgtctagctcgcggagaaggtgctcgtcccacctccagctccccatgctgatgcttcgcgcatgggagtgctgggcctgccccagcggcgtagccgggctcatgtctgcaggtaaatgaggggaaggggttggggggtgaagggcgggagctccttgcacacgggtgcggagcctcttgagatgggaagggcacgacgtcccacatgcagttccattgggtggcatggggtcctgaagtacagcccannnnnnnnnnggccctttgagatgggaagggcacgccgtcccaattgcagttccatcgggtggcatggggtcctgaagtacagcccacacccgtcacctgcgggcccgactcgcgggggggtgaccagggacgggcacagcacgctgcgaacgtaggccgcgatcgcaaaggccgcgaggcccagccggacccagtcgccctgctcgagggcgctgtcgctccgtggatggcccgacaacgcgttgtgaggaccctgatcgacactcggtcctctcccccggcccggcggctggcccttggccggggaggcccccctggaggagggcaggatcttgctgcgcaccgccgagaggcccttggcccagaccttgggcaacttgtttggcgccgcgggggcaggacccggctcgggagagggcggggcggggtcatcggggtctgccatgggcaggtatgtctgcggcaagcgcgtccccatgcccttgtggtctggagagtgtggggcgagggtgccacgggatgaaggaaagcaggggagggcagcggctgagctgaggactgggatcttggatctgctggccgggcaggcaccaactcgcacagcgtcacccgcacaatcacactcaccctcgtcccgcccctcgctggggcgcaggatgtccttgacgcggtccagcaggcccccaccctccttcctcgtcgcggccccggcatccctcctgcccaggccctgcagttggatctgcgtctggaagcccttcaatcgccgcagcgcgacgtcgagcatcgagggcgaggctgtgacacgtgggtgagggatcgggaggggttggttcgcggatgggagggaccagcaggcagcaagctggagtggggccaagtgcatcctgctgacagcaannnnnnnnnntcaccatccccctccccacctggtcgctgcaaggagccggccgcgccaggctccagatccgatatctgcagcgccaggaccctcagactcagcgcctctgtccactcctggaccgcagctgtgtgaggccctgcaggtgtggatggcggcgggacgggaggttcagctggtggatgcgatgcgtctcggcgcatggactggggtctcgaccccagcgccggnnnnnnnnnntgctggaccccaccctcgccacagccgctgctctgcgcctgcctctccagcactcacgaaagcggttggtcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgacaggaggttcagctggtggatgtgatgcgtctcggctcatggactggggtctcgaccccagcgccggtgcaaagtgcgcgagggacacctcgagcgtcggctgcatgcggtgcccagtcactcaaggctgtctcatcgcagccgctcggacgtctggccagtagcaagtctgattgaaccatccaaagtgcagtttcgcaggcgtgaagccctgggttccacaccgatgacacaccggcggggaggcggcgccagcgggagtccccgacccaggacaggagggccagccatgcaggcacgacgtgaaggggaccgcgggggcttgaccccggatccagctgcacgacggcacgggtcacctgcatgcagtgggccgggagagggcttgggagccggaggcggaaaaccccatgtcgttgtgcgtccatgatttcctcctccgtaagtacacttgcgaccgcacctcggccacgagttcctgccagggccacttatcgacggccagggtggctcgccgcagctgctccaccaggaacgccacggccagggggcggcccgcctccgcgcacgcctgtgagaggaggagctgatcatgtcaagtggagcatggatcaagcaccttgccattctcatcacaaaaggtactcatgcnnnnnnnnnnttgtcaagtagagcgtggatcaagcaccatgccattctcatcacaaaaggtactcatgccatggcatgcccctgcatcctcgatttgaatgcaaatgatctgttcaacacacccacacacaggctcctctcagccaacaattgccagcccttacgtgcaagaggctgaggacgaggtgatgggtggtgtcctggagagcatccacagcagggtcgaggcgtcccggcgcagcaggcgcgccggcgacggatgcctcctgctgttgcactggcatcgacgcggagctcacctcgccagccaccatgagctccagcaaagcttcccacagccggggcacggccgcggtgcggtgcaggtggctggcgagcagggatccccgcaggagcactcttgccagctccggggctcgtggcacggcatatgcctgggtgtgtgtgggaagaaagcgtgaatgctttcagtgctgcccccctgacatgccgttaagcatgaagtggccggggtcacaccagggcccagtcgatacacgcgagccccttctgataggagcatcctccggggcgggcccccatcctgagagtggaaactcccgcgctcaccgctgtcgcagcgcagagcgcgtctgtgagcgcacacgccgtctcgttgtcagcctcgacgttcacatcgttcgcagcgatgaagagcgcagatgcctcgtcccagggcagcatgccccgggtgccgcatgccagcgcctcctgcgtcagcaccgtggccggcgacccggccagggcagagagcaggtcggagaccaagttggccccgggcttggcattgtcttccagtgatctccccagctccgcctcnnnnnnnnnntgcagagagcaggtcggagaccaggttggccccgggctcggcatggtcttccagtgatctccccagctccgcctccgcctgctgactccaggaggggggacctggcggtccaggaccccggccagagcgggcctcgtgagcaggagtctcgcctactgtggaatgccgcgcggagccggagcggggcagcggagcagtattcatcacgnnnnnnnnnnccctggcggtccaggaccccggccagggcgggcctcgtgagcaggagactcgcccactgtggtgtgccgcacggagccagagcggggcagcggagcagtattcatcacggggcttgcggcgtggagcagggcttggaggattgggccggccaggctggcgcagtccaggcgccaggtggccgtcacctcgaccacgatgccctcgcctgggccgtcgtgaggcaccaaggcggggtttgcagaattgtgagctgggcttgtgccaccagccaaaccccccgcttccctcccttgctgctccgccagggccctgccctcctccgtgccttccagcagctccagtgggatgtcgggcggcaggtccacccgcggcgaggcgcccctgctggcctgcgccgcagggccgtctgcgctcgccgcccagagtcgcccctgtgcgagggagaacccaaacagcggcgccagcatggccgctgccgcgccggcggctgctaggtgcccggccgcggccgcggccgcgcccaacacgccggccgcgcggacgacccgggaggccaccgccgccgcatccccgcgcacgcccgagggcgccagggccatgggcagggccagccagggcacggcggaggaggctcgtgccgcagcagataccaatccccagtccgcgcgctggagcaggcgctgcagcgcacacgacggtgaagatgctgcacgccctggcacaacattttcgtcaccgggcccctcctccggcatcagcagctccacgacccaaacgggcaggtcgccgtccggcagcaggaggctggtgcgcagcgccagcagcgccagctcggccgcctggccggggcaggtgcccgcgcgttcctgcagtggctggaagtcgagccccgcgaccagggcctccgccgcgccgccgtctggcgacagcaggtgcgcgcccagcgcgcgcagaaaagtctcggcgcagtccgaccccggtcgcagttggaagtcggcggcgtgccagggcagggcccgccagcgcgcgagcagcgtatatgccgcgccagggtctatcgcgcggcacgcctccagcgcggcgcgcaggtcggagcggtacaagccccaggcccactccagggcgcggggcggggctgggctggcggcgatcggatctaggagcagggccgccagggcctccagctcggccgcgggaccggcgacgccggtgactgacgcagcgatgagcccggaaacggcagccgcatgcgcccgcgccagctggccgacggtgcagggctccacaggcatcaacaggaggagggctgcttgcggggccggggccgcgcggtcgccgcccgcgccactgccgcctgccgcccgtggcgtgcccgcgtccgcggatccctcctccgcgcgggcccagcacgcggcgtcgccggcgcccagccgggcggtnnnnnnnnnncgtccgcggatccctcctccgcgcgggtccagcccgcggcgtcgccggcgcccagccgggcggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaggccctcctcgcgcgctgcctcgcccagcaggcgcagcccctcccccagcacgcgcctcgtcagcaggccctccggcagcgcggccagcaagcccagcgcgcgcgcgcgcgcggcgccccggcagccgcgcagggccagggccagcgccgcggcgaaggcggcgccggggcgcatggacagcacggcctccagcaccgcgcagccggcgtcgacgctggcggcggcaccgtcgcgcagcaggcgcagcgccagggaaagcagggccgtcaggtctggaccagcctgggtataccaggggggtggggagttggtgttcatggggccatgcacagagcacatcggtggccgagggaagctgcgatgtgcccttgttttgggttttagtcggccgtggcgtgcaggggggtcccctgcagatcccgggcacgagggttttgccggcggcccctgcaacactgtcaggggccatggcacacttnnnnnnnnnntcccctgcagatcccaggcacgaggggtttgccggcggcccatgcaacactgtcaggggccatggcacactttcctcctcccagcaactcctctccggccacccagccgcagcccctttgccgcacctgggacgcgtgcccgccgccctccccagcctgcaggcaggccagggcatactgacccaggtcgaactcgcggaggagggcggcgcgctccggggcggaggccggcagggacagcacggcgtccagcatgacgccaaagtcgcgcagcctgcccgccgccagcgagggccccgggtccagcagcgcccgcagcagcgcgtcggggggggtcccgggggaccccgccccgccggggtctcgggtccgcaccgcgacgcgtgcgacgagcgccgccttctggtccagggagaagtaggcgcggccgtcggccagcgcgcggtccagtaggcgggcgaagagcggcgcggcgggcgggggggtggacccgtccagcgctgccgtcgccagcacagccgcaagctgggaggacagcgaagagccggcggcctccggctggcgcggcgcggcgccgtgcagcagcgcgcgctccagcaggaagatgccctgcgccgcctccaccatcgacttgtctatgtaatgtggggggagggggtaaggggtggttgagagggaagggcgtgagaggttggagcttgcttagcagcacggagcctgctcgcatcggggcacaccaatggcactctggagcatgacacgaggtgcaaggttcccgtccccgaatctgcacgagtgctgctgcccagggtctgcacctccccatcttcatgggatgctcgcccgcacacccaccccggagcacgtgcaacaacgtctgcagggcgctgcgccgcagcccgtcgtagtgctcctggaatcgcttggactcctcgaacgccggcggcggctgggagggggcggggcgtggcgcgtggtcgccgccggcccccgccaccctgtccagggggagggggcggtagcgggaggccactgccgtgcgaagctgggttgccagcgagttcagctcgtcctctgtgcgctgggtgacctcccacagcagggcctgggcctgggcaggggaagtgacgtgtgggtggggacatggacatgccgatcgcagagatgggatctgaagcctttgtcgggagacaggggtgctggcatggtcgtatcaggcgggggcggcgggtaaatcctgctgccagcaatgtggtaacgcatctacgctgataccccgccgccttcaccggcctctnnnnnnnnnnacaggggaagtgacgtgtgggtgaggacatggacgtgccgatcgcagagatgagacttaaagcctttgtcgggggactggggtgctggcatggtcgtatcaggcggtggtggcgggtaattcctgctgccagcaatgtgttaacgcatccatgctgataccccgccgccttcaccggcctctgctcaagcatgcagatgacacccctcatccagtcacacgagccctcaggcccctccttcggctgcatcccacgtggactcctacctgcgacacgacctccggcacatcgccctcccgcgaagaggcatcagcaggggcgtgcatgctgcgcttcccgccgcgccgcgcccagtactccagcagctccccgccctcctccaggcgcgctgcctggcccgccatggccgcatccaggtcccgcagggcccctgcgccgggcgcccaggctgtcgtcgggagagcgacgacgtcattctcgtcgtctccattggtggaagtcgcgacgccgggtccggggtttggctcatcgtagggccgacgggcaagcgccagcgcctgctnnnnnnnnnnggcgacgacgtcattctcgtcgtctccgtcggtggaagtcgcggcgccgggcccggggtttggctcatcgcagggccgacgggcaagcgccagcgcctgctgccagcccgcatccacctcggcgagctgggccagcagagctgcgtcgggagtgagctggctcatggcggcctggccgtcaggagcacgcggcgcttccctctgcccctcagcacccgcgccctccagcgcgcgcgccagccgcgacaggaagggcggcacggcggggcaggtctcgtggtactcctggctgagcagggccagctgcctgaggcactcctgtggggacgcctcgcccacatcgctgccctcggtcgccaggcgcaccgcgagctgcacccagagtgcaaggcccgccggacgaagcccggcgtccagcgccgcgcggcgcagcaaggagacgtggtcgatgttgagaggtgcgttggggccaaccgcatcagcgcctgggaagtcggcctccagcgccctgggctcgagcgcatcgccacccgccgcnnnnnnnnnntgccaagcgcatcagcgcctgggaaatcggcctccagcgtcctgggctcgagcgcatcgccacccgccgcatcagcacgcccgctttccacccaggcggccagcgtggcgggccagccgccggctcgcagcaggcgctccgccagcgcggctcggcgcgcggcgcccaggctttcaagatggccttttgccgggctgagcgcttcaccctggctctgagcagaccctcccgccgggtccagcagccctgcgtagaatgcggcctgtgccagcgtgcccagcgtgccgaccgcgccggggtccacagcgcggtgccctgcaccgtcggtcgccacccccgccagcagcgccgcgatgcagggcaggaggtccggcgagacttcttggccgctgccgcgggcggggagcagcggcagcgcggcgccgggcaggcgcgcggcctgcaaggccgcagggcccaggaggccaagcaggctcgcggtcggggccctccccgccagccgcgccagcagggccagcttgcccaaccccgtcgcgcgcgcggccagcgcggcggcggtttccattacatccattggttcctggggcacggggctggaccccgcggccaggagggccagctggacgtatgcccagccggcggnnnnnnnnnnnnnnnnnnnnnnnnnnnnnnnnggttccgagggagggcagataggaggagagtgcaaggtctagaattcgggagtgagggagctgggagggagggctgcaggtaccgaggcagggctgtggggcagataaggcacccgcgcgatagcgatgcatgtggagcccactccaagccatatggccggctggagtgccgtcctatcacctaagcactcacctcccacaaaggaactagccacaaacaaacatccgggaacaagcannnnnnnnnntgcgatagcgatgcatatggagcccactccaagacatacggctggctggagtgccctcctatcacccaagcactcacctcccacaaaggaagtagccacaaacaaacatccgggaacaagcaggcgcacctcgagactggccagcaggcccgcatcctcggcctcctccgccgaaaggtcggcggcgatccaggcgtcgccgaggacacccagcagcgtctcggcggcgtccgtcactgccgcgcccgacccgcccgcggcgactgccagcacgagcatcacgcggagcaggagcctgggcgccacgtcagcgaccgacagcgccaggccggacagtgcacgctgccagtggtcggggtcgcggcgtgccggggcgccgccgaacgcctcggccgccagcgccacgagctcggcgcccgcgacggggccctctggaggtctgtcctgagggggctcatcttcgtcgcccagcaggtcgatcagcggcgcatcctcgggcgccggggcccccagggaggcctggagtgacnnnnnnnnnncgggggagctcatcctcgtcgcccagcaggtcgatcagcggcgtctcctcgggtgccggggcccccagggaggcctggagtgactgcggcagggggcgacggtgtgcagggttggaagagtcgtcggactgagctgatggagtgagactcccgcacgctgctctcaatcaccaagtgcagatcaggatggccacacctccaatgcgccccctcccctttgaaagcacaccgtcgcgggtcggcctctcgcgtatgccaggatcacggtggccaccgccccccagaccgctccccgcgcggcctggctccgcgccacccgcccggcccggctcagcgcgcccagcacggccgcgatgcccgccgcctgggccgcgccttcatccccggcacagggggcccgctccgccagcaggccggcgaggcgggccagggtcgtgttgtccagcgcggcccagtccgtgccctgcaccacgctttccagcaggctcgccggcagggcgcaggcgtccggcagcgacctcagcacgctgagcaggggccctgaattgaccccggggccggcgccctcgcccgccgccagcgtcaggaggtgtgcggcccaggcatcgcatgctcctgggtgggagcccagcgtacgcagcagcgaggcctgtgggaggcgcggctcagcggcggccacgcgccaggcggcgtgctgcaggaagcgcagcgcgggcgggatgcgcgccgcggcggggtgggccgacagcagggcgcccagcgccgccagcctggcgtccagggacccgtcttctgcggcatccaggctcctgtattgagnnnnnnnnnntcagcgctgccagcctggcgtccggggacccgccttctgcggcatccaggctcctgtattgagggtgtgggaggtggctggggtgggcgcctcgatatgtggcatctggtccaccaagcattatctatgacacagaggggcgctggaggcctgaccccggtgctcctcatcggtcgccttctcctcctcctttacattgttaatcaacagcataccttgcgaccacgtgcagcaggcgctcctgggccacggcgaggtccagggcgccgcagaggccggggcccagcgcttcgcgctgccaggcggcgagcgcggcggccaggccctccctctccttctcttcctggaaatgggcctgctgcacctgcagagtcttggtcccgaacagcgagcccttgacctggcagaggcaggtcaagagaccggggatcgagatctgctagctgttttcgcagtgatggattaggcaagtccattccccccgccccccctttcccgaaagagttaacccacctggacagggacctctgccagctgccagcaggcactggaggcagatgtcacgctctgctccaggggcccaagtaaggcttcgactgcaggggcgaagtccagaatgggagggtcgagagaagggttacaatgggccttaacgtgagcatcccaccggcgcttccctcctctcacctgtagaccggaaagccgagcaagcctgggcgaaatccattggatcgagatgccactgaataacttcttcctgtttactctagcaatacattgtggaaggggcccttcccggaagcaaacacggcggaggggcgtggatcacttgctgtcttggccaggctgggatcccgacgccccacgtccatcttcacttcgtaatgtagcgatttaatcgacatgggtcgcctgagatggctccttgaaagcccagattccttcccattttgtgatccgctgcatctcgcgcaggcgcgtgatgaaatttcccttgcgagatcaccatcatcttgaggatgcaagtttctgatggtagaactacacagtggacggggnnnnnnnnnnnnnnnnnnnnnnnnnnnnnnnnnnnnnnnnnnnnnnnnnnnnnnnnnnnnnnnnnnnnnnnnnnnnnnnnnnnnnncaccggcacttcagccatgtcagctgacgttggatgcatccattgagacaaggtggtcttaggcttatgccatacagtggggacatggatatgtaggaagttctggtgcttgagtctgcaggcatgatggtgccggggtgatgctgcccccaaccaccatccttccatgctgctcccgccnnnnnnnnnntccatacagtgggggcatgaatatgtaggaagttctggtgcttgatcctgcagggaggatggtgccggggtgatggtgccctcaaccaccatccttccatgctgctcccgccatggggagtactcgacctcggaggccttgccgctgcgtgcacgcctcaaatgaacctgtcgacagttcggcctgcctcctaaataccttgcgggaaaggtatggtcgtgcccgcctcggcctgccaggagtatagaccccaagccgggtgatccccgcgtcacccgaactcgatgcagccttcctgggcacagggccagggttacccgggcagcaaccagccagcagcaggtatgagggaccgcaggttgtatccgtgcgcaggatcatgaggactgtccagctccaggctctcccacccccgcacatccccagggcccgggccatccaggcccgtgtatggccaagcccctggaggagggcagcagccaccgaatggtagggatggatcagttgagttggatcttgcatgctgctccagatgtgcgagctgcccaccgcagctcggaggtgctcaccagcagacacctcgccattccccccctggagcaggttacgggcagggtcccgcaggcggcccccctggtgccctccagggtcctcccggcgccagagcccccctggatcctgcctcgctgggattgaatcgcctgaacctgggcaacggtcctgccggacccgccccgtacccatcatctgttcagtacccgcccgcccagggcccgcccgcccgccccgctgcggcgccacagcgcacgccggggccccc

SEQ ID NO: 43594 - DNA, 553 bp, Chlorella protothecoides
  modified_base (112)..(335): a, c, t, g, unknown or other
attacctcccgctccgattcagtcggccatcgaatgatgcgggctgcagactccgccacacaccgattccctggccagggcccctggtcctggtgaccgatgagcgggtttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntccccccccagtgcaggcgtcccgcaccatggcctccgcgtcgcgggggtttgaagggcccaaggagcacaaatccctgcgggcaggggtgtgggtggggtgggtggtggtgcctgccacggatcggtgtcgcggcccctgctcgacgccaggcagtgggcttgaaaggggactgtgggtactgaaattcctgatgccagctgcggcagactgggccg

SEQ ID NO: 43595 - DNA, 61 bp, Chlorella protothecoides
ggatcgctggcctcgctgggcgagaccctgacctgcctggagatgctgctgggcagggtgg

SEQ ID NO: 43596 - DNA, 485 bp, Chlorella protothecoides
  modified_base (186)..(280): a, c, t, g, unknown or other
atccgtgcgcggcgccgtggcgtcgtcgaggccctggcccgcgccgagccggtgggcacgggcacgcgcccgctggccgcgctgtacctggcctcgcacgaggccgcgcgcgggctgcgcgaagccctgcgcgaggagcacatcctggtgctggacttcgagtccaccgtgttcaagcacgtgctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagtcgcgcagctcatgatccactccttcccctggaccccggactgcctcgcgctctgcacctgggtggcagccgaggcgggcgacgccgacgccctgggcgcgctggccgcagaggcgcagcgcaaggccgccgccgccgcgccgcacccggggggcggcgtcggccccgcggggcccttcgcctcgcccttcctggctgacag

SEQ ID NO: 43597 - DNA, 61 bp, Chlorella protothecoides
ctggtccttggccagcagccgcttctcgtattcggaggtcaggttgctgagcacgctctcc

SEQ ID NO: 43598 - DNA, 5413 bp, Chlorella protothecoides
  modified_base (479)..(488): a, c, t, g, unknown or other
  modified_base (731)..(740): a, c, t, g, unknown or other
  modified_base (821)..(830): a, c, t, g, unknown or other
  modified_base (1638)..(1647): a, c, t, g, unknown or other
  modified_base (2516)..(2525): a, c, t, g, unknown or other
  modified_base (2940)..(2949): a, c, t, g, unknown or other
  modified_base (3199)..(3208): a, c, t, g, unknown or other
  modified_base (3926)..(3935): a, c, t, g, unknown or other
  modified_base (4672)..(4681): a, c, t, g, unknown or other
  modified_base (5329)..(5338): a, c, t, g, unknown or other
cggcctggcggcgcgcgtcgccggtcgcctgtacgctgcgctgccggggtctgttcgggacgcgtggcggcgctgcttggagcaggccgcggccggcaagcgcgtgggcgtggaggaggcgctgggcgccgcggccgcgctggggctggtggccgcgcgaggcgtgctcaagggtgagcgcgcttggtgggggcagcgcggggggggccgtgcgcgccggggggttctcgctgggcgatgaagaggcggcaagggatcggggttttgccccgtgtccgctcgaggatgacacgccaccagagctaacaatcccgctcctaaacccctggccatctgtgcacaggacaagaaccacctccagaaggttgggtggccgccctcgcaagctgcgtgacgactggcgttgtggaccccgaggtccgcctgactgcggcgcagtccctggccgtcctggccgcggctgcgcgggaggccggggnnnnnnnnnnagaccccgaggtccgcctgaccgcggcgcagtccctggccttcctggccgcggctgcgcgggaggcctggggtggtgtggcgggcgaacaaacccccctcgccggcatcgactggagcgaggtcgtcgcagctatcgtgcccctgctggagcccagctgctcccaaattgcaagtggaggccctggaggttgcgtttgttgtcctcgggcgggaatgagggtggctgcaatgcatcaaagtcnnnnnnnnnngcgcgcttggcacgctggcctgggctgtgcccgaggccggcattctggaaagcgtggccgaggcgctgctcgggctgcatnnnnnnnnnncatcccattccacctctgtcaatcccagcatgctgaaggctccgagctgcccccgctttcctcccgcaggtgcagcagggtgccgtggccgcgcttggcacgctggcctgggccgtgcccgaggccggcatactggagagcgtggccgaggcgctgctcgggctgcatggccgccgcggcgaggcgctgctcttccccacgggggaggccctgtgcctcgtgtttggaggtgggccgggcgcagagcgcgtgcaaggctgggagagggggtctcagctggcttcaaatgagacggataccctaacatcgtggcatggcgacgtcctgagtcaaaggagcaggcatccgcgtccccgccgcgcatgctcccatctcctcactgtgatgattgcatcagcacacggtgcaaacttcaaccccccacaaccactaaactgcatcgcacccacaaaacacaggcacgcgtctccagctgcatcacctgctggacacagaatacctcggcctggcgagcctggatggccccaggggcagcacgcccggcggtgctgctccagtatcaaccgagcgccaggccgtgcaggccaagatcctggaggcggtggtcggccgcttcccggacagcgccaaggccgagcagcgcgccgcgggcgcggcctggctgaccgcgctgctgcagcacgtgggcccctcccctttgatcctggcgcgcctgtctgccattcaggaagccctcatcccggtgcatgttgggaagggggtgcaaggggaggggagcgggaagcctgagggcaggggaggggggacnnnnnnnnnnattgatcctggcgcgcctgtctgccatccaggaagccctcatcccggtgcgtgttgggaaggaggtgcaaggggaggggatcgggaagcctgagggcaggggaggggggaccttgtgtgtttgagtggggtgcgggggacgagattttctggcttgaacaggaggggcaggggcgcacatggggtctgggaagaccctgggggagggcgtgcactggacaaaggtcatgccgggtttgagggcaggacgcgcgtcctggccccctccaaaacctctcaaggacacccccctctgcgtgcagatgttgggggaggactcggagctcgtccaggagctggcgagccggggcctgatcgagacgcatggtctggccagcggggcgacgcgggaggagctggtcaagcgactcatcgtggcactgtcgggtgatcacttggggaggtgtccttggcacagcctcgttggctagctgacctaaatgtcttacagcagccgcggtcgcctgttctcctctgacccagcatcttcacccgtcgtacgacaggcaacacgcacaagcgccccgcggccagcctgtctggcgcgacggacgccgccaacggcacggggacggctgtggcggggggtgccggcggggcgggcacgaagtcaggggccttgctggtttaccgcgagctggccagcatggcggccgccctgtccgagccggagcttctggtgtgtgcccctgaattatatgtttttttggggggggggtatggaaagggagggagcgatgtggcagggcccagggcgccggcgaggtcggcggtgggattgcctgaagggtgtggggccaaaggcgttcaggacagcagaatcgcagggcnnnnnnnnnncatatggtttttggggggggatatggaaagggaggaagcgatgtggcagggcccagggcgctggcgaggtcggcggtgggattgcctgcagggtgtgaggccaaggcgttcaggacagcagaatcgcagggctgcatgccccgccgctctcactcgacggggcacgcccacggctgtttcccacctctcaccccccgccgcagtaccacttcatggagctggccctgcagaccagtgccacgacgagcggccccggcaggtgcggcggcttccacgcttgggtgcatgcctcacgggcggcttgcgcgccgctgatcccactcttcacagaccactggacacgcacggcgggcccggcccagtccgcagccgccccacgtggtgcccaccagcacaccggagcatgcacacgcannnnnnnnnnatccacgctgcgggtgcatgcctcacgggcggcttgcacgccgctgatcccactcctcacagaccactggacacgcgcggcgagcctggcccagtccgcagccgccccacgtggtacccaccagcacaccggagcatgcacacgcatacgcgcccatctccccgcccctcaccccgcctcgctccgtccaggacgccccatgctcacccccctgcaggcccacgccgacggtgacccaggcgtctttgannnnnnnnnntgcccctcatcccgcctctctccgtccaggacgccccatgctcaaccccctgcaggtccacgccgacggtgacccaggcgtctttgaacgccagcctgcctcgcatcctgccccgcctgttccgccaccgcttcgaccccaaccccaaagtccaggccgccatgtcccgcgtctggctcctgctggtggatgacggggcggcgcttctggacgcgcagctgggccccctgctggacgccctgctggcggacatggggcagccggcctggcgcgtacgcgagtcggccgccctggccgccgccgagctggcgcgcggcaggggctggggggacctggcgccgcgctaccagccgctctggaacatgggcttgaggtaggcggggccgtgggggcacgctcgcgtgggaggaggccaggatcccgcatgcccaggctgcgcaggcagaggggggtccgagggcgcctgtgacgacagcaagccggcgggcgtgaggcacttggcatctgcacagcgtccctgcggcacatggggggaacaaggccgcgcgagctggcagtggtgccgtctcgtgcgcccaaggtctaacatccccactgggtgttgagcgctgcgccgcactgcgtcgtcctcacgggcgcccccccccccaccttgcctgcaaccaccagctcccccttccctctgaccagggtgctggatgacgtgaaggaaagcgtnnnnnnnnnncccgcaaccaccagctccctcttccctctgatcagggtgctggatgacgtgaaggaaagcgtgagggccgctgggttggccctggtgaggacactgcgcggcttcgcgctgcgcgctacgggcacggagggcggcgcggatttgacccagggcgccgctgtcgccgccgtcctgctccccatcctcctgcaaggtggtgggggttgaggagccagggctcgtgctgtttgaggggggggagcacggttgcgtggcagctgggccaagcctgtgctcgcctcccccctcctctgcacttgacaatccccccacccacgaggcaaggccgaggcagccccggagcagagctcacccccttgcaccaaaacccctcctgccacccgtgcccacccaagaatacacacccacaggtctggcgtcctctgccgccgaggtgcgggcggtgtgcctggagtgcctgaccaccgtctgccgccaggcgcccccggccctgctgcggcagcacgtcgccaccttggtgcctcccctgctggaggccctcaggtgcgcaaggtcggcgggaaagggctgtgggcctgcgaggcggcgtgcggcggacgcatgcctgccaggccgcgtgccgccgctgtcggtgcatgttccgactggagcgcccctcgcgcccagcgccggggccgggggggggctggcggcggggaactcgcgcgatgggtgcgcacccaggccgaggttcagannnnnnnnnncgttccgactggagcgccccccgagcccagcgccggggcgggggggggggctggcggcggggaactcgcgtgatgggtgcgcacccaggccgaggttcagacaccctcccagcacccccacttcgaccctcactccgcccctgccagtgggctggaggactcgcggctcaactttgtggagcagcacgccgccggcctgggcctggacacagaccggctggacggcgcgcgggcctcggccgcccagtccgggcccgtcggagacacgctcgacgcgtgctccaggcgagtgggccagggtgtgtgggagggggtgggcgggaacccatcattcgagctggatgaggggccctgggcgggggcgggggcaccgtgctgctgggtggcccagctgggaaggaatccggggggaccggctcgcctacctgcaggctcagcccccaaacatctgctggcccctcctcggtccgagcacgcgcatctcaaaccaccccgtcgccctcaaaaccactcacgcacagggtgctggacgaggcctcgctggccgcgctggcgccgggcctggcgtcggtggtgaggcggggggtgggcgtggcgacgcgcgcgggcgccggcgccttcatcgcgcggaccgcgcgccgcctgggnnnnnnnnnncgctgctgggtggcccagctgggaagggatctggggggaccgacacgcctacctgcaggctcagcccccaaacat

SEQ ID NO: 43599 - DNA, 96 bp, Chlorella protothecoides
ccacgccccccaacccccccaaccagaccccatccccaacccccgaaacacacacacacgccaggcacggcgctgcaccacgcggcgatggcgggg

SEQ ID NO: 43600 - DNA, 61 bp, Chlorella protothecoides
gtctccctctccgagccctgaggagtcgccatctcccagccccgaggagtcaccctctcca

SEQ ID NO: 43601 - DNA, 11293 bp, Chlorella protothecoides
  modified_base (121)..(166): a, c, t, g, unknown or other
  modified_base (292)..(301): a, c, t, g, unknown or other
  modified_base (395)..(404): a, c, t, g, unknown or other
  modified_base (708)..(717): a, c, t, g, unknown or other
  modified_base (1080)..(1089): a, c, t, g, unknown or other
  modified_base (1301)..(1310): a, c, t, g, unknown or other
  modified_base (2468)..(2477): a, c, t, g, unknown or other
  modified_base (3170)..(3179): a, c, t, g, unknown or other
  modified_base (3696)..(3705): a, c, t, g, unknown or other
  modified_base (4718)..(4727): a, c, t, g, unknown or other
  modified_base (7770)..(7779): a, c, t, g, unknown or other
  modified_base (8451)..(8460): a, c, t, g, unknown or other
  modified_base (9407)..(9416): a, c, t, g, unknown or other
  modified_base (9734)..(9743): a, c, t, g, unknown or other
  modified_base (9953)..(9962): a, c, t, g, unknown or other
gggccgctgcgctcccaccgcggctcggtgtcggcgcgggatgggccgcgcacctcctcatactcccgccgctcgccgaagcggtcgccagagcccgaccccgggcgcccgccgccggagnnnnnnnnnnnnnnnnnnnnnnnnnnnnnnnnnnnnnnnnnnnnnntgtcggcgcgggaggggcccgactcgtcgcgttcgctgcgaggggagcggtcccgccggtcgccaaagccgccgccggagccgctgccaaagcctggacggggggggggggggggggggggggggnnnnnnnnnnaaacatcccttctacactcaacatggccacgccgggtcatgtgagaatgcatgccccgcagcctcttgctgagcggcgtacccatcccaaggcnnnnnnnnnngggagagaagggtttccacgggtaggcaagaatcctaaaaggcaagagcagccacgtgagcagtgagaccgcagactgtcagggggctgctgtgcactgctcatgaacatccctgctaccctcaacatggccacaccgggtcatgtgagaatgaatgccacgcagcgtcttgctgagcggcgtacccatcccaaggcacagcatggcagcctaggttctgacgaaacaggtcgaacgagtggcccctccacccctcaagtccgtccgtggcgccctctcacctcggccgcgatcgctggaggcnnnnnnnnnntttctaacgaaacaggtcgaacgagtgccccctccacccctgaagtccgtccgtggcggcctctcacctcggccgcgatcgctggaggccccaccggggacaaacttgcgctccatgccccagctatctgcggcgtccgcccgggacccgcccatgtcatcgccgtccccccgacggcggtcgtcgtcgccgtaccgacctgcacatgtgtgagttgggttcgcagttgggctaggaggcaggagatggcctggcagtacagacatagacgaatgctcccggtctgagaggcggctgtggcagcatgccattgcaccccagtcaacagtcacggtttcaatgggcacagaccccacactcagnnnnnnnnnnctgcacccgagtcaacagtcttggtttcaatgggcacagaccccacactcaggcccagctccaagcacacagcgccggcctctccagctacaacctgtacaccatgagcctgcccctccctccccggatcgacgccatacctccggcccgatcgccgccgtagtcccggaaggatccccccagcctgtcgcctggcttctcgtcgccctccnnnnnnnnnnaacgccttacctcctgcccggtcgccgccgtagtcccggaaggatcccccgagcctgtcgcctggcttctcgtcgccctccaccttcccccgggaggtggtaggcaggttgcgcaggatgtcatcgtcattcagtggccgacgcagagcggagccacccacccgggcactcggaacgaaggtgcccggcttgggggcatccactgtgctgacaaagtcggccagggacatggtctgctttttgcgccgctccttcttggaatccttgacggccgctgcagctcccagggaagggaagccggcgcggtcgggggcatccccgagcgaggggaactccttctccttcgccaccacgggcacgaggatgggtcctgtgacggagtggaggacggcatctctggctggcgctccaatacccaatctgggaaatgcaatcgtgggagaggtttgattgtttcaatgcagcgatacgcacgccaccgacgctcaccctgctctgcctcctcctcctccacggcctgggcccaggcgccagcgggtttggcccacgccatgatggctgtgtggggcggggtgacgtctgagttcctgtcaggatcggaagatacgggacctggactgctcgcttggcaccggaccatggagcggctgatttgaaggtcctgccaatcaagacccgagccgcccccgactcgcgtccgcattctggaaatcttgaataaatgtcatggaagaggatcctgtcacgaagttggaatttgctcacccagccccgcaggataacgtccggagctttttacagttgattttgtttcaataaggtgctctgatccgcacacggaccactgttgacgtgcaaccaaggctatctcacatactgcctgggaagtgtgcgccgagtgctcaacgtcacgccctttcagagcaccatgcctcgccggcaatttctagtaatgggcgttcggtacgccccagcggcaataaagaagttctttgtgcagcagaaggttctgacatcgggtgttcgagaactccgaaacggtgagaatgcaaacgcggacggggatcttcgattttgggctgagaatggtccacccctcttcagtatctcgagtgacaattcctctcttgcatctgagtatacatatcctggcactcnnnnnnnnnntcggacggggttcttcgattctgggctgagaatggtccacccctcttgagtatctcgagtgacaattcctcttttgcatctgagtatacatatcctggcactccatcgagttcgcatgttgccactctgaccctccttccacaggcgtacactgcgggaaggcgcaccccatctcggctgcccatcccagcaaagctttgcggagtatcgcagagcgacccgctgcgtctgtgtggaatagtgccggagtcccccgggctacatggtgtggcgcccggagccgtgcaggtgccagggatgccccctcctttgcctccacccctgtgtttctgagcagtggcaaccccggccgagcaggagcactggaaggaagctatggacggatatcaggaagcgatacaactgctactgcgcctcagcatatgcgcaatgctgcagcatcgcctgaagtccaggcacctgaagctggagtctccactaaggctgagagccccctcatgcgctgggccacgctgggtctgcaggactcgggccgaccttccactccgccgcagagcgccgagccggcccccaaattcagggcatcgctgcgcaagcttgcgtctgtgggaccccaagcgcccgctcccgaagcagccccatccaagcagcagctgaggaatgcgctgctggcatacgctgccatgtagattnnnnnnnnnnagtgggaccccaagcgcccgctcccgaagtagccccatccaagcagcagctgaggaacgcgctgctggcatacgctgccatgtagaatgtgaatgctagatgtgtactgggtggcaggcgagggtcaattaccagtacatgcctttggggttacatcacccctcatttgcgctccccgcgtgtactctgaaacaagctcctcttcttttgtatggaaagctgctgctgttgtcagtgaatgcctcccaaacctgtccagtgcccctcgttcccacgtgtgctaatctgtaacatagagcgctaccagggcatctggtgaatgtcgcctggcagagtgcagcagctgggcgggacttggaatgcgagcctgagcaggcttggcgaggaaggatttggttcactaggtatccatttcctcaggagttgggaagcggtcaattgaccattggttgtagggaggatgaatgtgcctatccagccgtaaatcttgcttgggtgcgctgaggctgggaggtgnnnnnnnnnnagagcaggcttggcgaggaagatttgggttcactaggtatccatttccttaggagttgggaagcggtcaattggccattggttgtagggagggtgaatgtgcctatccagccgtaaaccttgcttgggtgcgctgaggctgggaggtgaggcacaactacgcattgccatggcacacaattatcgacaccccctctgcccagccccagttcacgacaggactgccgtccttgcagccctgttcagctcgttgcgcggacgggccgggcaaggaggaggcggcgggtggccgccgtgatctcctccttggccatgaagagcagcgccgcggccagcacgctctgcactagcttggggcgcaggccctggtagtaccccggcacgccctccgttcgccagatcttggccaccgcgtcgcccacggaggagtactgcatgtctgcgtcccctcgccgcgccgtcatcatccgcgtcttcaccgtcagcatggggtaggtgaccaccgtggccccggccttggccagagcggaaagtatgaatacctccagggcgctggcgcgggtcaccttgcctgagttggtgggggtggggggtgggggatgggatggggtgacaagcgcgctcctgcaattgcaggatttctgcctacgacccacagcgtcctcggccatgggcaggagagctcagaatggggtccctacctcagcaacccccatgtgcaacacccctgtcaaactctcaggcgtgccccaccccagctcccgcacctgtctgctgggctctcaacttggcccgcactcctgccagccactcgtacagggtgtactgcagcgtggggttgatgaccatgaccagagaggcctggcagccattccagaagccagggacaccatactcgtggaagacctcgcggatgactgcgggggtgaatggtggcaggcgagtgtgggatcgatcgggtggaggagtcggacgggcgctaaaggggtgaaaattccacaccatcctagtgcnnnnnnnnnntgggtgaatggtggcaggcgagtgtgggattgatcgggtggaggagttggacgggcgctataggggtgaaaattccacaccatcctagtgctcattgcgtgcctgcagctgaggcacataccaatgaagccggcctgctctcctcagggcaaggcctgctctgatctccacacgtctatcgcatgcccttccaccgttggtgcctcgaacaaggtccggtcttcccaccaatcaagaagtccccacccctacctgagagggcggaggccctgggtgggacctccgggtcgatgacgtcaccgtcgctcgtcttgccacccctcaccgcccgtcggtgcgcctgcatgcgcgtggccaccacccagatggggttggtcagcagcacgttgcccgcccccgccaacgacgcgaccgccagggactggggcacggtgagcgtgaccccggggatgtcgcccgtggctgcgccgcgcaggaggctgtacagggtgaagtacacgccctggctgacggtggtgcccaccagcgcggcctcaagaccccggaacaggcccttccagccctgggagcccaggatctgcgggtgacagggcagggcgaagggggtccaagtggaggaggagtgttggtgcccggctcaggtttcagcagattcatcatccatacgcctcctgggaatctactgacgccacatacactttcgatggcatttcagacagggttcatcatcttcaggcctacctgctggaactgggcggcggaagagagaggggtcgcgaatggggtgtggcccgcctcctggggcttgttcctgactgtcgtggcttggagtatggcaacctgtaacaggtgttgtatggagctggacttcgtgatttaaatctgagacacgtccacactgtcgcacaggcacatacagacggcatggctgctcctctggtagccactcaccgttgacagagggtaggttgcgatggttgccacgcaccctgggataagacgagcgggaggtgggaagtgaaaatatgcgctgtaatatttctctgatcacgcaagaccgacagccaggtgctgcctcacctccgagggcgccagacacaccctccaccaatgcctccgtcatgtgtccgtggcagtgggtgaactgggcttgggtctttgggggccaggcacagtactgcaaatgttgagggtagaagcgtttgcagctgttcctggagaagcgcgaagggcttcttccaccgctatccctacgtattgataatgagggcgcctgtcagcactgtcggtaaattcagccggagcacgcagaagaaaggaagttcacggaattcaagcctgcgatcgcactgacgtttacgtcgactttggggggcccatctatgagggcgtgaatagtgattagaccaagttagagaggaactttattggggcagctgagagcacggaatttgctgtctagcggggcgaagactggatctggcatgactgtggagcagccttgggtggagaaatagtgagttggggcatgcacgctcgcatggtcgctgcagatcacagatcagttgtggctttgagataatttccaacaaatcgactcccccgccccgtccccagtcgaccaagggagatcggagatgttgcttcccagggggaggtggtgaaaacgctggagagcgccctcagctccggcaacgtacgtgctgatgggatttggggaatattgttggacaaaaaccttcaaggggttgctttcaaatctcgaatgggatccttgaagcctttctgaccatggaagcatacagagggggtgccgctccatgtatgttctctaaatggcctgtcccaatgaccccacccgctacacacactttctcgcagctcccacacctcttgttctatggccctcccggcaccgggaagacgacctgcgccctggccatagtccggcagctgtttggcgccgacctcctccgtgcgcgggtgctggagctgaacgcctccgacgagcgcggcatcgcggtggtccgcaacaaaattaagtcctttgcggccatctcggtgggcgcctcgcccgcgggtcgaagcgtgccaccctacaaggtcatcatcctggacgaggccgatgcaatgaccaccgtgagtggcggcggggggtcctaagaggaggaagggtgacgcggaggccattgcatgctgaggggtggcagtgcagccccaggagccggcttgggtcgcagacccgcacatgcgcacactcgaccaggcagcggagacgagcgcagttacccttacctttttggactcccccgcggcgtgcaggacgcccaagctgcgctgcggcggacgatggagacctactcccgcgtcacacgcttcatcatcatctgcaactacgtttcgcgcatcattgagcccctcgcctcccgctgcgccaagttccgcttcaagcccctgcacggcaccgtgatcgacgaccgcatcaatcacatctgccagggtgaggggcgcgtggggtgtggatgccacagtgccggttttgggggggctcggcctagccggggaggttgtggtgacagacgggaaccgcaccgcctagcccatacatcatatatggagtgtgagtggcgtcccatcagaaataggacagtggcccacgtcgggccatatccaaccggccgtatcatctctcccccccgttccattgacaaacagtggagggcgtgcagctgggccccgacgcgctgtgcacgctgtcccgcgtggcgggcggcgacatgcgccgcgccatcaccacgctgcagagcgcggtgcggctgggcggctcgccggtgcggccgcagacactgatggatgtggcgggggtggtgccggacgccgcggctcacggcctgctgcacacctgccgtgagggtgactttgcgggcgtgcaggccgccgtggcggacctcatccacaagggctacccggtgcgagggtttgagagggcttggaaggttttgtgagggacgagtatggaggagggagggtgtggagcactggnnnnnnnnnngcggcctgctgcacacctgccgtgagagtgactttgcgggcgtgcagtccgccgtggcggacctcatccacgagggctacccggtgcgagggtttgaggagaggttggaaggtttcgtgggggacatgtatggaggagggagggtgtggagcactggggctgagtcaggagggtcgagtgcgagcgaggaagacctggacccacacccatccctcacgctcccctccccttcatcacaatcgagacgcacaggcccaggaggtgctggcagaggtgcagggcgcggtgttggtggaccccggcatcgacgacgtgcgcaaggccagagtgttggagcggctggcgctggcggacaaggcgctgatcgatggcgccgacgagttcctgcagctgctggcggtggccagcctgacgcagcgcgtcatcctcggccaggcgtgagcgcgcagcgggggtggttgggatgctccgctactgggagcagaggagcccccgggagccccgactgactggaagcgtccactaccctcgaagcacaaccacacgttacaggatttgcagccggggcaggaagtgacagtaccaggtggggcgtatgcatgggagggaggtgctggtctgcaaataacagtgcaaggcacctctggacatcccgggcagagaggagagcgnnnnnnnnnnccgactggaggcgtccactgcccttgaagcagaaccacacgttacaggctttgcaaccggggcaggacgtgacagtaccaggtggggcgtatgcatgggagggaggtgctgatctgcaaataacagtgcaaggcatctctggacatcccgggcagagaggagagcgcaacggcaactacagagcatgcgtccgggggcgcggcaggttggtgctccgcgcgggcaagacagatcatcaggtacaaggccagcgacagcggggtagggattgcatgtgtcatggcggttgtcaggtcgggcacggcggtgtgcgcatgggccctcgtgcgagaggccgtcagggggagcggggagaatgtgatcaggcgtggccgccgctgccacaccagcgcgccggcgcctcctccaggctgagcacgacgccggtgccgtcctcgcccagcgcatagcgccaggtccaggagggcgcggcgatgggctccagcacggcactccagccgcggcgcgaggcgtcggggcgcagggtcaggcggtggccgtcgggcacgtggaagtccaggtcccccaccagcgtgactccggccgcgtccagctcggcgtgcccgtgcaggtgcacgcggcaggcggcgtggcgcgcgaccgcgtggcgccagtacacgttgctcgggtccgcgtagtccacgccggcgttgcgcacggccacgtcgcgcaggcgcaggcggccgcagcgcgagctgaaggtcaggcgcgggtggcggtctgggttctccgcgcacgccccgccgacctcggcctcgccgtcgcagggctggggcaggcgcgggaggcgatcggggaggggggccgcgtggagtggcgcgccgccgggctgcagcgggtcgaggggggggggcgccgccgccgccgcgcccggcgcctccatgtgccccagcacgtcgtcggccagnnnnnnnnnntcgccgccgccgcgcccgcgcccggcgtctccatgtgccccagcacgtcgtcggccagcaccagcaggctgccctccaggtccagcccctggacgtcggcctccgccacctccagctgcagctcggcgcgcggggccaggcgcccgccgcgcagcttctgcgcgaccacggaccacagcgggcccagcgcggggtggtacaggaagatgaggccggggccggaggccaggtactccggcacggttcctacctgcagtgtgtttggtcggggggggcgtgtgggcgttgggtgtgggttgtgcagcgcgggatgccacnnnnnnnnnncacctgcggtgtgtttggtcggggttggggggtggggggcgtgcgcgtatgggcgtcgggtgtgggttgtgcagcgcgggatgccactggccgccacaccgctccgaggaccccaggccactgtgaggtcgtcgcagtggcctcacgggccgatgctgcactcccacctccgtggacccccccctcttcccaccacccacgcacacacannnnnnnnnncgtcgtcgcagtggcctcatgggccgatgctgcactcccacctccgtgtacctccccctcttcccaccacccacgcacacacagacacggccagggaacaaacatgacacagtacctggggcacgtcaaagccgcaccggcccagcagctcggcggcgttgagctggaggtcgtagaacgagcccaccggcgtctggtggatggccgtggacccgggcgccgccgcgcgcttggccgaggaggtgaccttgcgccggacgttggtcaccaggaaggtgggcagcccgtcgtcggcttccgggtcgtcggccgcgtggtcgtcggccgcgtggtggtcggccgcgtggtcggggcccgcgccaccgccgcaggccggccccagcggcgcggcgaagcagtcggccaggttctgcatggtgcactccaggcgccccgcggccagcgtggtggtggccccccccgccgccgcatcgcgcaccgtcacgcgcttccccgtgttgagcaggaggcccgggagcagggcggcggcgtcgccgtcggccgcgccggcgcgcaccgcgccctccaccgcgcgcaggtcggcgtacaggatgttggcgttggcggggtaggcgctgtgcccgctgcccgacccgcaggcctgctccaccaggccccgtgccccgaactcggtgtactccacgttggtcaccgcgtagcgcggcgggagggcggcgtcgccgccatccccgccctcgtccgcgaacctggccaggacgttcacgccctccgccgcgcccaccacgcgctcgcaggaggcgaagccgaaggccttgccccgcgccaggccccgccccgccagcgccagcgccgtgtcgtccgtccccgccagggggttgctgatctggcgcagcaccgcggcggcacgcccccgcccgcgcagccagtcgtacacgccctcgtccagcatgagcttccagatgacgccgtgcccgcccggcttcatcagcggggccaggggcgcgggcagcagccagcgcgcgtcggccgcgctcagcacgggcaccaggggctgggagaagaggcggaaggcgtcgcgcccgcggccccaccacccgcgcgcctcgcacagcgcctccacgcgccacgcgttgcccttggccgcgctggtcatgatggccacgggcgtggtggggcgcggcgcgccgccgtgcaggcgccagtgcaggtgctcgcgcgccagcgtgtcgcgcaccagcgactccagcaggctgcgccccgcgtactgcagcaccgcggcgggcaggccctcccccgtctcctcgcaggccaggcccagccggtcgccgcag

SEQ ID NO: 43602 - DNA, 90 bp, Chlorella protothecoides
ctggggctggtggccgcgcgaggcgtgctcgagggtgagcgcacttggtggggggagcgcgggggggccgtgcgcgccggggggttctcg

SEQ ID NO: 43603 - DNA, 107 bp, Chlorella protothecoides
ggaaggggggagccgggtgcggtgcagtgggaatgtggacgggggtgggggggtggagggctgcaggggaggtactccctcccaaatcctggtcgctgtacatcatg

SEQ ID NO: 43604 - DNA, 61 bp, Chlorella protothecoides
gccctgctctagcgccgcgccggccatgtcggcgtcatagaagtcgcggggcaggcggtgg

SEQ ID NO: 43605 - DNA, 73 bp, Chlorella protothecoides
catgtggtaggtcctggtggggcggccccaatgcagggaggttttggcggtgaggggtatgggggcaggcttg

SEQ ID NO: 43606 - DNA, 129 bp, Chlorella protothecoides
ccaccggtgacggcggtggtgggtcaggtaccgagggtggaggagggggcttgggactgggcacagagggcgaggatggcggcagggggctgggctgctgtggtgagggcggtggggggctggggctct

SEQ ID NO: 43607 - DNA, 61 bp, Chlorella protothecoides
cgagcccaaagatcgcccctggcaggagggggatgaagggatgccttgagctcagggtgca

SEQ ID NO: 43608 - DNA, 14004 bp, Chlorella protothecoides
  modified_base (615)..(624): a, c, t, g, unknown or other
  modified_base (1101)..(1110): a, c, t, g, unknown or other
  modified_base (1750)..(1759): a, c, t, g, unknown or other
  modified_base (3063)..(3072): a, c, t, g, unknown or other
  modified_base (3461)..(3470): a, c, t, g, unknown or other
  modified_base (3560)..(3569): a, c, t, g, unknown or other
  modified_base (3755)..(3794): a, c, t, g, unknown or other
  modified_base (4506)..(4515): a, c, t, g, unknown or other
  modified_base (5243)..(5252): a, c, t, g, unknown or other
  modified_base (5674)..(5683): a, c, t, g, unknown or other
  modified_base (5864)..(5873): a, c, t, g, unknown or other
  modified_base (5966)..(5975): a, c, t, g, unknown or other
  modified_base (6068)..(6077): a, c, t, g, unknown or other
  modified_base (6311)..(6320): a, c, t, g, unknown or other
  modified_base (6406)..(6415): a, c, t, g, unknown or other
  modified_base (8240)..(8249): a, c, t, g, unknown or other
  modified_base (8615)..(8624): a, c, t, g, unknown or other
  modified_base (8930)..(8939): a, c, t, g, unknown or other
  modified_base (9309)..(9318): a, c, t, g, unknown or other
  modified_base (10220)..(10229): a, c, t, g, unknown or other
  modified_base (10324)..(10333): a, c, t, g, unknown or other
  modified_base (10522)..(10531): a, c, t, g, unknown or other
  modified_base (11089)..(11098): a, c, t, g, unknown or other
  modified_base (11832)..(11841): a, c, t, g, unknown or other
  modified_base (12237)..(12246): a, c, t, g, unknown or other
  modified_base (12533)..(12542): a, c, t, g, unknown or other
  modified_base (13070)..(13079): a, c, t, g, unknown or other
ggaggcgcagcgcggcctgcgcgcctcggccgacgcgctggaggaggcggagcgccagctggcggaggcgcgggccatgctggcgcgcagcgaggtgctggaggcggagcgctccgccggcctggccaggctggaggagggccaggggcgcctggcggcgcgcgaggcggcgctagtggcgcgcgaggcggagctcgaggcgggactgcgggacctgcgagaccgacgcgccgagctggaggtcgcgcgcggcgaggcggaggcgcgggttgctggactgggggcgcgcgaagccgcgctgcgcgaggaggaggtggcgctgaccgggcgcgccatgggcctggccagcatcgccgaggagctggagcgtcgcgatggcttgctggccgggcgggaggccgaggttgccgcaggcgaggcagggctgcgggagcgaggcgctgcgctggaggcgcgcgaggcccaggccacagcgcgggagggccacttggaggcgcgagaagccgacctggcggcgagggaggtcgccctggcggcccggaccgcggcccttgtaggagaaggccgggacagggacgtcgtgaaagggcagtcccccggcaagcgggcgcggcnnnnnnnnnntcccggaccgcgggccttgaaggagagggccgggacagggacgtcgtggaagggcagtcccccggcaagcgggcgcggcgcgaggacgcagccccattgagtcccctgcctgtcgtggaagaaggcatggaggaagaagatgcgggcgccgatgagttcctggacgccctggaggagctgcccgcccggcctgcaggcaggatgtcagccaagcgggcggtgaccaagtcgaacgccgctgcctcctcctctcctgcccggtgagaaggtgatgggggtggatttgatgctgagctgctgggtgaagggcctgctgtcgtgtcctgaggacatgagtgtctctttgtgagatctttataggtgatgtcggagcgacaggggaatgggacacaatcatgtctcctgctggacgccgccctcctgcaaccacctctcaaacaagctcatggctgtcaaccccctccttcatatgcagannnnnnnnnnccctgctggacgccgccctcttgtaaccacctctcaaacaagctcgtggctgtcaaccccctccttcatatgcagacaagcggcgcggtcggcggcgggacgcaggaagacggtgagcaaggcgaagtctcacccccctgccgaggaggcgcccattgctgccgaggatgcgcccattgctgccgaggaggcacccgctccggctgaggaggtgcccgctccggctgaggaggcggcgccatcgcagtctgcggcgtcgcggccagggcgcgccaccaagacccccgccaagtcacggccggcgcccacgcagtctgcggcgtcccggcgctggactgcagcggccccagccccttcacaggagccagccagccccagcgtcacgcggcggagcgcgaggctggctgcccgccccacacgcagcagtgcacggactggggcgccagatggtggcgaggaggtggagaaggtggtgggcagccccacgcggtcaactcggtcccgggccaggcagggatgagggcatcgctgggaatggcgccccaaccgggcccaaacgcggcatgccgtcgatccatgcatggcccccagctgtaacgcaaggccggtcgaacaattccaaacgcaattctagtgtgtnnnnnnnnnncaatggcgccccaaccaggcccaaatgcagcatgcatgccgtcgatccatgcacggcccccagctgtaacgcaaggccgggcgaacaattccaaacgcaattctagtgtgtaaggtggacatctgtgtatgccggtggtgcttctcctgccggcatgaccttcccggcctcgcccgcccgggaggcactggaggagtgcgcggtgcagcgctggctgcctgtgtacaggaggcatacctttgagacacgactgattcctgtggacaaagacctttgcaactggctcgtcagcgatggggtgtctgcctcgggcgataatcgagcggtgcgtgcatcggcaatggtggtgggtgcgcaggagaacgagggaatggggccttgccgctcctggctcattccgctgtggctgggagcccaccgttggattttgcaagcagaataatctgaatcatacatttaccctgctgccgcattgccctgagcgtagttcgggaccagggcaccccgggacctggccgacccagaccagcaggggtgggagtctgacagcgaggagggcgacggctcccactccggcacccctcctcccgcctccctccccaccctccacgcctccctggcctccgccatcgccgagctggggggccgcgtgcaccccaagttcacctggagctgccccaaggacgcggtctggctgtcacccggcaacaccctggcctgcacctccccagacgaggtcctgctcctcctccgagcctcggaccgtgtggctcacgacgttgccgccgcgccggcagattgcccgcatgccatcgtgctccggcggtggcgggcgctggaccctgggcgcgagttccgggcgtttgtggtcggcgggcggctggcgggcgtgagccagcgcgacctgacccaggagtttggctggatgcaggaccccggcgcgcgcgccgacctgctacaccttgtcgccgccttcttcgacgaccacctgtgcgccagcttcccgctgcacgactacgcctttgacgtgtatgtgagctcggggaggagcacgctcaagctgctagacttcaacccgccggggggcaccacttctgcgctcctgtacgactgggaggagctggggtggggtgggcggcgcgattgtgaggctgaggatggcgcggggactccgaaggcggatggcactgcggccatggcggggccagatgacgtggcctcgggagggccggcgcccaggcatgcgacagcagggcctccgacgcgagacgctccggaggctctgctgcccccctgcgtcgatnnnnnnnnnngcggcgtggcctcgggagggccggcgcccaggcaggcgaccgcagggcctccaacgcgagacgccccggaggctctgctgcccccctgcgtcgatgcgacatacctgcagcagctcagggcggcccagggtcgaagagaggactctggtgtgccacgctcgcccagcagtcatgcgagcaccactggcgctatccctcccggccagcctccacctggccagcctacgcccggtcaggctccgctggaactcagggtggtgcagggaggcctgcagctgcgtccgcacctggcagcctacggcgtcccctttgactttgttgacacctctgagggcagcgcgctaagtcagctgctggcgaacgtcggcgtgccctccgacctctggcannnnnnnnnncatctagaccttggatgatgtgaggaagaaagatcagatctccgcaaggggggcattgaaccggtaccaaccacccgattgccgccgctnnnnnnnnnncgactttgtcgacacctctgagggcagcgccctaagtcagctgctggagaacgtcggcgtgccctccgacctctggcaggagctgaagaggcaaggcgctgcggcgtcgtagaacggtgctctttttaatttcgctgcgagagtgtgaataggccatcttctccctcatgcatacggcagggacannnnnnnnnnnnnnnnnnnnnnnnnnnnnnnnnnnnnnnnagagcgatcgagagctcggacacgaagcgctccatttgattattgaaattttctgtgagtttctgggcttctatttcatcagttgccccggcgcatggtagagggagcccgggcgacagccatgtgattcgccctccgtactgtgcatccaagctccacgaggcctacatcacgccttcctggttcagaaacctcctctgaaatgccaaagtatgtgcgatgcatggcactgccccatacctgcatgtgccgcatctcctgtgcatggctaaccccaactagggttccgcaggttttttaagtttggtgcgcgctttcccctgggaacctctagctccgagagatccatccggaatggatccgttgcgtccttgggatcgacctccgaccccgaggacgcctcccagcccagttcccccgagtggtctcgggccggcgtactccgcacctcacgctccatcaccacggatgggagcggcctgtctgatgacgagaatagctttgccgctatggaaggtgttttcctagtcgtaggagggggactggccgcctttaacgttgctttggagggaggatggtgcctgtgagcctgaaaaaaacaagcggtggcatgccaagttgcatatcgacgccgccttgcatccccattcccttgtctccacgctgcccccgcccacctttctcccacaacagacgacgcccccctgcgccnnnnnnnnnncctggccgcctttatcgttgctttggaggaaggatggtgcttgtgagcctgaaaaaacaaggggtggcatgccaatttgcgtatcgacgccgccttgcatccccattccattgtctccacgctgcccccgcccaccttcctcccacaacagacgacgcccccctgcgccggttcgtcacccgcacccacagcttcgaccaggtggactttgacgccctgatccagaaccctgacctctacacggtgcacaacgcggcggaggcggggctgtccccccggcactacgccagcgccacgccgcccacgggcgtgaagcagccggtcgtgctgaaccggccacgtcgcagctctggcgagcggcccaggtccaagtcggtgctgggcatgcccaccttccgcccggacagcaccttttacaagtactggagcagcctgatcctggcgctggacctcacctactctgcctttgtggtgggtctccatgggggtgttgcggtgggcaaggggtttactgggaaagggaccgggaaatgatcggagcggggtttgggcgagacttggcgcggacgggtcatgggtcatgcccagagtcatatggtgcaggctctctcccagcccaagctgcaacccttgtcgcctcaatgcgcgatccacgtttggcccctctcttttaaccccttccccacactttcccggttgcaggttcctatcagcatcggcatgctgannnnnnnnnncatccacatttggcccctctcttttgaccccttccccacactttcccggctgcaggttcctatcagcatcggcatgctgacgtccttcctggtcctgaactggacatctgcgctggactacaccgtgggggcctttttcctggccgacctgatcgtgtccttccacgtcggcttcatcgccacctacaacctgcgcaaggtcctggtgctgaacggcaagctcatcgccaagttctacatgcagcacgtaggtgttgggaagggacgggagctactagagtgggttgtcggctgggtgagtgcgccaaggcctcgtctgtttggaatttgagtttcgtgcaacgaagcggaaggaggtgtatagtgcgccacagattcatgtatctcctaatttctggactgttgctcggacggtactgaannnnnnnnnncaaggatctgtataggtgcgccacagattcatgtatctcctcctttctggactgttgctcggacggtactgaaaggcttgccggtggcaatggtcccagtccgccgaccccccctgcacatgtgccccccaccgtctctccccctccacccacgcctgcccaggacacattcatctttgannnnnnnnnngggctgaggagtgcggatttgtcctgcttgtcaccagatccccaagcaagccccgaggtcaacctttcactcaaacctccgcaggcttgtccnnnnnnnnnnaggcggaggagcgaggatttgtcctgcttgtcaccagatctccaagcaagcccagaggtcatcctttcactcaaacctccgcaggcttgtccnnnnnnnnnntcagtccgccgaacgcccctgcacatgtgccgcccaccgtctctccccctgcactcacgcctgcccaggacacattcatctttgacatcctgtcggtgacggcatggctggtgcagctgcttatgctcctcctcagccacgtcgtcgacgagttcaaccccaccgtggcactgttcatcatggaggcgctgcggtgcgtggatgaaagtgggctgggtttgccagtagccctcnnnnnnnnnntcccttcccttcttggagtacaaagttcatccatgttcccctgcgcaggaactttacggcaggcgcgcagggctttgacaacaccnnnnnnnnnngcttcctgcgggtggtgaagctgatccggaagctgctggtcaacgcggtatacgcccccctcaaccaatcctcgtggatgaagtgggcctccagcgcgaccttccattacctcttctacatcgtttatgtgatcgcggtcctggtcaacttcctgggctgcatgtggtgaggaggcgaggtcggcggcttcttttcccaggccgtacacagagtttcagcccccttcccttcttggggtacaacgttcatccatgttaccctgcacaggaacttcacggcaggcgcgcagggctttgacaacacctgggccaactactacccacccttcgtacggtcctactctgaggatgggatgacagccctgaccgccgatgaagtgcagcacgacgtggaccaagtctggcgctactttgtcggtacatactgggccttgaccacagtgagtggagctgatgtgttgaagtcttacttttgtgaacgcaggactcggcttgtgttgtttgccaagccagcatgctcctccggtcaagaagctgccgtgctggatgaatcggaggtgatacaaggtcccagccgatatctgagctccaatgtgcttccctagacatggatgacccacctcctctgcccacacctcctgcagattgctaccgtcggttttggcgacgtggtgagtgcctctgcatgctggtaatcctagcatgctttcgatgtgttgggcaacggacggcctgatctctgatgagtctctgtttctcatcccctccccgggcagacccctgccacacttgttgagaccatcgtcgtgattatcgtggaagtcattggcatcatgttctttggtatcttgctgtctaccatcaggcaagttggctggagtaactgatggatcttggtctcaattctgtggataagtctgaagaatgctgatctgtggtggtcgagggtggctggcagtctctgatggtctgtagtcaagccttgcggctgtgagacggtggctgtgcttgcttgtgcaaacgctgtgaaccagcaagataccattcatgctccagcacaaggcctgacacctttcagatccgcccggtctctccctcatccattccctgcagtgagctcctgtccaactcaaacaaagatgccaggcgcgcatatgtgttccgcaagaagttgaccaccgtggaccgatggatgaaggggacgcggcttccctcccacctccagcgcagaattaagtctttctatgccgaggtgtgcggtgtcaaagggcttggagagggacggggatgtgtgcacagcagtgtgtgaaagagtgctggtacagcgtgacaaatgatgggattctaagaatactctgtgggactggtggcactcatggaacatggggtcacccaagtcaccttgcagatggatactaggaaaaagctgctgagctgccctccatgccatggtggtgccctcacctattcaatccaccccttgccaacaggtgtggctgcaccatgtggagtcctccgaggacacccacctcttcagagagttgccccacattctgaggaacgaggttgcatggaatgccctccaagcagccatggcgtgagttggaaagggttggtgtatcctggttcctccagaccccggcatgctgtactaggattgatacgtgtcccatttcctcagattcgtggaggtttgaggatgagtcacaccctcccggcagctcacggccccggtcctccactccccaccccaggcgcattccctttttcgaggacatgagcacgaacatgaagtggaccctctgctccaaattcgagccggttnnnnnnnnnntcccaccccaggcgcattcccttttttgaggacatgagcacaaacatgaaatggaccctctgctccaaattcgagccggttcgctttggacctggggaggacatcctgtcggagggagacaaggccgagaaatgctgggtcatgctggaaggtgtgatggtgtgtgatggtgctcttccccttgtcaggacaccgtcccctgggtgatgcagcaggcactgcagtaggattgaagttgggatacgggaaacggcggcggtgctgcacctctttgctgtgcacgtcaattcgtttcctgcttccctcacatttgcttcccatcaccataccacccttcccaggtgaggtggtgtcgctgcaccactnnnnnnnnnntcctcacattcgcttcccatcaccctgccacccctcccaggtgaggtggtgtcgctgcaccactacgtggaggccggctccatgcagggccctgcgctccttggcagtaccgtggtactgcaggacctggtggagacgttcaagagctcgccctgcaccctgcgcaccctcagctcctgcatctgctggcaggcaaggctcgattaacatgaatttgggggaggggaggggctctgaggactgcttgcgatgggcgcacactcagacgttgtatctttagggcgtctgtcaaactgactcagcacnnnnnnnnnncgaatcggggggaggggaggggctctgaggactgttttcgatgggcgcacgctcagacgttgtatttttagggcgtctgtcaaactgactcagcacccggcccaccccgcttatgtgccgcaggtccgctggaaggatctgcggctgctcctggactaccaccccaatgtgaggagggcgctggagtcgaggataatggcacaggtctgctgccacatcaccctctaccccagcgcctggatggacagccaactgctggtgggcaacagagttgtcagtgaattatggggtgaagggccatgaatgcatgcctggtggcatgagatgagcgtcgaaattgggctctgtacgcttcccagttggtctggtnnnnnnnnnncgaagggccgtgaatgcatgcctggtggcgcgagatgagcgtcgaaatcgggctctgtacgcttcccagttggtctggtgaaggctcaaggcctgtattttgagttgaggcctccagactgtgtcatctatgctccctccaccttcctattgtatctagcatccggagctccaggatgccaaagccagggcagaggagatggccaaggatctctgggaggggccctcgcaatcccaggtggcagaggggtgagggtgcaatgggatcgtgcgctgaagattcaggccaatcagtgcaggcttaagggagtgtgcacatcatcattgtcatggttgtcacagtgtatccctccttctccctcaggttcggtttgacttgccaagtggccacaaattggaacccttgtgtgaccttccctgactcatttcggccgacagtgcgagctgccttcatgcaatgcctgtttgcagtgtgcacaagcacttgagaattgtccattatttgcatacaatgttgtagagaacttgcaagtgtttattagaccaacaactcggggcgcgagatctcatgccgatcggcatcgaaacctacaacataagaccagcccccgtactatcaatacaattgaaccctcctacctatgctgtaatatatacgccgcgatactccattgagcacctagaaagtaagagggtctcacgccctcggaactactcgccgtgcgatgcactcctctacccagtctcacccttccgcatctcagctgcagtcaattctgaacagcacgaatgagcaagtagctcaacttgcgatgcaggtaccatttcagtccgcatgtgaaccgcggcatcattgctgcaccccgacctgttcctggtcaacgccatgccttttgcatccannnnnnnnnncaagaccagcccccgttctatcaatacaattgaaccctcctaccgatgctgtcatatatacgctgcgatactccattgagcacctagaaagtaannnnnnnnnntttgcgatgcaggtaccatttcattccgcatgtgaacagcgggatcattgctgcaccccgacctggtcctggtcaacgccatgccttttgcatccatcgggcaggatccattggcccagcatcattcaatactaccccaatgttgcaagtagggtctcgtgcctggactggagggaggagcgatgcgannnnnnnnnnagcccagcatcattcaattctaccccaatgttgcaagtagggtctggtgcctggactggagggaggagcgatgcgaacagtgatcccaactcccgggtacgagtctgtgggtcatcgcaagacttctccagacccatgcgcacagcagttgctccagctacattgcccccacacccgcatcagggcaagcctaccagcctgcataccccacacttccctcaggtttgtgatcaagacgtcagatgagtcgggcaataaggtcttcctgaatgtgtgcgcggacgcggcagtcccccttccagatggctggtctcctggtgagccgctgccccctgcggtgaagggatacctggaggctggaccggaagggtcagcccccagcagcggggacgctttgatgtcgctcctggcctttcctatgtggctcagcgacctccggcgagactcggaccacacgggtgcagcctgcggaggtgagggcggggtagttatcaggtttgttcattttggagggacaaaaccgggttgagcctccgcatcccttgcttgcagtggacnnnnnnnnnnccaggtttgttcaatttggagggacaaagccgggtcgagcctccgcatcccttgcttgcagtggactgagtcagctcagctgaagcttgcagtcttgtttgactgcgccggagggtggctgcccgcctgtgcctgccctgccttgcccaccctgcgtgactcatcaatcgcgaacatcacgatgtcacccacctccaccgcccttcgcagtcctggactgcgtgcttcacgctgacatcctgcgccacgccgctgaggtccggcccctgaagctctacgccatccagctggtcctgagcgaggtggcgcacaagtgcgcgctgcgcctcaacccgctgtacaagctgccgcgcatgcggtacaaaggccagggcccggttccacatgctgtgccggccgcagaggcgctcactaaacttccccaggagcagccggtgctgatgccaggtcagggcgcagagcgtccaggcctggtgagggaggtgctggccggccgggacaagggcctggccctccgcaccacgcccgccccgcggcccgcggcgcgggaacgaagcgaggcgtgcgaggaaagcgcggatcccagcaccccgctgcgggcaatactgcggtaccatggctgccccgtggaggccgtcagcgtcgaggtggcgctgacgcccgccctggtggcgacggcgcagcgtgctgtgcacgccgtgcgcgtgacagtgacggggcagcgggtgagcatnnnnnnnnnnggcgtgcagtgcacgctgtgcacgtgacagtgacggggcagcgggtgagcatcgccctccctgcctgcccggccctggaggtgggcctccccttcttcgttcgcccggatcagggcaccgccagggtcacggcgcaggggctccacgtgacgctgccctaccgcccgctggaggaagtgcaccctcgaactgcgtgaggcatcgtaccttgtgagtcatactttcttgcgattcccttcccttcccgcgaccctgaccagctgttgcagccttcctctcggaagttgtatctgttctccagtcccttgcagtatgcaagccaagcactgcaccaggcgagggcccgtgctccgccagcttccagccccaggaacaggacccgtcaaggccagtccnnnnnnnnnnattgtatctgttctccagtcccttccagtatgcaagccaagcactggaccagccgagggcccgtgctgtgccagcttccagtcccaggaacaggacccgtcaaggccagtccccaaagcgcagggggcggggggacacggtgcgacgcaggtccggcgccagcaggatcagcccgccggacctcgtgcccaccagcacgcactgctccggggtcagaaccagggtcgtgaggggtccagcgtgcagtgcgatgttgaggtgcacacgcagcgtggccaggtcgcggnnnnnnnnnnccgtgaggggtccggcgtgcagtgcgattttcaggtgcacacgcagcgtggccaggtcgcggatggcgaggccgccgccgctgcccacagtcaggagcagacgcccgtcggggctggcctgcatgtccgccagccgctcgtacacctcgacgctcgccagccgctgcccgctcaggccgtacccgtggatggccaggtcggcgtgggagtgcgtcagcagcaccccggggccgggggccaccgccagcagggccggggtggcggggcaggggatggagcggagcaacctttgtgtttgtatgtttggggggaagaaggtggggaatggagatttgggatggtaggggtacatgcaaattttgctgtgcttgcacccgatggagccgtcgttgcattccagaacatggggtgcagatgaccaagcaccgagcagatatacatgatggtctgcactccagtcagcatccagagagggtgccctccacaggaccctcgactccacgcaacccatggccctgagggtgcagnnnnnnnnnnaggtacatgtaaattttgctgtgcttgcaatcgatggagccgtcgttgcattccagaacatagggtgcagatgaccaagcgcagagcagatagacatgatgatctgcactccagtcatcacccagagagagtgtcctccacaggactctcgaatccacgcaacccatggccctgagggtgcaggccgatcccatcatcccttctctccagggatccacacaggcctcctttcctcactcacgtacctggcatcccgcaggccgtgcagcaacagggtcccgccggccgaggcgctgagcaccaggtctagcggggtgctgaccgccacggccaccacgggcgaggggtggccatgcagcgtggcgcgcgggcggcgtggcgccctttccaccccgcgcgcgcccatctcccagaccaggagcgtggcgtcgcgagagccggtcaccaccactccctcgtcggcggccaggcaggtgatggcgtcctggtggtaggacgccgcggcgctgggcgcgccactttccacccaggcgcagcgcagcgtggcatcggcgccgcccagcgccacgtgccgtgtgcccggcaggaaggcgacgggcggggcctgggttggggtgatgccaggacctgggccggggtcaagcagggtgagccctgccccgcacggttccagcaggccctggccggcgccggccggctcggcggcggtctgtccaaaggtgaagggcccggcctccgtgcggtgcgcgagccagcggtatgcggccaggcgcggcgcagcgtgcactgcgtgcagcgtgccgtcaggacccagcgccagcgcggtcacgggcgcggctgtgcttggccttgcccccggcagggccgcgacgacgcgcaggcactctggcgcatggagcagcggccagcgggagggggcgggggg

SEQ ID NO: 43609 - DNA, 61 bp, Chlorella protothecoides
tgcgaggcgagcgccgggtgggaaaggctattggcgcgcctgcatcccttacagcgtgcaa

SEQ ID NO: 43610 - DNA, 82 bp, Chlorella protothecoides
cgtgctccaacccacccagcccggctcgggggcgggagctgcgggagctgcaggagcagcgccgccgccggccaagaaggcg

SEQ ID NO: 43611 - DNA, 61 bp, Chlorella protothecoides
tgcatccattgcatctgtcgggggggggggggcgcggatccaaccgggcattgatcagccg

SEQ ID NO: 43612 - DNA, 16492 bp, Chlorella protothecoides
  modified_base (428)..(437): a, c, t, g, unknown or other
  modified_base (1022)..(1031): a, c, t, g, unknown or other
  modified_base (1688)..(1697): a, c, t, g, unknown or other
  modified_base (1795)..(1804): a, c, t, g, unknown or other
  modified_base (1938)..(1947): a, c, t, g, unknown or other
  modified_base (2941)..(2950): a, c, t, g, unknown or other
  modified_base (3077)..(3086): a, c, t, g, unknown or other
  modified_base (3565)..(3574): a, c, t, g, unknown or other
  modified_base (3792)..(3801): a, c, t, g, unknown or other
  modified_base (4089)..(4098): a, c, t, g, unknown or other
  modified_base (4261)..(4270): a, c, t, g, unknown or other
  modified_base (4347)..(4356): a, c, t, g, unknown or other
  modified_base (4904)..(4913): a, c, t, g, unknown or other
  modified_base (5203)..(5212): a, c, t, g, unknown or other
  modified_base (5611)..(5693): a, c, t, g, unknown or other
  modified_base (5771)..(5780): a, c, t, g, unknown or other
  modified_base (6320)..(6329): a, c, t, g, unknown or other
  modified_base (6699)..(6708): a, c, t, g, unknown or other
  modified_base (8656)..(8665): a, c, t, g, unknown or other
  modified_base (9412)..(9421): a, c, t, g, unknown or other
  modified_base (9976)..(9985): a, c, t, g, unknown or other
  modified_base (11031)..(11040): a, c, t, g, unknown or other
  modified_base (11878)..(11887): a, c, t, g, unknown or other
  modified_base (12836)..(12845): a, c, t, g, unknown or other
  modified_base (13214)..(13223): a, c, t, g, unknown or other
  modified_base (13730)..(13739): a, c, t, g, unknown or other
  modified_base (14478)..(14487): a, c, t, g, unknown or other
  modified_base (14557)..(14566): a, c, t, g, unknown or other
  modified_base (15761)..(15770): a, c, t, g, unknown or other
gccggggccgtccttgccgcccaggccggcagcgcccaggcgctcgaagcgcgcgaagcggccgcccttgccgccgagcgtggccgccaccgcggcgttggcggcgctggcctgcgcacgccctgccagctctgccttggccttctgggcccgctccttggtctcctcgtccgcccgccgcgaccccgcggccttgagcagcgcctcacgctccgcggccagcttcgcctcggccgccgcgcgcgcggcgcgctcgaggcccagcacacctcgccgcgggtcgtgcgtgaccgacacgccgggctggcgcctgagtgggtggaggtgtgtgtgttggcttcatcggtggggacgacgacgccgtgagccacgcgttggagcaggcgacaccgtgcatgtcctccagcaactgtggtgtgacggcaagnnnnnnnnnnagtgtgtcggcttcatcggtggggacgacgacgccgtgtgccacgcgttggagcaggcgacaccgtgcgcgtcctccagcaactgtggtgtgacggcaaggagtcggagccgcatcccctccggcacctgccctctggccccgccgacggccccctcaccctctccttttctatccacgagcgccctttcacccccgtcgtcgcacaccttgcattgtcctggcggtggcgagccaccgccatcgcgcgccgcagcagggtctcggcctgcgactggaaggcgcgctggatgacctcgaagcactccggcttgaggaccttgagccccgccgcgcgcatctgcttcacgcactcgttccccagccgccactcgctcagggtctggctggcggccaccgacgccaggccctgcgtccgctgcacttgtagacctgcatgaattggcgggcggcagggattgtcaggggcggcagcatggggtgtatccgcggtgcagacccggcgatggcgaggaggtgctcttcttgcagtgcacgcagcccagctcgggcaaaccccgttgtaggaagcagccccaggaaggcnnnnnnnnnnggtatccgtggtgcagacccggcgatggcaaggaggtgctcttcttgcagtacacctaggtgaaaggagaaggggtcccgagtgcatgcattccagctcgggcaagccccgttgtaggaagcagccccaggaaggcctgcacagagcctatgccacatacacacccggccacccactgctgcaccctagcagggcatcccgccacccaccagccatgagggtgtcagtctcctgctccatgtcaatgaaggcgtctgcgcccaggatctcgtcgatgtccccgtcgcgatccttcctgctggcagcacgggcacgcttcccttcacgttgaccgctacctccctcgccgtctgtggcacagggaggggtagaaatgtgcgattcagtgcgccacatccttaccctcaccacagcggtcacatccctgagcacacccgcgacaccgcatcctccgagcaatccatgaaaccggctggcgacgcagggtagccaggcattctgtgcccactcccgcaccccgcaccctccacctactcctgcctacccaggctcccacgcttggtgccgccggccttccgctgtgcacccggccccgccccgggttccctccgtgcaagcccctgctggggctgctgcgagcctgactgctgctggccnnnnnnnnnncatccatgaaaccgtcgggcgacgcaggggtagccaggcattctgtgcccactcctcccgcaccccgcccaccctccgcccactcccgcccaccctcnnnnnnnnnnggggtcgacgggcccgacgccggcggttgggtgcccaaggcgctgctgcccatccccgtggctgcccgggaagcccaccccagacacaggacccaccggcctgcccagggcaacccccggcacttcgccgcccnnnnnnnnnnagggttgacgggcccgacgccagcagctgggtgcccaaggcgctgctgcccatccccttggctgcccgggaagcccaccccagacacgggccccaccggccttcccagggcaacccccggcacttcgccgccctgcgaggccctctgaccctgaccgaggatgggcggtcgcccctgctgctgctgagggtagccgccgagcggttgctgcccgggctttgcctgctgcggctgctgcggatggccgggaggctgtgtcggaagcgggtgttggggtgctgcgctgggaggacgaccagagggcccagcgcccgcaccctcgccgccagtcccctgctgccagtgctgctgctgctgctgctgctgcttctgctgcgcggcagccgccagcgcggctgacttcttctctgccacatgctccacgcacttgtgcatgaagctgatcaggcggtcctcgggcagaaactctagcagcgcctccagcatcttgaagcccaccgcgacgtaggcttctgtggaggtggcggccgccgctttgagcttggggtagcgttgcacgaagatggcctccagccgcgccttggacccggagtcatacttgtgcagcgccccaaacagcatgtgccagtgggcaggtgagaacttggccaggaagggggccacagagcgactgagggtcctggagggagcctggccctgggctgctggggcaggatggggtgcaggtggggcggggggactctggcccccggcgggtgctgccgggtggaggggagccgcgtgagcctgggactggctgggagcggcagccgggtgtgggatgggtggagggatgtacggtgcgggcgcggggggagcggacgctgcgggaggtgcctgtgtcgtcggagcatggcagactgttcaacagaatgagacacttgcacagggattggaggggcaaagctggtaaatgctgccgatttgagcgtctaagctcgtgtttcttaccgannnnnnnnnnaagctcctccaagaggggcctggacaactcttcctatacgattgatgagtacgagatcctcattttcaacaatcgaggattctacgaaagcagggccccaggatgtgcatgtgaagccgttcattannnnnnnnnnccagggaatggaggggcaaagctggtaaaggcagccgagttgagcgtctaagctcgtgtttcttaccgagaaatcgccatccagagtgagcaggtcgcgcagaagttcgtcatccatggcttccgggagatgccagagctcctcaaagaggggcctggacaactcttcctatagaactgatgagtacgagatcctcatttttaacaattgaggaatctacgaaagcagtgtcccaggatgtgcatgtgaagccgttcattaccacccatgctgcaggactcgccgctcttttatgatggctatgagcgaagtgagaacagatcaatcaagaactatggcacccaagcctctgaaccttcactgttactacatcaacaccattctatagttttgaaggcgtagcttcaaaaacattctgattagagtggggtggaggaggttggaagtacagtgataccttgcacccttcactccggctnnnnnnnnnngtagttttgaaggcgtagcttcaaaaacattatgattagagtggggtgcataaggttgggagtgcagtgataccttgcacccttcactccggcttcttttcaaagctccacctcaaggctcaccttgcttctcaagatgtcacaccttccatgaacatacctgaggtgctgaaattacctcatcggcgcagggtgtcttgctctgcctgatttcaggnnnnnnnnnntcctgcttctcaagatgtcacacctcccatgacatacctgaggtgctgaaactacgtcatcggggcagggtgtcttgctctgcctgatttcaggatagctccttcctgctttcctgcattcctgcaggtggccatttcgaacaggcctagtggcacaagatcacgaatatcgagggatgtgttcagcaaacttgtgcgtcactctgctacgcatgcatttctgaagggaaaaacttgcacaaatcgagatggccgatcgaaggatcggtttgcgaccctcctcaggcnnnnnnnnnngggggccatttcgaacaggcctaggagcacaagatcacgaatatcgagggatgtgttcagcaaacttgtgcgtcacactgctacgcatgcatttatgaagggaaacaacttgcacaaaccgagatggccgaccgaaggatcggtttgcgaccctcctcaggcnnnnnnnnnncggcatttagaccctatgggcagcctgtaggttctcgaaagatcatcttcgtcttctcctcgcattctggacgctgnnnnnnnnnntggcatttagaccccatgggcagcctgtaagttctcgaaagatcagcttcgtcttctcctcgcattctggacgctgggataccagcgagagaggatcccacctgcactttgcggccctaccacctccgcgacagaatgggtaagcaagtgcagcatgagccccagccatgcagtcacatgttcttccctctatgtccaccagagccttcacccatcaccagattgatgctcagggatgcagcacgggtcgtgtccccgcgccccatggctgtgatgggaagctgcctggcagttatgggcgcgttgctcaatcccagggcagtcttgccagcggtactggttgcccttgtcgcttatgcctcggggcagaactttgagaggcgccgcctgcgggttttgcagcggcaacagagtgcagccctgccgcagactccttcctacctctctcgccagctggcagtagcaatggagcaatcgggggctgtggtaagtcagtgtgttaaggagcggtgtggcccaggccagcttgtggcggtcagtcgaaagannnnnnnnnngatcgggggccgtggtgagtcagtgtgttaaggagcggtgtggcacaggccagcttgtggcggtcagtcgaaagactcagggtgctcagctacaggcagactaccaggtgggcaccattctttggagtggtgcaatgcaacaagggctcagacatgggttgcccctcgagcaggcggcaaaggtggggtggctgaacccaaacccatttgaagattccaaccgagtaggttgaattttgcaactacatcccacgaaccatgaagtcctcggtccagcactcagctgaacnnnnnnnnnnctttgaaaattccaaccgagtagatacaagttggcatctacatcccacgaaccgtgaagtcctcggtccagcactcagctgaacaccccccaccccccttcacaccttcctccacacagatgcttcactctgcagtgtgcacagcgctcggtgccttgggctcccaccccagtcccagtgcctcgcccttggagctcgctcgcatgctcggcgagctgggttcagagcatgcaatccgcaccctgcgcctggaggccgccgcctccgcggcagaggctcgccgggctcgccaggcggagcgcgcgatgcaggtggagctggcggccaagcgggaccaggaggagaggctgagggtgttgcatgaggaagcgtacgctgagctggcacaggggcgacagnnnnnnnnnnnnnnnnnnnnnnnnnnnnnnnnnnnnnnnnnnnnnnnnnnnnnnnnnnnnnnnnnnnnnnnnnnnnnnnnnnncaaggaagtgtgtggcgcggtactatgtccctgctccattccaacataaaggaaagtgcgtgctgaggcagcctgctnnnnnnnnnnacgccaggcggagcgcgcgatgcaagtggagctggcggccaagcgggaccgggcggagaggctgaggatgatgcatgaggaggcgtacgctgagctggcacaggggcgacaggaggcggagcgccagctggacatgtatgacgaggtgagacccatgccgagggctggcgaaaaggaagggtgtggtgcggtactatgtccctgctccattccaacagaaaggaaagtgcgtgctgaggcagcctgcttgcaatcgagtagctctttgcacctgcttcaggaaggcatgtcgccacatgctcatggctgcagaggctggcatgctccgtatccacctaatccactcatactccccaatcccgatcagatggtggagcgtttggaagacagggtggagacactagaaaatgaacgtcttgagctgggcgcctacctgcaggagacgggccagctggatggtgaagcggagggtgacacatgaacagcacggtctgtgatcctcgtcccccggcctgcttgtggcaaaggccgccgccgacnnnnnnnnnntacctaatccactcatactccacaatcccgatcagatggtggagcgtctggaagaaagggtggagacactagaaaatgaacgtcttgagctgggcgcctacctgcaggagacgggccagctggatggtgaagtggaggccgacacatgaaaagcacggtctgtgatcctcgtcccctggcctgcttgtggcaaaggccgccgccgacagcagggtgaaagcgagacccttcaaagtcttcgctgcgtgaatctatatccccaggaaggaatctaccctcggcctcgatccccccagcccaaacgcacatgcactttggtcacccccaccaattccaggcgcacagaatgcatccggtgaagacctcctcnnnnnnnnnntgcgagacctttcaaagtcttcgctgcgtgaatccatatccccaggaaggaatctaccctcggccacaacccccccagcccaaacgcacatgcacgttggtcacccccactgattccaggtgcacagaatgcatccggtgaagacctcctctccctgcaaccctcatcacaggcacttgtttgtaatccgagtcacagtttgtgcagtgcatcgtctggtcggtcagtggtgagtgagcactctccagtctgcaacttgactccccctttcctaagacccctcctcaggcagcctggtgcaacatcaccgccacagcgtaggctgccatggaggacaccactcccagcgctgcttccgcccccacgctcttcagcaccggggcccaaccggtcctaccctcgagggcccggcgcttgcccgggggccctgcggcgcctccctcgccctctccctcctcctcggggtctgccgcggccgccgacggctccacctcggcactctgcgaccgggcatccgctccatcctcccgctcgtcgtcggcgacgcgtggctcggccggcgcgagtgcgctgcggcgcttgcggcccccgacgctggcggtggcggccagggcccgtgccgactcggccgctgtgcgccgcgtgctctgccggctgcgggtgctgcgccgcaggacactgtgtgccgcgtcggggctcacgggggtcagccacttctgcacctcctccatggggaagaagaactcatccggagagtctgcaggcgtggtgcagggagaactgagagtgggaagcctgccctggcagcggcacgtcgaagaagcctcggcaggatccctgctggacgctgggagcatttttgcatggaccagttgccccaccatttcacgcaagcacccctacatgcaggggctgcacatggagtttacctcccggtccaccagatcacctttgatgcggacaaagacgctgtttgggtctgggatggagatgccagtcacggaggccgaccaggctgtcttgcctttgggaagcttatcccgaggaaacacccatgccgggatctacacggtgcgtgtaagttatctaactcggtacatgtgaatctgtttggagcaaattcgcaagtactatttcccttcgctgcacgacctcacctccagtgcccgtcccacgagttccgccgtggtgtccactccttccgcccccctcgctgcgggacttgattttgtcatgatggcagatttctagataggcaggcactttcggagggagggtttggccagaattgagttgtggtaacatactccatgatggagatggacgcatttaaatccgaaacgacgactgcagggcgcgcaaccaatgggcaggcatataccttgatcacaagtgtctgggattgtccgtccctacatttattgcttgtgaacacctttggaatgcacaactagagctcagcggtttgcaagtcttgacgatggtatgggtgatatgctgggcccagcctctaaatgtcctcagggtccttttcaaagcactctgttaaatgtacaggcttatatacatgtgccatggcagctgggtactgatgattaaagctgtgacctggtgcaggacattttactttttattgaaacggcatgtcttgcttactactcatgtatgtatgcgcaaggaaggcaaaaggagtctgtatgacaagatcatcagacacactggtgctagactgggaaatcaccattcgaggcggtgtcagtcgattcgcagtggtgcatattgagaagaatgccctgggagccgtcgagttgacgatacgctccccggccccagcatgcttttcagcgagcgcgcaagaagtgctcgctctgtatttgcaagtcaccgacgaatagtaaatcaccgtctccttaagttactatactacagtaataagtcagacgaaacnnnnnnnnnngttgaggagaatgccctgggagccgtcgagctgacgatacgctccccggccccagcatgcccttcagcgagcgcgcaagaagtgctcgctctatatatgcaagtcaccgacgagtagtaaatcaccgtctccttaagtaactatactacagtaataagtcagacgaaactgcacagtagaccagataagccagcctcagcacaaggctataccgggatgtccaagaagaacaacttgacgaccagacaaaacgcgcacaagtttgcgctagaacgtatgtttaggtcaaatggtagaccttttgcatataagagggccctgttgatgacctcataatgctgctgcgtaccttcagattgctgtgccacaattcaagtaacggtggcacacggtgtgtgcgctgtagtatcagccgagcaaaagtacacggtcaagcactgcctttccactccatgcacacttgcaggtgagaaagccgaacgcgagaagcgggagaagaagaaggagaaggttgtgacaaaggcacagaaggcacctgtggagggcaaggccatcgccaagaagagcaagttcaagggcgtccgcatcaagcgcaaccgcaccatccgcggcatcaagatcaagtgagtgcacaagactggttagtagtgcagaggattttgctgcggtaggctttcacccctaagatgtatatgtctatgcactagcatgtgtacagtggacaccgctggggaattgctgaccttnnnnnnnnnngcagtattgcagagtatgttgctgcggtaggctctcacccctaagatgtatatgtctatgcgctcgcatgtgtatagtggacaccgctggggaattgctgaccttgtcgacccgcactttatccatctcagggatgcagagagcaggcagaaggtgcgggaggtgttggcggcagagcaggcaatgaaggagatggcagttgacgaggagccggtggtcaggagaaagtcgccagcaaagaagaagaagaaggccaagaggatacctgctgatgccatgcagttggactgatatgtgcttttagactgtcagtgcgtattttcaagccccaacacccttgttatgtagaattcttacagcaagcttggaagcaggtggcctcaccaggtcccttggctggtacagggggcaagtcatgcacagaatcgtcaggctgatacagagtgctcagcatgcgcagggctcctctggccctggaagagccgcattgcacgcggaagggtagcaggaggcacggtgtgtacttgggtctgagagatattcgttgaaaagtcnnnnnnnnnnaaagagtcgcatcgcaggcggaagggtagcaggaggcacggtgtgtagttgggtctgagagatattcgttgaaaagtccatgagcgagagggacatgaagaaaccagatggtgctggtgcctcacagcctcagcttcttacgagtctggtcggccccggggctccagtcgtcatccccatcggtggcatccccatcctcaccctctgactcaggatctgaggcctgcgcggtggcgacctgtgccaataatggagggattggtcgggtgctgactgcgtgatgcttgtgaggggccaatgactaggagtttggacgcccattctagtggcactggcaccaggctctagacccacccacccttgccagggaccgcttgatccgggagctcgtgcggaggacagtggtctggggcgtgatgctggcgcccctcgcgcccctgctcttgccccgcgtgctcattggctcagcatcgacatcctctgcgaggttgggaggaggggggaacaggatgtgcaggcacgacaccagaacaggttaaaacgcgagtgctccttgaatctacatcagaggatctcgagtgagcaacaagctacaggagttcatcgaccgtggagagtttgtgataccagctcttggctctccacacccaccacctccccatgctcacctgtgctgtcttcaggggaaggggtgtgattctctttccctttgccgaccccacccatgccggtcctcctccgcttgccgacgccgcccgctgtcttctgcccagtgccgtgctctgcgggggtgctcgcctgaatgacaggggcaccatcctcccccagcgcctcctcaaatgcctgtgcggtagacattgaagacttggaggtggcccccccgggggaatgatatggctgggccccctcagcccactccccacccactgcatcccctcacctgcaaggcagcggccggatcctgcgcctgtcccgacgccatgtctccaaagtgctcgggcgcgagcgctcgagtgtccggcgcgcagctgggggatacctggatnnnnnnnnnnagacgccatgtctccaaagtgctctggcgcaagcgctcgagcgtccggcgcgcagctgggggatacctggatcctctcctcctgcctcctccgctcacctggaagtagggagtggggttgtggcacacgctttcctccctgggcagcgagcagcatcggcagctgcagggtggcatccctggccagggagtgcgtcccaggtcccagacggccctccctcgccgttgccgggcatgcaggaagccacggcgtccgacaatgcacgtccatcaccagacgaggcgtaggcggcgatgcggtcgtcgctgatggcgtaggcgccctgcaggtagttcttcagccggagcagcagggccagggcgagcaagggcgcggtgctgggcgtaggaccgcccggggcctgtgatccccgcgccagggcctcccgcagctcccaggccgcctcctcgccgcgggcagagagcacgccggatacctctgccagcagcgcacaggcctcgtcccccctccgcagccgcaggtgggcgagcgtgagggcgaggaagggcagttccaatgtgtggccggttgaggcagggggagcggcagcgtcgggcggcggtacgcatgggacgctggcagccgtccggaagcggcgcaccgccacctacattcccaaggggaaggggggttgtgtgacttggtgtcgagggaatgctaccccaagacatgggaacgcgacaggagaaggggaggcctcttcatgcgcctgatctctccgtccctccaatcccagccctgtgccagagctcccccaccttgaaaaagtcggtgcagagcttggggtggggtcggatgnnnnnnnnnnacgacaggagaaggggaggcctcttcgtgcgcctgatctctccgaccctccgatcccggccctgtgccagagctcccccaccttgaagaaatcggtgcagagcttggggtggggtcggatggccagctcgtacagctcagccagcgaggcaaagaggccgctcctctccaggagacgcacctgccgcagggtgccccgaggacggagggggatggtcgcagggtgtcctctggcattcggcgcccatgcctttcggccctctgcaagatgcacactctgccctgtcacaggccggcacgttcaggggcctcaggccccagccctgcacaaaccaggccctcgctccccatccacccccgagccctgccctcaccccgtgcccggcgtccgcggtagcaaggaaagcgggagcggcctggatgccctgcaccaggcgctcggcgccgacgtaggcggcgtggcgggccaccagcgaccccagcagggccacggcgcgtgcggcgttctccgctccagggtcgcaggccagggtgcccagggcctgcaccgccgtccagggcccaaccagcccctccctgatggtgggtgtgtgagattgcagccgtggacacaggaggaacccgatgctccggtgtgccctgtgatttccaggatccaaccgaaagggaggaagggcaccgccggcgccacgttgccccctccccccccccgagcacctgagcacggcctccatgacgtccagggcacgggcgcgcactgcctcggcctcctccgcgccgctctccagcgcccgtgccagcaccaggtcccagtggtcctgcggggccggcgggggacgggtgggcgccgcaatcgggtgcagggcacgggccccagagtgacgcagccccgctgccgcccacctgaacgatgctgccgacgtgggacagggcgtcgccggtgccgttgnnnnnnnnnngatcgggcacagggcacgggcccagagtgacgcagccccgctgccgcacacctgaacgatgctgccaacgtgggacagggcgtcgccggtgccgttgcacgtcggcacgctgcccaccgccaccgctcctgggcgctcgcccgctgtcctcgtcgccccctcggggtgcagtaggtctgcgaggttggacagggcccgcagcttcagggcagccgccgcgtcgtccgccagagctgcatgatgcggagcagcagtgggggtagcgtggagcatggcgcggcgctcggtcgaccacgaacgggagctgctggagctcggggcgggcgttccaggctgcaaacgacgagggcaggcctttgcaggccacgnnnnnnnnnnacacgaacaggaactgctcgagctcggggcgggcgtttcaggctgcgaacgacgagggcaggcctttgcaggccacggatgccgacccccgtgcgccgcaaggccgcagtctggcgctcggtgacccgtgccgaggccagccggcccaccccagcaccagctcatccgaagctggctccgcaaccccatgcacaccgccccttcccacccccacatgagccctcgcctcaccctgcttcatggccacattgggcggcgcccccgtgcccagcatgatgccgggccgggcgagcacgaggccgcccagcgcctgcagcgcagactcctgctccgtgggcgtcgcctgtggggtgtccaggcacagtctacttcacgccgtgaaggtaccggccagtgggtcggtgctcacgtcaggccaccgcagttgcaccaccgcgccattccccagcacgccagggattctcgtcctttgcttgcactcctcatgatcccatcgacatccgttcnnnnnnnnnncgtctgcttcacgccgtgcaggtaccggccagtgggtcggtgctcgcgtcaggccaccgcagttgcaccaccgctccattccccagcacaccagggatctcgtcctttgctttcactcctcatgatcccatcgacatccgttctgtcgaggatgtgcgccccgaagtggcgccccacccctgcacctccccccccccaacacaactctgcacctttccacccccaccacacctctgctcggtggtagtggcgcaggatgatgccctgcacggccggcacggagagggtcacgccagcagtcacagcgcgccggccctcgtccagcaccgctcccccgccgtgccggcacagctggcccaggatgaagaggaagcgggagaggtgcgggcgctggggcccctcccggtcggggtcctggagccaggtggcgtacaccccggccagctgcgccacggccgccgcggcgggcggggcagaccgggacagcgcgcacagcgtgcgacacgccgcgcccaccacctgcgaggacgcggcggggggggctggacaggtgcggggctcggtgcatggagagggggctgtgtgatctgcgtggcggctggtccgagaccccacccacacacccgtcgcagagctccgccgcccgcatccctccggcgcccgccaccccctccgccacccctttcggtacccttttcgccaccctttccggtacctggacaaaggggtgcttgttgannnnnnnnnntgggggggttggggggtccgaggtgcgagaatcagggcatgtgtgctgtgctgcagcgacgcgcaggatnnnnnnnnnnacccgccaccccctccgccacccttttcggtacccttttgcccacccttcccggtacctggacaaaggggtgcttgttgaccagggacgccagcgtctccaccagccccgcgccctgggcgagcagcgtggcgggccccagcgcctccaccaggctgtgcaccagcgccagcagcgccagcaggtagtcggcgtgcagccggtccccggcgcctgggtggggcgttggggagggggggttgggggggtcaaggggtgcgagaatcagggcgtgtgtgctgtgctgcagcgacgcgcaggattaaacgtgccccattccatcgcatggcggttgtcatcacagacgcaagggtgaccggctcgcaaaacgcagaacaaacaccaaccatgtcgccgtgttcccatgcacctgcagagccggcgccccggaggtagggcgccaggctggccagcatggagccgggccggtctggcgggaggcagaggtccggcgagaccctggccagcgcgtggagggccagcagggggcccagcgcgccggcgtgtgcggccggctcctccccctcgtgcgccgcgatgacctggcccaggagggccccggccatggcgcagcccgccgagtggcgtgcctggaggagaagagcggggttcgggggaggggccagggtggagcgcaagggcctgcatcgtcaccccgccctgcagcagcctctcgagctcgcatgcccctgcaccccctgccccaggccggcatgcactctccccggaccccctctcggccccaccaggcacacctgtgcatctctgcccggaccaccgtgctcgagggcggcccgcagcaccacgaccagcgggtggccgagctccagcggcaggtgaaaggcgcggccggcgccccgcctcatgctcgcggccagggccgccaggagggaggcccggacacccaagctggcgccggcctgcgcccgcccggcgcccagcggcggcgctccctggagggagtctgggggctgctctcctgggggcagtcctgtgcctgagcctcgcacggtggaggacagggaggactcagagtccgacagtcgacgtgcgcggcgtcgaggagcgcaggctgggtagcactgtctgggtgtggcacaggccccagggctcccatggtgcagccggcacgccccggcacgcaggtctcggaacannnnnnnnnnactgggaagcactgactgggtgtggcacaggccccagggcgcccatggtgcagctggcacgccccggcacgcaggtctcggaacacaagactcccactgccgtccctcacacgccctccttcccccacccccaccctctcccacgcctttccataccccggcccacctgccggcgccggcgcgccgtcggcaaaccagagggcgtggaaggtgcgcgccaccacgtcccgcacgctggcctcggcgtccccggcccgcagcaggatgtggcgcgccgtctccatcgcgcgcgggctggcggggtccggcagcaggaagcagtcggccagggccctgatgcccaccttcctcaccgacacgcccacgtctgcaggcccggcatgggtggcaagggtgtgtgtgtgtggggggggggagggcagacaacaccgccagggtctggctgattctgatcaactacgtggcggcccgccgggctggcagacccctgcacctcactccctcctccacccccccccaaaaaaacaacacaaacaagcgcacccttggaggcgcggaccagggcgtcgtagtactccagcgccaggtcctcgctctgtcgggcgtgcggcagcagaaggttgagccccgcctcacgcaccgacaccgcctcgtcctgcgggagtgaggttggcgatggggggggattgattgcgctgggggtggggggggggggggggggg

SEQ ID NO: 43613 - DNA, 73 bp, Chlorella protothecoides
cacctcggcatagcgttgcatccagggcggcgttgacgcagttgtgagcaggccgggactgggcggcggcggg

SEQ ID NO: 43614 - DNA, 121 bp, Chlorella protothecoides
ccgcgggggaggccgccagctcggcccggaccgcctcggcgctcagcgcctccggcacctcggctgcgcggaacgagggagaaaggtggtcgggatcgagtcggcccttcctgcatgcaca

SEQ ID NO: 43615 - DNA, 23812 bp, Chlorella protothecoides
  modified_base (141)..(179): a, c, t, g, unknown or other
  modified_base (491)..(500): a, c, t, g, unknown or other
  modified_base (1182)..(1191): a, c, t, g, unknown or other
  modified_base (1638)..(1647): a, c, t, g, unknown or other
  modified_base (2260)..(2269): a, c, t, g, unknown or other
  modified_base (2948)..(2957): a, c, t, g, unknown or other
  modified_base (3236)..(3245): a, c, t, g, unknown or other
  modified_base (3636)..(3645): a, c, t, g, unknown or other
  modified_base (3901)..(3910): a, c, t, g, unknown or other
  modified_base (5331)..(5340): a, c, t, g, unknown or other
  modified_base (6762)..(6771): a, c, t, g, unknown or other
  modified_base (7639)..(7648): a, c, t, g, unknown or other
  modified_base (7871)..(7880): a, c, t, g, unknown or other
  modified_base (8131)..(8140): a, c, t, g, unknown or other
  modified_base (8581)..(8590): a, c, t, g, unknown or other
  modified_base (9262)..(9271): a, c, t, g, unknown or other
  modified_base (10029)..(10038): a, c, t, g, unknown or other
  modified_base (10269)..(10278): a, c, t, g, unknown or other
  modified_base (11061)..(11070): a, c, t, g, unknown or other
  modified_base (12196)..(12205): a, c, t, g, unknown or other
  modified_base (12711)..(12720): a, c, t, g, unknown or other
  modified_base (13701)..(13744): a, c, t, g, unknown or other
  modified_base (13960)..(13969): a, c, t, g, unknown or other
  modified_base (14860)..(14869): a, c, t, g, unknown or other
  modified_base (15387)..(15396): a, c, t, g, unknown or other
  modified_base (17169)..(17231): a, c, t, g, unknown or other
  modified_base (17833)..(17842): a, c, t, g, unknown or other
  modified_base (18594)..(18603): a, c, t, g, unknown or other
  modified_base (19414)..(19423): a, c, t, g, unknown or other
  modified_base (20185)..(20194): a, c, t, g, unknown or other
  modified_base (21437)..(21446): a, c, t, g, unknown or other
  modified_base (22170)..(22179): a, c, t, g, unknown or other
  modified_base (22973)..(22982): a, c, t, g, unknown or other
  modified_base (23270)..(23279): a, c, t, g, unknown or other
gcgcgggctggaggagctggcgggggcctaccgctcccgcgcgcgcgcgctgggctccgagcgtctctcgctgcgcgagcgcgcggccaacctggcgacggccgcgggcgaccggcgggaggagggggcggccgggccggnnnnnnnnnnnnnnnnnnnnnnnnnnnnnnnnnnnnnnnaggcggcccaggaggggctcaaggacgcgctggcggcgctggtggaggcggaggggcgccaggtggcggagctgcaggccgaggtcgcggcgctgcgagggaagggcggctccaccctggccgccagcgaggaggacctgcgcgagctccaggcccgctacgaggacgacgtcaggtggggggcattggggggtgcgatgtggtggtcccatgttctggcaaaggggtggcatcattggagaaccgatggtctcatgagagggatggctgacggagcaagcatgtgggaaagatgtttcggctggatgtggnnnnnnnnnnccgttgggggtgtgcgatgtggaggtcccatgttctggcaaaggggtggcattgctggggaaccgatggtctcatgagggggacggctgacggagcaagtatgtgggaaagatgtttcggctggatgtgggggggtggctgggagcacgtgggacacatgaagggtcgggctgggcaggatggtacctggcctgtatcggggtgaggcaccctgcactgtgttgaagggcatgcgcctccgtcagaggtgtcgagcatgcgcacggtcctgatgacggacacacgtcgcaccactgggccaccaaggcttcgaggcaggcaccctctcaatcagttcttcacccaacaccaatccctcttcctccctcccaacaccatcctgacagggccatggaggcgcagaacgcggcgctgcaccgggacctggcggcggctctggagcacgtgctgcaccataaactgcacgtccaggtgaggtgcagggtgttggtgtttgtgcgtagtgtgatgaaaggaggttgcaaggggcgaccgagggggggttaacgggtccagagcgatcacatgcacgagcagctgcctggagaaggcccagggaattcatattccgtgttgcagaccgtctcctgcgccctcaccggcctcggtactgaccctgctccctgccacacatcccccaggnnnnnnnnnncagtgtgatgcaagggggttgcaaggggtgaccgagggggggttgcgggtccagggcgatcacatgcacgagcagctgcctggagaaggcccagggagttcatactccgtgttgcagaccgtctcctgcgccctcgaccggccttggaccctgctccctgccacacatcccccaggacaagctgaagggcgcgggggtgcgcctgcgccgcgtcctggaggagtgcagggcgtgcaaggtctgcgcgtgactggatagattgcaccgcacattcagaggccgcgtcgccgatctaccaatagtgtgggggcgaataatccgaccgccctcctcgccgacggcgtggctggtgaccaggaacgcgcacctctcatgcgcatcccccgtgtgcacgctctgagagcctcgtgccggaaactcggtgcctccccaccgcccactcagcgnnnnnnnnnnctcgcatgcgcatctcccgtgtgcacgctctgagcgcctcgtgccggagactcggtgcctccccaccgcccactcagcgccaccccgatgcagcacaccaccccatcacatgtggttgctggcggtcacccgcggggccgacatgccttgccagcattgcaattgccatgctatctccatccctgtatgtaatactcgacatgactgttgaatccgatgggagtttcttcccgtgctagccctctgtccatgcaccggagtgcgacaacagtgctgaagttgatcggtccatcatgcccctcgcacaccccctcgcgcatggtgcgatgggtgagagcgcattcacgaggcgtgcagggagccatggacctcggtacttgacaccctaagaatcaaattctcactgaaatctagcgatgagtactccatcggtgatgtatgctgcgcttccacacgtccgcagcttccgcctgctgtgctcagaattagggcttggagcagctccgaaccacacggcgggtgcggacggtgccacccccgcgatctgggagctacgacacgaaccaggtcttaatccaacaggatacaaatacccgccaaagatggtattagnnnnnnnnnntccataagaatcaaattctcattgaactttagcgatgagtacttcatcggcgatgtatgctgcgcttctacacgtccgcagcttccgcctgctgtgcgcatagttagggcttggagcagctccgaaccacatggtggttgcggacggtgccacccccgcgatctgggagctgcgacaagaaccaggtcttgatccaacatgatacaaatacccgccaaagatggtattagatcactttctgaaaattgaagtaccatactgctgtgattcctgtatcgattcccggcaggtctttcatcgacccgtaaagctgcaaacgcccggtcgtgcgctgccatggcggcgacgaacgcaactgggctggaacaacgcgaggagcttcattattggcaactaaaactatggtgagcggggttgcaacaggactcggggagcgcgaggaggtcactgaatttaaatgacacagcgtgatcagcactgacacgcccggcgtcaatacccccttccaggcagcagcaacaccggcagttacaacaccgggtagagcaacaccggggacaacctcgtctgtaaccgcctcgagacgggagagacctgccagctgtctgtgctttccacctcagacaccctcacccttgcagcccctctccctcccagcccaccgccaagaccccccctnnnnnnnnnnggagacctgccagctgtctgtgcttccacctcagacaccctaacccttgcagcccctccccctcccagcccaccgccaagacccccccttccctgtcagcccggccccctccccagccaaccccgtcaccgccccagggaacccctggcccgccccggcgggcccctcgccagccccggcgagtccctcccttgccccagtgagcctccgcgcccacaccccagggacccctccgcctacctcagggagcccgtcccctgccccagggaccccatcacnnnnnnnnnncgccccagggagcccccgcacccacaccccagggagccccccgcctacctcagggggcccgtcccctgccccagggaccccatcaccctctccagacagcccttccccttccccaaacccctcaccagcgagcctaccaccacccactgcaagtccatcacctcccaccgcaacccctccacctccatctcacgttcacactcctccaccgcccccaaaggtgaaccctgcaagggtcccccctcctccaaaacacaccaatccacctcccaggaaggtttcgccccctccccaaaggaaattctcgccgccacctccggccaaggagccatcactccccacaaagaaggtgtcgccaccgcctactaagaagaagttgccaccacccacnnnnnnnnnnccactccccacaaagaagtcagcgccactgcctactaagaagaagttgccaccacccaccaagaaatcgcctcctcgcacaaagaggaactcaccatcccctgtcatgaaggagtcgccgccccctgtcaagaagaagtcaccgcctcccaccaagaagaagtcaccgcctcccaccaagatgataaatccttcactcactcccacagcattcaaaacatgcggcccgctgttgccatgcatacgtgtttacaacnnnnnnnnnnacaagatgataaattcttccctcactcccacagcattctaaacatgaggaccgctgttgccatgcatacgtgtttacaaccctatcctgtttctcagtacgatgtaaacctatttttctagttggttattattccaatgccatcagacaaggtttgagagcgtttgcgaagagggagcgcagcctggcggtgacaggcagatcgctggaggcttgcatcagttccttgccagcgctcccggacgttgtcggttcgccaccctccacacccgcccatgcacatcaaatctctgttaccccaggtccgtccgcccgcctgtgcagcctgacccgtacctcctccggccgcagggtgatgcgcgcccgcgccgcaggcgggcgcgcccctccctccggctccagcctgaacctggcgagcagcatgctcagcaccagcggcacctccagcatggcaaaccccgtgccgatgcagacgcgcggccccgcgccaaagggcacgtagctccccgccgcaccctggtctgagagaagcgcggtggcgctccctgcggcgcacagggcctccgcccaccgcccggggacgaaggccgccggccggccatggccctgcggaggcaaggccgcaccgcctgtccctgcattcatgttcgtgcgagcttccgcctcgctgcctcgacccgcgcgccagaccgccgggtcgcggtgcagcaaatacgtcgccaggaggacggtggtcccgcgcggcaggcggtactgcgccaggtcggcgtcgcgcgccgcgcagcggcccaccatgtaggccggggggtgcaggcgcatggcctccagcgccgcctccgtggcacgcgggaggggcgcggcggcgagaccaggggcggggggcgcggcggcggagtccgaggtgtggtggcgcgcagcagcaatcgcctcggctgccaccacctcctgggcatgggggtgtccggccagctgggcgcaggtccaccccagggcgatggcgctggtctcctgccccgccaccatcagcgtcatcagctcgtcgcgcagggcgcggtcacccatggcggccggcgggccgtccccctcctgcgcccgcgcgctcagcatggcgtccagcaggcaggggcggggtggcgccggctccgcagccaggtaccttggacagtgtaattcggggggcaggatggtgaggtgtttgtgtgtgatgggggcgctgtccgacgctgcagaccgtcgttggttcgggctgactcagatgtccagaggcatggcccaggacgtccacctaacaaccttgcagtcacctcccccactcacacacacacacccaaaagacacacaccccttcctacactcactcccgcctccgcgcgatgaggccatacaccgcctcgtccagccgttccacggcgcgcgccagtnnnnnnnnnngacacacaccccctcctacactcactcccgccgccgcgcaatgaggccatacaccgcatcgtccagccgttccacggcgcgcgccagtgctgcgttccccggcgtgggcaggtactctggcagcggcagcgccacgcgcgcggagaactggtcgaaggcctcctggatggcagccgtgacccccgccgcgcgctcgccctccagcgccgagccaaacagcgcctccagcgcaatgtccagggtcaggcggttgagcgcggggtagaggtccagggccgcaccgtcgtctcccgccgccgccacggcggcgtcaagctcgcgcagcgtgcgcagcgtgcagcgcgccatgctgcccgcgtaggcggccaccgccgcggcgcggaaagcgggcgtgcacagctggcgctggcggcgccaggtggcgccgtcgctgaccagcagcccgtcccctgtcaggctggagccggggaagaaggcggtgccggacttgacccaggtgtcggaccggtcctgcagcacgtcacgcgcggcggcggggtcggagaccagcaccacgcgcgacccggccagggtcaggcccaccaccgggccgtggtcccgcgccacatcggtcaggaaggccagcggatcgctgagcaggcgcagcgcgcagtcgccgccggggcctgtgaggcgaggtgggtgaggcaggtgggtgtgcaagggtgggtgggtggagaaggcgggcctcgaggagcacgaagacgttctctgggtacagagaaaggggggccatggggcagcatacaagtgtcccagcaagtaaagtggcgcagctcgttgcagagagcacaacgttaccattatcctggcagcagtgcagcgccgcctctcagtccctcgcacctggtggaaagcccggcggcgcgggggtcatcatggtctggaggcgagataacccggcgcccaggaagctgcccagatcagggccggtcctcgcgctggatgccctgacttgtatggcggttgctgcagaccggcgcagtattcctgccctgtaattgggtccatgcctgggccccgcttcgggcatgccacaggtgtgcatcatgcggtgggaggagcccaaagcacaggagcaaaggctggccattttatgccacgggatgggaataccagttgagcacccagatcctgggcagccaaggctggacgcgggttcaagatctcttggaagtgtgcgcggccatgaattcgccgatccgaccagcgagaggcttctctaccgtgcatgcatgggcatgggtggggcgcagatgccttcgggatcacacatcagcaccgcagcaaacatgaaacaagcaagtcatggaacgagccggcgcagtgaccccgtgtatgggacgaataaggactcgccatcgaccggacaacgctgtcgtnnnnnnnnnncacaagcaaatcatggaacgagcgggcgcagtgactccgtgcatgggacgagtcaagactcgccatcgaccggacaacgctgtcgtgcatgaaacccatgctgcactgctggatcgaatctgggtggggttccgcctttcctcgggcgtgcatcagacatgcatcggtccatcctgccaggccacattctcgatcccgctacctgcagagctcctgtgaaaaaccagtatttcagtgcgcatcacattgcgaggaagtgagcaccccgagcgaaaacaatcagccatggcatcctgcagcatgtcccgtctcgcactcgccacccccgtggccacttcccgatcgaccccccgcatgcgtgcctatggcggcaccccgctgctcaagcccgccttcagccccaatgtcagccctttcaaggccaccaggacgatgaaggtatgatgtgagcggtcctgccatcccacccgtgacgtgtgcaatcaagtactggcacgtgagcgatatgtgggggccagccgggtgccttgcatgcatgcatgggcagcatgccgaccgacagacccgcccatgccccgtcatgcagaccaggaaggcgaccttcacggtggaagcggccaagaagtctgtcagcgatctgtccaaatccgatctggagggcaaagtggtctttgtccgcgccgacctgaacgtgagcggctggccagccatggcgcggggatattatggactatgtggaatcttacacttctcagagatggaatgtggccacgtgtgatgcttaaatggccgtccaggcatcatgtggacattcggtattgagacatctgcatgttatgtcgctggtacacccactccctggcacgcnnnnnnnnnnggcggggatatcatggactatgtggaatcttacagttctcagagatagaatgtggccacgtgtggtgcttaagtggccgtccaggcatcatgtggacattcgatgttgagacatctgcatgttgtgtcgctggtacacccactccctggcacgcgccgacacccaaggcccacctacccacccgcccgtccccctctcccctgcaggttcccctggacggcannnnnnnnnnggatacccaaggcccacctacccacccgtccgtcctcctctcccctgcaggttcccctggacggcacgcaaaacatcacggatgacacccgcatccgggccgcagtacctaccctggagtacctcatcaagaacggggcgaggatcctgctggcctcccacctggtgcggcagggttgggtagggttatgggcttgagtataaaaggcatgatctgggcataacgttctcgctgagattcttgcaccttgnnnnnnnnnnatatgggcttgagcaaaccaatgcatgatctgggcgtaacgttctcgctgagattcttgcaccttgatgcctgggcgttgccaggcactgcgagtgtccgtggcactcgtctgacttctcctccctctcctccactttgcagggccgccccaagaacgggcctgaggacaagttcaggctgacccccatcgccccgcgcctgtcccagctgctggggatcacggtgatcaaggcagatgactccattgggagcgaggtggagaccaaggtcaaggacctgaagaatggccaggtagggaagctgtggctgggatgttggtgtgaggatgggacaagagggggggtaatagagaggacctgcctggacttcccaattcgaccagtgaccctctttcgcccttcatatttttgaaggttctcctgctggagaacgtccgcttnnnnnnnnnngtggtgtgaggaagggacaaggagggggttgatagggaggacctgcctgcacttcgcaattcgaccagtgaccctctttcgcccttaatcctctggaaggttctcctgctggagaacgtccgcttctacaaggaggaggagaagaacgatccgggccatgccaaggaggtgggcagtctgggtgaatcgtgggggcctgggatcaccttttcttgtcaaaaatggggtccactgcaatcggcaatcaggccctaagctgtggtagcagcgcttttacataaaaccttgcaatcctatgtccggctctcttatgctccttcccccttgtaaccgatcaatcacctgcacagctggccaaattcgccgacgtgttcgtcaacgatgcctttgggacggcgcaccgcgcgcactcctccaccgagggggtcaccaagcacgtcaaggagtctgtggctgggctgctgctgcagaaggagctggactacttgggtgagtcatggtggtcactgggtggtcagagtatggccggaggcagtgcccacatgtttgatggagtgatcccgcatggtttttgggatgaactaccagactttgccgctgtgagtcggccacagaatgcattgcatggaaactctgcccgtgaggcccaccagcaacggcaccacggtctcnnnnnnnnnnagcagaatgcattgcatgaaaacactgcccgcgaggcccaccagcaacggcaccacggtctcaacgtcgaccatttgcattgaggcacattagccccgcaccccacccctcaaccacaccctgtaaacccctgatctgcagacggcgcggtgaaggagcccaagcgcccctttgtcgccattgtgggcggttccaaggtctcctccaagattggtgtgatcgagagcctgctgcagaaggtggacaagatcgtgctgggcggtggcatgatcttcaccttctacaaggccaaggggctgggcgtgggctcctccctggtggaggatgacaaggtggagctggcccgcagtctgatccaggaggcggaaaagcgcggcgtggaactcctgctgcccaccgacgtggtggtggccgacaagtttgacgccaatgccaactccaaggtcgtgcccgtggaggagatccccgacggctggatggtgagctgaggggtgtgggctggttcagtggaatggttttggagatttctttctgttttgtggggtcatgcaatgaccatggccgggattggcaatgaccatggctgggcaaaacatggttctagcacgaggatgagcgccggggtgggctgaagcaggccttgactacagcaatggtctctccttctctgcctacgccctggcctgcacgctgcacatggctactgcaccaccctctaacccccgcgatccccacccaggggctggacatcggacccnnnnnnnnnngcgctgcacatggctactgcacccccccctaacccccgcaatccccacccaggggctggacatcggacccgactccgtggagctggtgaccaaggcgctcgacggcgccaagaccatcatctggaacgggcccatgggtgagtcttgggggagactgtggatggtttccgtggaatggggtcacacagcagactgaatttgcaatggttcatctgttgacatcccagcagnnnnnnnnnngactgtggatggtttccgtggagttgggtcacacatcagactgtattcgcaatggttcatctgttgacatcccagcagaccgcgcaaagactcttcagttgtcgaatgtgcgctcctgctggtgtggattgtgaatccttggatggccctccccctgattcaagactccgtcccttcacttctcttttctcaaaccgctttccctcaacccccctcccccccccacataatcaaggtgtgttcgagtttgacaagttttcgcacgggacatttgcggtggcgaacactctggccaccaagacggacgccatcaccatcatcggcggcggcgactccgtggcggccgtggagaaggcgggtgtggcctccaagatgagccacatctccacgggtggcggcgcctccctggagctgctggagggcaaggtcctgcccggtgagttgtttgggggggggggggacgctgaggtggcaggggcagagttctgaatgaggggaaaggcacccgctagcctttgtggtttgacagagtgggcagcgtggctgggatgacttgacgactagaaaaccccctccccatgcctcgcccagcctctctaagccccgcccacccttgcacaatgtactccatgcgccaggtgtggcggctctcgacgacgcttgagcgtcgcgtgctcgtgcaggggcgtttcacccatcacgcccatgcatgcggttgttgtgaggctcgcttgtcatcgccatgcctggaagcgacgtctcctctcccccagaattcctctnnnnnnnnnnccgcgggcttgtgcaggggcgtttcccccgtcacgctcatgcatgcgatctctgtgaggctcgctcgtcatcgccatgcatggaggcgacgtctcctctcccccagaattcctcttgttgtaaagccatttggctgtcagtagcatcgccagacgggatctgggatctgcatcctcatgacggaccagtggtccgccgcctgccgccccgccgccacccagccccggaagctggggctgcggccgcctccgcctcccgccctcccctgatccagtgctgcacatcgctgctcgagatctggcaggggaaggtggcgggaaggtaggccggcgagcaccttggcgcagccctggtcctcgcacagcgctgccgcggcggcgggagttgcggcgccggggtccacggccgaccacgaggccaggagcacatggttcctcaccgccgcctcctcctcgtccgccagcaccgccaagtggggcagcaccgagcgcaggctgcacgccaggcgcagcagcccctcgtcagcctccccctgcaggattgaagcgcggggggggggaagatgggagggtcacattcaggggcgtgaatgtgcggccatggcagcatgcaggtgcgcatgttgccgcccaccaagcgtcagccccgtccgaccaagacacgcacataaaagttcacggcgaggatgccccgcggcctgcggagcttggaggccagcaggcgcaggaatggggtcgccaccagtggcccagccacctccccgcccgcaaagacatcgtggatgatgtagtcatacgtgccattgggcagggaggacgccgtcgccagcgcatcgcccgccaggaagagtcccgcgtctgtggagcccaggccctttgggatcaggccaaaggcggcgctggccgccgtcaggatctcggggtgcagttccagcacatctgaggaggaggagagaaggagcatgatgaaggagttgatcgggccacgaccttgtccccgctctctgtctatcaggtggtaaccaactaatagacagagagtgcagcttgcggctcatggatctgcacattctgccgcactgagcctgcaagattccccacctgccaccacgccggcgcgctgcatnnnnnnnnnnctgatcgggccatgaccttgtccccgatgtagccatctctgtctatcaggtggtaaccaactaatagacagagaatggagcttgctgcccatggaacaacacattctgccgcactgagcctgcaagattacccacctgccaccacgccggcgcgctgcatgcctcggacggcggtgccggcgcccagcccgatgtgcagggaccggcggccgccggggacgatcgctgcgccagccagctgcaggtggaaggcggagtacaccgagtggccggcgatctgggccggggcgaggaagacgccgcccatgatgctgtgccccaggcggagcaggcgaaacctggcgatggcatgggtgtgtgcgtgtgtgtaagggggttgcggctttcgtgtacttgaggggtgaggttggtggcagggcccacatgatggcaaagtgtatggaagcggaatgcagagtgcctccattgagtctggtcgcaggaaaaggaaggaggaagggctcagnnnnnnnnnngtgaggttggtggcagggccacatgatggcaaggtgtatggaagcgcaatgcagagtgcctccattgagtctgatcgcaggaaaaggaaggaggaagggctcaggagagggccgccagagacataccagtccctggcacgccactgcactcctgacaccagctcaccgagctggcggctgggtgagcgtagtaccctcgatgacggcgacgaggttgccgtcccagcgggcggcggcgctgctcagcactgagaagccgggcgcgccggggcagggaccggctcgaccactcgctgccctggcttgcgccaggaagagggctgaggccaggcacgcgccggcaacaaggtagagggtgcgcggcgtgaccctggagcgcaaatggggtatcagggccctcgccagcatgcaggcggcgagcgcgagcgggatggcggtggtcggccaggggggcagggggagcagccggcctgcgtggagtcccgcggccgttgctgcaactgcgaggcctgatactctgggcaggggcacgcctctgaaggacgtcgccgtgatccacccaagaaggatgaggattgggcctccacaggcagcggccgtgagccctgtcctggccaggaggccaaccatgctcagggctcctgactcgctgtcaaggccgggggacaggaaggctcgtccccaccatttgcaggtgatgggcagagaaagcagggccccggggcatgccaacagaagccatggcggggaccggattcttagtgccgctgcagccccaaggcctgccagcaccaggctgatcaggggcaccaccgactcagcgacccaggagcctgtctgaggaatcaaaacgatctggagcaggcattgtgagtacgacaggtagatcagggccgcaatgccgtccagaggatgcagctggggttcagcggtgggtcgggctggtacaggtctggatcgcttcattgcatcctcctctcnnnnnnnnnnnnnnnnnnnnnnnnnnnnnnnnnnnnnnnnnnnngccccgctctgtggcgattccatggttgccgatcgggctcccgccacccgcgacgagaaactccgtgctcccgactccagcatggagcaaagtcatgcaactgggcccatgccctgcaatagttgctaaatagaaggagacgctgtgacacgggccgttcagctgacccgctgcactcctcgtccaatagaggcacccgtcgccaggaacactcgnnnnnnnnnngaaaggcatgcaactgggcccatgccctgcaacagttgctaaatagaaggagacgctgtgccacgggccgttcagctgactcgctgcactccctcgtcgaatagaggcacccgtcgccaggaacactcgcgaagagtggcttcgctaaccgctgcgatcatcagccacctggagcggggcagcacttgaaatggcaggacgtgggcgtgctgctgtgctgccggcatggatgaaaggtgaggcgcgtagatctcgcttgcctgagtggcacggtcctgtgtgatggtcgcgacggctggggttttctgtcttggcccggcacccgctggcagcggtaggatgactctgatgatccacattggtcccattccaggtaatgctgctccaggagctcccggtgccagcgtggctgtctcggtgagttttcagccggtgtttcagcaaggggaagggtgcacctgctcactcctgtgcatgcttggccgtgcgtgctttatccaggctcctgctcctccctgccggctccctgcatcgccaccatcccatccctgcaccaccacagcggccaacccccgctgctgctcccagcctcgcccaggctgcgcccagggcggccatgcccagcgccgcaccctccggccctggctcagcctggaccgagcacaccgccccagatggacgcaagtactactacaacgccgggaccaagcagagcgtctggaccaagcctgtggagctgcagacgccagaggtaagagtgtttgtgaggggattggggatgggtgagtctgtgccttggcttgcccaagcctttactttctgtggggacatcagggcaggcagggcacgctgtggcaggtagggtacgctgaggtccaatgctgcatgctnnnnnnnnnngggcttgccccaagcgcttgctttgtattgtggggacatcagggcaggcagggcgcgctgtggcaggcagggtacgctgaggtccaatgctgcatgctggacgcagatgatgcagggcgaggcggcccctcttctctgacagcatgcctgtcctcccatcctccccctgcctcaggagcgagctgccgccggggctgccgcggccgccgccgccgccgccgccgcagggccaggctcagccgtcgctgcggcacagcccgccgcagcgcccgctgcgactgtgaacgaatggaaggagttcaccgcccccgacggtcgcaagtactactacaacaagaccaccaaggagtcgcgctggaccatgccagacgagatgaagcccgccgcagcggtcgctgccactcccgccaccgctccctcgggcaacagcctggccgcccccgcggccaccctggtggggacggccggccctaccgcggccgcggcacaggccgcgctcaaggcggtggaggccgccnnnnnnnnnngcggccggccccaccgcgtccgcggcgcaggccgcgctcaaggcggtggaggccgcccgctcgggcgccaaggccggcgtgtttgtggcccagccggggtccatccagacgggccccaccccccactacgccaccaccgcggaggccaaggacgccttcaaggcgctgctcaacgagacgggggtgtccagcaccaacagctgggacgaggtgtcgcgggccatcatggctgacaagcggtgggtgccgcgggggtgggggggtttgtgggaggagaggggcggggaggcattgctctggatgcagtgggtctctagggcgcatgaggaagggtgtgtatttggcaggggacctgcacattgtgaggaggcttggctcactggatcaccaccgcaaggactcctcccctcacctacccacccctcaccgaccccacacccccttaacaaaccaaccactcgcagtttcggctcgctcaagacgctgggcgagcgcaaggcggcgttcaacgagttcgtgcagcagcgccggaaggaggaggcggaggcggcgcgcgcggcgcgcatggccgccaaggagggcttctacgagctgctggacggctgccgcgctctggacgcgctgcccaagttcagccgcgcgcgcgacgaactggagctggacccgcgctggctggcggtggcctcggcgcgcgagcgcgaggagctgttcgaggactgggtggaggagcgcgcgcgcgcggagaaggagcggcaccgcctggagcgcaagcgcgcacagaacgcgctgcgcgacctgctggagggcgcgtcgtggctggtggcgggcacgccctggcgccgcgcccaggaccggctggcgggggtgccggagttcgaggcggtggacgccgcggggcggctggaggtcttccgcgaggtcatggaggaggtggagaagcgggagaaggaggccgcggcgcgggcgcgggaggagctggtgcgctcagagcgcgccaaccgcgccgccttccgcgagctgctggccgacctgcgcgcgcgcggcgcggtgcacgcgcgctcgcgctggagggaggcgctggccctggtcgaggcggaaccggcctacctcgccgtggagcgcaacaccacgggctcccgcccccgggagctgtttgaggtggggaccagggtgatggctggctatgattcttgcttggacaaggacatgggaggcatgccttggggggagtgcatggcctggagcgtccccagcaggggatgttgcgaggcgcaccccccctcgactcacactgcatacgcgcacatgctcacctcatcgcgcaggacctgctggaggacatggagaaggcgtacctggaggaccgggcggagatcaaggccgtggccgcggagcgtggcctcgtggttgacatcgactccaagctggaggacttcctggcggcgctgggcagagcggcccccgccgaggcagccccggccggcaaggacggcgcggcggctgacggcatggaccgggccgacggggagggcaaagacgtcagcgcaggggaggtcactgtcacccagggggcacaagcgctgggcgcaggggccgagccagccctgcccgactccatccccacccagagcctgtgagcggcacgggagggagggtggtggtggtgtacatgggccgtgctggcggtacacctgttggggtcggaaacgtttcaggttgcatgctgtgtgtcgttgctgtcgcaaaaactgtgtgctctttcggcagccctcnnnnnnnnnnnnnnnnnnnnnnnnnnnnnnnnnnnnnnnnnnnnnnnnnnnnnnnnnnnnnnncctccccatccacacctgtccgcacaggcagctctactttgtggagcagcaggggctggcgcgggacgagatcgcgaagagggagaaggagcaccggtaccagcgcgaggacttctctcgccttctacgccacgagcgccggatagaggcggagacgccctgggaggatgccgtgcagctgctggaaaaggagccggagtggaaggaggtgtgtgtctgtgtgcgtttgtgtgaacgggtgggggttccagggttcagcggccagggttggcatgcgaaccggcaggcgtatggcgatcaggtgctgacccgggggggagggctggaaggaatgttgtgagcgcctgctcctccattccctgcactgcagcttgagagcctggaggagaagcgggagctcttcgatgccttcatcgccaagctgaaggtgcgtgtggtgtgttgcgagagggcggcagcgtgaaagttgacactgtctgggttcaaggggggggtggaatacaagcaaagaccaccaggccaagaagagtaaaggctggacggctcacagctgcgatcctaaccaaccatgcctgtcccatgcactctcaacacgaacccgnnnnnnnnnnagtctgggtttagggggaggtggaatacaagcaaagaccaccagaccaagaagagtacaggctggacggctcacagatgcgatcctaaccaaccatccctgtcccatgcactctcaacacgaacccgctctcccggcaggccaaggaggcggagcgagcggagcgcaagaagtcgcggcgggatgatgaccggtcagacgacgagcgcagggacaggaagcggcacaagcacaagaaggacaggaagaggtgtgtgtgtaggggtgaatcagagtgctagactgatgcagggcacgtgggggagtatgaagagggcgggaaggagcgcaggtcggcaccagtgcgcccttacctcccccctgtgctccacgcccgtcctttccaacatgacgcaggcatcacggcgacagtgacgatgagcgggacgggaagcgcgaccggcggagcagggacaggagccgcagcgagagccaacggcgatcggtggaccgagcgagggggaccagccggcgacgcagcgagagcagggacaggcgggactgataacgtcgtgcttgcaggcctcgcgctgcttgttgcccgggcatagcaccggctgtgagtgcaacgctgaatatgcaggggatgccagagactggatggacagcagccttgttcatcatatccatgagtaaacagcaagcttgtcgcaggcatgcttgtcgattagtgagaatagaggtttcgcagggggatcagtcctgttccggaannnnnnnnnnggggtcgtgcttgcaggcctggcgctgcttggtgcccgagcatagcactggctgtgagtgcaacgctggatgtgcaggggatgccagaggctggatgggcagcagccttgttcatcatatctatgagtaaacagcaagcttctcgcaggcatgcttgtcgagtggtgagaacagagctttcgcagggggatcagtcctgttccggaaggcgatcgattcaattctgggcgccgtgcgcacagagattcccggcgcactgcaggcagtgcaaagcactcagcctcaccgatcatcgccccatgctcggatcaaccccttccagctagtttgcaggagtcgaaactgccatgacgcggatggaggtaggctgatccggccggattgcaatgcacgaacggtccgcaagcactgccatgctcccgtttgacccacccccaccgactgcctcccggcagatggaggagtgcagggtggtaatcctgggcgccgaaatggaggcattgcagctggtgagcctgctgccgcgctctctgcagcagcagtgcatggtgttagaccatgccgggtcctggctcagccgctggaccacggcgtggcggggactgggcatccagcacctgcgcagccccgtgacccatcacccgggccccgagcctggagccttttccgcttggatagagaagcagggcagatcaggggtgggtcccgcgggttggtaattgaggttgcatggttggtcgactctcatcatggtcacatactgaagatgatgccagtacatatatttgcctcaccctcattacactgcagnnnnnnnnnngtgcatgtttggtcgactctcatcatggtcacatggtgaagatgatgccaatacgtatatttgcctcaccctcattacactgcaggagctcctggaagccgtgcccggctactcccccctgcccacagcacgcctgctggaggactactgcctgtccaaggtggtgaaggccctcccgccctgcctccagcgcatccggcaggacaccctggagcgcgtggagcccacgccgtaccaaggcacggcttctgaatcggacggctgcctgttcaactcgcgccccgattcattattccttgatgcctgccaggtcacccacctcccacctctctccttcatgtttgacccaggcggactgacgctacacctgggctccggcgccgaggttctgacccgcgccctggtggtgtcgcgcgtcgacagccgccccctcatcccgccctgggccgcagacttggtcgacagggagggcacggcggtacgcagcgcgcaccgcctgcgcctggccgaggaggagctggcgggcaggagcgtggccgtggtgggcgggggcatgacctcagtgaccctggcgctcgctgccgcggcaaggggggcgcgggcggtcaccctggtcgcgaggaggtggggcatgttttggtggggggggtgcatgctggtgtcgacacttctgggatgtgtccctgcttctttcttcgtccggccatacgcctgccgcatggccccaagaggctgcaagcctccgtcgactattctcacctnnnnnnnnnngtgtgtccctgcttctttcttcatccggccatacgcctgccgcatggccctacaggtgctgcaagcctccgtcgactattctcacctcccacccactcctcaccccagcgcttactctccacaccacgctccaggccactgaggcaggcgcccttcgaggtgggggtggggtggcagggccccaagctgatggtgcccttcgccggtcaacccgaccccgcgaccaggctggcggcctgccgcgccgcgcgtgcgggggccaccatcaacggccccgcctgggaggtcctggccgcagccgtgcggcgcggcgatgtggcggtgcgggaggggcgcaccgtcgagcgcgtggcgcgagagggcgacgctggcggcggtctggaggtgcgactggaggccacccgcagcctgcacggcgcttgggcctcggcgctgccagcctccgatccctcacctgggtcaaatgaaggcgaaagcttgacggtggacgaggtgtgggtggcatgcggcgcggcgaccgtgccggccgactcggcgcccttcaccgtgctggacgccctgagcctcccggggggcctatttgtgggcgggtacccgcgctgcgacgacgccagccttgtgctgccgggcgcgcccgtgtatgtgctgggccggacggcgatgctggcctgcggccccaccgcaggtgcctggtttgattgtgggggcgagggcgtggctggacctgcgttccggagatgtggatgtggggctggaatctgtcatgtgctgcgcggaggcgaggcaggtgcaggctggcagcaagggcgccgtgtggtcagcaacgcatcgtgtacccccctcgacaaaatcttcccccaaactcaaaccctttgcccaggcacgctgggcgggaaccgcgaggcggccaagcgcgtggcggccagcctggcgcgactggacatggcaggcgagaaagcgtggcacgcggccgccggcaagctgcaggccgcgccggcgcccaggctggagctgctgccgccgccggagacggagggcgccatgtggcaggctcccaggaagaaggtccgggcggtccaggctgtagtcgcagaatggatgcggtggtgtggacccatgcttgctggagctcgtggtgcgtcccgcatataaaccagctcacccggtggatcaacgcttcacacctttcccattctccctttccaaaccccatgccccttaccaggtgcctgtggcgcgggannnnnnnnnntccattctcccgttccaacccccttgccccttaccaggtgcctgtggcgcgggagcccgacaggatcgatgtgtcagaccttccccccaatcttgctcgcaaggagctggggcagtatcggatgatagacgaagggtttgacctgacactggtactgcaactggaggagccagtgaccaaggaccaggtgctgcgggtagagaggggttcatgcgggacgcctgtgagcctcaaggcacctgcagaagagccctgccacctccaactaggtccggagaatgaaattttgaaagaaagtgaggctgccccttgcctctgcctccaaacagtctcctcatgcccgcacctccaccctacccgtgcaggtcaggacggcctttgactggcagtcgctcgaagtgtgggctgttggccagagtcaggctttccacctgcacgttcccaagctttggggccgcatcctgccgggcaagtgcggcataaaggtgaatgtgcggaccaagaagctgtttgtgtgcctgtacaaggagaccgacgccgagtggcggtacctcaagggcttttagcttgctttggtcctgatatgaacgtccaacctcttctcctcatgatcactgtgctatgtatgcttgctggcttttgtgatgagatgctcctgtggggtgcattcaacgcaagcaacctcattgccttgtcccatgtcggaagatgcccacgtgggagnnnnnnnnnnttaatccttcttcacatgatcactgtgttctgtatgcttgctggcttttgtaatgagatgctcctgtgaggtgcattcaacgcaagcacctcgtagcctcgtcccatgtcggaagatgcccacgtgggagtgggcgcatgacggatccgtcgttaaaacccgactcactcttctcctcgcacaattgtgtcgatgttgcatggaagacttgtcagggcaagggatccagatctaggtacgatccattgatctcctaaacacagagaggcccaaaaggagagggggcagtctgcctctggcgcagtggcgtgttttccccgagtcgcgatccacctcactctgattggggccaggaggccagtcgctccgatgtcggggttggggctccagtccctgactgccagcgccctcaaggtgcatgggtggcaaggggacccgtgatgggcgccctggcttgacgatcggggtccacggatcggtgggccccatgcacgcggaacacggctcaccctgccaccccctgccgtcatgcccgcagacggggacattggctgtgaccagtcgactcacatatgcggtgccacacctgtcgggagccatcgacgtgtgcatggtccgccagcccgacgggtccctcaggagctcccccttttatggcgagtcctgggttggaaggggggtggattgggtaggacgaggagctggctggctgtaaagtcctgctcagtgaaggcccgagggcaccccattgcgccactcctcgctgggtcatgcgcagtgtgggccgctggctnnnnnnnnnnaccctgctcagtgaaggcccgagggcacccctgcagcgccacttctccctgggtcatgcgcagtgtgggccgctggctcgcatgcatgggtatccactgatcctcgctctccacctccactgcagtgcggtttgggaagtacaccggcctccgcacgcaggacaaacgtgtgcagattgtggtgaatggtgagttctaggggcgcatggcagggcaggcatccactgggtcagtgcgtcggccggcaccatcccgcgggagccatccctaccctcccacctggatgannnnnnnnnncgtggtgaacggtgagttctaggggtgcatggcagggaaggcatccacagggtcagtgcgtcggctggcaccatcccgctggagccatccctaccctcccacctggatgaccctgcctccctcctccgccaccccccttgccaggcgaggagctggactttgccatgcacctaggccgcactggcgaggcctactttgccaccgaggagcgagtccccctggacagcctcggcggcggccaggctgccgtggagggcctgggcctgcaagtggacgccgccctggccgaggtcgacggcggcgccccggtggaggacggggacggcttccagccggcttccggagccatgcggcggagcagcagcgagcccggcctgggcgccgccgcgcggtcgctgcccctgcccggggccggccagccgcttgcctccgcgccctccgacccggtgcgcagcccgtctccatccctgcccaccgccagggcgcgtcccgcctgggcgggggagggggtgggcggcggcgcccagcccccc

SEQ ID NO: 43616 - DNA, 94 bp, Chlorella protothecoides
tttggccccccccccccccacctcccttcgccaacccctccatgccctgcctgcgcaggagttcccggccaggtcgcgcgactactaccgggct

SEQ ID NO: 43617 - DNA, 61 bp, Chlorella protothecoides
agtggcagaagctggtgacagctgcaggggggagacagtggaggggggttgcggctcatgg

SEQ ID NO: 43618 - DNA, 68 bp, Chlorella protothecoides
cccgccaagttgtctccaccgcctcctgccgagaagcttccgccgcctcccgccaagaagtctccacc

SEQ ID NO: 43619 - DNA, 61 bp, Chlorella protothecoides
acagaattattcggcttgccttgacgggaggggggcctggattcgccctggcgccctcgcg

SEQ ID NO: 43620 - DNA, 61 bp, Chlorella protothecoides
tgctctatcccataagtggacattggatggggatctcgggggagcgcgccctcgtgatctg

SEQ ID NO: 43621 - DNA, 61 bp, Chlorella protothecoides
cggaaaagaaaggagatactgaaggggggggtggagcatcgggggggggaggcaagctgcc

SEQ ID NO: 43622 - DNA, 129 bp, Chlorella protothecoides
tggcgctctgcgaggggccgcgatgaggggctgtggggtgggtggggagggggcgggcgctgggccgtggccaccccagccaacagcaaaaggacccagaccctgcggctcccaggcacgcgcgcatgt

SEQ ID NO: 43623 - DNA, 61 bp, Chlorella protothecoides
ccagtgccgccagcgcggcggccagctcgccggcctcgccctcgctggcctcgctggagaa

SEQ ID NO: 43624 - DNA, 61 bp, Chlorella protothecoides
gagggctccggccccgccacgcccacgggcaggtcggaggacggcagcagctgcgggccct

SEQ ID NO: 43625 - DNA, 15740 bp, Chlorella protothecoides
  modified_base (99)..(108): a, c, t, g, unknown or other
  modified_base (341)..(350): a, c, t, g, unknown or other
  modified_base (444)..(453): a, c, t, g, unknown or other
  modified_base (1911)..(1920): a, c, t, g, unknown or other
  modified_base (2572)..(2581): a, c, t, g, unknown or other
  modified_base (3119)..(3128): a, c, t, g, unknown or other
  modified_base (3891)..(3900): a, c, t, g, unknown or other
  modified_base (4354)..(4363): a, c, t, g, unknown or other
  modified_base (5033)..(5042): a, c, t, g, unknown or other
  modified_base (8563)..(8572): a, c, t, g, unknown or other
  modified_base (9837)..(9846): a, c, t, g, unknown or other
  modified_base (10771)..(10780): a, c, t, g, unknown or other
  modified_base (11115)..(11124): a, c, t, g, unknown or other
  modified_base (12025)..(12034): a, c, t, g, unknown or other
  modified_base (13010)..(13019): a, c, t, g, unknown or other
  modified_base (13148)..(13272): a, c, t, g, unknown or other
  modified_base (13806)..(13815): a, c, t, g, unknown or other
  modified_base (14410)..(14419): a, c, t, g, unknown or other
  modified_base (15566)..(15575): a, c, t, g, unknown or other
cgcgcgcgcctccgacggcggcgtgcgcgtcccttctgccacggacggccccgccggggcgggcgcacccagtgccgcgtggcacgacagcctggcccnnnnnnnnnngtccccgtcagccggtgggagagggcggccaacgccgcggccgtcccagtacagggcgacgctccggcggccagggcgggccgccgggaaggcgcggcgcgttccgacgacagcgtgcacgctacagaagacggcgcgcgcgcctccgacggcggcgtgcgcgtacctcatgctacggacggccccgccggggcgggcgcatccagtgccgcgtggcacgacagcctggcccnnnnnnnnnnggcattcagaatccgggatgcaccagtgttgtaaatggaagccagaagcagcagcctattgataaaggctgtcgagggggcgcagcgcatagcnnnnnnnnnngggtagaggaggaggtcgcggcataccgagccgagctggagcgctccggcctgccgcggcccgcggtggcggcctcggcggcggcgcggcgggcgcagctcctcgctgacgtcgccgcacgaggggctgggagggagagggcatccaagcgggcgcgctccccggaccgtcgcgccggccggtgatgcatcttgtgttcacagcattagaaatccgggatgcaccagtgttgtaaaaggaagccagaagcagcagcctattgagaaaggctgtcgagggggcgcagcgcatagctaaagtgggaaactggtggacgccggctgctgaaccctgggggcttgcgctcgccccacacgtgcccgaggcgcgaacgcctgggaaggtggggatccagggggagtctcccaggacatccagagcatattcgacaaccagggcgcatactcccccttactactttcactgcatgtccctgtgtccaggcaataccttggaacttggagggcgaagcgtgcgcgacttccggcctcggccaaagtccgacatggcgtcgctggccgggggatattttgcacactctgtcctgccgcctcgacagcctccgcgcgaacggagtcgggtcggacagatcaggaatcctcgaagacgggtggccctcaatgtcgcggcagtctgcgctgagcccagcccacacttggatcgagccaccggcacgcaacccagaacgttgcaggcgctgctcttcatggcgaggtccctggcgaagaatgaactcagcgactctgaggcgccgtggggcctgcctccggccctcctggcgcagctggaatgggtgggtggacccctgccagtcaccctcacccaggccgctacatctcctccggcccccaagcagcgagcgccccctgcctcggaacaggctggtcggggcggccccgatccggagcgggaggacgatgacaaggaccccaacaagaagagcaaggactactatgcaaatgtgggcgatgtcatccgcacactgagggacgacatcccctgcatcttctggaagccttttgactgtgcgctggggcactgctgggggtctagtcctgattcggcgtgtgcatcctttgagaagaggattgcgtggctggcaatgacctggtgccattttgccctgctgacccctttcaattctcccatctcgccacgccccacacacacagatcacatctaccgcgacgacgtcgtcttcagagacccaaacatctccttccggggcttgacaaattacaagcttgtgatctggtcgttgaccacatttggacgcctgtttttcgccggcaaggaggtgtctgtggtcaacatctggcagccagaggagggcattattaagtgcgtggggcagggctgggggtggagtctcctcttctcttattgttggtgttggcttgatggtgctgtgcgtgactnnnnnnnnnncatcaagtgcgtggggcagttctggggttggagtctcctcttctgttcttttcggtgttggcttgatggtgctgtgcgtgacttccgctgctgcgcccaagattggcgtgtcgcccctgtccacccccttcccccccaccccgccttacactcccccaggatgaggtggcaggtgcaggcccggccacggctgtggtggctggccgagggcgtttttgacggcatctcggagtaccgactggaccacaggggcctggtgcaggagcacctggtgaccaatgtgcagctgcgtgatccgcccatcaccaacccgctcctctacggcctgaatctgctcatgtcgccccggctggcccctcagccctcccgagtaccctgcccaggtgagagggctgtgtgctttgggtgctggctgcatgtttgcaggccgttgcaacgggagtgtgagcatcgccatgcgggatgctgtgtcacagctcttctgcccaccttcaacctctagtccgtctcattgccttctcacgtcatgtctccgccacacagggtcatggagtgtgggaatggccgaggagggtgactcaccgagtgtgtttggcagtgtggacgcatgactgcttccatccttcgatccagaggcaagggatgtggcccnnnnnnnnnnttcaccgagcgtatttggcagtgtggacgcatgactgcttccagccttcgatccagaggcaagggatgtggccccttctccctggtcgcgaccgcgctggctgggaagacttgcatggacttgaaagtcgcagatacccccccctgtacacctttgactcgtatttcatatattggccgaaagatgaagatgcatgtaccctcagatctgatctttgaagcctgttccatgtgaaggttggtgccccccccaccctgcctgtcattgctgtaggcatcgtcactgtacagctgatgcatgaaataaaggggattgaatgagcaggattgcattcaagttctatgcagacattatcatctcctatgcaagtcagctcgacgggaaaatggggcagggggcgttgccttgccgaagaacagtgtggtagctgataaatgaagggtacagagtggcggcctgtgagcacagtgcttgcaagcctgggctgctgctggtcgaggacaggtagcactgaaggggattgtacacggcctttccnnnnnnnnnntgggctgctgctggtcgaggacagatggcactgaaggggattgtacacggcctttcctggccaggtcagtctcgcttcgagggaatgcgtgccaagatggggactgcggtgcctccacctctgcagctgctgcatggcatcttgccagagtagccgcacgtgctgcacccgacatcgccatcggaccagcgattgcagaggcagggcaccttgccggtgccgccgcaggtagagcattcttgctgcccctcgcgagtgggttgtgcctgcatcgcgagagcggggttacgggatcgtcagcgctcgagaaccagcgcggaacgagggccttcggaaacgagagctgggggattcggaagcctacccaagcgcccactgacctgctgcatcgcgaattggtagccaaaccaggcgaccgcgctccagatggaagccgtggccacttgcgacaccaggttgaaactggactcgtccaccatcgacagcaactgcgcccgcgcgactctccgtggccgtgacggcataatagtgcgagttgaggtgaatccgactctagggcgagcgttgggcagccgggcaggtgttaccaccgtgggggtgcggagggacaacatggtcaccacctctgctccttgctgtcgctcaaacgcttggttacttaggagtgccgaaatgtgtgagaatcgaaattcctaaagcaaaagcgatatgcgaaggacggaatgtagagaattcgtcatcgtgtggccggggattttggaannnnnnnnnngatgtgtgagaattgaaattcctgaagcaaaagtgatatgcgaaggacggaatgtagagttcgtcatcgtgtggccggggattttggaaggagttgtggagaagcgtgtgcccatcgtgcacgccttcttcatttcatgagagatctcttatttatttattgaacaatttcgataagcttgtgttatacataaacattccaaacgcagtctcgtcgacatgaaacatttcagcactgatcttgttcatgtgttgggtcgccgtcgccgtcacctgaacacacaaggcatctccacatactatttcatgccctgtttttttaatccaacttgataaaatctcaactgcctagcttgcattgagaatgtagcaggttggcgtggggtgcggttcgtgttgctcacttgccaagtagaatttacgaaatcccccacggtagagctcgagagtcttannnnnnnnnncttttctcacatactgtttcatgccctgttttttaattccaacttggtagaatccaaactgcctagtttgatttgagaatgtaacaggtcggcgtggggtgcggttcgtgttgcttacttgccaagtagaatttacggaatcccccacggtagagctcgagagtcttacaaccgtaacagacaaacagaccgctgcccagtgacaagcgcatgcacagcgagacactttagggacatacacttccatagttctttaccatcgaccgatggaggagcgatatgttttggggttggacggtgggaccgaaagcatgcgcgctggcatttttgatcgaaaaggtgccgtttttctgttctctggcgaataatggaggtgatgtctatgatcaagtgcatcttttggcagatggcaagtcaccggagtcggctcatgacatcccgcaggtgctcccatcgccttcgcatcctccccctattccacgacatatccccaatcctcctgggctgagcaggatcctgaagagtggtggagggtacgtaccgtacctggacggacccatcaccaagtgcatggacttccatcatgtatggctgatgtcaatggtgtttcctattcctagtatccaccccgagctcctattcacaggccatgggggaagccagtcgagcnnnnnnnnnnaaatggctgatgtcaatggtctttcctatccccagtatccacccggagctccttttcacaggccatgggggaagccagtcgagcagctctggcggccgcaaaagtcaagccccatcagattgaggccctgagtctggacaccaccaactgcactgtggttgctctggacgctgctgggaaggtcgctctgggggtggtttctcccatgatccactcgattctcattgtcatcgtgcaaagggggacacatcgtgctcgcacgcggcggcaccacctgccgagaatagagacctcaagccttgtgcccctccttccacccaggcgctgcgcccgtgcctgctctggatggacatgcggtcggccgcgcaggcggctagggtggcggcgagcggcgactcggccttgatcgtcaatggcggaggcaagggacccgtctcggctgagtggatggtccccaaagccctgtggctcaaggaggaggagccggaagtgtatgcagctgcaacatacatctgcgagtaccaggtcagtgtggcgtcaggggttggggttgggcgacgaaaaagggggcacgtcgtcatgtagcttgacgctgggcccaaagccagtgctggcccagaaggagctctagctctataccgccgcaccgctcccccctgcccttgcctgagccatccaacaatccgccatcatccccgctccctcaccacaaccaatcccaggacttcatcaacttcaggctcacgggctgcatgtgcgcttctgtgaacaatgtgtctgctcggtggcactacgacacccagaggggctggcccaacaccctgctccagcacctcggcatgccagagctgctggaaaagtggccccaggatgtgctccccctcggtgcgtgtccaggctggcgttgagcctgcctgtgcctattgctgagagatggtagcaggaccccatgggggcaccttccgcaacgctgcccacccaagacctctgggccccaccccccttcccccaagcaacacgcctcgcagctgaagtggtgggagggctgacacaggaagctgctgagcacctgggcctcgcccccggcaccccggtggcccagggcggcgtggatgcccagatcgggatgctgggcctgggggtgattgaccccggatcgctggcgctcctcatgggctccagccacctgcacttgggcgtcaccgaccagatgtgcgtgggggatggttaacgtgtggggtggccggggatgcgcctgtcccaggatctgtgagctgctgctccaggagagcaacagggcatgcaggccccgcccccaactccttgttcaaaaggcaggggcgggctggtgcagcagtcacttccctgggtgctcttcacctcaccattgtgcttgaattgtaggatgattggaccacagagtgcctgtgcttcatgcctcagacggccagagcactgtgggcgcgcctgcaatcaggtgtcccccttcctcattgtcaaacaaggtccctacttcaattctcctcagaatgaaccacccaaatccacaggctgcacggctctggcatgtttggcacctaccgcgacggcctgtgccctggcatcagtgtggtggagggaggccagacctccaccggctctgcagtagcctggctgcaccgcctgctgggctcccccggctatgctgagctggacaaggaggcggctggcgtgccgccgggggcggagggactggtctgcctggatcactttcagggcaaccgtaccccacacaccgacgctgcctcacgaggggcctttgtgggtctcaccctgcggcactccaggcaagcacaacattggggggaagggggggaaagcgtggtggcagtcccgggtcgaaaacttgctcgatgcaccccagggccatggaggaggaacgctttcagtattgaacctcgtcgctgatttgcctccttgactaggtgtgcttatcacgctgacatgcagtgttccaatgtgccccctttgccaaagttacacctttgcttacatgggcctggctggcatgagttgtcatcccaaacctcctcctggctcctctccgcttcccccaatccccccacacccccgccaccccccctccctcatcccctggcaggggccacatgcatcgcgccttgctggagtccatctgctttgggacagagctggtgctcgagacgatgcgtgacaacggcttccacccggcttccatcacttgcgcggggggccccaccagatccgacctctggctccagctccacgccgacatcagcaacatccccctccgcctcacagagtgagagggatgtagtatgacggggtgtggtgccttcatcagaaccgagctcttgtgtcgtacccagttgggcagcatcagagggtgctggggatcatccttgagccccagcctcggcaccctgcgcatcaccaccgtcccccttccaccacacacccagggtggcagaggcgcctgctctggggagtgccatcctggccgctgttgcagcgggctggtacccctccatcccagatgcagtgcggggcatggtgcacatcgcacgcaccgtgcaacccaacccagccgtgcatgaagcatataggtagtttaagtgaccggtcccggcggctctcgtgcagcatgctgcacttgttctctgtggggagacgcgatgtgacagggcaatgcctcatggtgcatgcggagtgggcaccccgccctgcctccgacgccaggccgatggctgccacccaccctgcgcgctcctccctccccgtctgctcgcagggagtcctacgctgcgtacaaagagctgtaccccgctctacgacccacgttccatgccgctgcagccagagactcagccaggcggcaagcgcagaagggcgccagggcgtctgcgtgatgtgtgaaaaccccttggcttcgcgtcctcttcaacaccatgtacttggtttaagtgcactgccaaaatgcatgtttactgtacagcaaagcgattcttggcttccttgtgtgtcccatggcaagccggggcagggcaggatgacaggtgcggcaggctcgggcgcgccttgatggttctcatgcctggccagtgcccaatagctggccaacgatgccggtggtctgccagtacttgctggtacacctgtccacgcagctgttctcccccacattgaggtcgccgtccttgtacctggtatgatgaggggtaagaaatggcatctgtctcaaggcagggtccagaggggccctcgcatacaacacgttggtatgagaagcacgatcaaacgcgaacactttcaaaccaatatacacgtaaaaagtcaagtaccaactcacttcctgtcgatgcacttgtcgaagcagctggtcaccattctgagaaggtaaggaggagaggtgcgtgtcgtcgaccatgtacagctggaagggagcatgtgcacaatgagaaacaccgaaaaccttacttgttaaaaagagcaacgcggtattnnnnnnnnnnggcgtgtcgtcgaccatgcacagctggaagggagcatgtgcacaacgaaaaacaccgacaaacttacttgttaaaaagagcaacgcggtattccatctcctgctgggccaggatcagggcctgggaggagtcgggctgctggctcgccatcgtgggtatgtgcctcacgacctttgcgaaactatcgactctgatgtcaaagatactatatgagcagcaggtgactgctgcagacagtgggaatgagatagcgtcccaagggtgcgccagtcagttactaggaagacttagcgccctggctccttcctccaccgccgctgagtaggctggcgcgcgcggtcccgtaattcgcggggttcacccgatggtaaatgcaatcccatccgatgcatcagcccacgaacccaacatccgacaccttttgcttctgaattgggtcggagggccgagcagtgggctcgtgttccgtgcgaagacgttgcggagcacgggatatcgagtcaccatgtcgctgcagcgcaccctggacagcgccttgcgctggccggccttcctcctgagtctgtttatactcttttggtccgtcccattctgcagcctgacctattacattcgcttcctggacctgaaaacggagaggaggggtgacgtcttcagctggtgagcggcgtaccctgactatagggtggaaggctgtgtgcgcagggctgacgccattgcgcacaatcacggaggattcaacatgacatgtctccgaatctcccttctcctgctcagggcagtaggcatgaagagatggtttggaatcaagatcctcaaggttggggaccgcgagctcttcaggaaggactgcatgtacctggtgcgaggtcgcgagggaggagtgcatcgcaaggcaggattggtatggcgggattgagcccttgaaaaaacgtttgtcagcatggggagctcttcgtccccctccatgggcaccaacctgaggctccacccctcccaacttgcactgcagatcaaccatcgcagctggggcgactttctggtggatcagtacctgacagagggccgctccaccttcctagcaaggtcagcatggtgttgagttggagtatgggatccccattcgataggttttgaagttcatttgctgagaaagggcatgtgaagggcctccaatgaagggtgactttaccctggttgtccagttctgcaccgctcctgccctttcttccacgccacagagccatggtggcggtggctttccnnnnnnnnnngaaccctggtagtccagttgtgcaccgttcctgccctttcttccatgccacagagccatggtggcggtggctttccctttcttcatgactgtcatcatggtcatgaaggccaccatggttttcaagcgtgggaacatcccggataaggaggtgtgtggtggcgggtgtgcagcgtggcattttggctccgcttggccgcctcctgtggtacagcccagattggctcatgttgcagccagatttgaaccacccatcaccacctcccgcgcctccacatccacagaaattcaatcgctggattgactctgaattcgcggccaccccgcagacggcaatcgctgtgtaccctgagggtgagggccatggttgggaggagtgctgcggtatgcttacacctggcgttcaccagctccgctgatatatgcttcaccaacatcaaaccctgtcctcgtcgcacatccgacgccctatagctcgttccgccccttcttcatccactcaggccaccggagcaccatgacggattccctgcccctgaagcgcggcatgctgcactacgcatacagccgcaagctgcccgtccaggtcatcattgcagcaaataaggaggccgtcctgtcggagaagcacagcactgcacgctttgggcagaccatttgggccggctactctggtatgtgcctgtttgggcctgagtcggggggccgacaggtagggccttcagtgccctgcactcctgtgcacctgggagggggctgtggagcttccacccacaaccgccttgccctcttgaaacgcaagattccctgcgccctgacgtgcaccagcattgcaaaggctcgattctcccttctccacaaccacgtacatgcgcagagcccatgttcccggaagagtacgagacctttgacaagttcatggacannnnnnnnnnaacccacgaccggcttgccctcttggaacgcaagattccctgcgccctgatgtgcaccagcattgcaaaggctcgattttccctcctccacaaccacgtacacgcgcagagcccatgttcccggaaaagtacgagacctttgacaagttcatggacaaggtgcaggccacctggaatgaggagtggaacacggtctttgggaccaagccagaaggtgtgtgagtgtgtgtttgtgttgctggggtgggtgcttctcctgtatgcgacgcacaatctacatgacagcattgtctctgccccccacggtcatgggtctccccttgcaaccagcaccnnnnnnnnnnaggtgcttctcctgtatgcaaggcacaacctacatgatagcattgtctctgccccccatggtcatgggtctccccttgcaaccagcacctcctgctctgaggcttcaggcacatgccggccccataaacatcaaccatacacccctccccccccaacacaacaaatatgcagggctgagggagttggtgtgccaggatcccaagctgctcacccccctgcacgtcaggcggggcgtgtccaccatcatcgccgtcgtggacatctgcttcctcgccatcatgtactactcgctccggatggcgcgccgggtctccgccgcgctgggcccgctggaggcccccctcctggcgctgctggcggtgtacgtcacggcctcactggtgcggtacagccggccgtacgacggcgtggccgcctccgcgcggaagggcaagctggcgcaggccagcgccacgcaggcgccgccggcccccaagctggcggccagcggcgtcgccgacgtgtccgccgccaccatcaaccgggcggcctcgctggcggcagagccgggtgacccccagggacggcagtgaggcaggggtaggtcacatgaacgtttgagatttttaggcgctctacagtctagtcaagagcaggtggttgatgcgctgctttacatgcccacgttacgctgctcccccacaaggcgtatgtccgacgaggggcgacccctgactgtcacctcagcgtcgctgctgtccccttgctggaccctgcgccaccccttgctgtgctgtaacttgcttgccattccgtgcggtttggatcacacaaggggtgggtgcaggagtgtggggtaggcacacatcgaaacgacgcacctcccccctctcccttgcgaacggtttcctggagcaaagnnnnnnnnnncggcgtgtgggttaggcacacatcaaaacgacgcacctccccccccctcccttgcgaacggtttcctggagcaaagaagggggtttgcacccccacgcccaactgtgtgccgactcacagcagggcaccgaaagaaacccgacacgcgcgcgccgtcctcactcacttccacacctggcgtccaaagtactccagcgcgggcaggccccggacctccaggtcgaagaggggcgcggtgatgacctccaggcctcgcaactcggggttgtcgtgcaggcgctgcagcgcacgtgcctggtccttgcgccggttgtccaggaagctctgcgtcgcgccgtcgccgatgacctggttgaccaccagcgtccgcaccggcacgctctcctttcgcagcgactccgccagccgcacgctctccgccgccgccatgacggtgggtatggtgacgacgatgaactgagtacgtgcctcgtcgtggaacagcgccttggcggtgttcatgcgctctgtgtgtgtggcatggtgggggaggagaggtggaacgaagcgacgagcacatgtgctggaggaggcggctgctcatgccaggggcgcccctgccgcatgaagccctgaagggtccctgtaagccagatggcagggcagcgctgcccacaaggcttggcgcacctctgaagacctccagggtggagggctcgctgggccccttgttcccctggaagaagcccttgaccgactgtgtgacgctggcgatcttctgctgcagcatcaggatctgggggcggggcgggatgtggaagtgccggagtaaggtactgccagcgcttcaaacgctgcgtgttttgctgtggcctgcaggagctgtaaagcaatccctcaatccgattcccctctctcccctcatctccccaagccactccgttcttgttgaccacctcccaacatagcaccttgcccacagaggtgtcgaggaagnnnnnnnnnncagccctgaaggatctttgtaaaccagatggcagggcagcgttgcccacagggcttggcgcacctctgaagacttccagggtggagggctcgctgggtcccttgttcccctggaagaagcccttgaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagcaatccctcgatccaattcccctttctcccctcatctccccaagccactcccatcctgtcgaccacctcccaacacagcaccttgcccacagaggtgtcgaggaagtctggcagggacagcaggcgcagcgtgtgcccagtgggcgccgtgtcaaagacgatgcggctgaagcgggagtactcggggctgtccaggaactggatgaccttggcaatggccagcgcctcgtccacgccaggcggcggcgtgtccaggagctcccctggcgaggggggtggtgggcggtgggtgggcgtaggttcccaaaggtcccccgcctcatcgggccgaggcccgatgggggtttaacctcctgtcatcatgcagactcacgcggctcagctgagaacacgagccctcccaggggcagaccaaggatcagccatgccgtgacatccacagcctccacgctccacacaccttgtctctgtcaaccgcactggcgccccaacccacccttccaccacccttccaccacccttccaccaccnnnnnnnnnngcatccacagcctccatgctccacacactctgtctccgtcaaccgcactggcgcccccacccacccttccaccactcttccacccaccacccttccaccacccttccaccactcacccaagttgaggtccttgagctgctcggccaagctccccagaccgacgctgcccagcacggcgtccagcgttccccccttcttcccggactcaggctcggagtctggggatttggctccccgcagctcctggcgcgcagcgtcgaggtccagctccatgccccacacttggccctggctgccctccagctccactgggtagccgcagctcacgtcctggggtggccggttgagcgtgtattgggggggggggatgggaagggacctgggacttttcgacagcgaggctgtccaccgccacgctgtcccctggccggcaagccctcagcgcctcccgcacgctcgccatcatgttgggcccccgtgcggagcccgcgccccgcgccctccttccccccttcccccacgccatccccacaccgccgctctcgactccatccgagctcccgatgccctcccaccacacgccctcacctggtcnnnnnnnnnnccaggcccccatgcggagcccgcgccccgcgccctcctccccccttcccccacgccatccccacgccgccgctctcgactccattccgagctcctggtgccctcccaccacacgccctcacctggtccagggcgtcggagagggagtgcgcggggtcggtggacaccaccagcgtcgtgtgcccggcggccgccagctggacggccagggaggcggagcagctggtctttcccacgccgccctttccacccagcatgaagaagcgcctgtccgcgcctgaggtagggcaggatcggggcagggcgcaggcatttggtgtgttgagagggggaaaggggggctgcctggagcatgcgcgcggcctccaggaggccccctcggcgctggcaccctgcaggccagcctgcttcgcccccccaccccctccatccctcacctgccgcaaactcgtcgatgatgccgccccacaccaggcccccaaagtactgcaggccgggcaagccccggacctccaggtccaggtaggggccctgcagctggcgcagtccctccaggccccggctgtgtgccagcaggtccagcgctgccgcctggtccttcagcttgctctccaggtacctgggcgtgaggaggggctgggccctctttgtgacctggagagtaggcctgcaagccccaggctccaaaccactgccgcccgccaccttccctcccaacccccgatctcccttctcacttgcgcgccaggcggtcatcgatgacctggttgaccacgatccgggagcaaggcacgccctctcgccgcagcgcgccggccaggcgtgcgctctcattcacccccagcaccgtgggaatggtggcgatgatgaattctgtcgtgtccgcgtcgtggaagaggtcccgcaccaggcgcacgctgttctgcaggccgagacggacgaggggcggcaggagggatgggagggctggattgggtaccctgcatgccctccgtcgtcgtgggggtgggccctctcgcaggcacaccaaagtcccttgcccgtcccccggcgggcgaggcgcacggaacccaggctgcatccaaaggcacccagtctacttctcgcaactccccccccctctcccctccccttccaccccacgcccnnnnnnnnnnatgcatgccctccgtcggcgtggggggggccctctcgcaggcacaccacagtcccttgcccgtcccccggcgggcgaggcgcacggagcccaggctgcatccaaatacacccagtctacttctcacaactccccccccactctcccctccccttccaccccaccc

SEQ ID NO: 43626 - DNA, 110 bp, Chlorella protothecoides
ccgccgtgacgtcatccactggcagcgggttccagtgccacgcacgcaatcggtgtggttggggagctggccccggccggagagtggagccagggtcctggcttgctgat

SEQ ID NO: 43627 - DNA, 120 bp, Chlorella protothecoides
cggcgcggcgccacccggtcccgccagggccgggccggcggccactcgggcgcgcgccggggtgcgggcgcggcatccgcagcatgcgcaacgtgcacgggagcatcacagggctgccgc

SEQ ID NO: 43628 - DNA, 398 bp, Chlorella protothecoides
  modified_base (98)..(235): a, c, t, g, unknown or other
catcgcccccgcccgcgccccagccgccgcgctacgtcaacgtcgtgcacgacctggtcatgcgctgcgtgcactgctgctacggcgagacctgggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngacgctgcagcgccccgcggtgccactcctccgcgccgtgctggccgtgctgcgcacgctgcccacgcacgcggccggccagcgccgcgccatcacccgcgtgctcaccttcgtcctgcgccgctgcctgggcctgcccgtcggcgacggggaggaggagggg

SEQ ID NO: 43629 - DNA, 159 bp, Chlorella protothecoides
ggttgggggggcatttgcgcatgcaggtgcatgctctccttcccttcaccgcataacgtgagagaggggcgggtccctccccatcgtggccgtagcccgaccttgcctcttcactctggccctgcaagtcatgttccaaaaggaatgtccccgctcaag

SEQ ID NO: 43630 - DNA, 61 bp, Chlorella protothecoides
ttggtacagacgacctgagggagggggggggagggaaggcccgttgaggcacgaagatcca

SEQ ID NO: 43631 - DNA, 61 bp, Chlorella protothecoides
tcgggcgcgctgctgcaccagcagccgcgccagcaggccctgcgtctccggtgaggccggc

SEQ ID NO: 43632 - DNA, 111 bp, Chlorella protothecoides
ggcggcgtcctcccgctgccggtcctgggggcgggggtgagggatatccaggaacgtcggcacggggccttgggtcgcgcagttgtatctaggactcttgccccaacatca

SEQ ID NO: 43633 - DNA, 61 bp, Chlorella protothecoides
cgtgtggggggtgttgaagggggggggaggccagccactgtggtccaaaggccggtcggat

SEQ ID NO: 43634 - DNA, 61 bp, Chlorella protothecoides
gcaacatggaggtggagcggttgcaggggggggtcgcacagtgaattgctaaaaagaccgg

SEQ ID NO: 43635 - DNA, 61 bp, Chlorella protothecoides
tgtccaacacccgcctgtattgccctccccacccactcagattgctgtgtggggcctggca

SEQ ID NO: 43636 - DNA, 72 bp, Chlorella protothecoides
cctgaaggagcaggagtccctgcgctgcctctacgtggggccagtgctttgcaagggagtgtggcaaccaca

SEQ ID NO: 43637 - DNA, 73 bp, Chlorella protothecoides
cgtgtgccacgcagcttggagggcctcaacgtaaattgagggaccccccccccttcccccttcccaggttcgg

SEQ ID NO: 43638 - DNA, 76 bp, Chlorella protothecoides
gtgcgcggccacgatgccgcgtagctgctccgggcgcaggcacaggcgctgcaggatggcgcgccaggtgcccacg

SEQ ID NO: 43639 - DNA, 150 bp, Chlorella protothecoides
ccgcacacacacgcgcagttgacacccgcctagcgcgcatgcgcggtctcaaacccagacacacccgtacacctggacatacacgcacacaaaaaaacccagagcccacaccccaccccacactgacccgggagggagctggcggtggag

SEQ ID NO: 43640 - DNA, 12111 bp, Chlorella protothecoides
  modified_base (613)..(769): a, c, t, g, unknown or other
  modified_base (862)..(871): a, c, t, g, unknown or other
  modified_base (940)..(949): a, c, t, g, unknown or other
  modified_base (1146)..(1155): a, c, t, g, unknown or other
  modified_base (1251)..(1260): a, c, t, g, unknown or other
  modified_base (1710)..(1719): a, c, t, g, unknown or other
  modified_base (1773)..(1782): a, c, t, g, unknown or other
  modified_base (3064)..(3080): a, c, t, g, unknown or other
  modified_base (3164)..(3173): a, c, t, g, unknown or other
  modified_base (3543)..(3552): a, c, t, g, unknown or other
  modified_base (3625)..(3634): a, c, t, g, unknown or other
  modified_base (3945)..(3954): a, c, t, g, unknown or other
  modified_base (4699)..(4708): a, c, t, g, unknown or other
  modified_base (4994)..(5003): a, c, t, g, unknown or other
  modified_base (5617)..(5626): a, c, t, g, unknown or other
  modified_base (5769)..(5778): a, c, t, g, unknown or other
  modified_base (6257)..(6266): a, c, t, g, unknown or other
  modified_base (6664)..(6673): a, c, t, g, unknown or other
  modified_base (7104)..(7113): a, c, t, g, unknown or other
  modified_base (7935)..(7944): a, c, t, g, unknown or other
  modified_base (9560)..(9569): a, c, t, g, unknown or other
  modified_base (9771)..(9780): a, c, t, g, unknown or other
  modified_base (10505)..(10514): a, c, t, g, unknown or other
  modified_base (10582)..(10591): a, c, t, g, unknown or other
  modified_base (10819)..(10831): a, c, t, g, unknown or other
cggcggaggcgctgcgcctgacgcgcgacgccaagccggacgatcccgaggaggcggcgcgcatcgcggcggcggggggctcggtgcgccgcctgaccgacgaccccgacgacgtgccgcgcgtgttcgccgccgaccccgggtccaccgccccggggctggccatgtcgcggagcctgggcgacgccgcggcgcacgcgctgggcgtctgtgcgacgccgcgcctgacggggcacgtgctggaggagcgcgacctggccctggtcctggcctccgacggcgtgtgggacgtgatgagcgacgccgacgtggcggccttcgtggcgcggtaccgcgcgctgcgtctgccgggcgtgtcggtgggcgaggcgctgacgctggaggcgctggagcgctggaagcgcgcgcgccgcgaggccctggtcgacgacatcgcggcggtggtgctgcacctggcgccgccgccgccgccgctgcgcgccgcggggccggagcactcctcctgggccgtgccgcgcgagctggcggcggcggcggccagcaacgaggaggccaacgcctcctacgccgcctggctggccgacccggcgctgaacccctgcgcccacgcgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctgttcgacacgcgcagccacctgcgcctgggcgtcggggccgagcgcgggagcagcgcggggctgagcgcggagccgagcccgggcctgannnnnnnnnngactacttcctgcacctcttcggcaccgcacgcggcagcgtcgcgcggcacgccgccgccgcgctgctnnnnnnnnnnactgttcgacacgcgcagccatctgcgcctgggcgtcgggggcgaacgcgggagcagcgcgaggctgagcgcggagccgagcccgggcctgaaccgggagccgagcccgggcctgaaccgggagccgagcctgggtctgaaccgggagccgagccttggtctgggcggggagcgggaggcgtctcaggccacgccgnnnnnnnnnnatcgagggtttgggtgggtgtgggggggtcaggggtgtgacacgggtttcaggggccagtgaagacctgcatgcatgcaggcgggcccggcgctgnnnnnnnnnnccctcgccgggggggctctccagcgtgtctaatgaggaggtcctgaggcccatccgcagggtgaggcgttgagggtttggatgggtgtgggggttccaggggtgtgacacacgggttttcaggggccagtgaagaccctgcatgcatgcaggcgggcccggcgctggcctgcgccccggcacacgggccaagggaggtcctagcctcggcttgagtgctgcgagtcgcacccaggccccagccccagggctgcgttgcaacgtgttggccccccccactcctggggccgtcgtcaggatacccacctgcagcaccgcacgccaccgcaggcctacccctcgtcgggggacaccagcctcctggagtcgcgctcgtcggtgagtgtgctggggtcctgcccgccgcgtccagggcacccagcgtgggtcgagggggcgtgatgctcaggcnnnnnnnnnngcccccccccccccctggggccatcgtcaggatacccacctgcagcaccgcacnnnnnnnnnngtctgcctgccgtgtccagggcacccggcgtgggtcgagggggcgtgatgctcaggccggggtgccgggggctgagcgcccagccgccgccgcagcgtcgcccgccgcagcatcaaggaatacgcttccaggtgcgaggatgttcacccctccccacaccccccgcttccctgcccctgccaggcgcgagacatcctgcagtggggctcccacgagggcaaggtccggggggggctccccaccagcatgtcgggctccctctccaggctgggctctgagggctccatggccgccgctgcgtggtgagtcggcggcgtgctgcgacgggggctggggcagctcggcatgtattcttttggtggcttgggttgtacgcactgaagcttgcagcggggggtagggctatagggccgcgtcgcttaggtgtcgcctgtcacgtcactctctccaccggctctgcctcgggcgtcggtctgaccctttggccccatgcaattggagaccccaacctaccccccacctcacacacacaaaaaataaaacactcccaccacaccgcaggcgggccagcagcctggacgaccgccatgcggcgctggagtcttcctgcagcctgcagccgcacagcggctcgcccctggcctccgccctggccgcgtccctggccagcccggagcccagccccgtgtcctcggaggccctaatgcccgtgcgcacctgctcgcggcactcgggggcgctggacatcggcaccaggccggggctggggcgcggcgccgttgcgcagcggtgagggggggaccctgggctcgtgccgggggtccgcccacgaccgactgccgccttgacatccttgtaattgcgttactgcgtgccgccagcatgccgtgttcttgccaactcggtcttcccattcttttgccctgcccagtatgacttgtagagtatgaaagcctcgcagccacgcgaacctgacatgtgacacgagtccgaatctctgcacctcatacccgccacttcgtttcatactggaagcggagttgaccgcggcggagatgtgtccgacgcgccccattgtgcactcgcgggccacacccgattggatttccggctcccattcactcctgtcatacgtgagttgttccggcggcatccgagggggtcgcatgggagtccgggcggcacgtgcatgatctcgagggggaggggtggcacacccattagaacgcaccggctgatggcaggcatccttctgaaacccatgcaggaaaggctggggggnnnnnnnnnnnnnnnnntagtacggctggtgtgccggccttgacccaacccaggcggtttccgtgtcaggttgctgggtttctgctcggaaagtatccccnnnnnnnnnngaaatcgtgcggtcaccatgaatgcatatgtgtcgacgctgggattttggcgggcatctccagctgcaataggtacgtaatctgcggtccaggcaatgtcacgatgtcatcgtgcctcctcttctggtccaaaaagaaccactggcctgcagtacggctggtgtgccggccttggcccaacccaggcggtttccgtgtccgtttgctgggtttctgctcggaaagtatccccgtcatactgccccatacagcccatacacggccgaactccatccgactccatagccatactcacaagaacattctgatgacattcatactcccataggctggtcatgggcgatactttgatcacctattagcgtttcannnnnnnnnncccccctagctccaagtctggtgcccaggtaggctgtgggatccctgacggctggtcccatgcctgcaatggnnnnnnnnnngcaccgtccagcccgcggacaccatgaagcgggctcgagtgagaactgtttccagcaaaccccctagctccaagcctggtgcccaggtaggctgtgggagccctgacggctggtcccatgcctgcaatggggcggggccacatcctttcttgatacatggaggcggattaaccaatacacgggaaggtggggggtatccgaggatttccatgcccatccgtacacacatgcacaccgatgtccaaccccatgtcgatggacctccatggaactgcaggaggagcccagaggtccccgaagacccaaatccnnnnnnnnnncacctccatggaactgcaggatgagcccagaggtccccgaagacccaaatccgcgtttctgtgcttcctgtcgctgtatcggtgagtcgaggtgctgtgcggggcagcctccccatgcccggacccggcgccgactgtcatcgtaccgatcatgtaggccccctgacccaccgctcccgtcccttcgcagatctttgtacaaggtaggaggcaaattcgcccccccgccggcaccccgccggcctggggtctctgtcgtacgacggcccgccggtcccgccgcttacatgcctgcattctgggccacacctgcgcacttgacctttggatcgggccgcgacccgcccttcaccctgcacacatcctataccttccctccttcaaccgttccctatcccggctcccattttgcagtcgagcgtgggctcggctttctcccaccagcgcacgctctgcgccgcggcaggggaagcctggcgcgccatgccccacgaccagcgggcgccctttgtgcgagagtcggaggccagtaagctggagtggtcccggtatatgggatcccaggggcgcgtacggaagcgcaagatgaaggtccagctgccggtcgtggagcagcgggacgccaccccctcccaggcatctgccagcgtcagctccagggtcagtgagcgtggcgggcccgaatgggagggagtcagggtgggtgcctggctcgaaggggtggtggttttcaggggctggcacnnnnnnnnnntgggcccgaatgggagggagtcagggagggtgcctggcttgaaggggtggtggttttcaggggctggcactgtgcacagttgcccgcagaggcatgacagcgtgagccggcacgaagcgctgcccagcctcacctgtggaaccctcgctcctcgacctcgtagccgcacccccttgagcacctcacaccgtgacatgccccacccctcacacacacgcaggccaccaccagccctggctgcgccggttcggagcaggcagacacgcagtgccgggcgccctccagnnnnnnnnnnaacatgccagcgtgagtcggcacgaagcgctacccagcctcacctgtggaaccctcgctcctcgacctcgcagtcccacccccttgagcacctcacatcgtcacattccccacccctcacacacccgcagggcaccgccagccctggctgcgccggttcggagctggcagacacgcagtgccgggcgccctccagccgcgacctgcaccgccaggcctcggcccaggtggaaactgccgcgcccacccccgcgccgcgcccggccgcgctggacctcatcttgcccagctacccagtgccctggtcgatcagggagtacgagctcacccgcctacgcggcacccccctgcgcccctttcccccctcgcgctccctgggccggccgcccagcggtcactacgccggcggcggcgcggactgcagcctgtggtcgccggtgcaccgctccgactcctcccacctcgcccccgccgcctaccccggcgcgccgctcgcgccctggctgcccctggccgaccgcgccgagggggggttggggcccgggctggacgtggccgccgccagcctggggatgtggcggcaggaggagggctggaacccggatatcctgcacnnnnnnnnnnccccagcccgacgccgagagcggcaagagccccctcatgcaggttccctattgcggcaccctggcgggctctcatcccgggcacacacacgaatctttcatcctgcgggatgtgggactgcggctcctcgcccccaccaccannnnnnnnnntttgggacccgggctggacgtgtccgccgccagcctggggatgtggcggcatgaggagggctggaacccggatatcctgcacctggattccaccgacccgctgccgctgggcgggccggaggccttctccggcatgtgggaggtgctctgacctgggcccagcccgacgccgagggcggcaagagccccctcatgcaggctccctattgcggcacccttgcgggccctcatctcgggcacacacgaatctttcatcctgcgggatatgggactgcggctcctcgcccccaccaccactccggctctctccttgttgaacccctccatcgccctacaccttttgatagggcgccgaatcaggcgccgttcgctcctcgagggtattttgacccctggtgcaccctgctacccttttccattgcacccctcgacaatgcagccgtcgcatgttgcttgcttctccctcataaccctgccgnnnnnnnnnncacaccttttgatagggcgccgagtcaggcgccgttcgctcctcgagggtatcttgaccccgtgttgcactctgctacccttttccattgcaaccctctaaaatgcagccgtcgcacgttgcttgcttctccctcataaccctgccgcatgcctggcgcctccttgcgtgtcagcatgtacaggcagcctccgcctccttccgctttatccatgcgattgagtggttcgcgccctgattgctgtttacatatgcacacttgcgccgtccccccccttgagcagggtactccattcatgtccctggccttgcctagttgaccagtctttattgtaatcatgtgcacgcagtgtgtgagcctgatgataatgttattttgaacttccctctggaactagnnnnnnnnnntgcctccctccgttttgtccatgcgattcagtggctcgcgccctgattgctatttacatatgcacacttgcgccgcccccccccttgagcaggggactccattcatgtccctggcctggcctagttgaccaatctttattgtaataactctgcacgcagtgtgtgagcttgatgatgatgttattttgaacttccctctggaactagaagtcaagggctgaggcggggacgtgcgctggagttcatgtgtgggcatgttcagacatcatccttgctgaccagcggcaatcaacctgccgtatatactgcggctgcaccgtgccgcacctcactcggtgggagagcagccctcgacggtaacattcgagttttgaacgcagagagacatggtttcccggtatgtcgcacatcccaaggggtttgtagagatnnnnnnnnnngacattcgagttttgaacgcagacagacatggtttcccgctctgtcgcacatcccaaggggtttgtagagatctggtgctgatcgagatgggtcctcatcaaaccccagagaaggtcacgtgcttccgcgatgctcatggcggcaacacacacacctctccgggatgcatgccgatgatccgaggcccaccggtcacccccccaccaaatacaaccccctgtggcaccccgcatcgccataatctcgcctgtcctgtgcggcagcggctggtcaccatggctccgctcttcatcccctgcacatccctgccacgggtgtactcccccctggcccagcgccgtggaccctgcctacccgggcggcagagccgatccatccccttcacccgcccctcacagcctctgggtcgcctggccctggcaccgccaacccaggcagcctccccagacttggtggggtcccccccacccgacgccgtgaacgggaatggcggggaggctcatcaacgagaccacagccacgtacaagcggaattctgtcagggaaccctggcggtgcatggcggggagcgggccggccggcccagggtgtcaggtgcagtgaggaagggggtgggagtgggtggtttggaggtcgatgcttcgcagctgggcgcagggggcatggtgacctctgtgccctgtccccctgatccctccttctcgtgcatgcattcggcattgctccagcgtgcatgccacaaccgagtggcgaccccatgcctgggccccttgcctgtgcctctggcatccgtgtcgcctgccctcgccctcaggcgcggnnnnnnnnnntcctgggccctttgcctgtgcctctgggttacgtgtcgcctgccctcgccctcaggcgcggcccctttgtcccagcgccccttccctgtcacccgcacgcatgcaccctccctttcaaagcctccacgtgcagcctccccaccccactcccacggcacggcggcacctcactcacaccccaacccctccctccccctctcaattctcctcccatccccttcctcccctttccctccacccccttatccccccaaaccaacccacagactcgctgaccacgccgatcgtgcagacggcgacgtacaccttccgcgacaccgcggagctgatcgcgtaccaggagggccggttcgggtcgtacgagtacgggcggtacggcaaccccaccacgcgcgcgtgcgaggagaagatccgcgcgctggagggcgccgaggactgcctggtcagcgcgtcgggcatgaactcggccaccacaatgctgctggcgctggtgcccgcgggcggccacatcgtgaccaccaccgactgctaccggcgcacgcgccagttcatcgccacgctgctgcccaagatgggcatcggcgccacggtcatcgacccctccgacctgggcgggctggccgccgcgctagacgcgcaccccgtctccctcttcttctccgagtcgcccaccaacccctacctgcgctgcgtggacgtgccggccatcaaggcgctgtgcgcgccgcgcggcgcggcggtggtcatcgactccaccatcgccacgcccatcaaccagcgcgcgctggcgctgggcgccgacctggtgctgcactccgccaccaagtacctggcggggcacaacgacgtgctggcgggggcgctggcgggccggggggacctggtggcggcggtgcgcgccatgcacaacgtgctgggcggggtgatggacccgcacgccgcctacctgctcctgcgcggcatgaagacgctggacctgcgcgtcgcgcgcgccaacgccaccgccgcgacgctggccgcgcgcctggaggagcacccgcgcgtggcgcgcgtgcactacccgggcctgacctcgcaccccgaccatgccatcgccgcggcgcagatggacgggttcggggggatggtgtcctttgaggtggcgggcgacctgtgggccaccgcgcggttcgtggacgcgtgccgcctgccctacatcgcgccctccatgggcggcgtggagtcgctgatcgagcagcccaccatcgtgtcctactgggaccaggggcccgaggagcgtgcgcgcctgggcatccgcgacagcctcgtccgcttctcctgtggcgtggaggcagccgaggacatctgggccgacctggcccaggccctggaggccgtgtgagggagcgaggcccggggtccgggcccagcagcccctggaccgcgtccaccccgcagacgcagaggatcccccgtcgcgagcccgtgaacctttcactcgccctggcctgcctcctgctccctggcacggcggaccacaggcctgcgtgtcctcatccgtcgctccccccccccgagacccatgccgcgtggtgcgcacacctctctccccttcatcccttgagatcgagtgccgnnnnnnnnnncttcactcgccctggcctgcctcccgctcgcctggcacggcggaccacaggcctgcataccctcatccgtcgcccccccccagacccatgccgcgtggtgcgcacacctcgctccccttcatcccttgagatcgagtgccgatcctcagacatgggatgagggcatggacacctgcaagaagaagcatgcagatggcagggnnnnnnnnnnggatgagagggcaaaatgactccagcaagcaccaggctccgtcaggcagacttgaggacgttgttggccttgatcccggcgcgcgtctccagcttgacccacctccgttgctgggtggggaagggagagcgggcgaaaggtgagcacgccaggcagcagtggacgcggaccacttgcggccgccacacagggaactcttctcaaatccaacccatgccacacccccacctacctcctctgactgcagctccgtgaactcatgcctctgcagctctgtcaagggcttctccggctgggccagctcccagagccaggcggggagctcctcgtcggacttgagggctgggtcggtcccgttctttaggatattcacacccgtggcgacctctgtggacaggctcgcgaacgctgcacaattgcaaggcgtgtaataaattgatgggggagcgcacggagcttgttctaggactcgaatcgatgggaaaagttgggtgggtttgcagaccgggtggtgctcacctcgcggaagtctacacagggttacgacgggcagcgctcgtcgagccagcataatggaggatatctcaagggctatatatcccaatgcacccctgatctcaaatgagtaccagaccaggcagaaggcagaaggcgcggcgggatagacgaaaggaccgtcaagctgcgctgcagttggataccgaggtcaagcagttgtgagagannnnnnnnnnggagcactagtccccccaggtagggcgctatgtatgtttgcgcaccggggtttaggggttgccgcatnnnnnnnnnntgatacctcaggggttgtatatcccaatgttcccctaatcacaaatgagtatcaggccaggtagaaggcacaaggcgcggcgggatagacgagaggaccgtcaagcggcgctgcagctggataccgaggtcaagcagttgtgagagaatatcactcttcactcccttgaaattcaaagtttagtgcgccactgcttcaagtggtcatgcaggcttgctgggcatcctnnnnnnnnnnnnnggacttccaatgatgctggacgtgaacaagcccccacaagattctcgcacgtctgaatcggtttgttgcatgctatccagccggtcaggctgggctattgaggacggcaccactagaggttaccggcgtgccgggcgacgggtacccgaataacaacaaggtgggcaacagacagagacggatgcagggtcctgggaatggaattagtgttgtaacatgtcccatttgatgtcgcgcattggcagaggaccaacttgtcgtcacggggcctcttgaccctgtcccgtggtcggcacttcgccccacgacgtccatgcaagcaatcgtgtattccttcggtttgctttggcacccatcccgaagcccgacagatggtgtgacgttcctcatgctcgctctgtaactggcacaggccaccccccccgcgccgctcttatggctgtgcgtcgtgtcggttctctcttcaccttgccccgcgcagcatcgtgtgccggcatgacccccggcagacagcctgaccttcatccctgcccatcatgcttcccaatccaaggttgagcgcccctgaatccattctccctttcaggactggcagcatgcgcgtgaaggcccccgcccggccggtggaggcgcctggccagcacaacccctccccatacaagctcgtggggccccagctgacctccctgacactccccctgatcctctgtggcccggagagcctaaacctacgcccaccgagccctcccccaccccgggctgcgtctgccccaccccagagccagccatccgccccgccccggcccgacacccccccggcccccaccctgacggccagcgggcgtccccagcgcaaacgtaagcccaccgctgccgctgccgcggctgcagaggaggccagcgcggctcaggcagcggccgcaagccaggcctcccgaccggcacgccggcggcggcccgacgcggatgcagcgacgaaaccgaaggccacgacgcctgtcctggcccccggaggcctccccccccgccccgtgtcccacgccaccctgccggtggccaccctgcccggcggcgtgcgcagcgtcggcccctgggacttcccgcgcgtgcgcgcctttgcgctgtgcttggcctcttacgacgacctggcgctgctgaggggtgcagcgcccgcgccgggcgcccgtattccccaccgcttgtccccgctgacgcccagccgcgccgcggccggccccgagtccgaggcgcggcagcccgccgcccgcccggcgccgagc

SEQ ID NO: 43641 - DNA, 61 bp, Chlorella protothecoides
gcggacgaggcggacgacgagagtgacaccaccgccagcggcaagaagcccgccaagaagg

SEQ ID NO: 43642 - DNA, 61 bp, Chlorella protothecoides
tgctccccagccgcaggccagcagctggaacccccggcgccagcccacctggccttggtcc

SEQ ID NO: 43643 - DNA, 595 bp, Chlorella protothecoides
  modified_base (223)..(232): a, c, t, g, unknown or other
  modified_base (332)..(395): a, c, t, g, unknown or other
acgctgaaccgggcggaatcggcggcggccacgcccggcacgcccatggtcaccccaggtgtgtggggtggggttggggaggggttcaggtgtttgggaggcggggtgggacggtggtgggaggggcgcaggggcggttgcctcgtgagatttctgagacgcactcctgttgccggaggcgccaggagggcactgcatccaccgctccacccacccctcccannnnnnnnnnagggcgggagcctcgtgagatgtctgagacacactcctgttgccggaggtgccaggagggcacttcatccaccgctccacccacccctcccaccagtcannnnnnnnnnnnnnnnnnnnnnnnnnnnnnnnnnnnnnnnnnnnnnnnnnnnnnnnnnnnnnnnttactccctccccgccccacccctttccccagcgacggcgcgcttcaagagctggctggcctcctccccagacccggtgccctcgggccccgctgacgaggaccccgcgccgtggctggcgggcgtggcggcgcgcgtgaccgcgctcaaggagcgcgcgctggcggcgtcccgcggtgcggccgacgcggcagccgagg

SEQ ID NO: 43644 - DNA, 251 bp, Chlorella protothecoides
acaggcgcgcggggggacgggctcgcccttccagccgtacctgcgggaggaggcctccacgccgcccacggcgacgtcgggcgacggcccggcctccgccctgctgcgctacctgcagaccatggaggccgcgacccagggtcagagcgtggccggccccccccctgcggcggagggcccctcgcagcggcagcaggcccccggtggcgccgccggcggccgagcggggccgccggagcgcacgccgtcgc

SEQ ID NO: 43645 - DNA, 61 bp, Chlorella protothecoides
ggcctccccccggcgctgcagcgcggccttagcggtcttgatcccggcgatgtcgcgctcc

SEQ ID NO: 43646 - DNA, 61 bp, Chlorella protothecoides
cgctgtgtgtggtggggaagagggggggggggggggatgccttgcatccgtctgtgcacga

SEQ ID NO: 43647 - DNA, 61 bp, Chlorella protothecoides
gaaattattgctcatataaattaatagagggtttttgatttttgtctataaaacgatattt

SEQ ID NO: 43648 - DNA, 350 bp, Chlorella protothecoides
  modified_base (104)..(275): a, c, t, g, unknown or other
cgtgttccggctgtgcctggcccccgtgggagcgctgcgccgcctggtggtgtcccacgacgccgccggacttgccccccactggcacctggactgggcagagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcgggtaggactcatcctgacgatgactggcgagctgtgcaacaagggactctgatccagcaggcacaggggcg

SEQ ID NO: 43649 - DNA, 61 bp, Chlorella protothecoides
tggtgcactatgcgcccaccaccaaggaggggagtgccagtgggctggccgacctcttcct

SEQ ID NO: 43650 - DNA, 4701 bp, Chlorella protothecoides
  modified_base (1234)..(1243): a, c, t, g, unknown or other
  modified_base (1553)..(1562): a, c, t, g, unknown or other
  modified_base (2579)..(2588): a, c, t, g, unknown or other
  modified_base (2894)..(2903): a, c, t, g, unknown or other
  modified_base (4284)..(4293): a, c, t, g, unknown or other
  modified_base (4439)..(4587): a, c, t, g, unknown or other
aggagcgcatggcggccgccgtggcggcggagacggccgccgccacctgccacgcgcaggccgtcagtgcgctggcgaggctggacctgcgccgcgcgggtggcgccgccagcctcctcctctctgcctcacgggacggggtcatcaaggcctggcggtgagagcgctgaggtcgcaggaggttgtgtcatggcggtgcctgcctgcaggtggattccttgtgtgtgcctgcaggtgccctgactgtgaaagaaacatgcgctgtgacgtcggagcgcgggtgaggaagccgtgggggggctcatttgcgacatttgggcgcgcggaggcactcgtcgatctgctcgggacccatcgaaacacggatacatggggagcagcccgctccagcactcccaatcggcatcgcactctcgcgaatgtgtctggccaagagcagctcgccgcgcccctgaccgcccccctgggatgtcggtgtcttgccgtgctgttacacaggggtggagcgtgcctggggcctcagcgcacagggcggggacgaggcacgcccgccctttcgcggcgcatgcacccccatgcacagatcagcggctcagacgcaggccggcggcctgtcaggcggagcgacccgactctgggtgggtcgagccagccgcagggcccagcctgccctcccagggcgagatggttgtgaccgggaccccggagtccatcgggcggcaactacaggagattctgaggccaccccccgacacagactaccttgctgtgagtgcggtgttgggggtggggggggtgcacccacacctagccctcccccacatacagagcgcggcgttgatccgaagcctcccgccccccctttccacccacctgcacaccaatgctctctgcccccaggagttcctggccatccagaacaatggaccacggaagctgggattctttgggacgcggaacatgggtttcatgcaccagcagctgatcgaggtcctggcctacgccatgatcctcacggtgcgtgcattcctgctggcccctggtggtccccggcagggcgcagaggcagcatgctcccccgcccgggatgtgcgcagggcatcatgtcaagctcccggcacctgctccccgcagggcaatcacatctacacctccggggctactgggacgaatgcggcggtgattcgaggggcgctgagagctgagaacccggagctcctcaccgtggtcctgnnnnnnnnnntgggacgccatgtcaagctcacggcacctgctctccgcagggcaatcacatctacacctccggggccacggggacgaacgcggcggttattcgaggggcgctgagagccgagaacccggagctcctcaccgtggtcctgccacagagcctcaccaagcagcccctggagagccaggagctcctccaacaggtcagaggccactggttgatggcctggccctcagagcatcttgtgtttgtctcgagtttcctagctcgaagagggtctgcgtttcaattgcatgcctcgcccgattttgcccccccatcnnnnnnnnnnccttgtgtttgtattgagcctcctagcccgacgagggtctgcgtttcgatggcatgcctcgcccgattttgcccccccatcaaccgctgcatgaccttccaacgcccacaggtgcctcagttgatagagatgccccagaacgatgacatgcaactgtcagaggccagcaggcatgtcggggcggggcagcaaggggcatgccagggtgagcttccgagtcaagtgcgatgccctccaggattgctcacctccccagagcctttcccaacccacaggctgtgcaatcgtgacatcataggccgcgtggcgcagatcatttgcttcgccttccatgactctggcctgctcctggagacgtgccaggaggccaaggctgagaagaagattgtgaccatgtttttcctggactgagctgcggggggggcgcttgtgctgccttttgaaggatactcttgtacaagtcagggtggtagttatcgggcgagccgtgggctggggcagccttgaacagggagtcgtgcgcacagtggcagctggtgcttcaagcgccctgttctgatgagaaggggcagacgcatcgacgtgggccccacgtcaggccgccagcaccggccgtgccaccgccggtgcggggcccgtggcccctaccacgaacgcgccggggtcaatggccaccgacttggtggcgttgtcggtcttgtagatgcccaccaggcggtccgccagctcaaacatgttgttgcgcagggagatgatgacgaactgcgcgttcttggtgcgctccttgatgtagtgccccacgatcgacacgttcttgaagtctgcgtgcagggtgggggggtgttgggtgtttgggaaggggttggtgagtggggcctgggagagggctgcacaagtggtgtcgttggatgcctgacgcccaaagacaaaacccccgagccatgtcatgctcgtctgtcccgccacaccgagttgcagtccagggaccaccgagtgtcccgccccacccattcatgnnnnnnnnnnttgttgggtgtttggggaggggttggtgagtggggcgtgggagggggctgcacaagtggtgtcgttggatgcctgatgcccaaagacctaaccccccgagcccatgccatgctcgtctgtcctgccacaccgagttgcagtccagggcccaccgagtgtcccgccccacccattcatgcacactcagcctttcatcctctccctcacgattccgcccttcacccccccaaaaccccccgcgctaaggactcgcccaatccccagcccctcggtcgctcacccagggcggcgtcgatctcgtccatnnnnnnnnnnacccccccaaacctccccgcgccaacgactcgcccgatccccagcccctcagccactcacccagggcggcgtcgatctcgtccatgacgtagagcggggtgggcttgtagtggtgcagcgcaaagaccagggacagggagctcagcgtcttctcccccccgctcaggttggcaatgttcttccacgacttcttgggcgggcgcaccgagaagaggatgccctccgagaatgggtccagcgagtccaccagctccagctcagcgtcgccgcccagcgtgatcatctggtacatctccttcagcttcagggacacggcgttgaagccggccatgaacccgtccagccgctgcttgcgaaggtcctcgtgggcgcgccgcacctgcgatttgcgatttgcgatttgcgatttgcgtgtgtgtgtgtgtgtacgggggaacccagggtcgggttgtgtacgttggattcggcgggggagaacagcgtggagtttcctgggagggttctcatcgccgcgtgtcgtgcagggatgctggcaaatactccattccagagagtttcctcaccgctgaccctcgtccgtggcgctgcaggcggccgtttccagccaccgtggcgcggtatcccacccgttccctcacacagacccctcgacatgaaacacacgcccttccaagaccggcgaacctccccctccagcacctcgtctcgctgggcggtggcgctctccagctcggcggctcgcacaccatactcggcgtccttggcgcgccaggcctcgatggcggtgaggtcgatgctcatgcgctccatctcctcgcgcagtagggtggtgcggtactgcaggtcctccgtgctggccgccgccagctcctcgggggtgggcgcggcgggcgcctcgccccacttctccgccatctccgcgtcggcggccgctgcgcgcccggcccacagccgccgcttgccggcctcgtccttggccgcgacgcgctgcacctccatctccgccaggatgtcctgctccacgcgccggatgacgcccacctccctgttcttggcctcgaatccggcgcgcaggtccgccaggtccgccgctcgctccgccagcgccgcctcggccgcgttccggcccttgagcacctccagcgccgcctcgtccagcgccttgaactcctgccaaagtgtgtgtgtaaagtaaggggggggggcgggcttaggggtgtgcgaaaggtgggacagtggttgacatttgcccatgggaaatgctgcatgggcacagtaggtctctgaatatgcccgtgccctcactccttcaacccccccagccctccccacaaccgggcccccaatccctcaagctcacgttcttggtggcctcctgctnnnnnnnnnnaggtgggacagtggtgaacatttacccaagggaaacgctgcgtgggcacagtaggtctctggatatgcctttcccctcactccttcaccccccccctaaccggacccccaagccttcaagctcacgttcttggtggcctcctgctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcgccctccttcccctcgatctcggcctgcagggccgccagcgcgccgcgcaggcggcgcaccggctcgcctcccaggccctccagctcgcgctcgaggcgcgcggcctcggcc

SEQ ID NO: 43651 - DNA, 61 bp, Chlorella protothecoides
tcaccctctccgagccctgaggagtcaccccctcccagccccgaggagtcgcccagcccca

SEQ ID NO: 43652 - DNA, 73 bp, Chlorella protothecoides
ccaaggagtgcggagctgcgacggccaggcagcggaacctggcgacgccaaagatccgaccacccccgccgcc

SEQ ID NO: 43653 - DNA, 66 bp, Chlorella protothecoides
gaggagtgtggggggcgaggaggagtgtggaggccaaggaggagtgtggggggcgaggaggagtgt

SEQ ID NO: 43654 - DNA, 76 bp, Chlorella protothecoides
gcccccgaccagaccccctcaccaacctcggacccccctcgcgcactcccgctttgcaggtcctgctgagccaggt

SEQ ID NO: 43655 - DNA, 61 bp, Chlorella protothecoides
tcgacgacagcagcccctgggtggatgccacctccccgcgctggtcccagaacgccatggt

SEQ ID NO: 43656 - DNA, 114 bp, Chlorella protothecoides
gggggggggtggagggggcaacgtggcgccagtggtgcccttcctccctttcggttggatccaggaattcacagggcacaccgcagcatcgggttcctcctgtgtccacggctg

SEQ ID NO: 43657 - DNA, 98 bp, Chlorella protothecoides
ggaggccaaggctgcgggtctggtcctgtacagggatgggtggagccctggggcgccatggcgcaggccccccgagcacgccggctgccagtcagggg

SEQ ID NO: 43658 - DNA, 61 bp, Chlorella protothecoides
caagggaaagtatgttcccaaggcgacggggcgcgcacaccctgaagatgtcgacgcggcc

SEQ ID NO: 43659 - DNA, 3376 bp, Chlorella protothecoides
  modified_base (516)..(525): a, c, t, g, unknown or other
  modified_base (1391)..(1400): a, c, t, g, unknown or other
  modified_base (1693)..(1702): a, c, t, g, unknown or other
  modified_base (1972)..(1981): a, c, t, g, unknown or other
ccacccaccccacgccacgccaccccccaaaacacacccatccgcagatcaagtccaaggagcttacgtacaacggcaagggcttccaccagttcagggtggagcgctcctcggcctacatctcccagatcgacgagcactttggcgagctgaccgtgcgcgagacctttgacttctcggcgcgctgccaggccagcggctaccgcaccaccatcatcgagcggctggcggaggcggagaaggcgcagggcatcgtccccgacccggagctggacgccttcatgaaggccgccatctacgccaagggcaaggacgccagcctgcaggtggactccacgctgggcctgctgggcctggagggctgcgccgacaccgtggtggggaacgcgatgctgcgcggcatctcaggcgggcagaagaagcgcgtcaccacggtgcgctgtgtggttttgtgtgtggcatgtgtgttgttgtggggtgggagaagttggatgggcagtgatgctgtagcgctgnnnnnnnnnnacgctgtgtggtttggtgtgtggaatgtgtgttgttgtggggtgtgaggagttggatgggcagtgatgctgtagcgctgaggggagcaatgctggggtgcactgtgtcccccacacgacgctccagccccggagcgcactctttgcgtcggggctgcaggctgtgctggaaggcgcgcacgtatgatcggtccatctgcgtgtgaacaacactcctccacccacacatgaacacccccttcctcccccccccccaccaaccacatcctcagggcgagctggtggtgggccccgcgcgcgtcatcttcgccgacgagatctccacaggcctggactccaacaccacctactccatcgtcaagtccatcggcaacctggcgcacgtcatggactacacggtgctggtgggcctgctgcagccctccccggagacctttgacctcttcgacgaggtcatcctcatctccaacggcagggtgagggggaatggagggacacaggggatgtggcgtgggtgcgcagatgctgtgtatttgtgtgcaagtgctgccccaggcattctttgtaccaggctgcatgctgcatgcaagccccatcctgccgtccatcacctctccgtccccccctccatccattcccagatcccttaccacggcccccgcgagacggtgctggagttcttcgagtcctttggcttcaactgccccgtgcgtcgcggcgtggccgacttcctgcaggaggtcaccacgccctcggaccagcacaagtactgggacgctgcggcgctaggtaagcccttccgctaccagacggtgcaaatgatcgagaaccggtttgccgagacgccggcctggaagagcatggccnnnnnnnnnntgaccagcacaagtactgggacgccgcggcgctgggcaagcccttccgctaccagacggtgcagatgatcgagaaccggttcgccgagacgccggcctggaagagcatggccgaggagttgagcaacccctacggcggccccgaggagaacaacctcgccctgcagaccgcacagtgcgtgaggttgggggttgcaggggaaggggtctcggattgctacgtgggcggggttgtgttggaaggtacaaagtggttgggaaccgtcctgggtggctgaatggcgtggcggaggnnnnnnnnnnttgtgggcggggttgtgttggaaggtacgaagtggttgggaacagtcctgggtggctgaatggcgtggcggaggacggatgggtggtggaaagtgtggagggatggggattggaatcacatagtggtgttctgccgcacacgatagggtgacctggacccctgcatcatcccctgattgtctggtgctctgaagactgccccgtgcagtctctccccctcctggtgcacacccacggatggaatcccggcgctgtgttcatgtcatgcgnnnnnnnnnncgaagactgccccgtgcagcctctcccctcctggtgcacacccacggacggaatcccggcgctgtgttcatgtcatgcgggcgctcgacgcacgactcatcctgcctctgacatccatgccaccagaccaacctccccctttgatttcccaccccccctcacgacagctacgctcaaaagcatggcgagctgctgcgcgccaacttctggcgccaggtggtgctgctggtgcgcaacaagatcttcagcatcatccgcaccacccaggtcctgatcatggccctggtggtggccaccgtgttctggaaggagggcaaggagaacgtgcaggacggcaacctcttcttcggcgtcatgttctactccctgctctaccagctgctgggcggcatctccgagatgcacatcttggtggagcgcctgcccgtcatgttccgccagcgcgacgccaagttctacccaggctgggcctttgcgctgccggtcatcatcctgcgcatccccttctccctgatcgaggccaccatctggtccctcatcgtctactgggtggttggcttctcccgctccgtccgcttcctcatgttctgggtccagctcttcctggccaacgtctggtccgtccagatgttcgtgctcatcgccgccgtggcacgcaatgacaccatcgccacggccgcggggaggtgcgtggggtgtgtgtttgatatctcgaagggaggtccaggggaacagggtcaaagggggtgcggtgaggatgatgccgcggccagtgtctcagcccttctccaccatgcgcctcccccctcaaacaccccaacccactcccacagcttcttcctgctcatcttcatcaacctgtcgggcttcgtgctcaacacctccgacatccccccctggtggctgggcggcttctggggcaaccccttctcctacgccacccgcgcgctggccatcaacgagttcacctcctcccagtgggacgtccccgacccggttaatggcgggaccctgggcgccaatgtgctggccttccgcggcttccagtccgcttactggtggtgctgggtggccatcggcttcatcatcggctccttcgtgctcaacgcctgcgcgttcgtggcggccatcaccttcctgggcgccccccactccaagcccaccatgaccgaggagtacctggaggagtacgacctggcgcgccgcgtgctcagcggctccggccgcaccgacctgcccgcctccgtgcgtaccgccagccgcctcgcgcccggctccaggcccgcatcggggcccctggccgccaaggcggccgagactggcgccgcgccttccggcccggcaggggatggcgcggcgccgcccgacgctggcgcggcgggggatggcgcgggg

SEQ ID NO: 43660 - DNA, 61 bp, Chlorella protothecoides
tgaccatgtccgcatcttgacagttgggggggttgactatgtgcggcccgcatgggcaagc

SEQ ID NO: 43661 - DNA, 80 bp, Chlorella protothecoides
ctgcaagaggcactccccatcggcggccagtacgatcccctcgaccccgaccccccacatctcccgcccgcacaggaggc

SEQ ID NO: 43662 - DNA, 61 bp, Chlorella protothecoides
accgcttcagcctgtgcgtggagaggaacccggggggggggggggggttgggggggggggg

SEQ ID NO: 43663 - DNA, 61 bp, Chlorella protothecoides
tgccaggtccggccctggcggctcggcgggggctgtcccaagatctccactcctctcgctc

SEQ ID NO: 43664 - DNA, 61 bp, Chlorella protothecoides
taattcattgacggcccccatggcttcagcctcgatcgagactggacgacggttgacagtc

SEQ ID NO: 43665 - DNA, 8542 bp, Chlorella protothecoides
  modified_base (493)..(502): a, c, t, g, unknown or other
  modified_base (1592)..(1601): a, c, t, g, unknown or other
  modified_base (2328)..(2337): a, c, t, g, unknown or other
  modified_base (2735)..(2744): a, c, t, g, unknown or other
  modified_base (3580)..(3589): a, c, t, g, unknown or other
  modified_base (4502)..(4511): a, c, t, g, unknown or other
  modified_base (4731)..(4740): a, c, t, g, unknown or other
  modified_base (4841)..(4850): a, c, t, g, unknown or other
  modified_base (4942)..(4951): a, c, t, g, unknown or other
  modified_base (5989)..(5998): a, c, t, g, unknown or other
  modified_base (6198)..(6207): a, c, t, g, unknown or other
  modified_base (7050)..(7059): a, c, t, g, unknown or other
  modified_base (7988)..(7997): a, c, t, g, unknown or other
  modified_base (8353)..(8362): a, c, t, g, unknown or other
cgccgccgcgcgcgcggccctcacgtccgtggccagccggaagaggacgtggtcgccggggcgcaggcgagcgcccgcagccacgtcggccgcgtggaagagcacgcggcgcgggccagcgcccgcagggcagcccagcacccccgcgccgtcgttacccgggccggcgccggggcgctccagcaccacgcccgccaggacctcgggggccaccacctcgaacaccaccgacccggggggcgccggggtcacgcccaccgcgctgagctggcccttggcgtcacgccgcacgccgtactccacctccagcccgggcgtgacctggtcggggggaatgccctggagctgggagaagtggaagaagatgtctccgggacggtccagctgcctgtgtggtcggtgtggcaaaagggggggttgctgggtgagggcaggggactgagaaaaggaggttgaccccggggcggggggggggggggggggggttggaaannnnnnnnnncgtctccaggacggtccagctgcctgtgtggtcgttgtggcaaaaggaggggttgctgggtgagggcaggggactgggaaaaggaggttgacccccgggggggggggaggggttgattcatgcatggtgtgggcccagttgatcagggcaggcctgcacaaagtgccccggcccacctgatgaagccaaactccttcttggtctggacgatgcggccgagcaggcgctcagcgccggggggcggcagctcggccgcgctgggctccggcgtgccaggcctcacgccgtccctcccaccctgcacgcagactggccgacattggggttggctgcgtgcgaggttggcgccatgcggacccacggcccaaccctccatagtccactgcgatcccaccctgttgcagctccatgccaccggtggcacgagcagcggcccttccgtccagtctccccgagctctccaacccaggcccccccgacgcacctgcaaccccaccagccggatgttcaccgccttgcgggccagggtggccgagctgtgcgcgacctcaaactccacggcgtcgttctccagcaccgccggttggccggctgcggggttgtgggaaagggcgggaatctcagtgagggtcacccgccgccccgactcctccctctcctgctcgccacccaagccgcctctcaagtcatgcccctgggttgccgtgcagtgcaccccgcaaaagaatgatccccctcccaagctcaccctgcacccggaagttgccgtagtgcgcctggtgctgcgcgctcgggtcctggcccggctcgctgtacaggatcacgccgtcgtctagcctgaccgaggcctgggagcgggagcgcaccgccacaaacccccgctgcgtgcctgcgtgtgacagggtggggtgggctggtgtcaaacgagtccaacatcctgatggggcgcgctgcgccgcctgccccggacacagcccccgacgccctccgcgcaaaccgccccgcacccgcgggggccagccctgccgcgccctccaccggtactcagacgggtcccgggcggagccatccccacgcgcgcacctgggannnnnnnnnnttttaaacatcctgatggggtgcgctgcgccacctgccccagacacagcccccgacgccctccgcgcagaccgccccgcacccaggggccagccctgccgcggcctccaccggtactcagacgagttccgagcggagccatccccacgcgcgcacctgggagcagctcctcgccgaggagcaggaacgccgcggcgggcgggccctcggtcgcgggcaggggcgggccccgcgcgtccccggcgcgcggggcggcgggcctggcttgcgggggtctcggcgctgggccccgcgccggcgcctcccgcgcgccgccggccctgggctgggaggggtcgaagcccggggtcagggtctccacgcggcaggccacggtgcgccccgaacccgcgtcccggccgatcacgaagccgacgtagtcgttcagggccgcgccgccgctggcagcgtccgagtcgctgacgtggaagaagatgcgggtcctctcgttcttgatgaagccgtactggtggatggggggacagggggagggggggattcgccagggcatggcagggacgggcataggtggtggcctggaggagacaactgagtcaggcctcacggccagcaggcctgcaagtatgatggaatgtgcaccgcctccccgccgcacagcagcaggccggaggggcgcagaactcccacattgacatggctgccagctgcaactctggctgcccccactnnnnnnnnnnaaggagcaggcctgagcggcgcagagctccctcattgacacgactgccagctgcaactctggctgcccccactgaaagcttcaccactctctccaggctcacattctgctgacgtgccacgacgaatccgtattgtggagtggcatcctctggcacctcgatctgaggcctgggggtccgcgcgcgtggctgtctgtcctgcctctccctgtcctgccgcgagccgggcctgtaggtcgattctgggccggaaggggctgaaggctgcgcacgcaagagctcttcagagctcaccaaggatgtcgacagcatctagggtctctgggggagaggggaaagggggtaggcggcgaagtgatcgtgggttggggaccggcgcatgccaggcactaagctannnnnnnnnngaagggggtgggcggcggagtgatcgtgggtgggggaccggcgcatgccaggcactaagctacattctccaccgatcagcaacatacctcgagatgaagttgaggaatgtatacaacgcgctcagcaaagaaagctcttggatgcaagagttcgggacggcgaagtcggggagtgtctggtgtcctcccaggctgatgcggcagacgagtgcgcggggttggaatttggcgaagcaatgagcacacagggcgtgcgtggtacaccgtgtgaggcctgcgcggtgttgggagcagctggccgaggctttgtgggctccgcctctactcctggtcccggtgggcagggtgacgtggtggtgctaggttccttggggtcagcgcgcgcgatccaaaaatcaagaactcgtgggcatggtgacatatctgttacatgtgcatcgtagatcctatcgagagaacttcaaaaagggttgtaccgctctagctgcttctcccccctgactagccggctctcgggccaccacgaccgcacgcgccatgaacctcgcccgtgctggacactcccagcctgcattagccaggcaccagcccagctctgtttggcctgtcaccgttcgaacctctcactttatgcaacctgtgagttgtgcgagcgctggtgacgtcaggtcgcattgactgtcttccatgcttccacccatgtctcacccatcatctcattcacgcaggctcccctcccccgcccatcgggcggtcgcgcccgtgcagcagtgaatcttcacagtcctcagcctgccgtggaggcagcgccagccgcacctcctgtcctgcccttnnnnnnnnnnttcccctcccccgccgatcgggcggtcgcgcccgtgcagcagtggatcttcacagtcctcagcctgccgtggaggtagcgccagccgcacctcctgtcctgcccttccgtgtgggccatggctgggacctgcaccgactggagccgggataccccctgatcatcggcggcatcgacatccctcacgacaggggctgcgtcgcccactccgatggtggggtgtattggtgtcggtgtgcagggcatggcatttggaatcagcatccaggaggcacctttgagagccgcatgcacctttcccatacattacaccttcccacaccacccgtcccacaggcgatgtgctgcttcacacggtaaccgacgccatcctgggggcgctgagcctgcctgacatcggccagctcttccccgacaccgatccgcagtggcgaggcgcgcgcagcgacatctttctgcgggagagcgtgcggctgatgggcgagcacggctactccctggggaacatcgactgcaccatcgtggcgcagcgccccaagctctcgccgcacaaggagtccatccgggccgcgctctgctcgctcctgggggcgcacccctcagtcgtcaacatcaaggtgggccggggtttggtgagttcccagtcagacattagctttcttgttgagagggggcatcagggccacgtgcactgaggtgcgaggggaggagggtcatggcgcagtgcaggggagagcagcagagcacagatgcgggacgggttgcagactgttgctttccaccccatcaccccctctccacaatcctcgcccctgcacaggccaaaacgcacgagaaggtggatagtttgggcgagaaccggagcatcgcctgccatgctgtggtcatgctgtaccgacgagacgatgccaagnnnnnnnnnntaaaacgcacgagaaggtggatagtctgggtgagaatcggagcatcgcctgccatgctgtagtcatgctgtaccgacgagacgatgccaagccggcgcctgcctgagtgcttcttgctggactgtccgcagcgagtatgccagtctgtacatgagcgagcagcatgcagatggagcggcaaaggagtgcaggagcaggtgcaaatatggtcctgggggtnnnnnnnnnnaacatccagcacagtaggagccattggtgagtcgctgagatgcctgccttgccaatgcagcgataagaccaggtgcagggtgccactgtccaagctggcannnnnnnnnncgctggcacaggggggcgacaacggtagtgctttgaggcctgagtctggatgtggaatgaaggtcacagtcctctcagctcagtcggcgatnnnnnnnnnntgctggcacaggggggtgacaacggtaatgctttgaggcctgagtctggatgtggattgagggtcacagtcctctcagctcagtcggcgatgaggggcgtgttgcacatgggacacaccggctttcggttcccctctgcggaggacaggaaccaccgatccacgcactccaagtggaactgggagggagggttgagaggggcaggggttaggggctggaagggttgaaggcaaactggcctggatgacatccagcatagcaggagccgttggtgagtcgctgagaggcctgccttgccaatgcagcaataagactaggtgcagggtgccactgtccaagctggcaagaccccctctacttgctgccacctcccccttccacccctccagagaatcgatgccacacagccaactcccagggacaaactgccacccgcccaccttgtgctggcagcgcggcagcgctcgcaggacgtcccccggcacgtagtcgtcgcagcagatggagcactgctgggaggaggtgtctgcgcggtccagcagggcagccaccagggccgccttctcctgtgcccccggcccggggtctatccgcgcccggcgcagcagggccttgagctcccccgccggcaggcgcgccagctgctcggccgagtggaagacctcggtgggcagccccagcacggcgcggctcaccgcggcaaagtggtcggggtctgtgcgcggcacgggcgcagcggcgcgctccgcggcgtggcccgccgccggcccacccctcgcgcgcagcacggcggagcggaagacgccgccgtcgcgcgcgccgcgggtcagggcctcgcgtaggcccgcgccgcggcgcaggtggggccagccgctggccagcgccgacatgagctggaaccccgcaatcatggcccccagccacacggcgctgcccagcaggcccagtgcggaggggtcccgcagtgtggtggggatgaactggggggtggggggagggaagggagcctgggttgttcaccagtaatgatgaggagcnnnnnnnnnnagggtggggggaggggatggggactgggttgttcaccagtaatgatgaggagcagcatccggagcggtgggcccatccgcgacgagtcagatgagcaggagggtggtgcacttgccggtaggcagttgccagcaggactcaggacattgccatcagatactgggatgaagagtatgaatctgtctgcccaccaaatatannnnnnnnnnccatgagggtggtgcacttgccggttggcagttgccagcaggactcaggacattaccatcagatactgggatgacgagtatgaatctgtctgcccaccaaatatagtggcagggtgcaaacgcgcgccatctcgcctctgcctagggctcgcacgtcggaaaaccctcgacccaccaccagcacgcccgtcctcgcgtaactcacaatgctggcaagcatggctgggacctctccgatcagaactcccgcgaggagcaggccgatggtccagccccagctcatgccgttgccaagggagaggatcagcatcgcgacaccgtgcgaggaccgcactttcaacctggatgactcctttgcctcgtagccatgtttggcagggaacaactggcgtaggaagtgttgttagttataatcgccctacccttgcaggtgatcggggcttcttaaagcggggaaggtgccacgcaggggcatgtcgggagggggttgtcggcactccacaggtcgcgcccgcgccctcgacggagatgttgtgaaagctggatcttgacgacgaaccccaaactcgccgtgatctgatcgaaaggttactgagtaggcatcgaatcgatactttgtggtcatcgtgctggatcccgctgatctcggatccgagaacaggggcctgctcccttgagttttcggtctggctgtggcacccctttgtaaggcccaatcctccgtcggaggatacataatcggatcttcttggcccagtcatatctcccacatccactgtattgaatcacggttatgcccagtgcagtccggttgatgtcccagcctgcccggcggtaggaagnnnnnnnnnncaaggcccaatcctccgtcggaggatacacaatcgaatcctcttggcccagtcatatctcccagatccactgtattgattcacggctatgcccagtgctgtccgggtgatgtcccagcctgcccggcggtaggaagatcacttccccatgagtgccgtggacaccctgctgcagcggctgcgggggcgggccacggggccccaaccttgtgccgatgccggaccgcgcttcctggtcaccaagcagtcctggcggggccagtaccaccgggtgctgtgcatcacgcccgcggcgctcatcacacactaccccgagacgggggacaccacgaacgtgtggagcctggcgggggatgcggatatcgtgggcctggaagtggggcccgactcccccgagggcggcctcttcaccctgcgcatggcgccccgaaaggtgcggcgctgctggaggtggctgggggctggtccatgaatgcgaatgcgccgtgcaacccatggccggggtggtagcgcagccctccgtccttggacgcctatgagcagagcagcatgtccttgctgcgttgcgcacccctccgtttctccggcctggggttgcacggcaatctggcctgggctcggagcagtccaccgcccacccacccacagtcgccacaccgccacacccacgcatccccacccgcagggaaaggacgtgaagctggcgtgcagagcgcgcaccgcgctgctgaccgtgctgtaccagagcctggcgaccctgcaagtccccatcccaccggccctgctcaggtgtgcttggatggctgggtgcgatggaatctgatgctgaaatacatgggatgccgccgcccaggttggccagtccccccctccctgactcaatccatgctcctcctgcacccctcccccttcccagcccccccaccctgnnnnnnnnnngtcccaccggccctgctcaggtgtgcttaaatggctgggtgcgatggaatctgatgctgagatacatggaatgccgccgcccaagtcggccagtccccccctccctgacttaatccatgctcctcctggccccctcccccttcccagcccccccaccctgtaccccacgtggaagctgcggcgcggggtctgggtccccgccacgctgcgaatctccagctggtgcgtggagcggcttgaccccggcacggggtccgtgcgctggcgcctgcagtacgccgacgcggcgacgccggcggtgcacctgctggcggccgacccgggggacccccccggcgcctcctgcctggccctcnnnnnnnnnnccacggggtccgtgcgctggcgcctggagtacgccaacgcggcgacgccggcggtgcacctgctggaggccgacccgagcgacccccccggcgcctcctgcctggccctctttgggcgcgccgggcggtcgccgcgcgtgcacgcgctgcgggaccgcgccggcgcgttgcgtgcgctgc

SEQ ID NO: 43666 - DNA, 61 bp, Chlorella protothecoides
cgcacaccgccagccccttggcgggggaggggcgctcgccgatgcgcaggatggggcgcag

SEQ ID NO: 43667 - DNA, 872 bp, Chlorella protothecoides
  modified_base (273)..(458): a, c, t, g, unknown or other
  modified_base (617)..(742): a, c, t, g, unknown or other
agggtacatgccctaccccgtcatgccacccggtgagctgggcttgcggggtgcgccgtgacggggtgagatcctgacaccggcccctgcctccaggcgcgggcgcggggcgccaggcatgcgccgcgggtcgccgcatgggtgagcaggactgctgccacgcccctccagccgccccgtgccagtgcgccatcagccctgcctccgagcgcgccgtcaaacagtccctcgaaccccgccgcctccacaggcagcgacccggtgcaggagggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccagtgtctccaggcaggggcgagccgctcgttcaaggctgacgctggtagggctccgtgcatgcccccccccaatgccgccctttcttccccccgtgcagcctgatttggacggacgccctgcaccgccgcttcctcgaggccctggagaccatcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgcagggcttggagggctgtgcgggggcatttcttgcggcccagacctggccgctgtgggtctgcggtgcgccgtcgccatcctggcacccattaccagcactttgcccatcgggcaacgcaggagatg

SEQ ID NO: 43668 - DNA, 61 bp, Chlorella protothecoides
cctgtccaccatgctggccacgggcggcgcgggccagctgtacccggtgaccaccaacccg

SEQ ID NO: 43669 - DNA, 61 bp, Chlorella protothecoides
gaggctggcgtggggctggtgtggcctcgagccagaggggcatggggatcagtatggcctc

SEQ ID NO: 43670 - DNA, 61 bp, Chlorella protothecoides
gtccaggtaggagtcggcctcctcgcgggaatcgctggtgtacagccggcagccgacggcg

SEQ ID NO: 43671 - DNA, 77 bp, Chlorella protothecoides
cgcggccgcgcgctttgccatgccaggtgggggggggccgtggaacaagattggtgacgcattgtgtcagtggatcc

SEQ ID NO: 43672 - DNA, 61 bp, Chlorella protothecoides
ctccgcgggctggaatgcgggggcggcctgtactgcagggcccgcctgcactgcagggccc

SEQ ID NO: 43673 - DNA, 61 bp, Chlorella protothecoides
actgcacgtgccacacctgccgatgccgcccccgcctccgcgcgtgcgcccagcccgcccg

SEQ ID NO: 43674 - DNA, 61 bp, Chlorella protothecoides
tcgtgtccaagcgcagggaggtggagagggggcgacatgtccccacctctgcttcacactg

SEQ ID NO: 43675 - DNA, 90 bp, Chlorella protothecoides
ggggctggatgcatgaaggaggctccccagttcagttgccccccccccccaccctaccatacaaaatccgccctctcaccttgagagttt

SEQ ID NO: 43676 - DNA, 61 bp, Chlorella protothecoides
ggatcccaagactctgccatgctcggcgggggattaaaagtctcaagactgtaagaacctg

SEQ ID NO: 43677 - DNA, 61 bp, Chlorella protothecoides
gagcagggcctccagtgtcagggggccccccccgccccgagccgcgcactcaaagcagggc

SEQ ID NO: 43678 - DNA, 95 bp, Chlorella protothecoides
gccgcccgacgagcagaggcggactgccggcgtccgacggggcgggcgcgctcgcgaccggggggcgcggcgcaggcaattgccgtgaacgatgg

SEQ ID NO: 43679 - DNA, 6902 bp, Chlorella protothecoides
  modified_base (125)..(201): a, c, t, g, unknown or other
  modified_base (945)..(954): a, c, t, g, unknown or other
  modified_base (1190)..(1199): a, c, t, g, unknown or other
  modified_base (2973)..(2982): a, c, t, g, unknown or other
  modified_base (3114)..(3123): a, c, t, g, unknown or other
  modified_base (3190)..(3199): a, c, t, g, unknown or other
  modified_base (5169)..(5178): a, c, t, g, unknown or other
  modified_base (5674)..(5683): a, c, t, g, unknown or other
  modified_base (6211)..(6220): a, c, t, g, unknown or other
  modified_base (6599)..(6608): a, c, t, g, unknown or other
  modified_base (6834)..(6843): a, c, t, g, unknown or other
ggcggcgccgggagagcgcgggcccgcctggccgagggttggggagggcgtggcgtacagccggcccgggcgccgcgccggctgcgcggtgaccgggcgtgcggcggggtggggtgggacgcggnnnnnnnnnnnnnnnnnnnnnnnnnnnnnnnnnnnnnnnnnnnnnnnnnnnnnnnnnnnnnnnnnnnnnnnnnnnnnccggcagccgcacggcgaagccggaggagggcgctggctgggcggtcgtcggagacgggtggaggctaccggggagcaggggcacacgatccagatccagctgctccgtgtggtgcgggggtggtgcttgcattgccgtgccctctgggtcctcgcctgcagggttcggtgtgtggggaggggggtggggggttgaggcgggtctcttagagggcgccgtgtctggaaaagaaccctgcactgagttgagcgtgcactccccgcacacagcctcttgcaacagtgccgccaatggccgggaaacgacaccaggaactgctcccgcctgggtctcaccaggcacgaccccagtccccacaagctccacctccacccccctgcacctcgctgcatccgcacgtagtcggcgatcagctcctccgccgactcccggccaaaggtccggcgcagcatgctgcgggtgaaccatgtgccgtccgtgccgcccgggccgtccatggtgaggtagtagtgcacctcggaacggcccccccggctgtgccggtcgtggaacaggatgcaggccgtgagggccccgggtccagcctcagcctcggcctgcgagagggcagttggtcgcaaccttgacgcgccctacggttcgacgcgtgcgcaccggggcgacattcctgcccaatgtattagggatgcgtggcacccgacgccatgcaggatgctcaccggaggagtgtcaggcatgcccannnnnnnnnnggagggcagtcggtcgcaaccttgacgcgccctgcggatcgacgcgtgcgcaccggggcgacattcctgcccaatgcattagggatgtgtggcaccctacgccatgcagggtgctcaccggaggagtgtcaggcatgcccacccacgtcccggaggccaccccacaccttgtctccctccatcaaaaatcagcctgaaccactttgcggactcacagcactggtcatctgtgtcannnnnnnnnnggtcccggaggccaccccacaccttgcctccctccataaaaaatcagcctgaaccacttcgcggactcacagcactggtcatctgtgtcatcgtggccagaccacagcagatggacatgcaccgcgactccacggtgccccagtccacgcgcaaccccttggtctgggcggcatgggcagccagggcggccttgatggcctggcgagcgcgcatggccgggccagggggccggacccccaacagatccgctgcctcctgccaaccctcccatgatatgtcggggatggaacctggggcggcgttggagtcgtgcaggccagcgacataggcgtaggtatcctggggggtgacagacggagtggtcaagggtcaatctgatgctgcacgtgagatcatggttgcgcgcatggcgacgtgcggatgactcacgatgaggccttggtagagtccttcctccatggcggatcagatgcagatggtgccgtgcgagggcccgtggcgtcaagggtccattctcttcgggcgggcggaggtgccggggcgccaaccttggagtcgtctcgtcgggccgatgatggttgtctaatgtaccggaaggtttacccttgggtttcaagactgccaagagctgctgccgtcatggccccagatcctctctgacgaattcgagcgcgctccggttttcattcagatcctctgagctgtcgggcatccaaatccgatctcaatcactgtatcttacaaaatggttgcagtagcaccaggcaaaccggttgttatttttagatcatgcatgcattagtagtacatcgagggctcaaatctgtacagggcctgcaggcacatatgccaagcggctgccctcgccccagccagggctcaggtctttgaaaggaaggtagcagtgaagatctgggcaccaccacgaaattcgatatcagcacagaaaaaaaccttggagtcgaaagaattctgaggatgtggggggggatcattaggagcaggtacagtaaaaaagaagagaagaaaactactgatcatgtatcgcatctatcgctggcatctttgccagctgggttctatctgaaggaatactgcctcgccctcaggcatagtgcgcacggaggggaggccccttgcgccggtgattggagctggccgtcgacaggctgcgagcagagtgagggttgggaggggcgagtcactcccgcgcagcagcaggagcccggtgcatgcgtttgctttcattggcaaggcccctggcaagtggtgttgctccccacacacactcttgccagagggcagggttggacctcctcccactcttcccggcccccaccctccagatgctcaccctgggcagcgctcgaagctgggcagcatgggcgcgtctgcgtagcctgggggtgtcccagggcccatctggctctgcccgctggtggccttggcaggcacggtgttccagcgcaggggggtgcttgggtgctccaggttgggtgcctgtgtgtccagcttacactgcaggctgcagaacatgttattatcctgcggtacgagaagggttggagtgggtggatggcgagggcccctttgggataagcatggcaagggcatgcacatgggggattggagagtgccccgggcctggaaggaaagggctcacgggaacgaaacagatgctcccagtagcctacctgtaggtgtctggagcacatgaggcaggtgtagttactgctcgtcccacgcggggctttgggctgaggacggcgacgnnnnnnnnnncgtggggtggcgagggcccctttggggtatgcatggcaggggcctgcacatgggggattggagaatgccccgggccggaaaggaaagggctcactgaaacaaaacagatgctcccagtagcctacctgtagnnnnnnnnnnttgggatgggggtggggatttgagggctggggctacgtgcaaagtcatctaggaccatggcctggannnnnnnnnntacagttggatctctccaagatccatgtggcgcgagatctctgccaccttgaccacatcgtggtatgagctcctcctgacctgtgtggggatgggggtggggatttgagggctgaggctaggtgcaaagtcatctaggaccatggcctggaagctgcagcggacttgtgggaagctgcattcgcgcgcaaagagggctgcagtttcgacccggtcgagactcgcaccgatctcgcacgcctccccatcgccgttgtgctctggatcggagccccgtgagcaatccgtgagccccaggcggtgcccagcgaccgcgccatggccttacctggaccagggactgcgggcaggcgcccagcacacacgagctgcagtggggttgtccagtttcgcagtcccagaagtttagcagggcatccctggaggaccgaaacgcccaacatgatgggcatggggagaaaaacccctcgaactccaccatcgagcgcagggccggggagtgcggggggtgccacagggacgtcccaggacccgcgcgaccgggcatggacggcatggcgtggctccgattgcgcgttcgaacggaatgtaccgccttggaatacaaatgtgtgagctttccagcccctgcgggcgatgcacaacaattaacctaacggaacatggctggagttgctccaagattctctttgccggcatcggaggggtcacgtgtgcccacgagattttgtggtaccagcgaatcgcaagcactgggcacagtacaccacacagcgccagaccccggatcagacaccgagactccacagtgcttgcctcccgcgcggcatcagcgtgaatgcagcttccagccagcagccccccgcaacgccgtcctctccagcctggcatagtactctgccaggtccggggagcgcgccgccgcctcccaggcagcctgcgccccctgcagccatgcagcctccgagggggcggggtccgagggtggaggggcctgcgccgcgccgcccagggccgggagcaggagcgagtccaggtcgcggcgctgcgccccctcggggacgcaggcaacgtccactcgcgccgggcgctgagattccgcgccgctcgcgccacgcgcccctgccaggaggcaagcggtgcggaatgagcgcgagcacgggacgtgggcgcaggacgcccctctctccgcgggtgagccggtgcacccggacgcgcggcgcgttcgctcccccggctccccagccccctccacactcacacgcaggggcccaaggggacgccacaaacgccagctccgcggcgcgccgcaccctcgccgtgcaggccgcgccgggccacgccaccacgtgcaccagcaggaggtccgccaggtgtcgctcgccaaacgggccgggcagcgcccgcgtcagcatctccgccgtgatcaggtggtcccagagcgccgcgtcccgctccccctcgcacaccaccaggacctgcgggggcaggcgtgtggtgtgaggccggctgtgcggaccacgcggccaccctgaccagcatcaggccggagcgtgatgcatgcaggcgtgggcgccgggttgaggcctccctctcgagggccggagagggggactggccaccagcagggcgcgccgctcacccgtcggcagacgcacagcatccacatggtctggaccaggtccaacagatgcagcacggcctcaaagggcacggcgccggccgtgccggcggccgcgacggcggacgtcatggccgcgaccaggcgggggggggccgggcgcgccgccagctcggccagcaggcgcgagctgtgcaggggggcggggagcagcgctgccatgcggtcccccgcgctgatctgcgggccgagtcaaacggggtggggtgaggggtggtcgtgggagggtgagggcccagtgtctcccctgggccacgcgcgcatcagacagagtgtgccgagggcggcannnnnnnnnnacccagtgtctcccctgtgccacacacgcatcagacagagtgtgccgagggcggcatggtctgagaggggtgatcacatcacggtgatagggagcgcgattcacccgcgggattcagtgccctcctcatgaacgcaccctcatttgcagtgcaaggactttgtccgatggggcgtcgaccgttcggaagggctgcgcccacggcaggtcggtgctgcccaggagcatcaaggcatcgagcagccttgctctcatggggttgtcacctgtgaggcggggaggaggggggctgatggagcacctcagcatcgcacaggcagcaagttttacccatcgacatgctgctgcattctcatcaccactcaaccagacacgaaggcgtcggcaggccccgccctccatcctcggcagcgcaccaccaatgcatcccagtacgaagccaaagggttcctcagaggacagctctggccggagccccgtgtcgtgcagctgccacnnnnnnnnnnggaagccaaagggttccttagaagacagctccggccggagccccgtgtcgtgcagctgccactcctcgtccacgagggaatcctggaggacggattcctgcgcgtcaagtctttggagcttcagcatggggctccgatcgacaggtcatggaggagtgaccgttcccaagctccatgacgctgcatggctggcaccttgtccccttcttaccgtggcattgccggatccagacagacgcgtgccaccaggacctgcgatcggcgagcctttgtccttcctctgcatcagcaggaccctcggcggggtctgcgtacgggcaccgactccccgtgccggaccgggtcccatgacccccctgttcagcgcctggtcacgacatgacggccactatcaggatcgcattacgatgaaatactgcgaatcttggcaataaaatcatgtatccattcgtgcggctcgctggcacggtctctgtcctgctcgaggagcatgcagagtgagcgcgcccgctctggcgccccgtgggnnnnnnnnnncatactgtcaatcttggcaataaaatcatgtctccattcgtgcggctcgctggcacggtctccgtcctgctcggggagcatgcagggtgagcgcgcccgctctggcgccccgtgggacacggctcagcactaggcccccaggctggccagcaggcgcatctggtggtccagggccagggcgtcgatgaaggggtcgatgtctccctgcaccagcaccgcctccatcccatgcagggtcagccccaccctgtggtccgtcacgcgcccctgtggagggaggggagggctgcaggttttgggggatgcatggaggagttgggtgtgcctttggcctcgtgttgagcgactcacgtgcctctgacgtacgtggtccatgccnnnnnnnnnnctggtgtgcctttggcctcgtatcgagcgacacacgtgcctctgacgtacgtggtccatgccccgtttgtcatgcctcctccccggtccagacctctggcatgatcaaacccagcggccgtcgagacatggcccccctggagtcagcgtccacctcccatgtcaacccttgagctccccccaagaccccctccaccatcccaatcctcaccctcctcccccccccnnnnnnnnnntccggtccagacctctggcatgatcaagaccagcggccgtcgagacatggcccccctgg

SEQ ID NO: 43680 - DNA, 61 bp, Chlorella protothecoides
ggcgggtggaggtggagactttttggcggggggggttgggaaggcaaggacccatgcatac

SEQ ID NO: 43681 - DNA, 7999 bp, Chlorella protothecoides
  modified_base (99)..(303): a, c, t, g, unknown or other
  modified_base (401)..(457): a, c, t, g, unknown or other
  modified_base (1243)..(1348): a, c, t, g, unknown or other
  modified_base (1523)..(1532): a, c, t, g, unknown or other
  modified_base (1669)..(1678): a, c, t, g, unknown or other
  modified_base (1813)..(1822): a, c, t, g, unknown or other
  modified_base (2284)..(2293): a, c, t, g, unknown or other
  modified_base (3685)..(3694): a, c, t, g, unknown or other
  modified_base (4420)..(4429): a, c, t, g, unknown or other
  modified_base (5824)..(5833): a, c, t, g, unknown or other
  modified_base (6379)..(6388): a, c, t, g, unknown or other
  modified_base (6581)..(6590): a, c, t, g, unknown or other
  modified_base (7118)..(7127): a, c, t, g, unknown or other
  modified_base (7266)..(7275): a, c, t, g, unknown or other
gtggggctcgccccggcgagcgccggcgaggaggagaccgccgccgcgagcgggctgcagtggcgcgtgagcgccagcctggccggcgtgggtctgtcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccgtggtcgcggcgctaccggccccccgccagggcctggccccgcgccgcgtcgacgacctgctggccgggggggagaggcaggcggggcggggcgnnnnnnnnnnnnnnnnnnnnnnnnnnnnnnnnnnnnnnnnnnnnnnnnnnnnnnnnntggcgccgccggcccgcgggcgtgctgtgcgtggaggacgcgcgcctgacctgcgcgccgctggccctctggctggcgcaggagcacctggaggccctggctggcgcggcgcgggtgctgggcagggcagcgggcgtcggagggggggcgggggccccgggaagcggtggcgcgcaggaggtgacggggcggcgatcgtcgctgggaacctcctccgagggcgggaaccccccccctcaaagcctcaacccggtgctgtccagcccgggggtgctgcagctgctggggggcgcgccgctggcgctggaggccgaccggaagctgttcatcaacctgctggccctcgcgcctctgcgcatctccctgtccttcctacccacgcccctgggggacggggcggggacaggtgagcgggcggggtctgtggggtgtctgttgcaggaggtggagggttgtcgtgctgtgggaacgatcggcgaccgcggcatcggcatgcgtctcgtcggaatgcataccccgcaccagctggagcgccatggacatcttgtgcgctcgactcctgcacccctctttcacctccctctcgatcccccccacccctcttctatctgtcagtgggcccctaccggcgcctgctgtccctggctgaggtggaggacgcgcgcatccgtctcgccgcgctttccttgcatcggcccctcatgggccaggcggcgctgggtcagctcctgcagcgccactacgcgcgtgccatcctgccagaggtctacaaggtatggagatgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggggagcaccctgtccctccacattcacacctgtccagcaccccactcgcacccctactttacatgcatttgtccccaccccccccaaaccaactcccttttcttcccaaacagatcctggggtctgcggcggtgtttggcgatcccatcaggctcgtgcatcacctgggcctgnnnnnnnnnngtctgtttgtgcatgtgtatgtctctaggagacttcaatgttgtttgagagtgggcggactggattggagatgggagactatgcaagcatgcattgtgtactggaacacacttgatgcaccactcgacgaaggggannnnnnnnnnctgtttgtgcgtgtgtgtgtctctaggagacttcaatgttgtttcagagtgggcggactggattgaagatgggagactatgcaagcatggattgtgtactggatcacacttgatgcaccactcgacgaaggggannnnnnnnnnccatgcatttgtccccgcacccctcaaaccaacccccttttcttcccaaacagatcctggggtcggcggcggtgtttggcgaccccatcaggctcgtgcatcacctgggcctgggcgtgtggtcggtgctggcctcccctgccgccgggctggtggaaagcgcgcgcagcaggggcccagcccagctgctgctgggcctggcggaggggccgcgtgccgccgccgcgcactttgccttcgcgctgagcaatgctgccgggaagacgaccgccgcggcgcgcaaggccatgtcggcgctggggctggacaggtgggtgtgtttgagggaaggtgcgggggggcccgtatgtgttgcgcttgcaggcgtctgggtgtggcggcggcggcgacatgcgtccgtcaacggatgtgaccttgccgggggtggcccattcatctggcgatcgtcctggccccttgctnnnnnnnnnnttccgtcagctgatgtgaccttgccgggggtggctcgttcatctggcgatcgtcctggccccttgctacttcctcgcccctcgctcactgcctcatcccccctccgcaggtacactgctgagtacccccaccggcccaggcgggtcgagagggacgggggctcagcgctgatctggcgctcggggacttcactgctttctggtgaagaccaggggccgacaaacggacgcggcgaggccctgctccccgccaccctccgtggcctggtggggctcgtggccgagcccgcagccggcgcagaaacaggcgagcagcgggtgttgcatcatgggggcaggccacgatccaggttttgtccctccattcacagcattgcacgacatttgcaaggaacactctggcgagccctggcgcccatgcagactgcgccggctgaggtggtgcacgacaggcacacacatgcccttctgacattacacaatctcacccctctccaacaccctccccctaccaggtggcctgctgggcgcagcgcacggcctggtcaagggctcagtgggagtggtagtgctgcccctggcctccgcgctggacatgctggcgcgcactgccgccagcgtccggctggcggtggtcggtgcgccggcgctgggctggacccgacccccccgctacgtgcccgccggcgccccgctgccggcgtatgtcgccgagcaggcgctcggccgctggctgcttctggagctggaggcggcgggggagttgggaagcgcggagggaggcacgaccccggccgccgcctttgtctcctgcacccgtctcgagccggacggaggcaagcacctggtgctgactcagcgcttcgctctgctcgtggaggcgcggcggccgcgctgggcgccgcgcctgtgctggcgcgcggcgctggaggacctggaaagcgtcgcgcaggtgggggacagcggcctgcgcctggtggcgcagcgtgcacgtcgctcagctttgaccccggggcaggggcggggcgccgcgcccagccccttctccctctcagtgtgcgaaattcggtgcgccgggtcggagccggcacgggcgctgcacgacgacctcgtatgcagggcggcggcggcgcgggcggcgcgtcggggagcgtgggtggggctgtgagtgatgtgctgcgcccgcgtccgaatccagggacggaggatgtgttggacccagggtctgtgcaccattccagttacaggtggccactccatcgtcaacacgtctgcactgcacgcttctttgggacgattcaactcatcgcaccgcttgtagagagtatattcaaacagccttggatctctaggtggtcaccatttttcgggaaagttggaaaaactgaatctnnnnnnnnnnaaaatagccttggatctataggaggtcaccattttttcgggaaagttggaaaaactgaatctgccccgcggactcttccccagcaaagttccagcagagacccacttgtgccagcatcgggatcgccgcgtaccgatccgggatccaaaacatttcgttccagtccagattgccgtaatcgtactccgtcaagagcagccatcgcagggcggtgcatccgactctccactccctcgagtcacctgtcggagatcatgacgaagacctcgagcgtgcccaccgatccccatgagcgcctggcggccatctcccgggagtttggggagtatggaggtgcgatggcgtcccgagggtgttgtggggaggtgtccatgccgcccgcggccttgtccctgtgccctgctgaggtgtacctgtcagcttctcgagtccccgcttccagcatggccccccctccgcacaggcgtcaacacctccaccgagacttcctctacatttaccggtgggcacatgggctgtcgatggtgcgtgtctcgtcctgcgtgggcggggcatcgcgccctcggacgaccgggcgcagatttgccttcgggaagtctcgggcagcggtcaagcctccggctcaccccggtcaacgtgcctgcctggctggccccccaggaacgcagctgtgttctgtttatgccgaagcatggatcccttttcaggcctcaccctcctcacctnnnnnnnnnnccccccaggaacgcagctgtgttctgttcatgcagaagcatgaatcccttttcaggcctcaccctcctcacctgggacccacccccctaacctctgacagtgctgaaggcggaaaccctgcccgacatcttctccggcaagatgggccccgaccagggcgggtgctacctgtacggccgctgcttcaaccccaccacgcgcacgctggggcgccagatcgcggcgatggagggcgcggaggccggctactgcaccgcctccggcctgtctgccatctcggccacgctgctggcgctgtgcgacaccggcgaccatatcctggcttcggacgcggtctacggcggcacccacgccctgctgcacgacttcttcccgcgcaagtttggcatcacctccacccagctccccgtggacgacctggcgcggtgggaggctgcgctcaccccccgcacccgcgtgctgtacgtggaaagcgtgtccaaccccacgctggtggtggccgacatcccagccctggcggcgctggcccgcgcccacgggctgaccctggtggtggacaacacctttgcgcccatgatcatctcgcccatcgcgcacggcgccgacgtggtggtgcactccgtcaccaagttcatctccggcgcctcggacgtcgtggccggcgccgtggtcggccgcgcggccttcatccaagggctcatgcacccatgctccggcccgctcatgctgctggggcccaccatggacccaaaggtggcggcggagctcaccctgcgcctgccccacctggcgctgcgcctgcgcgagcacggcgcgcgcgcggagctcttctcgcgtcgcctggaggccctgggcgcggcggtgcgctatccgggcctgcccagccacccgcaggcggagctcttcgcgcggctggccaacccgggctatggcgcgggcggcatcatgaccgtggacctgcgcactccggggcgggcgggggccttcatggagcgcctgcagaacaagcacggcttcggcctgctcgccgtcagcctgggctacttcgacaccctcatgtccgccagcgccgcctccacctccagcgagctctccgacgccgacctggaggcggcgggcatctcgcgcggactcgtgcgcctgtccgtcggcatcacaggcggcgcggaggcgcgctgggcggcgctggaggaggcctggcgcgccgtcgcctcggtgccggaccacgtcgtcaaagcgccctacaaggcagcccaggtgtgtatggaagttttgggctggagggaatggggggagcagaaacttgttggagcagtggagggatctggtgtgggatttggaggtttggttgcggacttccggcaagtcttcgtctgaaggagaatagagggggannnnnnnnnncaggtttggatgcggacttccggtgagtcttcgtctgaaggagaatagagggggaacgcgcctttccgtcgcatctcatcaacgtgatcaagctccctgacgtacttcgcgccaccccaaccaccacgctgcagattcgcaaggatgcggtgacgggggcacgcctgggacggaccccatcctggcacagctttgggagcgacgaggagggtgcagaccaggcggagcaggagcaggtgaggcgccatggtgcgcgtgacgggggccagctgtggcaggcaggaggatcagggggatccatcgttctgtgccggcatctggtccaggagcgtcgttgagacatcgaaccgcactgctccacccttcaattcctttggtcctccatccgcgcgcagaagcggatgaagagggacggaccctgggtgcgacgcatcgacaccaccaccgaagtggagtacactcccgtggcctgagggccaagggactgagggtttgtagagctggttgctggccctcgagtgcatggcatgcagggcagcaatcggnnnnnnnnnngctgaggatttgtggggctggttgctggcgcccgagtgcatggcatgcagggcagcaatcggggccttagctggtcagggattgccacatttctccgtatgcaagatgctgcgatgggctgttgatgtaccccttcccgtcatgggtgtggtctggaagctcgaccctgggaacagcaaacatcggttctgcnnnnnnnnnnatatgcaagatgctgcgatgggctgttgaagtaccaagccgccttcccgtcatgggtgtggtctggaagctggaccctgggaacagcaaacatcggttctgcaaggttcagcacattttcccgtgggcagcagactcagttccgcaccatttccaccccgcatgcatgctgcactgaacgacgcctctgaaattgcttgtaccacctgcatgcaagagtcccgctgccgggaagtccaatgagtcttgtaaagtcggcacatatccactgcaagagggcaggtcacggactgcagatttggtgcgaggtcgtgaggcggctggctggatgccagtgttcaccaggctggctctacatggcagcattgtgcactcaggcccttccaatatgtagaaacgatacaggggtgcacctctccctcccatgctgaaccctgatcccatacgagggtatttccgcttttacatcgagggggacaccgcacagaggctccccgaccatcaaacacagagcgggagggaagggggnnnnnnnnnnagttcaccaagctggctcggcatggcagcatcgtgcactcaggcccttccaacttgtagaaacgctacacgggtgcacctctccctcccatgttaaaccctgatcccgtacgagggtatttccgcttttacatcgaggnnnnnnnnnnaggatcagttcgccgcgccgcgctcagcggccgatctgagcatccagcagctccgggcgtgggcctcccccccccagcccccccttgcccgagcgcccgcctactccttggaggcctggctctgcacgcgcagggccctcttcttggcgagggactcgctgcggcgctcgcgctcctccttcagcctggagaccagcagcttgtggtactccgcctgctgcgtcttcttggactcgatgcggcgcgccttgagcgcggcgcggtgccgcttgtgctgcagggtgcggggggtgaccaggcgctggatcttgggcgccttgatggtggtcttgccgttcttcttctcgatcttgcgcccgtagatcttgacgtagtgccgcacatcgtcgtccttggtcaggttgaacatcttcctgatcttggaggcgcgcttgggcccacgctggcgtggcttctcctcgtcggtcaggccgggcagctccgccacgcccttcctcacgatcaccaggttcaggacggagaggtcggaggagacgatgcagccgcggaccgacttgcggcgacgctcgccgtcgcggcggccgtgcccgcggaagcaggagtcgccgggggacatgagcacgcgcacgcggccgggggtcagcacaccctgcttcatggggaagccctgcttgtcctggccacccttgatcttgaagatgtagcccttgaactcctggggggg

SEQ ID NO: 43682 - DNA, 114 bp, Chlorella protothecoides
aaacgtcagtctgcctctcgcgactcgtggcccaagccaccaggccccctgcgatacagctcctcagcgactcggaacctcgcggtggcccgagtctcgtactcgccctcccgg

SEQ ID NO: 43683 - DNA, 77 bp, Chlorella protothecoides
cacacttgacaagccggcctgcaccgggatccaggggtccggctggacccctggtgcgacgcagacagtcctggctg

SEQ ID NO: 43684 - DNA, 76 bp, Chlorella protothecoides
cctcccttcaactcctcccccccctcccccaccacacacaccaacacacacagccgctggtgaaggaggacctgag

SEQ ID NO: 43685 - DNA, 61 bp, Chlorella protothecoides
tggtggaatagcagcggcgggcaggcagggggcctgcaggaacacgagagaagaggcactc

SEQ ID NO: 43686 - DNA, 65 bp, Chlorella protothecoides
ctactgtgaaactgcgaatggctcattaaatcagttatagtttatttgatggtacctgctactgg

SEQ ID NO: 43687 - DNA, 61 bp, Chlorella protothecoides
ccccgccgcgccggtcgaggcccccaccgcgccgcgctgcttcaactgcggcagctactcc

SEQ ID NO: 43688 - DNA, 82 bp, Chlorella protothecoides
ccgacaggggcaggtgattagcctttcaaacatggacgcacgacgggcgccggtggggtgacggtccctgccgacaacacat

SEQ ID NO: 43689 - DNA, 162 bp, Chlorella protothecoides
gggaggggcggtgcatcgacccccgagagcaggggggtgcggagcggggtgcggcggcggccgggcggaggggaccctgcacggggggccggccttcgaggagcgcaccgtggagccccactgccaccccctgccagccaccctcccgcaccaaagcaccgt

SEQ ID NO: 43690 - DNA, 61 bp, Chlorella protothecoides
attcagacaggcagtgtataggaagggggggatctggcccctttaagagctaaggatgggg

SEQ ID NO: 43691 - DNA, 61 bp, Chlorella protothecoides
gcagcgccggtcgatgagggcgctggcggggcgtcctccgccgcgccgccggccgaggatg

SEQ ID NO: 43692 - DNA, 491 bp, Chlorella protothecoides
  modified_base (129)..(264): a, c, t, g, unknown or other
aggctggtggcgccctcccaggggcaggcccccgcgccgcgccccgcgctggcgcccgtggcgcccgcctgccacacgcggccgccggtggtgacggtcacggtcaggtgggaccccgccgccacgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacccgcggttgctgtcgcgcttctcctggcggtcgccgtaggccaccggctcgttcacgccgccccaggtgaacaggctgccgcccacgccctcgtggaagaaggagtgctcgccggccagggaccccgcgctgctgctgcgtcggtgcgcgtgcggcggcggcgaggccggcggcggcggggggggggacggatggtgcgcgccgggcgcgtcgcacgggggcgc

SEQ ID NO: 43693 - DNA, 1540 bp, Chlorella protothecoides
  modified_base (185)..(202): a, c, t, g, unknown or other
  modified_base (379)..(388): a, c, t, g, unknown or other
  modified_base (938)..(947): a, c, t, g, unknown or other
cgtcgggctgcggcgcctcatgtcccaccccggcggcttggacgcgccgacgcccgacggcctctcccccggcgagctccagcgcctggccttcgcccgcctcctcctccgcccgccggccctggcgctgctggacgagcccacctccgcgctgggcgcgggagcggcggccgagatgtatgccnnnnnnnnnnnnnnnnnnacgtggcgccgtgatgcgcagggggcgtttggaggagcacgggtcgaggcagcggcgcgtgtcgaccgtggctcttgcgtcgccgatcgtgggcgcacggcaaccattttcaaggccaggagcgcacagtgttgccgagtgcgcggatgaactttgtgaagtcttcactggtccgcnnnnnnnnnntcgcggccgcgggcgtcacctgcctcagcgtgggccaggacgtgccgcacctccgcgccgcgcacgccgcggtgctgaagctggtgggcggggatggggcctggacgctggagggcggcgacgacgtggcgccgtgaggcgcgggggcgtttggaggagcacgggtcgaggcggcggcgcgtgtcgaccgtggctctcgcgcctccgatcgtgggtgcacggcaaacattctcaaagccaggagcgcacagtgttgccgagtgcgtgcatgaactttgtgaagtcttcactggtccgcctcaccccatacccctttcagagcttttccaaaagtaccctggatctgaccacttctcgattttcccgtgtcgtcccatccagaccctgccgagtgcacagccacgcccagctcagttttcaccccctctgagccggtccacctgctccgcaacacacacgctctgccaacctgtacaacagtcaaccacaaacctgcacaatgaagcaaccgagaatcatgtccaacaccggctgcaggggccggcacacnnnnnnnnnntctcgattttcccatgtcgtcccatccagactctgccgagtgcacagccacgcccagctcggttctcaccccctctgagccggtccaccgcaacacacacgctctgccaacctatacaacagtcaaccacaaacctgcacaacgaagcaaccgagaatcgggtccaacaccggctgcaggggccggcacacattcgcctgcatggcacacccacatgcccagaggactcccagataccccaggttcagggccgccggggcctggggcccaacctcatggcggcgtccagggcggcgcggtaggtccgctcgtagtacagcttgcgcgcgtgccagccgcgctccctctgcgccttcgcacagcagtcgatcgcagagtcgacgccgacctggggcgcggttcgcgccagctcctgcaggctcttggtacgcggtcccctctttgtcacgggggcggcggcaacctccccctccctccccaccgctcgcaggggcaggggcccgaccccgagcggggcccaggcctgcgccgggccgcgccgcagcgccagcagcaggctggcgtcgcggcgcggcgcaggcagggacctgccg

SEQ ID NO: 43694 - DNA, 5223 bp, Chlorella protothecoides
  modified_base (154)..(341): a, c, t, g, unknown or other
  modified_base (1558)..(1567): a, c, t, g, unknown or other
  modified_base (1747)..(1756): a, c, t, g, unknown or other
  modified_base (2086)..(2095): a, c, t, g, unknown or other
  modified_base (2580)..(2787): a, c, t, g, unknown or other
  modified_base (2910)..(3136): a, c, t, g, unknown or other
  modified_base (3272)..(3281): a, c, t, g, unknown or other
  modified_base (4001)..(4066): a, c, t, g, unknown or other
gccccggcgcgccgccgccgcgcgacccgccgcccctgccccccgccgcgccgccgcgcaggcgcctgcccgcactccccgcccggcccccgggcctggaggacatggtcctggccatgaacgcggccacgggcgcggcggtggccagcccgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntccgtctcgccggaactggccggcggcggcgaggagagggcgggggacgcccggcgcggcgcccccgccggcgcggggccccgccggggcgcggccccccgccccgcgctgacctaccgcctgaccctggcggcgcagaacctgcgcgtggtggtctccggcgaggcggccggctcggcgctgtccggaggctgcgcgcgccgcgtggacgccaccgccttcgtcgacctgttcagctacctgtcgcgcgagtcgcgcgccgtcatcgccgcccacctcctgccggcgcgcgagggcctggacgcgctgcgcacgccgctgtcggacgaggcgcaccgcgccgccacgcaggggctgcaggaggcgctgcgcgaggcggagatcccctccatggccaaggtctgggcctacccggaggacatgcccgccatcctggccggcatccgcgagcagcagtcagggctggcgggtggggccgggacggggagtggggcgggggggggcgcggacggcggcgacacgaacaaagggcggcgcccgcgcgcctcgccggccggggcgccggcgcccccgccgccgccgcacccgcccgtctcctcgctggtcacgggcgacgcggcgctggcctaccccatgcccctggtgcccttcctcaaggtgggcccgctgcgggcctccatgctggagcggttggaggcggcgcccagcgcgcccagcggcgccgccatcatgctggccggcaccgtgttcggagtgcaggcctgggtctccccgctccatctctggcacctgctgtcggtggagctgaccgtgcggcgcatggtccagcgcttccgcgcctccagcctcctggccgagaagcgaagggccgggcacggcgcggagagggggggaggcgacggcgaggggggaggcgtggcgagtgtgccgggcccgcccgcgccagggcccccaaccaagaccttccgcaagctggtggtcatgtttggcatcggccagaccaacgtgctctggatggtgagagggggaggcaagtgccagggggacgggaggtgtcgaaggtttccaagggcggctgtgtgtgagtgacggtgtccttgcaggctgatggcatggcgggggctgccatgatggactggccgtgctcctcatcatactgcgacccctgcccattgcagcagcacccggcgcccgacggggcccacgccttgaacggnnnnnnnnnngcagggggatgggaggtgtggaaggtttcaaagggcggctgtgtatgagtgacggtgtccttgcaggctgatggcattgcgggagctgccatgatgggctggccgtgctcctcatcatattgcgacccctgcccattgcagcagcacctggcgcccgacggggcccacgccttgaacggnnnnnnnnnnctggacgcccaagggtctcccaggccgtgcgggcgccgcgccggccttccgccggcagtggggcatcacggtgcgtcgcggcgaccctgcatttgtctgggcgcaatggctggcgcccatctacagcatcgccatcgccgacgcgcgcggcgtgctacgcctggaggtgtgtgcgggtgtggtggtgcggggggtgggggctgtgaggtcgattgtgcctggtcaagttgggggggttgaaacctgacgccctgtgtcaaaggacccttgtccccaccccaactccccacttccccaccctctccaacaggccgacggcggcacgctggnnnnnnnnnnagggctgtgaggtcgattgtgcccggttggtttgtgggggttgaaacctgacgccctctgtcgacggacccttgtccccaccccaccccaagtccccacttccccattctctccaacaggccgacggcggcacgctggcgggcgcgacgttggacggcgtgatcgtgcgcgacctgcagctgccagagcgcgcgcagcacgcctacgtgctgcgcccgctgcccgtgcgcgcgcggcgcctgtcccactgggtggccagcatgcgtcgccgcttcctgggcatccgccgcgtgtcccccgctcgccttcgctgggtgacggcggtgcaggcggtgatgctggcgcggcgcatccgcggcacgggcgacgcgggcgcgctgctggcggtgccgccgctgcacagcgtcgcgctcggcgggctgggcggcggcgccacgctggggccccagttccgcgtccagttccgcggctacggcgggggggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngccggggcgcggccaccgccgccccagtccccgccaccaccgccgcagtccccgccaccaccgccccagtccccgccaccaccaccccagaccgccatgacacagaccgccggggtttgcgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttaagggagtatcatggagggaggtggattcggcggtgggcggctccatcggcggcgtccctggctgggaggtggtacgggttgggtgggatgggtatgcaagtagcacacaactcccgtactggcacattcaccnnnnnnnnnnccacccgcccgaggacgaggccgacctggaggtgggccagatgctcgtgtacgcgcgcgtcaagcagcaggccagcatcgcggcggccgccacgcagctggcgcagatcgtggccgcgctgaccgcgccacggaaggatgtgacggcagctgggggtggtgcagggggcgccgaccggggcgcggccgccgcctccccagtccccgccaccaccgccccagatcgccatgacacagaccgccggggtttgcgtgtaaaggtgctggtggtaggcatcgacctgctcttccgcgtgcagtcgcgcgacctcatgtcggtcaagctccagtccggcacgctcgtggccgagcgccggcggttggggcgcggcgcgatgccacgcgacgtgcgcctgcgcatcaccgccgccatccaggacgtcatggtccaggacttgagggtgggtgtggattgggtggaaagggggaatgaggtggggggtgagggagtgtcatggagggggtggagttcggttgtgggcggctccatcggcggcgtcccaggcgggggggtgtagtacgtgttgggtgggatgggtatgaaagtggcacacaactcccgtactggcacattcaccctcctcaacccctccccctccaccaccaccaacaggctggggccgaacactgcatggtgctggtgcccaatggcggcgcggagtactgctcctttgacgccgcnnnnnnnnnnnnnnnnnnnnnnnnnnnnnnnnnnnnnnnnnnnnnnnnnnnnnnnnnnnnnnnnnngcgccctccctggtcctcgagcttcaagtgaggaggtctttgaggggtggggaaggggagtggaatcgaatggggctacgtccatgcatgcccagattctggactgggagggcaaagggtttctgggcatgcagggcgcatactgctttgtgctgcgccggggaatcgtttgcctggcctgcgcctggcgtttcccaaggccatgcatcctccaacacgagctcccattcctccttccaccccaacccgcagaacccgcgtatcctgctcctgttccgcttcgtggcggacctgctgcacgctgccgacatcgtggagtcggcggccggcagcaccgcgccgcccgccgccgagcgggcgggggagggcgcggcggctggcgccgtggaggagccggacatggcgggagtggcggggccccgcgcgccgcagccacccgtgcccagcgccgaggccgcagcgaaggcacgggtgctggagggcggcgcggccgcccccctccccgaggcagatgacctgttgccggacgtcgacgatccgggggagtgcggcgtggcagggccggggccctgcctccccctccagatcgtggtgcagctgagcaacgtgggcatcgtgctgcccacctccgccacctcgcgctcggtgctgggggcgcacatggagcacgtcctcctcgccatccccggtgggtgaagatggggtgtggagtaggttgggagccttgctgggtgaggctttgttgggtggtcaagcatgtacttgtgttgacagggcggcgtggggagcatgaggggcagggccggggccggcactcttacgaaatggcagcctgactcagcaccacctcgacctcccccatccccaggcgacgcgctgccggcgtcgaccttggaggactgcaacctgccctccttgggcgtgatggtggaggagagcctgctcagcaacgccacctacaagtacagcgccttccaccgcgcggcggaggagggggcaggggagtgcagcggcgcggcgggggaggcggggaacggcagagtgccccccgcgccccaccccccgatccctggcacgcacgccgtgcccggcaccccgccggcctgcggggatgcggggccggccggcccgtccaccgcgccccccgcgcccgagtc

SEQ ID NO: 43695 - DNA, 63 bp, Chlorella protothecoides
ccgctccctggcgacgtaggcttgatgccgcagcttccgaaacggcttctcgtgcatgtgcca

SEQ ID NO: 43696 - DNA, 1504 bp, Chlorella protothecoides
  modified_base (771)..(780): a, c, t, g, unknown or other
  modified_base (978)..(987): a, c, t, g, unknown or other
  modified_base (1054)..(1063): a, c, t, g, unknown or other
  modified_base (1398)..(1407): a, c, t, g, unknown or other
gggggcgggggcgccgccgcccgccgcctgcaccgccgcggcgaaggcgccgggcccggcgccggccgtgccgcccgaggacccgcgatctccgggcgcctgccccatccccgcctggtccccgccgcgcagggccccgccactttgctgcgcctgcggcacgaccacctgctgccgctgcgcggcctgcgccgcctgctggtgctggctcagcacggtgaccagggtgtcgaagcgcgccatcagcacggtgcgctgctgggagtaggccgcgttggcggcgtcgatggcgctctgcgccttgccccgcacccgctccatgtagcgctggtactcgtcctggatgttcttcacccgaatgttctggatgcggtccagcagcgccacctgctcctgcagcccacgcaggttctgcagcagcgcctccacctccgcgggcagcgcgccgcccggcgagtccggcgccagcatggcgcccagctgctgcaccaggttgttccccacgtccagcgggccagccgccagcgcggcgggggccaggtccgccgccaggatcgcgttgagcttggcggtgaagccgtccaggtccgacatggccgccagcaggccgccggaggaggccaggccgtgccgcccgccgccctcgcgctcgccgtactcctgcgtgtggagcgagggtgtgtggttgggtggggtggggaggtagagtacagccagaacgatgtttcttccgggggagaagggtgtggatggcacacaaggagcgtgcgnnnnnnnnnntgagtggagcgaggggtgtgcggttgcgtggggcgggggggtagagtacagctagactgatggtttttccggggggggagggtgtggatggcacacaaggagcgtgcgggcgcccggcccgggacagcgatggccagcacccaaaacaccgggccccccatgacaaaccactcacctccccgctgggcatgccgcccnnnnnnnnnnatgggtgtggggagcgtgaggatcagacactggagagggttgcgtgcgagcgagcagcccgcccgcnnnnnnnnnngcccaaaactccggggcccccacaacaagccactcacctccccgctgggcatgccgccctccagcgccagctgctgcacgcgcacgtgcatggcgcggtagctcaccaggctctgcatgatgtactcgaacacctggagtggcacggaggtgggggtgtggagcgtgaggatcagacactggagtgggttgcgtgcgagcgagcagcccgcccgctcgacaccccgatgatcgtctgcccttcaggtccagacttcccgtccgctgcctcctgaacatctccttcccctccccgcgtccacgcatccaccctgatccccccccgggggggaaacnnnnnnnnnntccatgatcatcgtcccttcgagtccagacttcctgcccgctgcctcctgaacatctctttcccctccccccgtccacgcatccaccctgatccccc

SEQ ID NO: 43697 - DNA, 1732 bp, Chlorella protothecoides
  modified_base (114)..(283): a, c, t, g, unknown or other
  modified_base (1334)..(1343): a, c, t, g, unknown or other
  modified_base (1433)..(1442): a, c, t, g, unknown or other
ggtcggccgccggccgctccgacctggccgtggcgacgccgcctgcggcgcccgggcgcggctccgacttcaccccgggggcgcccttggggcgggcaggcccggggcgcggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaatggagtcaggtgttgagggaaaggtgcgggagggcaggacaagggcatcgcacgctggcaaagttccatccagggcacctgctggtcagctgccacgcgggtttgcaggcggcgtgcgcacgtcataccggcaccggccgccgcctcaacaggctcggctccccaccaaactcaccgccatcgtcgtcgctggggccctcggatgacgagctcgcccctccgcgctgccagttccagaggccaagggatcgcagctccgcacgcaccccccgcactcggcccttcttggccccaggcccctcatccatcgcaggaggggacgcgagcgccggcgaggtggcggcctgcgtgggatttcaaaggggtctgttggccgtcatgcaagggcttgcgtaggtgggccgaggaattgtgtagaggagcgcaggggcgtcatgcggatcgatgccctccatggcacacggcctcgcaggctaccttgccggtgtgcaggagggatacgcggacgtgccggggcagggggcccacctcggcattgcccttcagctgcgcgcccttgagcaggcctgggcgggtggaagggggcaggggaggggtttcgtgtgattccacatcatcagccccgcctcagcagaggcctcacctaccagccatgtgagcgcccggaaaccacctgcatgccccatccacatcgccgtctgcagagccacgtttgacggcaaccctcgatcgccgcggcgcacctgccctccccagcagctcgtagtggtgcttgaaccatgccagcagcagctcgtcctgctgagcgctccgtgcctcaagcgccctttcctccttctgcagcccgggggcgctcgctgcggtgccgagatagcagtcgatatcgggggtggataaggagacggcgagtacgtggtcccagctggtttccccactgttcaccccacccacggaacatagaacatatggaacggagggatgaagcagcctgtccaccctatggccagtgttcctcggccaacagccgggctggcgaggccttccagtnnnnnnnnnngtgccccatccacatcgccgtccgcagagccacgttcgatggcaacgctcgatcgccgtggcgcacctgccctccccagcagctcgtagnnnnnnnnnntgggggtggataaggatacggcgagtacgtggtcccagctggtgtcctcactgttcaccccacccacggaacatggaacatatggaacggagggatgaagcaccccgtccaccctatggccagtgttcctcatccaacagccgggctggcgaggccttccagtgcaagcgctgcgcccgctgcgcccagtccgctgacctcccgcccaaaccctggccccctccaccttccgagtcggagggcggggcgtcctggaagcgcgtgccgcgcggcgtggggcccgggcgcgg

SEQ ID NO: 43698 - DNA, 105 bp, Chlorella protothecoides
gcgtccggcaggagcacctggtggtcgtgttgtgtggggtgcttggcgggatcctgggcgtcatgttcgcatgcattcatccaccccgcccgcatcctcgcgacc

SEQ ID NO: 43699 - DNA, 70 bp, Chlorella protothecoides
gcagaacttgatgagcaggagagcggcagggcagcaaagggtaccgggcgccgccgacgctcaccggcac

SEQ ID NO: 43700 - DNA, 97 bp, Chlorella protothecoides
gcgcctcgcgcagcaggccacgctctgaaccgcgagtccagatcagtgggaccgggccgggcctcatatcggccaggtgaatgactgagtgcgggga

SEQ ID NO: 43701 - DNA, 172 bp, Chlorella protothecoides
gaggcgcgcgggcacccgctggcagccgccgcatgccacgggtcgtcggggcggctgggcggctcgcccggcgcgtacagctccgccggctcctccggcggcttcctgtccggcctgggcgcgggccacgcgcatgtcggccactccttccactaccccccccccgccggct

SEQ ID NO: 43702 - DNA, 131 bp, Chlorella protothecoides
gctgccggtctcgccccccaagccgacggcgtgcgcgcccgggtgcgcctgctggccttgctgcgcgagctggcgcactcctacgcgccgctggccctggccgctgcaccggggctgcaggccgcgctggc

SEQ ID NO: 43703 - DNA, 61 bp, Chlorella protothecoides
atcggaagagcacacgtctgaactccagtcgcacagtgatctcgtatgccgtcttctgctt

SEQ ID NO: 43704 - DNA, 61 bp, Chlorella protothecoides
tgttgggtgtccatgtggctgcctgagggcgtatcttgctgtggttgtgctagaaccagct

SEQ ID NO: 43705 - DNA, 106 bp, Chlorella protothecoides
tacggaagcggggagggcttgaggcgcagcgccagcccgagccctcttcggtcaccccgtccactcacgacgctgaccccccccgaaccatgttttgcccgaattg

SEQ ID NO: 43706 - DNA, 62 bp, Chlorella protothecoides
ggccatgccgtgattgcaggggaggggagcaggcaggagggtgagttgggaggttgcactgg

SEQ ID NO: 43707 - DNA, 71 bp, Chlorella protothecoides
cctggagagaagatgggtcgcaaggcagggtgagggtacggccgcctgatagggaagctggaaggagtaat

SEQ ID NO: 43708 - DNA, 70 bp, Chlorella protothecoides
gcgtggaggaaagcacgcgctgtgtgtgtgtggtgtgtgtgtggtgtgtgtgtggggggggggggggggg

SEQ ID NO: 43709 - DNA, 70 bp, Chlorella protothecoides
tcgctggggtcgaggttgcctggtcgggagtggcgaccgggtcttctgtcggcgccagagggtttgcgaa

SEQ ID NO: 43710 - DNA, 72 bp, Chlorella protothecoides
acccttcacccatgttccccacccatcatcacaacctcccacccccccctcccaggtcactgccaggagctc

SEQ ID NO: 43711 - DNA, 75 bp, Chlorella protothecoides
gggtttctcatagcaattcgcatcggcaggaggggaggcccaggctcctccctgggaagtaaacgaggatcctcc

SEQ ID NO: 43712 - DNA, 61 bp, Chlorella protothecoides
accccgtgttttctcgccctgtgtcgtaggcctctcagacgccccctgtgccactcggcgt

SEQ ID NO: 43713 - DNA, 4506 bp, Chlorella protothecoides
  modified_base (178)..(267): a, c, t, g, unknown or other
  modified_base (1116)..(1125): a, c, t, g, unknown or other
  modified_base (3407)..(3448): a, c, t, g, unknown or other
  modified_base (3896)..(3905): a, c, t, g, unknown or other
  modified_base (4208)..(4312): a, c, t, g, unknown or other
  modified_base (4433)..(4442): a, c, t, g, unknown or other
cccaccccccccctccgtccccagctgggctaccgcctggcccacatccagcgccgcatgctgccgatctccatgcacctgctccagcgcgacggccagttcctgaacgggcacgacctgttcctcaagcgcgtgggcgcggcctaccacgccttcatcgaggactcggagacggcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgcctggaggacctgcagagcaccacgcggtacgtgacctggagcctgcacaccaagtcgcggagcagcctgaaggccatgctgggcaaggtgaccacgcccgcgggcggcgcgccgcgcgcgggcaaggccgccgcgggcgcggcggggggggcgggcgatgcgcccatgctggaggtactggagaacacgctgtggagccggacgctgggcgcgatgagcgaggagatcgtggccgcgctggtgtgccagatcttcgagggcatccgcgaccactttgtgcaggcggtggagctcaagttcaactgcttcttcctcatgcccctcatcgacgccttcccgacgcgcttgcgcgaggagctggaggccgcctacgcggaggacctggacgaggtgtttgacgtcgccgcggtacgcgccgccctggagggccggctgaaggcgctggagtcggagctggcctccgtggagcgcctgcagcgcaagtttgccatgatccactccaccctggcccagcagcagtcgggcgggggcgggggtggcatggcaggcggcggcggcggcacggcgggcggcgccaaggaggcggcgcgcagcagcgccgagaacgcgctcctggcggaggcgctgcgcgccgaggcggtgcgcgcgtcggcggagaccaacccgctcaacctgtcgcagagcagcctgcccgggcgggcgggcaaggcgggcacggaggccgcgcgcaccgtgcaccgcgcccccctttccacgctgcgatgaggatggggcagccggggggcgggcgggcgggtggactgccgccgggcggatggactgccgccgggcgggtctactggcgannnnnnnnnngagccgggggggtggcgggcgggtggactgccgccgggccagggggctgctgccggccgggtggactgctgccggccgggtggactgccgccgggcgggtctactggcgagcgctcacaccggcggtgtacgcggagcgccgggcgctgcgctgcattgcctttcccccctcacacactgaaaaggaagaaatcctcccttacccccaacattagcccctttcatctcttacccccccggaaaagatcctcgcacgtgcgagaagagatgtgagacctgcagatgtgtacccgcccttggcctgtgctttcccctcttcacttgacgtaacagactcctctcccatgacatgtaaaattcagatttgcaggcgcgcagaaattttggattcggatgacgtgatccagaattcagctgtggcatgccaggtgctgcccagtggcggggcgtgtcggtccggaccatttcacgttgtcgggggcaggccgcctcgtgatcgatctcaaagcccacgagtcggccatgccagggtgttgaggggtctcgaggtagtccgtcacagccagcctggtgcccgagctctcggcgacggggtgactgtcacgacggggccgccccctgtacacacaccgcgaggcagggatgccgatcgaggacgctgcggcggcagctcgggagggaaacatggacttcatctaccacctgaacacggagcagctgcatgccgtggtccacaagtttgacgaggacaaccggaccctgctccatgtggtggcctgcacgggggacctggatttggtgcagtatattctagacagcggcggtaaagagctcatcgaccacgccgatgacgaggtgcgtggtgaggcttccacatgaggccccctctggcatgggaggggtggtttccgacggccccggctcgacaccgcccgcctcgggccccgggaatgcaccggcatgtcggcgcgcgggagcgcatgctcacccatgcccgctccattaccgccgcgcagggctggacggccctgcactccgcgacgagctgcgggtacccctccgtggccaagctgctgctgatcacgggtgccagcgcggggcagaccacagcgcaggggcgcagcccgctccactacgcggccagcaaggggtgcgtggacatcatcccggatctcgtctcgcacggcgcggacgtgaacgcgcgggactgcacaggggccacccccctgcaccgcgcagcctccgtgggcttgaccccggtgctgcgcgtgctcctggacacgcccggcgtgaagctggacgtgaaggacaactacgggcagacccccctcagcctggcgtgcagcgggggccaccgcgtggctgcgctggttctggcaggccggggtgccgacgtggaggtggggcatgtctgtgagggggggcagggtgtctgggaatgcgtcattgatttgttcgtatgaggaatgtttgcagaactttgccctctgagttccatggattgtccttcacccgagctggcttgtcacatccaagcttgctactgctcttgatggcatatgctccgctttcttcctcccagcgtccttatgtcgcctccttcccaatcctgccacgcagtctgagaatcaggagggcgagacgcccctgagcctggcggcgccctttgggtcgctgcgcttccacctggggcagctggccaagggggagaagaccctggacgactttgagctggcgtgagggtgcccaaccgcacccccgcccgcctatcaacttctggaaacctgagcgaagtggagctcgggagcagggatacacgggctgaacctccactgcacatccctcgggaggtttgcttgcggaagcaacctggctgacaaatgagccggcataaacgcccctaccaaaggacccctcggccgcctgtcccttcataagcacccaatgggctggccgagcttgaggtttcgttgagaactgcaccctcccaacccccatttttcacccatcacccacagccccacaagctggggaccctctccctcaagccctttgaacggtttggcatgcaccatgtgaaggtcgtcgcccctctttaccatatcttcagtactcaagacacacttctctcctcgtctgtctgacacgcgcctcttgcaggctcgcttttcctggtgatgtacctcactttctcaatatgctcggagtggctgcttgtcttagtatctgttcattccccttcatcgcgagaggaccagtgagaggggggggggggggggggnnnnnnnnnnnnnnnnnnnnnnnnnnnnnnnnnnnnnnnnnncgtgggcgagggttaggtgggtgccgtgggattacatggggtggcaatggcatcaagagagatatgacagagacggtctggagcggtctggagcgattcatgttgctcgcggcggggaaacaagaggggatgggcaagtccaatgccctggcgacgccagccgcctttgggggtatcgagcagggaaggtcatggagcttccccatgggcttcctcgcggaggcttggggctgttgcgctgcagatcatgaggagcagggcacccgcgcacggcaatgggtggcgcgtgtcgtgctgtcgacaggctcgcgtcagggcagggcctggagcgtgggccggccaggccccggcacggccaggccgggccccagctccatgccgccatccctcatggcgccggggtcggtgggggtgtccgggggcggggcctgcgcctcgcccagcgtgnnnnnnnnnngcgtgctgtcgacaggcacgcgtcagggcagggcctggagtgtgggccggccaggccccggcgcggccaggccgggcccccgctccatgccgccatccctcatcgcgccggggtcggtgggggtgtcggggggcggggcctgcgcctcgcccagcgtgctgggcggggtgaccagctcctcctccgaccaggcgcggtcgcggggggccagcccctcagcgctgctgctcaggtccctggctccgctgccaagccctgcgtgcccggctgcatcaccccccgcacagtcggcgccctccggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagccctggccgcccttgcccggccagtgggtgggaagcgtgccccacttggaccgcggcgtgggctggggcgcggggggactgcgcagtcgctgggcccggccgccggcccccacccccnnnnnnnnnntggtcacggtccatgccgccctcgacggcgcctgctgcgcctgctcccaggtcccgcgctggac

SEQ ID NO: 43714 - DNA, 89 bp, Chlorella protothecoides
ccgccgccctgcaccgcgtctggctggaggcgagggggtggcgaggggttgggctggggggctggggagcgggcggggccggcgattgg

SEQ ID NO: 43715 - DNA, 61 bp, Chlorella protothecoides
cctcttcacataatcatcggcagccccacccccttgacgctcgtctgtgcaagccatgccc

SEQ ID NO: 43716 - DNA, 61 bp, Chlorella protothecoides
ttccttccggcctgcatattaccggcttggggcggcgctgaagcggatgctgcctgcaaag

SEQ ID NO: 43717 - DNA, 71 bp, Chlorella protothecoides
ggtggcggaggggagctgggtggcggagggctcgggcttgaaggtgggggaggagacgacctggcaggcgg

SEQ ID NO: 43718 - DNA, 61 bp, Chlorella protothecoides
ccgcgccagcccgggcaacatgtcctcggcggtggacctgctcgagtcgctggccggcccc

SEQ ID NO: 43719 - DNA, 104 bp, Chlorella protothecoides
ggcgggcccaggaggtcggagcagagctcgtgcagacgcgtctcgtcccgtgcttctgcgtgtggaaagggagaatgtgaggggagggagcatgtgaggggagg

SEQ ID NO: 43720 - DNA, 61 bp, Chlorella protothecoides
agcccgggagtggcggagggtgacggcagggggaaggctgtattggcaacgcagggctgca

SEQ ID NO: 43721 - DNA, 14066 bp, Chlorella protothecoides
  modified_base (432)..(441): a, c, t, g, unknown or other
  modified_base (594)..(603): a, c, t, g, unknown or other
  modified_base (855)..(864): a, c, t, g, unknown or other
  modified_base (1055)..(1064): a, c, t, g, unknown or other
  modified_base (1812)..(1821): a, c, t, g, unknown or other
  modified_base (2115)..(2124): a, c, t, g, unknown or other
  modified_base (2396)..(2405): a, c, t, g, unknown or other
  modified_base (2856)..(2865): a, c, t, g, unknown or other
  modified_base (3035)..(3044): a, c, t, g, unknown or other
  modified_base (5184)..(5193): a, c, t, g, unknown or other
  modified_base (5355)..(5364): a, c, t, g, unknown or other
  modified_base (5955)..(5964): a, c, t, g, unknown or other
  modified_base (8316)..(8325): a, c, t, g, unknown or other
  modified_base (8915)..(8924): a, c, t, g, unknown or other
  modified_base (11913)..(11922): a, c, t, g, unknown or other
  modified_base (12148)..(12157): a, c, t, g, unknown or other
  modified_base (12853)..(12862): a, c, t, g, unknown or other
  modified_base (12963)..(12981): a, c, t, g, unknown or other
  modified_base (13759)..(13899): a, c, t, g, unknown or other
ggggggggggacgcgcggggggacaggtgggaggtctgcggcgcgccgcccactgcccggcagtaccagcacgacctgatccccgcgctccgctctccactcacgctgcccagagccggcagaggcgccgctgggcaggagctgcgccacctgggccacgcccacccgctccgcctcggaggtctgcaagggtggaaagcagggaagtgttgaccggccctgatgagaacatgccggagcgacatgcgggttgtgggtggctggatgctgcactacgttctaggttcgcttggcctcctccactcgcctccacggtgaaggcagacttgacaaaggtggtggagtgctgtttgtccacatgatggacctctgcgcgggggggggggagactcacattgtttcggcatgccgaggatgatgtatctgcatgcnnnnnnnnnnttgtttgtccacatgatggacctctgcgcagtgggggagactcacatcgttccggcatgccgaggatgatgtatctgcatgcgaggtccatgcgagcggtgcccccagatgccagacacaggatggatccagcgattgatgtgacccttctcnnnnnnnnnnttgccccagacgccggacacagaatggatccagcgattgatgtgacccttctcacaacccctcacccgtctcgaagaggccaacaggaaggacagagctctgcgtcgccagtgagggattcatcaccaggtacactggcgtctcattcagccgggatatctgcacagtcgagggtaggtggacaatgtgacgaatgcgagatttcaggaagaaaagaatcttgcggcgtgaacatacgaagctctgaggagnnnnnnnnnnagacaatgtgacaaatgcgagatttcaagaagaaaagaatcgtgcggcgtgaacatacgaagctctgaggaggtatgtggccatagaaggaatctcattgcacaacacgcctcgccatgtacaaaagactggcagcggcaggcttgcctgcgcatggggtcccaggtcctctgggaggggaccctctgagnnnnnnnnnnccaagactggcagtggcaggcttgcctgcgcgtggggccccaggtcctctgggaggggaccctctgaggatgagctgtaccagcccacaatgtccaaggtggggaacacttgtttatctgcggcggaacggcaaatgtcaaggtgcgtgagcctgatggttggatgtgagattgctaatggtgtacctgcagggttgaggatgcggttctccatcagaccctaacccctctccagccctcctcacattggtccgcccttttctgcaaaaattccaggtcgatgctgtgtgaggcgacccgcagctcgaaggagttgctgatgtcgacattcctgccagactgctcgcccagcaagcacccgtatacccggctggggtggtccgaagacgatgtggacggagctgacggattctgccgtgctcgggtgcactgatcgctgatgcttatgaggacgagctgtgatgaaaacaaggggagggccaatggcatcgggatcgcatgtgtttcctgtactggcaccctggtggaaatgatcgagccgtaccgggtgaagtcggaactggagaccagatgtgctcgctggtcgctccacagtagtatcactcgtttgctgcattgctgcactggattccgactcttgcctcggaatcctgagcgtgcagagcctggtgctggggcacttcagcagcagctgcagtccggctggctcagtctccggattttgggaatggattccaccatgtgaaannnnnnnnnntcacttcagcagcagctgcagcccggctggctcagtctctggattttgggaatagactccaccatgtgaaaacccagaacagcctatgatgtcaaacttgatggacgatcagcgcggcacaagtgttggatccagagatctcacatggagggttccgggcgccaaaactcaggccaccgcttgataacgtaggagtgctacatgagcccgtacagcaaccatgcgcgcaacgccagaagcagcatcactcagcgctctctggcgctgagatgggcatcgacatcttgcgctctnnnnnnnnnncgacaacgtaggagtgctacatgagcccctagagcaaccatgcgcgcaacgccagaaacagcatcactcagcgctctctggggctgagatgggcatcgacatcttgcgctctgtcctcgtgcatcagatcaattccaagtcctccgcccctgacgacaccgctcctcccagacgaaggagagttcccatgggcttgttccattgagattacacacacattgcgataagttagggatgagtttgtcggatccctcgcacctggaggcccagcnnnnnnnnnncattgcgataaggaagggatgagtgtgtcggatccctcgcacctggaggcccagctggcttcccagatcgtcaccttgtggaggtcccagacagcaccattccaggccatagttgacgactatgcagctgtactgcaacgagcacaggagtcgcatgtatgtgtgtggtgtcttattcagcactctcacatcgaactgagccacgacatcttgcagcgcgtatagccccattgcctggcttcccctgttcctctgcttgcaggtgagggcagcgcagctcgacagagaagccaatgaggctcgcgctgagaatgacaccctgctacgcgccctcgaggctgccaaacgtggagcagtgacgcaggaggaggtgggcatggaagtagttttgcgctggagctgactgcgagttggtccaaaggcgcagactcagtcttcccagcaaacgctnnnnnnnnnnaacgcaggaggaggtgggcatggaaatagttttgagctggagctgactgcgagttgttccaatggcgcagactcagtcttcccagcaaacgctttggtaatttgtcaactcataatgacaccgctcttccgttttcccctttggaccagtttgcagcactgcaggccgtnnnnnnnnnnggtaatgacaccgctcttccgttttcctttttggaccagtttgcagcactgcaggccgtgctgactcgcacggagacagacctgacggcggcctataaggacaaggcgatgctggcggagtccagcttgcaggtcacacagcagctcagcgtgaggcttccttggcagtagtggtggatagaaatgcggtcacgagacgaggctggaagatgtgggatggggtgttcattggtgttaactgcttcatggctcatatagggccgcacctgtgcaggtccagtgcaagcaccctgctccactctacaaatgccatcccttccacctacctccaggtcgtacgcgacatcaatgagcagcagactcgggagattaaggaagcggaggcagcgatccgcacgctgagggaccaggttagagccctgcgcggcgaagtggagcgactggaagaaagcgtggccatggccggcaaggaggcagaggtggggcccggctttggcctgatgtggaggagccattcagttggggaccctgcttcatgcacagctggcactcccaaggcagatggctggctgatgggcagaagaagatatcaaatgttggcatgctgggtgcgccgtggtggctccccagccacataaaagcttgaggacggctcaccgcccgcaatcccccacacccttgaccctccttgtgcaggcgcaaaggaatgacgccaccgtatccgcggctcgggcggcagcgctggaggctgacaatgcggccctggccagacgcctggtggagctcaaggaggctgagattgagcgcatgaacgacatcaaccgccagggcgaggaaatggtatcttgggagtgtatcaaggccttgagggctctatgggatggaggatggtatgtgatataagggagcccatatgacgatgggccctgctgctgagaagtcgccgtttggtggctgttacgcatgggtggttcttgaagagtggcgaagaggcaggcacagcctccccaagctgcaccagaaccatgcaagccccctctcactccctgactccccgtataacccccctcttacagctcacctccgccaagcgtcaggccgccgagctgctcgccagcgcgagcgcccaggcgcgcgccgcgggccccggcgccgcagtggcctctctggagagggcggcgcggggcctgagcctgggcgaggccgcggcagatgcgctgccggccgtgctggcgcgcagcgtgcccgaggcgcacggcgccggctgcttcggcgtggccttcaaccgcgcggggacggcgctggcgtcctgcggcgccgacaagaccgtgaagctgtgggacgccattgcggaggggagtgcgcccacggccacgctccatgtggggcccggcgaggggaaatagaggaggaaagaggaggggcgggcgggtgcttcgagtctggatgatgttgtggcccggcgcggggcgaacaaattgcggccgtgctgcaataaagagcaaacgtcctgtggcttctctgcccactttgcccaaccagtccctccttgtcgcctctgcaatcgcgcccacaaaagaccccccttccccccctaaaacacggcctagggttgaaatcatccaagcccagctgttgtccaccccggaccccacctcaatctcacccccccctcaccccaaaccatacagggtgcgtttgagggcctgaacagcgtggcctggacccaggacggccgctccgtggtgggcgcggagtctcgctccgcgctccgcgtctgggccgccgacacggggcgcctggccgcatcgctgacggggcacgcggggcgcgtgacgggcgtggccgcctcgcccgccgacgccgcgctggtggcctcctgcgccgccgaccgcaccatcaagctgtggggcctggaccgcggcttctgcacgcgcacgctcatgtgccactccacctgcaacgccgtggcctgggccagcggagccgccggcctggcctccgcgcacttcgacggcgcgctgcgcctgtgggacgccgccagcggccgccaggtcagcgaggtggcgggcctgcacgggggtcaggtctgcgccctggacgtggggccctcgggaggtgagcgggtggctgggggggnnnnnnnnnntggggcaaggactggctggttgttgaggtcccagcggccccccagcggcagctgccgagcatcccggcaaacaagccctcctcctttgggggccgtcatcagagctctctgctctgcacagtctttattgtaaccaaacacctagaatgacccccccccttnnnnnnnnnncgagcggcgcctggcaccgtgtgggggtttgggggccatgctgttgcggggcctctgcacgcctgcccatgtacaagatgggcaaggactggctgcttgttgaggtcccagcggctccccagcggcagctgccgaccatcccggcaaacaaagccctcctccctggggggccgtcatcagagctctcacctccgcacagtcattatttcaaccaaacacctagaatgacccccccccttccgcagtgatggcgctgactgcgggcaaggacaatgtggtgcgggtggtggacctgagggccctacgcgtgcaatgcacgctcaccagccgacacttcagcgtggggggcgcctggtcggtcgtggcgctcaggtgagggtcatgggggtgttgaggaggggggtaatggccaggggagaggggagagggtggagtggagcggctctccaagcaaggagtcgacggcgggcgcagccgcgtgtacgcacgaccgggtctgcccttcacatgctggagtgtgcatttaaggtctgctctgcatgtcgactcagtcagcaatcgctggtgtgcatgcttgacggctataccttnnnnnnnnnngaggtctgctctgcacgtcgattcagtcagcaatagctggtgtgcatgcttgacggctataccttgtcgccgttccctgtgcctgcctcggaaccactacctggcgcaatgacagtacactctcacaacccttcaaatcctttgcagcgccgacgagcaccatgcagcagccggctccgccgatggctcagtgctgatctgggacctgaccaagcccggcacagcccccagccggctgagcgcgcgccaggctgcctccccagtcacggcgctggcctggagccccatcggcgcccccatcgtcacggggtcaaaggcggggggggtcgcgttctgggatagagccgaggacgactgatgattaaattaaaggtgcatgccgcggtgctgcatgcgttgcttaggaggcagcaagtccagctttgtggacgagcaggccaagactctagaacattggaggcaaagtgacaaggattgcaggccagaacaccttgtcttcttgggtggccattcactgcgcaacgctcagcctcgtcagtcctttgaccctcctgccgtccgctccgtcggggagcgtcgcccaaagcccttggccgtggcagccgtggatgggctcttgcgaggcgccttcttctcggcactgcgtgagggatgcaatggcttgcgccgtgaagattgctatggtgcatgttggcggaccaagggcatggtcctttctaataccatcctccttctcccgcacctcgccgaggcggacatggatccagagccgattggcctccccttcctatcctgctcttccgctcgttggtccagccacgtcgcgattgacaagtacgccacctgtgcagataatctgtctcgacttaaaactgcaaaatgggaactcgcaagcttctgggatagaagagcagaagagacctgcatcccagccatacattcctccagagtatgcatggcagcgccatcgtacccctagtgttactatggtgagggcggcggcagacgcggtgaagaggatggaggtgagaacctgagttggttctgcactctccgccagctctgcaatccttgcgcccgctgctgcacaacggccactagctctgagtggagctgattctggatgccaagatcctgggtacccctttgtacccctgtcatgtgatgctcgacactggcgattgcggaatgtcgaccattgcagcccggtaccgtctgccccggaccgagaagtgacggtgccacagggtcggatatgggccagtgcctgcattatgctgccatacttcaacgctttgagatgtaaatgcaccgacttcactgttgtatgcctggcatgcggtcgtgcgaggtggagcgaggaaaccattcgagcgatctgcgggatcatagcacgccgcagcacggagtggaaagcctggaagttgtcattggggcaacaactcccgcttcacttataccgctttcacggagcatgccgcatgcgccgcgatggaagacgactatagcctcgacttgaccagatccggggacctgcgggtcgatgcgaccccgtttctcccggtgagacatggtgtcgggttgggcctcgggtgggcaacggtttctcaactgcacccccgcgcatcgggatcccaggccattgcgccgatgcgtatcgcgccagatctggcagaaatatgttacttgcgtgctctgacaccgagcaaggacccccacacctccaaggcttccgcctcgacggtgacaccgagaccattcgccccgcagtcggagcggatgaaacccatcaagactgtcatctcgcagcgcgacgtactcgcgacactagacaaaggtgagatttttatgacgttttgacgctagtgtaggccttggttgaggtcctggtgtgcacgctactcgcatccctcgcaatttcggcggagggggaagatcttgaaggtcgcttatcgaggggggagccgccaaggcggctcacgctcggagcgtggcagaggacccacccccacccctcccccactccacagtgccgttcactcctagtcagggcgtgtgcacaccaagtccgacacacacgtggatagcccaccaccccccgacgatcgtggacggcaggaatggcgcgccctgggcaagtcaggtgccgcagctctgagagcttggggcggggccaggttgccacagtcaaaatgtgatgcagaccagactctgtgttcttgcaacctaggaattctgcctgacggagcagcctccactgccttgcctgcatcggccccaccccccaccccctcccaccgcaggggcaggagcagcccgcgcagtgtcagcagagccagcagcactacgggnnnnnnnnnnaccccaccccccaccccctcccactgcagggacaggagcagcccgcacagtgtcagcagagccagcagcactacgggagccccgggagcaatgcgtccgacgcctccatgtttcccgccagcaagaccagcgagtcctccggcacggccagccccctcacccgtcccctggtccagtccctcttctacccgctccccggctcgccccgtgcctccatccaggaccatgccggcggcctggagcagggctgggagcccctcggcagccccagcggccgctccatgttcgcccagttcttcgccggggagctggacgcggagggggaggcacccctgctgtctgatgagggcgtgctgtccccgggaggaaaggacgctcagggccgcgatggggcaggcgccattgaggtgaccccggcagcctacggcctggcggcctccctgtgcacggcccagggcctggcagagcccccgatgcaggtgcggccggggcctgggtgctgggagactggtgtgcagccgtggagactcttggaagacatacgctgtcatttgcctgcgatgccgcagggccagacactgcctgacaannnnnnnnnnggactggtgtgcagccgtagagactcttggaagacatacgctgtcatctgcctgtgatgccgcagggccagacactgcctgacaacgactctcccactttcccttatatacaaaccccgaacccactgcagttggtggagctggcctccctccttatgtcctatgggctggcggtgggcgccagcggccccccctcgcccgtgcaggagggcaggggtcgtgtcaagcggaccaagacgcagcccctgcgcctgaatgccgatggcagcatccgcctgaacgcgaggtgggaggggcaggggggcacccggcgttgtcgcaagtgggaaaaggtcctgcagggccatccttccccatccctgcccccgcagcgctcattgactgcacctcgcctcccctgccgatcttccctgcaggcagcgccggacgctccggcgggcacaggagcgggccctgcggtccctcgtggatgcacagcgcctcgtgcatggcggcagcctcacccaggtactgtggagtttggcgggggagttgttgtgctcctgccacgaggcaggaatggtcctgcagaggagtcaccttgcctgggcattcgctcccagggcggatgtgctgcccgtataggtgcaccggccaaccaaagcgcagacgcacccgcacttcccccatgccccccccctcacaccgactcccatcacccgcaggcagcctcgcgggtgttccaggccgagggcctgacctaccccagccaggccaagcctaccctggccccaccccccaccttgcaggtgccctacaccgcgagcacgacggtgttcaccgccgggggctaccaagggtacgccccaggcatgggcgccctgggcggcggccacttcgtggacgccagcggctacgtgcccgccggctaccacccacccttacatgcccccggcggctactgcggcgtgcaggcccggggcgccccgccccaggtcgggcccccacagatggcgtcatggggtccgccgccggccatggcgcagcatgcgcccctcctgctcgccggctcactggggcagccgcaggggcatgtggcgcggagttgcagcatgaggcccgggcagcgcatcagcaggtttgcccccgaccaggtctgagcagggggtggtcagacctctgacgcaccagctgccaatctgaccgttcagcagggatcgactgtcttcgagcaaacctctggagggaaaacctcccgctggcatctgacgggaccccacccaacgccccctccaaacccttgccctgactgactgtagtgcgccttttcctgacctcactctcttgggcccagggtctggcaagcaggcccccttcccatgcccgacccattgcaaccatggcacccaaacgtgggacctcaacccttgtcattgaacttcacgcgattcgagatgcacctcgcactgctctgatgcacctgtaaagatcatgaggctgagaggagtggaagtttggaggtgtctcgtgcctggttcgggtgggtaagcatggcaacccccgcgtcacagcgtctagatactcaggtgcctgccggcagaatcgagagtacgctcagacagggggcaggggcgcccgcagctgcgtgacgatgcgctttccatagtccagatcgtcccccggaacagccgccagaacggcatccagcgcagccacagcacggtccacctacgccccaaatgttttggatgcttctggcgtgagcacaattaccaggaactattcggcgccaaaacctccatttgccggcgcatgacatgccagtgcccccccacacaccttggacagggaggctgggccgatggagtcccgccccttgacagcctggaagatgctaaagtcaaggtcctccagggttctcaagaaggcagtgctctgctttccatcccggctggtgtactcccccaccgcattcactgcctcgcgcagaccagcaaaggctcccgtccgcaggcgggagcgtgcctccttggcgtcctcgactggagagtggcaatggaaagttggatttggggaggcgccgagagtgatgggagtgggagacggcgtggcggcaccattggcaggttgcctgagggagagccgacgcgtcttcgcagtctcaacccaggccctgctcactcatcacggtgccaaggccgctcagctgatcccgagcctgaaggagggaggggacatagtatcgcaggggttcaagcgccctcttcttcaggtagttggacattccaggggtctcagctgctgcctgccaggtggaaaagttgagagggtgagaccaagcattgtcgtccacttctcacatgcatgcagggaacagcgtcgagtgcaccaatgcatgtcgtcgatctcaccgctttccatggaagggcagggaggactgtgagagccagacccaggcatcgtcgagaaatggggctggcacgggacagcgctggagtcttgtcgtaatgaagtgggagtgggtgggtgggttagagggggtagaactcgggtgggcagtggtagagtactacccgacagtaatcaccttttacatgggcatgcacgtcatacctgatcagggtgggcgtggcagcgtgccacagcacccaactccagagagactggtgcccgggtcggtccggcgctgcacgaaaatgtcccgactggcatcgcgcaggttctagacctcaaatgctggaaggaacaacccttgaaacttacaggtacgcagggtgtcactgctgaatttgcaagggaatggtcaccgagggcgatcaatcggtgaccacaagatccaaaggtttttcggattgcggctccgaccagctcaaccccactggcaaatggcagatgtcctccacgcagattattggcaagggacattcgaagcattccgatacccgcaacactcgtcaaagggatgccatgaatccttcaaccgacagatacgctccagggtcggttttgnnnnnnnnnngtacccgcaacactcgtcaaagagattccatgaatccttcgaccgacagatacgctccagggtcggttttggatgtctatagttggtgggttataacatcattctgcctgaaagatgggcatactacaagactatacagtccagaggcaatgtgggtcttgaaatcttataccaaaacatcatccagaaaggtatctagtggtcccaagtgtctgcaagtcgatgnnnnnnnnnncactacaagagtatacaggtccagaggcaatgtaggtcttgacatcttataccaaaacatcatccagaaagggagctagtggtcccaagtgtctgcaagtcgatgagcacggaccataaccccccctcacccagaaagggaagtcgactcctggaggagcttccccccaaatctgcttatcggggtagctcaccatcccccccgacatcaggcacgagcccctcccggcgagctccacataccgcaagatccaggcccttcatacactcactgttcgcctttccgagcccctgcttccccgtcctcctcccctcccaaccccgtcagccacgcgtcccgcgtgtctcgagctctcccttgaatggtgataacactggattctcaacctcccgcccccccgtcacccgtcttcgtctgcaatggacagctgcgggtacgcgccgcggggcatgggagccgggccggaggtcccgcacgtcccctgcgcaccgtacgggccccgcctcgcactagcacccaaccccatccccgctccgtctcccgtcccccccaggttccctctggcgactgtgttggtggacgggagggcagcaggggagccgttccggggggaagccgcgagcgggagccaggctaaggcgtgggtgtccgccgccgacgccgtggccgccgccagccgcagccccgccgaccccnnnnnnnnnntgcacgtccccttcgcactgtacgggccccgcctcgcactagcaccaaccccatccccgctccgtctccccccccccaggttccctctggcgactgtgttnnnnnnnnnnnnnnnnnnnggacggcatcccccccgccctgcgtggccacctgtggcccgccctgtctggcggcgccgcgctgcaggccgcggcgggcgccagtgcctacgaggcgctgctggcccggcacggcctgctggcccccgccgccgacccggaggcctgggacgtgctgccgtcccacccggcggtgggcgggcgcgagggcgcggcggcggtgcgccgtctggccctggccaccgccgccagccgcggcatgctgcacccgccgcggccgctggccatgctggccggcttcctgctggctgtcatgggcctgtcgcgggaggaggcggcctactggacgctggccggcctgctggcccaccgcctgccccgcgacttctatgacgctgacatggccggcgcggcgctagagcagggcgtcatgcacatcctgctgcaggcgcgccggcccgccgtctgggagcgcgtggcgggcaagcacgccggcgtgggcccggggccgggttgccaggcgcgccccgaccgcgactgggtggcctgcctcttcatcaacgccctgcccccaggtgggctgatgtgaagaggggggtcggtttgtgtcgccggggcggcaggaggagcgggatgcccagcctgcgcggtgttatcccgccccacgcgtcacgtccccatccctcccaacactcccccctaacacccccacccccccacaaacatacccgactcccagacacgacagcccgcgtcttcgactgcctgatggtggagggcgtcaaggtgctgcaccgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccggcggtgctgcgctggcgcgtggcgcacacgaccgacgcagacgcgctggtgcgctgcgccttccgtggcgtgggcacgctgacgcgcgcggggctgctgactttgcgcgccgcccagcaacgcgacatgcacgctgcggaggccagcgccgccgcgcgcctggc

SEQ ID NO: 43722 - DNA, 61 bp, Chlorella protothecoides
ctggcctcctgacagaggggcaactccaggcccccgtcttcctcaagcccctgctcgagaa

SEQ ID NO: 43723 - DNA, 73 bp, Chlorella protothecoides
gggcgagcggggtgtggggcgagcggggtgcggcgagcactccggggtgagcgcagtcgggcctcggcagctc

SEQ ID NO: 43724 - DNA, 61 bp, Chlorella protothecoides
gaatgccaagcgttgggcgtgaatggcaggggccccctgtggtgtttgttgcgcatcctgc

SEQ ID NO: 43725 - DNA, 61 bp, Chlorella protothecoides
ccagcccgtctgcttgagctccaacggctttctaatctgaccgtcagatgatgaagctcgc

SEQ ID NO: 43726 - DNA, 61 bp, Chlorella protothecoides
ctacggccccgcttcgcagggcatggcaggggcaggagtcagcatagcaggcgcgcttggc

SEQ ID NO: 43727 - DNA, 7565 bp, Chlorella protothecoides
  modified_base (797)..(806): a, c, t, g, unknown or other
  modified_base (886)..(895): a, c, t, g, unknown or other
  modified_base (967)..(976): a, c, t, g, unknown or other
  modified_base (1754)..(1763): a, c, t, g, unknown or other
  modified_base (2133)..(2142): a, c, t, g, unknown or other
  modified_base (2337)..(2346): a, c, t, g, unknown or other
  modified_base (3501)..(3510): a, c, t, g, unknown or other
  modified_base (4005)..(4014): a, c, t, g, unknown or other
cccccccccaaaaaagggacggaagtaacccccccttccacacgccctttcctccccttcacagccacccacctgggagccggaggtggccatggcggtgacgtggaaagcctccctccacttcttcttgatccactcaaaggggaaggagtcggagatcttgtacgactgctgcgtgaacttggtgcccttgctcatgaccaccagggagctgaggctgctggacccggcgatggcggtgatgtagtacccccggtcccactgctccatgatccagtccttgggcaggaaggcggcgggggccacgcggtagacctggtccccaaacccggtccccgcgtccatgatgatggcccacagctcgcccgcggcgcagacgcaggagatgtagaggccgtcggcgtagcccttggccacgtgcacatccaggcggtggttggagacgttgtagtggtaccgctgcttcatcggcgcgtgcttgttgtacacgctgatccactggctggcggggtagccgaggcgcaccttcttgcgccgcaccgcgtcgtcccggaactcctccatctgctcccgcccacgcttctgccccacgcgcaccgcgttctccacctggatggggcgggcggccgagggcgaccccagcagcggctcgaacaggctgatcagggccgcgtacatcggctcctcgtcaaacttcaggttcatcaccgactcggtgaagatcttgaagggctctggcttgtacctgggttggatggagtggcaggggggatgagagcatgccggggcagatcgcnnnnnnnnnncgcgacccaacatgcacggcatgggacacctcccctgacccagtccagacatccctgcgtccccctcccagccgggcagnnnnnnnnnntcatggacctgccccctccaccccatccccatgccctgaacactccctcccgcacccccccccccccccccnnnnnnnnnntgcgacccaacatgcacggcatgagacacctcccatgacccaatccagacattcccgcgtcccccctcccagccgggcaggcatgccaccccccctgtcatagacccgccccctccaccccatcaccatgccctgaacactccctcccgctctcccccccgcacatgcacacctgcacagcgcctcggcgctggtggccatcttcttcttggccaccaggaagcccttgttctcgccctggaacccctgccagggcaggcggccgttgagcaggaagagcagggtgtaggccagggactcgaggtcgtcgcgccggctgggcgtgcggcccaggtgcgcgtgcacgctggcgtaccggatggtgccgcggaagtcgtcggggcgctggtcgtacttgacgtgggtgcgcgtcttggggtcgcgccagcgctgcgccagcccaaagtccactaggtacagccggttggactcgggtgtgccgggcgggcccatcaggaagttctctggcttcacatcgccgtgcacaaagctgcatgggcgtgatggtggggtggggctggtgagcggctggaagtgcagcatacagagactccagggagcccgggagcgcggcgcgctttggacctggcagcatgtcacgatgctgaggcgactggcagggcacacctcaaggcatgggtgccaggcctacaaggtgcctgtgagcccgctctggttctggcttccagtctcaagcctgcaggccaagtctcatcggtccagagcacctcaaaacccnnnnnnnnnnggaggcggctggcagggcgcacctcaaggcatgggtgccaggcctgcaaggtgcctgtgggcccgccctggttctggcctccagtctcaagcctgcaggccacgtctcatcggtccagagcacctcaaaaccccacctagaccccgccgcactcttcgtaccctttctggtggagggcctccaggatggtgatggcctccacagccacgcaggccacaaactgggcgctgagctgctgcccctcctggttccaaacgtcccacaggctagagcccagcaggtccatgatctgagtgaggagggggaagagatccaagaaagctgtcggcatggggctatcgcaaggtctgatgggatcaggagccagctnnnnnnnnnntcaagaaaggtgtcggcatgcggctagcgcaaggtctgatgggatcaggagccagctgccgagccacaccctggaatggctcaggcagggggctcgcaagcaggcctgggcatgccatccccctgtaagcaaagctcccctacagataaacctcccacaagagctgtgcaaagggcacatcaatgtcacagtctnnnnnnnnnnaggctcgcaagcaggcctgggaatggcatccccctgtaagcaaagcttccctacagagaaacctcccacaagacttgtgcaaagggcacatcaatgtcacagtctttgcccgcaaaagtcgatcccaactgaccatgatgtagaagttgttctgcagacccttgaagtggatgtgcggcactccatatgtggggccaatggcgctgtggaagattgggagggattggaggagtgatgagtgcacgagggcggaatgcattacctgtgcgagagcagggggttggtgaagccatcaccagacgacaggcccctgctggtgtaagctcccattcatagcacatatacattcccacccagaagaataaggatgctggccctcacttgtagacaccccattcaaagggggcaccattgggggcgcatcctttgctggtcttatgctcgaacttcaaggccacctgcgcatggaagagggggacacatacgggtaagcaacctccagtaagccgcactgcatactacatcagtgtataatgctccttccaacagatcaaggactgccctgccaatgccccccacccctccccacagagcttgcctccaagggtcgggtctccttggctgtccgggccttgttcgcccgattccccaggaacacctgcccgaatccgcccttgcccagacgtcgtcccgtaacatacaccggcgagttggagacttgcacctgggttggggccatgcgggggattagtgcatgagtaccggcacaggtgggtaacaaacctagcccaacccagcaggggggatcaggacgtttagctggtcccagaaactcatctgactgcgcattcagacacctcaggataccctgcacgtaccctggtcgggcatgcgagctcctccttctcctccccttcgcctgcaacgggcggcatcaggccggctgcccgagcacaggctacgcgctatgcgagcgcaagcaatctgtacctgtttcggggagggtgattgatgggtttgcaaccccgaaaatttaatgtgccctgcctaatgacgggcatctaccatcgggcagcgggacgagctgggcattcgtcggccttacgggggcctttcccccgaacaccctcaacatccgccactgctaggcctcannnnnnnnnnagggagagtgattgatggttttgcaaccccgaaaagataatgtgccctgcctaatgacgggcatctaccattgggcagcgggacgagctgtggattcgtcggccttacgggggcatttcccccgaataccctcaacatccgccactgctaggcctcaccaaataacaagagaatcaagtcgggcgagagtcagctgtcgtccatgccggctggggagctccaggtggtccagaagcaggggccacggcgagccagggcccgggttcaaactttggtcacgcccctatggccagcaccatgaaacctgttcgaggcaaattaggaggattgtgcgactgggtaatgagcgtgtgtgagtctatgggctccctggttggcgtgccccagtcggccacgggccgggggtcgttctgaggaggactaaattccaaatttccaggagttgtacctctttgcatccattactgaagcgggaaccaacgttacaagcaggcnnnnnnnnnngcctgttcgaggcaaattaggaggattgtacgactgggttatgagtgtgtgtgagtctgtgggctcccttgttggcgtgccagtcggccacgggccgggggtcgctctgaggaggactaaattccaaatttccaggggtcgtacctctttgcatccactgctgaagcgggaaccaacgttacaagcaggcatgaaattgggtgaaatggctgatgtacaagtcagttattcgttaggggaggattggagtgtcaagtactactgaggaagggccgtcctgagaggcagggcgactgcccattccattgccgcagcgaaaattttgcagaccgcttgatgaagtcgcagtccagggtctgggctcatcacgcccgtcttcgtacatgtcattaaatctatacctaaggctgctgctctgctgagggtatcaggtggctgccgcggtcagctccacgcccaatgtgggatcctgtggagccggcgaggcgtctgcagccggtgtgctggagtgcgccttgagctgcgcccgcacccggctgatcgtggtcaggttggcggagaaggaggccaggcccacgccgtctcggaccagctggaaccagggcaggcggttcacacccagagcctcgcatgtgtcgttcatctcctcgctgtccacattcacctgtgtgtgtgggaggggatggtacggctgttgtcaggactgatgacattgaagtgtaccatacacagcagctatctgatgggtaattgcatgaccagggcgccatttgcaacttgcaacctcccgcccaacgccagattgccagatttaaacgcgggccgcaccttgatgaacaggacgccggggttgcaggtcaccatctgctggaatttggggtacagccttcgacacccgttgcagtggggggcaaagtaattgatgagcaccagctggcctgaggcggccgaggagagggcagccttgtactgcgctgaggtcaggacggtgatgaggttggggtggttgccttcttgccaccacctgctgtcagcatccagagccgcgcgggcctgagactccagttcccgacgtctgcgaagtgtggggacgacccatgagccgcgaggtagggcattgcgagcacggccccctcaggcatgttcgaagcggtacagggtgtcggtcacggaatcgcacctcgcgctgatgacggtgagctgctcggcaggtgccggagcttgggtgggcacgacattgttctgaatcgacgggtccgatgtggagcatggccccgctgcggcactggaggccccgactgacgggactgtccgacggggcttgttggtgggacgggggcaggtcgcacccagcgcgaggccagggagtgcagtcgacatgcccaggtttcgcagaggttgcgtcaaggcgggatctgccggaagctggtcggaccctcgagggtggtaccgacggggggtcggtatggagttgtgagagaacgaacacgcagatagcctgcgtgatacagccgggagagtgcttggggttcagaaaacgatgagattattggggacgcagctcagccgtgaactgagattctgttggatgccgcacagaagtcgcggggccacccgtcaggatgaggtccaggcgtgtttgccacgtcagaccgtgagttacgctctaggagtcccagatcgcgcgggattcaaattagtgagaacccgacgacagatcgccgaccccccctcccccagactgtttgttcacatctaaaaatctcaatcagttgcaaagaatgcgcatcgtgcccccgcttttcgaaccctcggagggccccttcaccacagccgacatagtggccgccaaggccacagtccactgtacctactacaataagcctgtggcgcaggcaatcattcctacggagcgcgtgtaagacttcctgcacggcgagggccgcgtgttcaacccccatctcctcaacctccctggccacaggtacctgacccataaggcacccagcacagaggtgcctttgttgcgggatgcgtggatcattccccatcagcgacgggggctggcctggcacatgcacgagaatccgtttcggaaggtgcgccaccaggcctacgtcggcagggagcgggccatcacccggcttgcggagcagtgccgcgctccccctggcatgactacggtcgtgggcgtgggcaactggtcagcccaggacccgggggggcatcatgcgggggactctgcggaggccctgaatccgtttcttgcggcgggtgtgcagggtggtggtggttgacgagcacaggacttccaaactgtgctgcgcctggcacgccaccctgcacgcccaccggcacaaccgggtctgctgtggcgtggagacgtggacggaactgtggggcatgaagcactgtgtcaacacggcctgcaaggccaacgttgtcaatcgcgacgtgaatggagcggtgaacatcctgatgctgaccaagtgctttattgagaatgcacctcgtcccacagcttttggtggacccctgcccccccttccattcccctcgccccctaacccccctggttcgccgattgaggcaaccaactgcgccagcgacatcccgtcctcgggaataagctgctagccaccggcgcaagcccggtagggggtggttcaagggtattccgtgctttcccgggtgcccctcgcgcccaagtcattcttcctccgctgtacaattacgatcaaacattgcatgcattgtgggttgtcaaggaatcatgctggaggccatcaggtgatccgcgccggttgccggtagtgttgggtccatgaacgacggtaaaccaaggcgcacacggtgcccatcgcccgtctgatctccttcacaccccccaggtactcccgtggtagcctcgagctccttgagcagcgtgatctgcccaccaccacgcgctacatctctgtgcggggttcagaggacgcatggcgggccatacgggacatgaccgtgcggggcgcgccagccatcgccattgccgccgtgctcagccttgcggttgagctggtggtccagggggagggatcccagttctcaggcgcggcccaggcctcccagtacatccaggatcgcctggagtacctggtgtctaggtgggttgtggtgggtgtgagtggccaccacggtggagggggagtaccagccatggtgggtggagggggagtggcattggctgctgtcgtcaaacgtggttggcgatatccccgagattggtacgcacatccgacaataaggtccgttcataaattctcccctgcacactcacacatttcaatgttccctccgtgccgcagccgccccacggcggtgaatctggcggaggccgccgctcggctgggcgccgccgccgcggaggccgccgcggcccccgccgccaccccctcctcggtggtggagacggcggtggcgggggcggaggccatgctgcgcgacgacgtggccgccaaccgcgagctgggcgcgctgggcgccgacgctgtggcgcgcgcggcgggggt

SEQ ID NO: 43728 - DNA, 61 bp, Chlorella protothecoides
ttgagcgcgtcaagtgatcggcccggctgggggagcctgctgcggggacgcacgccggtgc

SEQ ID NO: 43729 - DNA, 61 bp, Chlorella protothecoides
tggtgcatccatacggctggcagggcgagggcatcaatctcatgatcctcatcttcgccat

SEQ ID NO: 43730 - DNA, 2071 bp, Chlorella protothecoides
  modified_base (216)..(225): a, c, t, g, unknown or other
  modified_base (408)..(417): a, c, t, g, unknown or other
  modified_base (1059)..(1068): a, c, t, g, unknown or other
  modified_base (1319)..(1328): a, c, t, g, unknown or other
ccgcggcggctggcggagctggcggcgggggcgatggcgcggcgccagggctcgagacccccggcacgcccctgcccatcgacgtgcgcggtggtgctgtgggattattctggggcggggatgtcagaggggtttggagagggggtaggaaactcatgcattatcgggcacaggtgttgctgctggtccgccccaaggggcaggggcggtggggcnnnnnnnnnnacggggatgtcggaggggtatggagaggggttaggaaactcaagcattctgaggcaaaggtgttgctgcttgtccgccccaaggggcaggggcggtggggctgttggaagggccccgccccggcccatgagtctcctatggagatcattttcgacacacacacacacacacacacacacacannnnnnnnnnaggccccgccacggtccatgagtctcctatggagatcttttttgacacacacacacacactccgggaccacccccccaaaatgtagatgaacgcgtgggcggaggtgacctccaccctggcggccacctttgcgctgtccggcgcagtgtgccagaccagcagcgagctggggcccgccccggcacccggcgcccctgaggcccccggcggggtccgcctgctgacatcctccggcgtgctgctggcggcgcggcacgagctgcgccccgcctttgccgactgggcgctgcgccacgcgggcgtgctccaggacggcttcgcacggtacgaggtggcgcggctgcagcgcgcgggagcggggcgcgggccgcctcgccccgccgccgtcgccgaagtggacatcctgggcgcggcgccgcgcggcgcgggcgaggccctgctccccctcgccgagctggcggccatggtgagtgtcgcgctggccgcgctgccctgtccgggggccttcgagcttagggtcgggcaccgcggcctcctcgccctcgcgctgaagcacgtcggtgagcaggagggcttgaggcaggggtttgaggcgcgctggttggggtcagggggttgcgaatgcacggagtgggggcggnnnnnnnnnncgagggaggggtttgaggcgtgctggttggggtcggggggttgcgaatgcacggagtgggggcgggggtgcagacgggagcgggggtgcagacgggagcgaggcgatgggcggggtcccggggccgcgtggtgggagtcagcagacatgcatggagcgccaggcgctgccgcacaccctggacgcttgctggttgttggtgcacctggcgcatcctcatgccctgtgccccccccccgctgccgtcggcgnnnnnnnnnnaccgcgtggtaggagtcagcaggcatgcatggagcgccaggcgcatgccacacaccctcgacgcttgctagttgttggtgtacctggcgtatcctcatgccctgtgctcccccctcactgccgtcggcgggcgatccctgcttcccgcaccccactccctccccccacgcccaacatgcctccacgaccatcccctcctcaggcgcaccgccggagctgcacgcgcgcgcggtgcagctgctgtccaccgccgcggcggcctcgccgctgcacactgcggcgcgcgcggcgcgctggccggccatccgcgcgggtctggagggcctgggcctggcacctgacgcggcggcgcgctgccgccagctgctcctcctgggctcaggcgagccggagccggccctgcactggctgcgcgcgacgctgggccatctggcgcccccgggcgctccggggacgaacattggcgcgccggccccgctggacgatctggccgccctgctcaccgcgctggccgactgcggcgtgcccggcggctgcgtggtggtggacccccttattcccccccacgctgactacttcacggggcccctcctccagtggcacctggtggcgccaggcacgggtgcggcggccatggtgggcgtggcggggcgctacgaccgcctgctgcgcgcagcctgggcgcggcgcgccgcggaccccgatgtggcccaccccccgccgcagctaggcggcgtgggcgc

SEQ ID NO: 43731 - DNA, 6711 bp, Chlorella protothecoides
  modified_base (101)..(246): a, c, t, g, unknown or other
  modified_base (428)..(603): a, c, t, g, unknown or other
  modified_base (982)..(991): a, c, t, g, unknown or other
  modified_base (2231)..(2240): a, c, t, g, unknown or other
  modified_base (2435)..(2491): a, c, t, g, unknown or other
  modified_base (2793)..(2802): a, c, t, g, unknown or other
  modified_base (4466)..(4475): a, c, t, g, unknown or other
  modified_base (4584)..(4725): a, c, t, g, unknown or other
  modified_base (6248)..(6257): a, c, t, g, unknown or other
  modified_base (6353)..(6362): a, c, t, g, unknown or other
  modified_base (6440)..(6449): a, c, t, g, unknown or other
gtagggttcaagggcaatgcatctcagggggctcttcaacaggcagtcacgacatgacctggtgggaccgctcggcgggcggtggggcgagggcagcctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtcgtttccccgttgatcgccctgcctttgtctctgggcgacgcgtcccgtgcccagcttgatcgtgccatccaccccacccacccaccccaaaaacaatacacagctgggagggagcggggtgctggtgctgcccatcatgtacatctttgacgaggagccgcaccgctggcgcgcactgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcgctggggacccctccccagggcctgatgtgcctctttgccatccccccctgcccctcgctgacactgtgacagagtgccttgccattgacagaggaagggaggacatgggaagggcatgaggggggccaagggccgcacaccgtgagcacgccagcgacccctcactgagacccgcgctggacccagggccgcgccggcgcggcgtcggcccgcaggatacccatggcgcgtgccgtcttgatctggcgcgccacgtgcttgtgcagcttggcggagagcttggtgcggcggcgggggacgatacgcccggtgtctgcgcagggagagggggtgattagtggtgaggaggagacacagggatcggaatgggtttggnnnnnnnnnntagcttggtgcggcggcgggggacgatgcgcccggtgtctgcgcagggagagggggtaactagtggtgaagaggagacacagggatcggaatgggtttggtggtggacacggtggtgggccaagcacgagcacgatggacgcggcagctccgcgcctgcagacactccttggccttgcagccgctgcagccggcgccatgcacaagcattacattctcttggacagactgcaacaggaaagcaatgcgtcagtcgccaccccactctagcgcctgcctgtgatgaaggaggagaggaaggccgcgtccctgaagtctgctcgtgcaagcacgaccttggcagggatggccggcggttggcgggtgacgctgcgtccaaactccgggggggccgcctggtacggatccaggtcctgtggtgtttgtagagggggtcggtggcgtcgggagctggaaattaaaaaggggaggccctcaggttggccagccgtggcgatcccctagcctgccgacacgccgagtctacgcttgctgtgagctcagggctccgcatctggtggcggcggccgcatccctgataccttccccagaccccttgtcttggccttcacggccctaccccgctccgcctgcccgtacctccggggagtaggtctggccggggtagaagaggcggaaggggtgcacccgcgagggcgactgctcctccgccttgttgccaaacacggcacgcggcgcatccgtggcctgggccagcagcccgtagctggcaaactcgccctccggccggccgggggccggggtgggacgggactgggccatgacctccatgatcccagcacggtccagggtcgcggggcccttgcccttgcccttggccgtggcgtgccgcgcggcgccccgccccgggagcagctcgtcaaggggccggccgccggtctgctgctgctgcacgccggcgggtcgcagggccggcccgctggagtccgctgcggcttcgccagaggaggtgccagacgcagcgtcaactgacgcctctggagcggcgtcccggcgcaggcacgactcgctcggcggcgatgcctgaacgccaccctggctcgatgatgcctctgcagctgcacctggattgatgtgaggaggcgcacatattcgttggccagagagtggggctgaatattcgtacgaggagcaccggccaagccagggcctcccccccagcacaagtgttggccacggcnnnnnnnnnntagctgcacctggattgatgtatggaagcgcacatagtcgttggccagagagtggggccgaatgttcgtacgaggagcaccggccaagccagagtctcccccccagcacaagtgttggccacggcctaccaccgacacaatgcatgcaatcgcatccacctttgttcaggtcgtcgagctgcccgtcagcccacnnnnnnnnnnnnnnnnnnnnnnnnnnnnnnnnnnnnnnnnnnnnnnnnnnnnnnnnngctccgcctcgctcgtgggtagggactgggaggagttggagtcctcgcctgggggcagagtactcaggcgcatccatccattctgtacctctgcacacccataccctcgcaaagatcggctgaccaacaggccacacagccgcgagcgggacagtgcggcagggagcatactctcccggagagctgccaacacccgggatgcgctgcaattttgtttgcagaaatatactagttcttaatccttcggtttatattcaactaagatttaactatcgccagtgccgcgtcaaggtagtctacannnnnnnnnngtattcaactaagattcacccatcgccagtgccgcgtcaaggtagtctacaccatgctgctcagtcgacaaggctacacacaccaattccgcactttccatcggaaccccctacaaatcacgtttgaccagctgggccacaccccgcgcgcgtcagcatgtgcaatgccacagaaggggtggagatctccctgattttaaacatgatgggagtgctggagtgctggagggtgctgcgcgcaacccacaaattctaaaaggggagtgatccccgcgcacagcgctttggaactccgcgtcggccccctgcccgatggctgagatcatcccattttccgtaatccactgcacctcagaggtaagtgcgcccccgttcgatccacccattgcatctgcatgcttccgggtttcttgaacaaaccccaccactgtatgcccgcaaagtgatctcgacaccgcgagctagcacggggtcaacgcgttcgcacaatcccacaggagcatggtcatccctgcacgtcactcgagagggggggaagcacttcgggatgggcgtctgcaaggcaagcaagatgcctggacggcaccagactggtcttgcccagccgaagggataacacccctgggaggcagtctctcgtatgcaagcaatgcatgccgtgcatgcttggattgtactcccagtacccaatgactctgtcgccatctgtgtcgcagggattccccctttccccaagaagtcacgctgcagctgcgaggcgctgtgcgactcacccagctccaactcctcgcgcatgagtacaaggtgccgcctgggtgccgatggtggtgagacaccaggctctccagactcaggccacacctcgtcctcctgttcttcctccacccaccccctctccacaccccctcgccgcagatcgcctccaaggtcgagatccgggtcgccgaggacgccgcggcccccgcctggcggagcctgggcttcctgtccttcagccccaacgaccgcagcgggcacgccgcgcgcgagatgaagagcgtcgccctgcccggcccccccgcccacctcgtccagctcatcttccacggctggcaccccaacgccctcaatgcccatggccaggtggggctggtgtccctcgccgtcagcggcgaggcgctgcccgggcaaccaccgcccagcccggcgcgctcccccgtggtcaaacgcggcgcgccggggaccccgccccgcgccgcgccgggcgagtccaggctgcctcccccgccggggatccacggcggcgcggtcgggccgcccgccgcccgcgaggcacagtcgacgcccaccaggctggcgaccggctttgcgggcggggcgccggcggcagcacggccagctcgcccccaaatcgcggccgatccatgttcgccgtcgcgcgcggactcgacgggcgcgcaggcacgcagtctggcggccgggcgcaggacccccgacgcgagggtggacccggtgacggccgcccagattgacacactgcagcgtcagaaggctgccgccgtcgaggcggaggactacgacgaggccaagcgcctgaagtgcgccatagaccgcctctgctccctcggtacgcgggctttgggggttaggagggggggggttctgggacctgtcgatgcattgcnnnnnnnnnnccgtccccaaatcgcggccgatccatgctcgccgtcgcgcgcggactcgacgggcacgcaggcacgcactctggcggtcgggcgcaggacccccgacgcgagggtggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacgggctttgaggggtaatggggggaggggggttctgggacctgtcgatgcattgctgcaggtggagggtgggattgtgtttgcgcgcctgcagtaccgcatgcatgctgacacagggccacctgctactccagagccccagaagcatgcgctgccgtgcaccgccctgccttctccttaaccccgactcccgcccaaactcgcaggagccaggatcgccgggctggaggccaggaaggcggcggccgtggccgccgaggactacgacctcgccaaagaaatcaaggcggaggtggacggcctgcgccgcgtctcccagcgcggctccccggcccgagcccacggctctgggcaggagggcgaagacccccgcgaccccgggccgcggcccccctccccgcccatcccgacgcccgtgcggcctgacctgcagcaggcgccgcccggcggcctcgccggcctgcgcgcttcgctggtggccgcagcctcccacatgggcgccgaggtggaaaggatgagcagggaaagggccgcggagaccagcctcggtgacgagggttcgagcggagacctgggccccggttcgagtggggcgaggccagccccgggcgagcgtggggacggggagggccgcacctcggcctccactttgtgggcagagcacccgccgcccccggggttccctgccggtgagggtaattggaagggagggtttcctcctggcgcggcgtgaccctagcattgtgaacggggggagcgtggaagcctgaaagtggtagagggaatacctgtgcagcatgtcaccttctacaccatatcccaactcgatgcccgtcgccccagatctgccactcccggagccgctctctgcggcagcggccaaggatgccgacgagctggtccagttgataggaccgtacgcctcagcctgcctcctatccaagacctggcagctacgcgttgcggcattgcaggcgagagggcctgaatggctgctctgcattggcggggttcagtgggaagaggtggtgacggatcaggaacaccagcgcacaagacagcccctgggctgccctggcatgctgctctattccttggcaggcacacgcattccctggacaatgacttctgcctggacggtatactcacccagacccacccccttccgcttcccctcgcagtggctggaggccggggcaggacgggcgccgggcctgctcgccgacccagacaactttgggttgctggcccgcacgctcagcgctgctctgcacgacagagtggcggccgcctacctcgccgccctgcctgctttgctgctcctggcccagtgccaggtgtgtctgctgtggcgcagggcgctgtggttgggagggttggggtggatggtgtggcagttgccggagccatgaccatctacgtgtgggtttacccaaaggtctcttgacgcagaggatccatcgtgcatgagggaacccccctcccccgtctgggctgcgctggggtcccccttcccattggannnnnnnnnntggcgctgtggtcgggagggttggggtgaatggtgtgccatttgccggagccatgaccatctacttgtgggtttacccaaaggtctcttgacgcannnnnnnnnngtatcgctgccgatcttcgctcccatcccgctacccagcccctgcctcgccccccctcccagggcctcccccgcggcnnnnnnnnnntcattgctgccgatcttcgctcccatcctgcgacccaacccctgccccgccccccctcccagggcctcccccgcggccgcgtcgtctcaggcctcaccgacgcggtggccgtactggtagaaaagtccggtgacctgaatgcacgcgtggccgaggcctccactggcaccctgctggcgctggtccgggccggggccacacagctggcctccgcgccgggcgcgctgctgcgcgcgccgaggcccggcgccgcgccgcgcgc

SEQ ID NO: 43732 - DNA, 61 bp, Chlorella protothecoides
gaggaatgcatgcagcgtcgtggtggctggggctcggcaaggtgccatcccatctgaagtt

SEQ ID NO: 43733 - DNA, 61 bp, Chlorella protothecoides
gtggatcctagacatgcaccgcgtggctggggtatctgcgctgtgatccggatgtctatcg

SEQ ID NO: 43734 - DNA, 1151 bp, Chlorella protothecoides
  modified_base (176)..(345): a, c, t, g, unknown or other
gcccacgccatccccacaccgcccctcgcccactccccctccgccgtcccccgacgccctcccgcccgaccccacgctggcgtcggtgcgtgcggcgctggacgcggcgcacagcgggctggactccgtcaaggcgcgcatcgggcagtatgtggcggtgcagcggctgcgcgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctgggcggcgtgcgcgacgaggccgaggtgcgcggccaccgccggacctacgtgggcgccatgcccgggcgcgtgctgcagggcctgcgccgcgcgggcgcgcgcgacgccgtgctcctgctcgacgaggtcgacaagatggggcgcgattcgcgcggcgaccccgccgccgcgctgctggaggtgctggacccggagcagaacgccgcgttcgtggacacctacctgggcctgcccttcgacctctccgccgtcctcttcctggccaccgccaaccgcgcggccgacatccccgagccgctcctggaccgcatggaggtcatccacctgccggggtacaccctggaggagaaggcgaggcggcattggagggggtggaaggaccagggggcggggcggggtgtttgggaaaggggtgccgccagactcctgcacgcctccgatcgctcccaaatgccggtccaggaccaccccagtcaccccgctgcctcacggcactcactcctccctccctccctccctccctcccatcgccagatggccatcgcggagcggcacctggtcccgcgcgtgctggccgaccacggcatgacccacgccgacctggccttccccgccgacagcctgcgcctgctggtggaggggtacacgcgcgaggcgggggtgcgctcgctggcgcgcgccatcgccgccgtctgccgccacgtggccgtcgacctcgtcgccaccggcgagggcgcggcggagcccaccccggaggccccggaagcgcgcgggcagggcgcggacccggcgacgcccgacg

SEQ ID NO: 43735 - DNA, 61 bp, Chlorella protothecoides
gaggagtctcccagtcccagcccacaacagacgcccagccctagcccgcaggagtctccct

SEQ ID NO: 43736 - DNA, 61 bp, Chlorella protothecoides
cctactcaaaaaagccttcctgacggcggggctggacctgtacctgttgccgtatggggtc

SEQ ID NO: 43737 - DNA, 134 bp, Chlorella protothecoides
gccgcgccgtccagctgcacaggcagccaaggggaggagcgaatgatcaaagcctgtcgaaggccagaggtgacaatgcagcgtgcgtggctcaagcgaccggcccagcccccgccccgtggccccccgccctc

SEQ ID NO: 43738 - DNA, 13745 bp, Chlorella protothecoides
  modified_base (121)..(130): a, c, t, g, unknown or other
  modified_base (221)..(396): a, c, t, g, unknown or other
  modified_base (576)..(585): a, c, t, g, unknown or other
  modified_base (816)..(825): a, c, t, g, unknown or other
  modified_base (1014)..(1023): a, c, t, g, unknown or other
  modified_base (1560)..(1569): a, c, t, g, unknown or other
  modified_base (2404)..(2413): a, c, t, g, unknown or other
  modified_base (2793)..(2802): a, c, t, g, unknown or other
  modified_base (3587)..(3596): a, c, t, g, unknown or other
  modified_base (3711)..(3720): a, c, t, g, unknown or other
  modified_base (4072)..(4081): a, c, t, g, unknown or other
  modified_base (4413)..(4422): a, c, t, g, unknown or other
  modified_base (5086)..(5095): a, c, t, g, unknown or other
  modified_base (5601)..(5610): a, c, t, g, unknown or other
  modified_base (5665)..(5674): a, c, t, g, unknown or other
  modified_base (6644)..(6653): a, c, t, g, unknown or other
  modified_base (7053)..(7062): a, c, t, g, unknown or other
  modified_base (7766)..(7775): a, c, t, g, unknown or other
  modified_base (8335)..(8344): a, c, t, g, unknown or other
  modified_base (9180)..(9189): a, c, t, g, unknown or other
  modified_base (9417)..(9426): a, c, t, g, unknown or other
  modified_base (10639)..(10648): a, c, t, g, unknown or other
  modified_base (10970)..(10979): a, c, t, g, unknown or other
  modified_base (11051)..(11060): a, c, t, g, unknown or other
  modified_base (11192)..(11201): a, c, t, g, unknown or other
  modified_base (12007)..(12016): a, c, t, g, unknown or other
  modified_base (12178)..(12187): a, c, t, g, unknown or other
  modified_base (12524)..(12533): a, c, t, g, unknown or other
  modified_base (12746)..(12755): a, c, t, g, unknown or other
  modified_base (13076)..(13085): a, c, t, g, unknown or other
  modified_base (13429)..(13438): a, c, t, g, unknown or other
gggcagcgctggcgacctgccccgccgggctgcgcgccgccgtggtggacgatgcgggcacgctgcacgtcttcgacggcgctggcgcgggggcgggcccggggctggcagcgggcgcggnnnnnnnnnnggcgcgccgccgtggtggacgacgcgggcacgctgcatgtcttcgacggcgctggcgcgcgggcgggcccggggctggcagcgggcgcggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggagtgggagtttcaagggtgcgtttgaagcagggagacaagagcgcttgcgccaacatgctttggggcctggtttgaacaggccatgggacgcccgaaggcgaggtccctggaagaaagacggccggcagcagcagcatcacaggggaagccggccctgaggactgcggtgcttgcgcnnnnnnnnnncggccgacggcaccatcagtgtctggagggtttgaaaggcgaggtgtgtgcgatgcgcatgcgcatgccgcctcctgggcggcgctgctgtcacagagtcgaggcaaggcaagtggagcaggggcaaggagcagaggattgagtgggagtttcaagggggcatgtgaaggagggagacaagagcgcttgcgccaacgtggtttggggcctggtttgaacaggccatgggannnnnnnnnncgcaatcagtgcgtcgccgggccccgccgtcagcgcgccgatcccagggggaagtggtcgagggcggtgaagttgcccttcacgtaccggtcaacgatggcctccgtcctctctgccttgtctgcggggggggagggcatgggacggggggggggagtaagtggcatgcacacctgtgcacacgtcccnnnnnnnnnntgcaatcagtgcgtcgccggggcccgccgtcagcggcccgatcccaggggcaagtggtcgagggcggtgaggttgcccttcacataccggtcaacgatggcctccatcctctctgccttgtctgtgggggggaagggcgggggacgggggttgggagcaagtggcatgcacacctgtgcacacgtccctggggcggagtggctgcactgtggagaggcaacatggttctcctcacccccctctccttcgcaccagtgtgcgcattgacgtggaccacggccggcaggaagtcggtgtagtgctggccggtgtggcgcagctcccggaacaaggtcagcgagttgaggaagagctcgtagtccattatccgggaagtcactgcgggggactgcaccatgccaggggagcgtggcgtgtgggaggggtgcccgggtacgctcagctggtactgggaggtaaacaacccaatctctcaagggggggacagtgtgaccttgagtataggcccgctgggccctcaaccatctccagccccannnnnnnnnntgggggacagagtgaccttgggtataggaccgctgggccctcaaccatctccagccccagcagccgcaggccaggcccccatcacaccttgtacgtcggggtggaaggtaggaacacgctttcgctgaggatggtctggtcccaggtattctctgtctccacccggcggacgaccagcgacatcaaatctctggaagcctcggtcgctctgcgagtgaggacagcttttctcagtgatgagggtggggttcacaaacggtcagcgtgaggaggggtgctgggcatctgccgaggtaatggatgacggcatgcagcggccctcatcccatgctgccctaagagctctcaaccccccccccctcttctccatcccagtcaagtccacacctgacgtagatgaagcctgcgttcagcaccacaaggttgagaaggacggcgtcgctgccgtaccccatttcatcatgccctggatgcacaagagcgggaatggggcgggtgggatcaccggtgaacctagccggcggcagccgaagagcccctggccctattccttggctaggggttgccctcgcgagtcgcgaccggaacaggcccccaggcatgggcatgcaggatcgctcactcagggaggtgtggaagccgtatgccgtcctaacatcgtagccgtcggtcatgcattccacatcggagtctcgcacaaggaaggagaacgggtcctgcaggaccaacacgtcggcatctgcgccaaagggaaggggttgatcgtgagggcctgggggtgtgggcgggtgcggggtcgtgggtgcccccccacacagggcaaccctgtctcaannnnnnnnnntctgcaggaccaacacatcggcatctgcgccaaaggaaaggggttgattgtggggccctgggggtgtgggcgggtgtggggtcgtgggcgcccccccacacagggcaaccctgtctcgacggggtctgcgcactgtgaacccgctggtgtcccacctgagaagagcacagagtaccccaaatcaaggcaggcagccatgatgcggaacttgagggccccgatcatagtacgggctccacccggctgctggctctctggtgcctgggtgcgcagagggatgggggatgtttgaagctggctggagaatggagggagctacacggggtgaggtaatgctgccctccatgctcgtgcactcacctgcagcttcatcatgaagnnnnnnnnnngtgtttggagctggctggacagtggagggagctgcacgggctggggtaatgctgccctccatgcgcgtgcactcacctgcagcttcatcatgaaggcggccatgccccggccctccgcaaagtccctggtcttgttgtccaaggcgagcaccagagcgttcttcacgcccactcggttgatctgcgagtgggagagaaaggaacaagtgtgaaggttcaggtagagacctgccccctcaccgctggcgacggtcttgggcaggcataagcaatagtaggctgtgcctgggaggtggagctgtaatttgcgaatccctccacactattgtcagctcacgctctgaatgcagaggtctagaatagtgccgttgtgcgcatagtgacggtcggacatcaccaccaggacctcattgttgatggcaacctgcgaggggcagagaggtgggcaggtgagctgctccatgccaaacatgcgccgggccacaaggccatggggcagactcgaccctgcatgttcatcccaggcacgtaccttcttcagcgccgccgccagcccagggtattgcagtgccttttctcttgatggacgctcaagtgtgtgccttccctgcacacagggttaggacttggtagggatcgccctggagcagagtatctggtgccccttgtgagatctgagaaatgcaatgcgatgaagtaaaaggatggcgctggtcacgtcgaactcctgggtgaaaccccgtacattgtggttttctgtgacggtcgacgaagaggttctaaannnnnnnnnnagcctcctacgaccaaaatcattgcaacttgtcttttgcgctgaggttctcactcaccaacggatacttcgacgcatggtattctgatggttggaccgggggaatcactcacaannnnnnnnnnacgcccgggagcagagtatctgggggcccttgtgaaatccttagaaaagcaatgcgatgaattaaaaggatggcgctggtcacgtcgaaatcgtgggtgaaaccccgtacattgtggtgttctgtgacggtcgacgaagaggttctaaagagtggcggaaggtccaacgcgtacccatctcgagagttgaacttgattggaaccaggacgcaaagaaggaataaagagcacatgcccagtgccagggctcgaactgggtgctgaaagggaccaagcctaccggccggacacctgtcccggatggtcgtcattgcgacttcccctggcgggtttacgaccgaagatgcacacnnnnnnnnnncgacggatacttcgacgcatggtattttgatggttggaccgggggaatcactcacaatacaaacatctcggccctcctttcctcacaggagtgacgtaccatgaacctacacctcagcgcatccacagacagacgtcgcaaaaacaatcttctatcgatgactcagtcgtgacaataccgacgtgtaggatattaagtaataccaccgtttgaatctcctttttggctcggcttccctgcaaacttttgagtatggtatagtatgcatcagattgtacaaatgtgagtatcattgatcaaacgtatcctatggctcttcatacttctcggcnnnnnnnnnngcaggagtgaagtaccatgaacctacacctcagcccacccacaggcattcgtcgcaaaatcaatcttctatcgatgactcagtcgcgacaataccgacgtgtaggatgttaagtaatacaaccattcgaatctcctttttggctcggcttccctgcaaacttcgagtatggtatagtatgcattagattgtacaaatgtaggtatcattgatcaagcgtatcctatggctcttcatacttctcggcactacctgaggcttatcagtgtaaggagcgagggtggcagtgtcgatgtcagggatggcgttatctcatacagatatgggagtcagatgcctgcgtgacctgattgcagtgaatgcacgtccatgcagcgagtaggaatccctgctgctgggaggtctgataatcttgattggcaggcatcgtcaaaagatcatattactgggtgctttaagtagtaataagggcatgaacaccatcagaatccgcgttactttgggatgctacaacagacttccaggatccgtgccccaattaaggagcagattcgagcactcactctctcagtgtccggatgaccctatgagccgattagggatcaggaagcgacctcgatgcactcacagtgcatcgatctgaacgagaactgcatccggtcgcnnnnnnnnnngcagaatccgcgctactttgggatactacaacagacttccaggatctgtgccccaaataaggagcagattcgagcactcactttctcagcgtccggatgaccctatgagccgattagggatcaggaagctacctcgatgcactgtgagtgcctcgatctgaacgagaactgcatccggtcgcccggatcaagatactcgaagtaaagcacgtctggggtgcgaaaaacgtgtgttgagctggtgtcaacagcgtatgaggctgcgatgcgcttgatgcatgagtgcaagacacatgcaaagcgtaatgatagcatagctttagaacggccacccatggagggtttgcgccagaccagactcgtgccatgaactacctcagacccgcactcgaccgccgacctcctaccccgtcgcaagcgaatgctgcagtccccatacgaatacctcgcccttcatggtttggccccatctaccagtgctgcgacgtaagtaaaacacataaagnnnnnnnnnngatgggtttagaacggccgcccacggagggtttgcgccagaccagactcgtgccnnnnnnnnnnttccccatgcaaatacctcgcccttcatggtttgcccctttctacgagtgctgcgacgtaagtaaaacacataaaggcagcgtatggtttcgacagccagtgacagggatgatttcgtagactattcacatgccgcatacgagccccaggctttgtctgcggtctggagcccgccttgcgtgcaggcacgagatcccccgactctggactccttgccacgagcatgactttggccagaaggccaccccgccacctcacgacctcacggggaagtcatccagggccttgaggtcgccatccacgtatcgcttcacgacggcacccatgcgctcgaacttatctgccaagggggaagtggaagaggggtgtggcaggggtcatgcaagcatccatggctccacaccggccggccctggccacccacgagccacagccaacgtactgctgtggtagttgacgtggatcatgacggggcggtggtcgatatacttctggccgctgtaccgtaggaatttgaacagcgtcttggagttcatgaagagctcgaagtcaagaactcttcgtgtcacagaggggtcctttggagggggagcaggaggggagaagcggggaggtgggacatcggcatgtgcagggcaatggaccccatagtgtagttccatgcacccgtcgcccatcattgcatctttccaaacaatctacgcaacagggaggctcagcacctctacgaaaggcatgctcagcaccctgcgcacgctgcctgcctggtcaccccccctccccataccttgtagcccgggtgggagggaaagaagatgcactcgttgaacagggcctggtcccagccgttttccgtctcaacgcggtggatgaccttgttgagcaggtccatggaggcctgggtggccctgtaccaggggagaaagggggccgtgggcttgggactgggctgggcgagggggcttgcatnnnnnnnnnntctgtaccaggggaggaagggggggcgtgggcctgggactgggctgggcgagggggcttgcatgggtgatgccagggggtctgctccaggcaagaaggacagagcaggattggaactggggtgcacatcctcctcccaagccaagtcacaagttgtggcagtgagccaccgcccacgcaccggatgtagaacaggccgctgttgaagacaaagacgcgcatggagtgggcataccgcgcccaacccatctcctcgtcgtctggaggtgtgcagggatgcgtccatggaagcgagcaggagtgctcgcccacgagtacaatggaaggagataccggcgcaggctggtgctcgtgctcacattccttgcactcccggcgtactggttcgattcacatcctcnnnnnnnnnnagcgcaggctcatgctcgtgctcacattccttgcattcccggcgtactggttcgattcacatcctcttttaaagcgcccctcctgactctcacccccccatgcactcgttgccacgcccagccccggaacccacccaggacatcgttgtagccataggcggtggcggcgtcccagccatcgctcatggactccacgtccgagtcacgtgccaggaagccaaaggggttttggagggtgatgatgtccacatctgggaggaaggggaggagtttgtggcagcgcaggtttggtaacacaccttgctgcgtattcttggcacacagcagtcagaatgcaggggagatgctgggtccgcctgtgcacagaggtcactccactcacccgagaggaaaacagagtagcccagctccaggaagtggctcagtatgcggaacttcatcgctgaaaccgcatggttgtcgccgttgccttgttgtgccttgggaatctacggaatggcggtgctgattgtggggttgaatcctgcccaccgacaccccaccaaaccagctggtggctgggctcagctgggaagggcatgtgggtgacagtggccctcctcctcaatccatgtcatgtgaaagtggtaggcatcctgtgcagacgttgggaaacaggaggacccctcccatcagcccagcaccccccccccccctttcccgcnnnnnnnnnntgtcaccccaccaaaccagctggtggctgggcttgcttgggaagggcatgtgggtgacagtggccctcctcttaaatccatgtcatgtgaaagtagtaggcatcctgtgcagtcattgggaaagaggagtacccctcccatcagaccagcatacccccacccctcccaccccccgctctgcagcccaccccacctccagctgcatgcggaaggcggccatgcccatctcctccgcattcttcttggtctcgtcgtccagcgccagcaccatcgcattcttgaccccggcgcgcagcacctgggaccagacaagagggagtttgttgtcctcagacaggagtgctcaccatgaccaagaagcacattcttctccacttgccgcttgccaactcacattctggatccacatgtccagcatgccacccttccttgcgtagttgatgttgctcacagccatgagcacctcgtttttaatcgcgacctgcgtgtagtggaggggccgaggagttttggggcgcttgaagaaactggtgtcattgattctgggcaagcgccctgcnnnnnnnnnngttaatcgcaacctgcgtgtggtggaggggccgaggagttttggagcgtttgaagaaattggtgtcaatgattctgggcaagcgccctgcaccacagggagcgccaccagcaccagcttacagggagtgcagcttgcgtctgcaggataacggtatcctggcaacagccgtaccttgcgcaggaatgctgccagctcaggatccttggcgtccctctcaggtgaaggtgtccacagtgaatgacgatcctgtgggtgcgggcatatacaccgatgcagctcccgattcatggtgtgatacaaatgcatcaaccaacctcatatagggacttcatgatgtacctgtccagtgttggcctgaacctgaagctcggatctcgaccttgctgattgcctttcctggacagccgcgcccatgtcctttgtcaatgtctgagctgcctgtagcagaatgtacatgaatgccgccatcgccccggcgtggtagatcagccagggaatggagcggcgaggaccgcccggtgttgagcgcatgagtgccatgttgcactggtgttccttcagtagcccttcaggacatgccctggtgattgtgacttcacaagggagtgagcctggatgcgtttccttctgacgcttcacgactcataaaagttgaagcttcgtcggtgtccaagcccgcgcagcaggcacatcatcaaaaagctaatgcccatgcaggacgtgtggttgctcgtgacagccacacatatcgcttccgagcatacctgacgcgcaattgggcaaattaaatttggtaatcagatcactgccccgtccctcgccgtcatggggtcnnnnnnnnnntagccacacatatcgcttccgaggatacctggcgcgcaattgggcaaattccatttagtgatcagagcactgccccgtccctcgccgtcatggggtcttctcaccggcgaagacactaagcctccacgttgatccggctgtaaccaaggccacgaagacgacgagatcagagtgaatccttaggatctgtcatgtttatgcaagcttcggcgcgtttgtggcgcacannnnnnnnnntagaccaaggccacaatgacgacgagatcagagtgaatcccttgagatctgtcatgttgatgcaagcttcggcgcgtttgtggcgcacaaatttggtggactggcgcgcaggcttcagcaccaccatgggtcccggaatggtatacctggagtcgctgcgaaatcacgagcgcgagggcgtgccatcaggcgctggtaccgacacatccaagggctttgacctggtgagatgcagactgcatgccgtgtcgatgtgtacgtgcgccaggactgggcatttgtatctgcatctttgagccctccctccctcactttcaatcccaccgacgcggtggcctcagaccaagatgcacaggctgcttgcccagctaggcgatcctcaggacgcgtggcaggcagtgcacatctcaggcacaaagggcaagggatccaccgccaccatgctggcgtcgatcgcatcagctgctgggctgaagacgggctgctacaccaggtggattgttatgctctgcttgcccatgcaggcttggagcaccagacctgcccatggaatgaggtttgcatctccatctgaagctgctcaagagctaagcaatgggggcccatgggccagggcatcgatcttacccttgaccgtgatttccaccttccccaccccctcccagcccccacgtggtgtccctgcatgagcgcatcctcatggatggcaagcccataacgtccgaggatttggatcaggcactggccgcggtccagcctaccgcccaggggctcagccacgcgtccccggagctgccccccctcagccacttcgaggtcctgaccgcggcggccttcgcccactttgcggccgccggcacggacctcgcggtggtggaggtgggtctcggcggcgcacgcgacgccacaaacgccttccgccctgccggccttgctctatcggtcgtgactcccatcgggtcagaccacctggacgcactggggggcagcgtgcgtagcgtggcggccgccaaggccggggtcttgaaggcgggcaggccgctggtgctggcaccccagcccctgcacgaagcccaccaggaaatcaagcgagaaggtgtgtacttgagcttggtcggaacagctggattagagggactgcagtgcgcctgcagtgaggccccctgcagaaggggcgtgaagcgagggaacagcctgtgcagggtcctgtgcnnnnnnnnnntgctttgtcggaacaggtggattagagggactgcagtgggacggcagtgaggccccctgcagaaggggagtgaaacgagggaacagcctgtgcagggtcctgtgcgtggtagattgtgggcctttttttggtggactgtgtgggtggacgccagagataactgagtaagtctaaacctgggaggaaaggatggtacaggggatcccacaggcctcctgggtgaaggagcgtgccttgggggacagggccaagtgcttttgctccaccctctgaacatgcaaggatccaaacctcctgcagcccaaagctctcattcaatgannnnnnnnnnattttggtggactgtgtgggtggacgctagagatattgagcaagtctaaacctgggaggaaaggatggtacnnnnnnnnnngatttcccgagcaccgctagatgacaactcataccttggctgggaccagcctgtcaccccggacacaccaagtcccctccgctcctgctccgcagctcacaggctggggtgccctgtgatcgaggtggctgnnnnnnnnnnagtttcccgagcaccgctagatgacaactcgtacctcggctgggaccagcctgtcaccccagacacaccaggtcccctccgctcctgctccgcagctcaccggctggggtgccctgtgatcgaggtggctgacgaggtggagctggagtttgcaaggggcggggagcagcatccagctgcccctgcaatcgtgcgagtccttggctccacggtggctgcagcgctcggtcttcagcagggcgactgcataggtgggcaccgtgtgtggcattctgatgtgttgaggtgcaggagaggggagggactgcggaagatgccgggtgtttgaagatgagcgcttacctcccctcccagcaaccgtccgcccctccccacccactcgcttgacagagatgaagctgggcatggagggcgtgcaccagctgtcaaacgccgccaccgccatcacggcagcggccgtcctggcatcggagggaattctgcagggcctgaccctggaaggcctgaggcttggcctctcacgcgcgcagctgcccggcagattccagcgctgccgcctggcggagcacagagccgggcctgtgctgatcgttgatggggcgcacacgcctgaggcgtgcgccgccctggccgcctcgctgcgccgcgctttcccggaaccctcccctgtcgcgctcgtcctggcggcggcggccgacaaggacgccaggtaccatctgggctgtggggtacgcaggctgacaggccccaaagcactctgccctgcctgcagtgcatcatgtctgcgtccagagactgcccgggcnnnnnnnnnnatgtggggtgtgcaggctgacaggccccacagcactctgccctgcctgcagtggatcatgtctgcgtccagagactgcccgggccaagcacaatgtgctctccaccctgcagctttgccgagttagcttggcctctgcgctcatcgctcacctcccacgacnnnnnnnnnngagcacaatgtgctctccaccctgcagcttcgccaggttagcttgacctctgcgctcatcgctcacctcccacgaccaccccatccctcgtgcagcggcatgtgcgcggcgctgggtgcgctgcgccccgtcgccgtcttcccgaccgaggtggaggtggccggcagcggagcccgggcgatggcgccagggtcaatcatggcagcgtggcagttcaacggtgcgggcgcgtgggggattggggtcagggtcggcggacacgccctgcaagtcatgcctggatgcctttccagcggtgcatgcggcccgtgacaggtcagcaggcggggctgccctnnnnnnnnnngtgggggcagggtcggcggacacaccctgcaagtcatgcccggatgcctttccagcggtgcatgcggtccgtgacaggtcagcaggcggggctgccctccatggcccggcccacagcacccagccctcagactggccctgcactgccagctccccaaacactcgaagctccatcctctttcactccccctgccgctgcagtgccccgcccggnnnnnnnnnntcagctccccaaacacttggagctccatcctcgttccctccccctgccgctgcagtgccccgcccgggccgggtgatgatgcagccgtcggtggtggccgccgtggagagggcgcgcatggagctgggcggggtgcgggaggggggcggccccggcgtgatcctggtcaccgggtccatgcacgccgcaggggccgcgctgcgccgcctgcacctcgtccccgcctgacgcggcgagtgcgaggggctgcggggtcacccggcgcggcactgaaccccctctcggtccccctccatgctttcatctgaaagcaccatggtnnnnnnnnnntgaggggctgcgggtcacccggcggggcactgaaacccctctcggtccctctccatgctttcatctgaaagcaccatggtcgggggctacatgtaaacaggactgtgcaggctacaggcacaggccgctgacatccaggtggagctcggcggggggcttggggatccagtgctcgaagaaggcgtgccggcgcaggccggcccagcgctcgtagtactccccaccgcaccgggccttcacctcgccgtaagaaagcagggccagtcgcggccccgacaccatcgtcgccgcgcccggcaactcgggatctcccgcacgctgcaccccagccgcgtcctcacccnnnnnnnnnnggtcgcggccccgacaccatcgttgccgcgcccggcaactcgagatctcctgcacgctgcaccccagccgcgtcctcacccgccccccctgcctgcagcaggcgcagcaggtccacaaaactgcgccccagccgcagcctggaggcggccgacgccgcgctgggcctgatgccctcgcccaacttgcgcttgtgcccggagcgcagccccagcacgcccgtcaggccctccagcgcgccgcgcggcacgccagccgcggccccgcccggcagcgcgtgccacagcaggcagccgccggcggccgagc

SEQ ID NO: 43739 - DNA, 16966 bp, Chlorella protothecoides
  modified_base (956)..(965): a, c, t, g, unknown or other
  modified_base (1401)..(1410): a, c, t, g, unknown or other
  modified_base (3019)..(3028): a, c, t, g, unknown or other
  modified_base (3659)..(3725): a, c, t, g, unknown or other
  modified_base (4332)..(4341): a, c, t, g, unknown or other
  modified_base (5619)..(5628): a, c, t, g, unknown or other
  modified_base (6887)..(6896): a, c, t, g, unknown or other
  modified_base (6961)..(6970): a, c, t, g, unknown or other
  modified_base (7351)..(7360): a, c, t, g, unknown or other
  modified_base (7821)..(7830): a, c, t, g, unknown or other
  modified_base (8068)..(8077): a, c, t, g, unknown or other
  modified_base (8682)..(8691): a, c, t, g, unknown or other
  modified_base (8761)..(8770): a, c, t, g, unknown or other
  modified_base (9788)..(9797): a, c, t, g, unknown or other
  modified_base (9975)..(9984): a, c, t, g, unknown or other
  modified_base (10760)..(10769): a, c, t, g, unknown or other
  modified_base (10922)..(10931): a, c, t, g, unknown or other
  modified_base (11598)..(11607): a, c, t, g, unknown or other
  modified_base (12824)..(12833): a, c, t, g, unknown or other
  modified_base (13023)..(13032): a, c, t, g, unknown or other
  modified_base (13825)..(13834): a, c, t, g, unknown or other
  modified_base (14053)..(14062): a, c, t, g, unknown or other
  modified_base (14177)..(14411): a, c, t, g, unknown or other
  modified_base (14479)..(14488): a, c, t, g, unknown or other
  modified_base (14808)..(14817): a, c, t, g, unknown or other
  modified_base (15178)..(15187): a, c, t, g, unknown or other
  modified_base (16828)..(16903): a, c, t, g, unknown or other
cggccgccgccgctgagcagggcgccatttttgtcgtgcaggcaggcggtgcgttgcctgttgggccgccaggacgccagtctgcttctggctcggcggctgcccgcgaggcatcatcctcgtcgccagactgtgttgagctgggaggcgcatcagtgtgctcgcttcccgggcagatgcccgatccagcctccactgttgcctccctgttggtgagcgtccaaaggggaggattggcgccatgctcgcagtcttgaagctctccggcaggctgtaaagagtgatgcgcagtctccctctcccgactgtacaagtgtggcaggcgtgcacgggcagctgcccacccatgtataccgccaggccatccatcatcctctggcacctgcacataacgcaccgcttgaggagacgggcatggcgcatggccactgccttgtccgttcgcccggggagaagcgctgcgatggcagcccacttgacacgtccattgggctggaaaggggggaaaggtgtcattggagaggtggggtgagacagggatggagctttgcgagggatgatgtagggctgagcaataccggatgtggctgacatggtaactttggaatgatgccaaggggttttgtactcaagggcaggcagtgaagacagcaaaccttggtaccacatattcctgccctgcgcagacactcactcacccgtctgaccaggtgagcctgtttgaggatcgtagcgtcctcctgcatgtatatgcgcgtgaatagggatcaaggagggtcatatggtgctcccccaccacggcgctctgtccagtcaagactgtgctacgatatctcgaaattccgggtgtgcagcgcaaagcatacaccacgcacccctgacccccgattcccgtccgccggctccatgcacctcggcagtgaatggagcggtgctggtcacgtccggattgagcnnnnnnnnnnggaacccctgacccccggttcccgtccgcccactccatgcacctcggcagtgaacggagcggtgctggtcacgtccggattgagcacgttcatccatcgttcgcggcactgcacatccgacctgcccggcaccagccttgccacagccacccacgtcttgccatgcagggcgatggcctgctcgagtgggagtaggtgaaaaatggtttaaagagtgcagggacagacaaaaccctgatgaatccagcggggtgtctcacatcccagaccattctcccaccctgccgttctgttcaggaagccgccatccctatataacaccaccaatgacgcggaccccagccacccacccgctgcagagcatcgtcctccaaggcggtccacttccccctccgtggtgtggccgtgccgccacccaaagagccccgctgggtgnnnnnnnnnngtcgtcctccgaggcggtccacttccccctccgtggcgtggctgtgccgccacccaaagagccccgctgggtgtgccgtcgccaggcgtgcatgaggctctgcctgtcccagccaggccccattttctccgccagcatctgcagggcagatggcggggggaggcacgagtgacagatcgtagggccagcatcaccaggcgtgggttccatgacgagctgagggggtgggcctggtctgcagacgtgaatcccgacgcatgtgtgtggtaaggccaatcagatcgcactcgatcaccttccaccgaggaccgtggcgctgcatcagccgcgccagcagtgagagctggtccggactcagctcaccaccctgccgcgctgggccggcagagggcccggccgtcccggcctccatgccggaaggcacgggtccggccgccccctcctgactcctcggcgccgaagaggcccgcctctccagctccagccaccgacgcaggcatgcgatcgcggtgcgcttccctcccagatcagccgccactgccggccactgcatgggtgtgggcaaggcgctcaggctggttgcttgtgtacagccgagcagaggatgactcctcatgtggcaatcagggctccttgaggagaacccgacaccagcatcttgcaaggaaatcatcctcacaagcaacgcctccccctcctcaagccacagccagtcgcccgcacctggtggaccccgaggcgggccacggcatctgccagagccgcgtcctcctccggctcataggcatcgtggcgcaggccggggcgcaggccgttgacccaggccaggcggcaccccgacgcgcccgacgcgacccccgcccgctgctggaccacctgccagtcgccgcggtcaaaggccagggtggccgcctccacgccagggtcgtccagggtcaaagcctccacgcccgcgcaccgagcctggatgtccgcgggggtgaggggctggccggccgccagctccgcctccacggcctccagcacggcattggtgcgcttctcctgcgccgggtgccgggttcggcgaatccggggcattctcacgcgggtcgagggaccgggagcgcgagtggccactcgcccagggcacgcagcgtcgaccacacgagtcctgcctcacggcagtgcctcgactggtagcatgcggccgacaccgtccctggccccagtccgagttgccacgcacctgcaccagctggatcacggcaccccggagccgtgcggcatcctccctggagagcgccgtggacgggaaggtgtgaggcagataccggtacaccggtgccagcacggcagcctctgggtgcagcggcggcggctcgtcgcccaccgcccaggcccgggatgggaccgggaaggccggctcctgggggatgcaggggcaggttgtgggcgggaagcatcgagcggcaggggttggggtgagcttcgtcaatcatacgcgtccactgcacacccttgtcggagccttgcagctccagggtgaaccccacagccagttactggcgtgaagcacatgatactctctcagcctcgggcccaagcaccttcaggccgctggaggcgnnnnnnnnnnggcttcgtcaatcatacgcgtccaccgcacagccttgtcggaaccttgcaattccagggtgaaccccgcagccagttactggtgtgaagcacatgatactctctcagcctcaggcccaagcaccttcaggccgctggaggcgctccgcagcgcccccgcctgccgcttgcgagcccggagcgcggccacgcacgcctctgcatctgcgttcctggacgccgcgctctcgatggactccaagagccgcttcaggcgagcctgaatggctcggttggccgcgagcgccgctcggagggcacctgcacgaggatggcgcgcatcacctggccaggcaccaatttctgctccgatagatggcgactcgtgttccctcctatcttctgtggaagcatgacgtgcaagttgaggcccgaggcgcagggtgtggcgaggtggcaagtcattcacgattcccacaagatgatgaagaggctgcccacctgtctccgcaggaacctgccggctctctggctcgatctcctcagcaccatcagcactggggctctcgtccggagatgcatccccaccgctggcttccacggcgatgcgcccgccctcctgtggaatgccgggctattgatctagtttctgnnnnnnnnnnnnnnnnnnnnnnnnnnnnnnnnnnnnnnnnnnnnnnnnnnnnnnnnnnnnnnnnnnngccgctgctggactccatatgcggttgccatcacagcccacctctctgtacgcttctccaagtacactgcgtagggcggccagctcatcttgcagtgcctgcagctcattgagctcttcctcgtcctcactgtcctccgaagctgaagacgcgccgggcgacatatcggagcctacccaggttcccgtaaatacattgccacgactccaaggaccgttggaccatgtgagcttgtctcctcggtggcttagcggtcgaactgcgatcgcgcgatctggggagtgcccgcgcgcgcgcgaccctcgactcctggcggttgagtgtccacccggaacatcacgcacccacaaattttacaccgcaccataatgtcgactcgagtatgtagcgcatcagtatggtgatatgcgcctttgggcgcctgataaacgcaaaggcatggcactgctgaagccggtctttgctgtctttgtcctcatctcgctcgtcatccttcgctcctcacccctgcgaatctatgtgagtggacgtcgggagggggtgcgagagtccaaatttcatcaaattccaacactcgacctgatcacccattcgaatacggcgcagnnnnnnnnnnacgaatctatgtgagtggacgtcgggaaggggtgcgggagtccaaatttcatcaaattccaacacttgacctgatcacccattcgaatacggcgcagaccgaggatgcaccgcgtggtgtgcagcaccgcgttgggcctatctcgccggtggagtcgacatacacggtgggctgtcgaccctcccctgcagggtcccgacaccagatctgggaccattgttgcgcattgaacttgatctggaggtgatctggccacccttcaccctggatctgttcacctccctcccacacagtgctcggaggagcacccggatttccccgaccagcgcatgtgtgtgttctccaacctcctcatcgtgaaccagacacttcactatgtgagcagcaagcaggaggagctgcctcccatcttcatcagctgggaaaaggtgtatgagggcgaccagcacctcgccatcagcatgacccagccagggaatctgcccctcactctctggagggtgagggggaggagagactcggagggggatgggcagtatcaaacggggcacaagatgccagaccagcctaaagggtcctgtggtgctctcaacatcccagcaaacattggttaaaaggtgtggtgcaggtctccccaatccctgtacatattcgcccacgccaggaagtggaggtggttcgcagggccggtctctttcaccagcagcaccccctgaactattaccaccttttcaccgagatcgtgcccaccatgcactactccatctgccgggccctgggcatatgcacgcatgaagtgagtctcatgaggttgtggcgtggctgctgctgctctgccggcaccacgttgcccacccattgctgtcgcccaccatctgcaaaccccggtgcggcaggcgtcgcaggacctgcggctggtctgggtgaacaagtctggggtcaaccaccccaagggctatgtcttcaatgcgccgcaagccatcgtggacctgctgcagtgcatcagcccgcagcccgtcctcaacctgcaagacaccgggtcgcgggtgagtcggcggtgcgagctgtgtgggtgttgcagcgtcctggcaggcctgccctgctttgtgatggggaccccgtgtggtatcggctcaagaacgggatccctgccaggcacatgtgctggaggatgtgcatatgataaagcctggaccgatgaatggtgctcaagggtacccctctccccccctccctaccaccagccaatcctgatggagaaggcggtggtgggcctgnnnnnnnnnnccccccctccctccctactaccagccgatcctgatggagaaggcggtggtgggcctgccccgcaacgtccgcttctaccaccagaagaaagaggagtggcaggccaggttcaaggacccgccccccctcaagtacatgaagcattaccgggagcaagtggccgcctgcctcaaccatgactttgtcaacgagcgggtgcgggctgcttggctgcagggccttgaccgatggcggcttgcctctggaccagggcgccagcgagttttgcattcgctgctcgaatcgtgcatgcagcgatccgcgggtactactcctgttttctgctccccgcgtccttgccccctcccccacacaattcttccctcttccaaactacctcctccctccccaaccaccccaggcgccgaccgacccggtccgcatcaccatagtgaaccggcactacgaggcggggcggtcgctgctgaacgcggagaccattaaggaccacatcctgtccctgccctccgtgcgagaggcgggaccggggcgggtggtggtggaggtggtgtacctcaagggcacgctgcgggagcaggcggccgtggtctggaacagctcggtctacatctgggcgcatggcgccgccatggcccacgtcttcttcctgccgcgggtgggtggcacggggcatgtggagggagcatgggggttgtgggagctcctcccccgccaagcattgcgagggccaagtcggcaaaccaagaattgtgcgctggtttggtgcgcccacgtttccccttcgaccacctctgtccggttcggtcaactgatggcgcaggcgcttgcacccctgccccgccatgccatgagtgcccccggtttcacacttcacaccctccaccctcatgcagggggcgcatgccgtggagctggtgcagtgggctgtcaaggatccccacgaccagcatgtttgggtgcagggcatccggaaggccttcgacatcgacatccagctgggggtggtgaccaacgacgaccgcaccaaggtcttcttcaactacgacgtgcgctgtggcaggcgctttggtttggaattggcgacggagcaagtcctgcacacacatccccacgcaggggcctgcctgcccgcgccgggccgagcatgctgagatgccttcctgtgatcctgctgcaccgactgtggtgcgcaagcccatcacctcacccccccccccaatcctacccccacaacccttgcaggtgatccgagccccgannnnnnnnnncggcgacaaagcaagtcctgcacacacatcctcgcgcaggggcctgcctgcccgcgccgggccgnnnnnnnnnnccccccccctccccatcctcccctcacaacccttgcaggtgatccgagccccgaactcccagtaccaccgattcaacgactcggagaaggtggcgttgctcgagaacctgacctgtcccgagcagccatatgccaatggcggggaatgcttcggctggttccattggggcatgtcccttgtcctcaagtttgacctcctgaggccacaggtggtggcggccctgaaagcactccgcccctgatcccccttctgtgagtgagcgcacccgacccaccatgcccgtccatcttggacgacattgacctgacacgttttctctgctcactctccctgtactccgtgggctcctcgcccggctcgccattgcctgccccaatcannnnnnnnnntgcgacattgacctgacacgttttctttgctcatgctccctgtactccgtgggctccccgcccggctcgccattgcctgccccaatcacctgtagtgtcccgtgaatttgcaatgccttgcacaacagctcagacgtcgtgatatatcccaattggattgaatgtaaggccgacgagactgctttgggtacgggtgattttattgagcaatctagctcccaagagcgtgtcttccgtcgagtacaggggggtccatgtgaatccaaggcgggttgtagggttatatcaccacccagagcagcagcaacagttccccgggaaacgccgggtttgagcacagatctcgatggatccaaatgctatactatcgatgcaagccatcccatgagcggggtaacggcgaccgcccccatccgcccccatggccggcattggtggcctgctggacagcctacgtgccnnnnnnnnnngtctcatgagcggggtaacggcggccgcccccatccgccaccatggccggtattggtggcctgctggacagcctacgtgccgacgtatctctagggacccggcccgctgcggggcaggagggcgatgaagaaacgtacatcaccgccgtctgggatgcgctctgcaggcatcggcttctggagaccatcctgaaccagttgctagaccggagtgtcccaggggcctgtccggatcacnnnnnnnnnnggggacccggcccgcagcggggcaggagggagatgaagaaacgtacattaccgtcgtctgggatgcgctgtgcaggcatcggcatctggagaccatcctgagccagttgctagatcggagtgtcccaggggcctgtccggatcacgagcgcgccctgcgccacaaggacgccggcaactccttcttcaaggctgggctgtacgaggacgcaacgaaagagtatgaagagtgcctgcactggctggacgctcgggcctggcccgtccaggccgcccaggcctactccaacagggccctttgctggctgaggcgggggcaggccacggcggccgaggaggatgccggccaggccctcatcctggacccagccaatgccaaggcggccttccgccggtccagcgcccgcatggcccttgaggactggccgggggcactggtggatgcgctggcagcacaggcatctgcgcccgggccggatgtcgaggcggccgtggccagatgcagggcggctgtcggaggggtagaccaattggccagtggtggtgctccggcctgcgctgagcgtgctgcgggtcctgacactgatgggagcctgaggcaagcannnnnnnnnnaaggcacagtgggggaaagagggtaatagaactggcatcgccgtcatcagcaggttgtttggaggggctnnnnnnnnnnaaacatggccagagatggtgctccggcctgcgctgagcgtgcttcggggcctgacactgatgggagcctgaggcaagcagcgccccgtcccgtcccgtcccagcctgctgtcgggggcaggcaggcgcaggaccctcgccttggccgagagctggtcgccacgaggcaagtgtcccgtggggagtgcgtactgcgtgaggcaccagtagcctgggtgctgggtcgtgctgccagccaggaggtgaggcacagtgggggaaagagggtgacagaactggcactgccgtcatcagcaggttgtttggaggggctgaaagcctggagtcgccactccctcgtctccacaaagaggcaggacgtcaccctccccaaccccagtcctcacccaccagggagcatgcatgaccgctcctccctcctcttctttccgtccgtctgcagcgctgcgcacgctgcggcacgctgctcgggcacccccccaggcgcgccgtccacccctgcctcgcatgccccctggccctgttctgcagccccgcctgccgcactggccaccctttccaccaggcgggcgggcgggagtgcggccgcgcgtggtcccgcctgctgcccgccaactccctcctggcgctcaggctggtgctgacgcagcgggggctgcccgcgccgcaggccagcgcgctggccggcctggcctgcggcacgcacctgttcagcgccgaggagaggctggtggcggctgcgacggcctgcctggccgcgctgtgctgggccgggcccgagcgcgtgagcctgagggccgaggacgaggctccactcctcggcctggcgaccgcagtgttccgcgcctcgggccaggtgcggctgaatgcctttgggctgcacccaccctggaactcggggcgggacacggcctatgcccaggcggtctaccccaccgccagtctggcaaaccatgcctgccggccgagcatctccgtatactttgatgtgaggcctgtggtgggagagggtgggtgtnnnnnnnnnngcgttgcaaagcccagatgaggtccgtgcacactccagtctttggcgagggagcgccggatctcactcatctccggtaccggtgctgggtgcacgcattactcgcttgggaatccggtgcagcagcaccatgctgtttgctgaccaggggtctctccccctggacccccctgccttcnnnnnnnnnnacgtttcaaaagcccagatgaggtccgtgcacgctccagtctttggcgagggagcgccggatctcactcatctccggaaccggtgctgggtgcatgcattactcgcttgggaattcggtgcagcagcaccacgctgtttgcttacaagggtctctccccctggacccccctgccttccatcccagggactgactctctgcatgaatgcagtggctgctacctcagctggcacgccgctctggcactgctatggcgccagcgcggcagccatgagccggccgcagcgccgggccatcctggagggcacctacggcttccgctgcgcctgccgggactgcgtgaatggcagcgaagaggaggacgccgagctcacggggctgcgctgccccttcacccccggctgcacagggtccgtgctggttcccacccgcctgcccgcacgcctgacctccgcgtgggaggttcctgccgggagcggaatttgcagccgatgcaggaaggatggcaccgatccagctcaccggaccagcctcgagcgggcagtcggggcgctggcgggcgtggcccgccaggtggaggcactggagctccacatggcggggctggcggagagaggggcctggaatcaccccgaggtggatgaggcggtccagtcgctgcgcgagggattgcaggtgggcgggaaacaggtggctgcgggggatgttgtgggaggtgagtgctccgctcgcacgcctcgtcaccgatggccaatgactggcatctgcgctgagccnnnnnnnnnnaggtgttgtgggaggtgagtgctccgcttgcacgcctcaacacccatggccaatgactggcatctgcgctgagccagccgccagggctctcataaccctgcaaggcacgtaagagggacatgaacgtccaggagagatccctgttgaatactnnnnnnnnnntaccctgcaagtcacgtaagagggccattaacgtccaggagagatccctgttgaatactctctgacatccccaccgtccccgcgcccccatccaggtgcactggcgatgcctcccccgccgcagcctcgccagcgtgcccctgctcaagtacctggcgcgcttccacctggcccgcggtgagtgcggcgacggcacggcggccgtgctgtgcacgctgagcaccctcagggcccgcttcccccgggaatcctcagagggcgccgctgccacggccgaggcggcggcggcgctggaggcggtgcgtgtcgccacgggggccggcccgacatcacccgcgctcaggcgccacgcctacctggagggcacgggcctcggcggccgggcagccgaggccctgctccatgagctggaagacgctcgcaggctccctgatgcgacgtcggagctggcggtgtggtttggagaagggggggcaggggccctgctggaccacatccgcgccctggtggggctctctcctcatgctcaagccacacgcagagctggagactttgtgtgacacccgacagccgcgacatcagttgacaagctttccatacgcaatgaaagccttgctgagtgacgcccgcagaccgtggaacgcgatatcacagccgaggccggtannnnnnnnnntttgcagagtgaccaccgcagaccctggaacgcgatatcacagccgaggccggtatcccccatgcgtagacatgcacagcgaggcacagtgaagaacagcaaggcatgcacacaaccacttggatcacgcgccgtcgcaaaactcctccagtgtggcccgcagctccgccgcgtcaaactccgaggtgattacgcagccgccgagggggcccttgagcaggatgaggcgcagcgtgccgtccaccaccttcttgtccacgcccatgaagcccatgaacacctcgggcgtcatgccctgcggcggtggggatggtgttgtgctgggtgagggccgggggatgcacaaccagcagcatccatggtctttgccaagtcatcatagtcctgcacaagggcaatcgatacttcacctgccgcccatgagtaggtccatcggcttcccccactctcaacacagccccaggccacccacctttggtggcctggtgggcagccccgccgcggcaatgagcgccgttgtcctgccctccagcgcggcgtctatccagcccagccgccggctcaggtccgctgccatcaccgtgccggctgccaccgcctccccgtgcagccacgcgccgtagccggcggccgcctcgatggcgtgcccaaacgtgtggcccaggttgagcgtggcacgcacgccgccctcccgctcgtcggcggccaccacctcggctttgttctcgcaggagcgccggatggcatgtgtccacgcctgtagagggggttgggattgtggggcggcaagtgatgcatggtcagcaggtgcagcctgtgcgcatccttgtgcctgcccgaggcagaagcgtgttgcggcaagaggtgcccgtcggagggtgtggccttcgccccgtgtcctccaacccgccccaaaactgaccccccccacccttcgaaggcacctgggggtccctggccaggaggcgaggcatgttggcctccagccactcaaacagctctgcatccctgatcaggccatacttgatgatctctgcagatagggaacagggccagcaggagcgtgatggcaatcgtgatgactaaacattgcgtaccaagggcatacctcctctgcctgcggtgcactggcaccacacggcagcctcagacaatacaagaaagacttagaccttgacgcaacagatccggcgcgcatccagccctccggctgccannnnnnnnnncatacgaggaagacttagaccttgacgcaacaagtccggcgcgcatccagccctccggctgccatgtgaccaaggcttgcagccatgacctggattccaaggcagacatctcaacccctcagatacccgccccgcctatcacccgtcgttcacaatcacccctgaacctgagatgccagaggccagctcnnnnnnnnnngcatctcaaactctcagatacccgccccgcctttcacccgtcgttcacaatcatccctgaacctgagatgccagaggccagctcccgggcgggcagggtgtccagcgcttttgtgtcgatgaggacgcactgtggctggtggaaggcgccgatcatgttctttcccagggggtggttcacgccggtctttccacccactgacgaatcgacctgggccatcaccgtcgtgggaatctgcaggccgaggagagtacgggggtgggtgaagtgcctcacaaggcacacgctagtgcatgcgatcgcacagacgcagcaccgccagcgcacctggacaaaggcgacgcctcgctggtaggcggccgccgcgaagcccgtcatgtcgccgatcacgccgcctccaagggcgacaaaggtggtgttgcggtccagcctgacaccgaggtgaggggtggacgacttgagaagacggcaaacacagcgcgcacagcgtgacgaatcctcgcaggcgatgctgcccactgcagtgcagcgcctgggcattcgaggcgcgggcagcacaggcacgcccggctcgcactctcgggcacaatgggacgacgaccccaagcagccattgactccatgcccctgtccgacccacctggactggagtgccttgtcccacaccttctgcagcacctcgacggtcttgtactgctcgccgtcgggcagcacaacatgctccacccggatcccgctgtccccgccgcgcagcgcggccagcgtgggctccaggtactccttggccaccgtnnnnnnnnnnctctgcagcacctcgatgctcttgtactgctcgccatcgggcagcacaacgtgctccacccggatcccgctgtccccgccatgcagcgcggccaacgtgggctccaggtactccttggccaccgtgtcgttggtgaccaccagggcggaggagcctgcgatgtgctggcgcagcagggcgcccttctgcaggagcccggccccgatgtagatggggtannnnnnnnnngcaaggcgcgggcagcacaggcacgcccggcttgcactctagggcacagtgggactatgaccccaagcagccattgcctccattcccctgtccgacccacctggactggagtgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgtacgcgtacccaggttcacctccaccgtctccatgggccccgcctcgacatggggaggtgcgtggnnnnnnnnnnggtgcgcgtgcccaggttcacctccaccgtctccatcggccccgcctcgacatggggaggtgcgtggactgcctgcgaggcctggaagcatccaggatggtgatgatgcgatggtttggtcttgccatggcccttactgtatcaccccttccgtcgcacgtgacgtgagcttgcgcgccatcgtatgtctcacctccatgctcacggcccttgctgacaagcgcttgcgggaccttggatctggcatgcctctttgacccgcgaggcccgcgcgcgaggtatgtctacaagcctgggcagtcgcgaaaggcctggctacnnnnnnnnnntcatgcctctttgaatcgcgaggcccgcgcgcgaggtacgtctaccagcctgggcagtcgcgaaaggcctggctacagccagaccccgggcattcgccgcgaggtcgatgccgcatccgactgtgagaacggtcattgcagagatttcataagaacacggatttgggtaccaaagtgcaggctggctgaaggtgggataacgagttgcgacgatctcgtccgggcggtcagggcgcgagctacatgactgacaacacggggtgcagggtgcaatgtctcaagcttcatgcgacacgagcccctatgtctctcgcactcgaaccttcaaactaacaccattagccatgccatgacctccgtnnnnnnnnnncgtctctcgcactcggacctttcaattaacaccattagccatgccatgacctccgtctcgcctcttggccaacgtctgtgtcccgggtgcttctcagcccttcatgcacggagaccccgcgcggtacaggtgcatgccatccctgtccaatctggagtccaggacgttttagttggaggagctgtgtttgtggcaatctcagttgcattcgtcaacggcttcaaggtgaggtccggcgtggtgggagtgctctgcatgtatccatgcaggtgtttggagtccccacgaatcccacatgatctctcacccatcgcaggcagatgcacgcccatgcccatcctgcggggcaacgggtggcgtgcgctgtttcgcgtgcaacggctcggggaggatggaggccggaggagcccctcggcagggcgcggaccggaagtgggcgggctctgcctttcagaagcagccgtcccatcccaacgcatgccgagcttgcgacggcgccggcatgctcttctgcgcccgctgctctggcacgggctacatcgatcgatagagcctcaggtcgggcatggcgctgcgtggaggcctccaggctccatgtgtgccatgaacatggtcgaggtttccagccccatttaggcatgttatgtgctccccataccagtcctgtgccctgaccacttgtcctgctcccctctgcccattgtgtacccctcgttgcattgcccacgctgctcagaagtgctgtcaggaagcaatgatggtgtggaagggcgtggccggaggtcacagatgggacatccccgcaggggcatcccactgccgcaggcagccggccgagtgccaatctctgcggcatcagtagggtcggtaccgcaccccgccgcccctgccccccgcctccaaccccctgctcggggccccggtggggggggcgtctgtcggaggctggcgcagggcgccgtaaatgtagcccggcatgttccgcaccatgctcaggtccctcatgcccaggcgggacagcacccccgctgcagacgcctcgcccatgtcctgtatggaggggggcaaaaggggtgggcggcggctgagtgagaccgccgagcgtcccctagcaaggcgtcctgaccgtcgcagcgccggagcagcgcctgccggcctgctctgaggcgaccgccccagctccaggctggagacgcagtacaaacacccacggctgcctcccccctcgccgcactgcacagctacttgccagcagcatgtccacaagcccgtcgttgaagtggtctacacgcaggaagccgccggatttggccaccagcgccgcgagctgggcctggagggagggcggcaggcgcgccaccgcgcccgtcgagtacgtgggcccgggtgccgaggcgtacggcgctgctgcaccgggcgccgcggcgtacggcgctgtcgttccgagcccagcagcatagggcgctgcgcccggtccggagccgtacgacgctgctccagcccccgccgcatacggcgctgctccggcccccaatgcatacggcgctgctgccggacccgtgccgtagggcgccgcaccggccccggatccgtagggcaccggtccgggaccggcggcgtatgcggcggcctgccccgccnnnnnnnnnnnnnnnnnnnnnnnnnnnnnnnnnnnnnnnnnnnnnnnnnnnnnnnnnnnnnnnnnnnnnnnnnnnnctgctgcgctccgtaggccggctgcggcacgtacccgccggcctgctgcgatggcgcaggcgc

SEQ ID NO: 43740 - DNA, 61 bp, Chlorella protothecoides
cacgagacccacctgtagaagaatgtctgggcaagcagctgcagcgccgcatccgcatccg

SEQ ID NO: 43741 - DNA, 108 bp, Chlorella protothecoides
ttttccaagatccatgcggggtcatcgcgcgtcagccgagcatggatcaaagccccagcttccgccgccggtgcgccgtaggtgtgctggagttggatgagcggccgg

SEQ ID NO: 43742 - DNA, 1186 bp, Chlorella protothecoides
  modified_base (431)..(440): a, c, t, g, unknown or other
  modified_base (513)..(638): a, c, t, g, unknown or other
  modified_base (919)..(1035): a, c, t, g, unknown or other
gcgccgcgccgccgccgcccgcgccgcccaacgggtcggcgcgcgccttttccagcacgcaggaccggatttccgcctccatggccgcctgcagcgtgggccggtcctccaccaggtggcgcagcagggcctccatgtacggctccaggccggggacgtaggcgtcgcggcgcgcgtccaggaccagcgccaccgcgccgcgccgcgccgccagcgccgccaccgcgcccgacttggtcaggcgcgagagcagctggagcgccgcgtggagcgtggaccgcgtgtcgggcgcggccaggtcgtctccggggtcgacccaggcctgcccctgcacgcggcgcagcagcgccaggcacgcctcggctgaattttattttggggggtagggagggggggcgggttagtaggggggagtgagaaggcaggggggnnnnnnnnnngaggaagtgcggaaatgattgacgagcgagagataggacggtgcgggccatggtcatggtcaagggcgccagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcgcttggtcccaggagacgagccctccgcacagctgagcgaggcgtgcgctgtttactccatcaggccatgcccgtgtacccctggctgtcaatactccatactgccacccccctctcccctccccccccctcctctccacccccaccactaccatagccactccactcacccgcttccaactgctcggcctcgctgagcaggccgcccaccgcccaggacgctgccatgctttccagggccgccagcgcgtcgctgggctccggcgcggcagcaggctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgtcgggcgcagcgccgccagaggcggcccctgcgcttgcggagactgcaggcgccgtggtcgctcccgcagcctccgccgcgggttccgctgcggaggtggccgcgtccatcgccgtcggcgcagctgctgccgccggcggctcggcccc

SEQ ID NO: 43743 - DNA, 20954 bp, Chlorella protothecoides
  modified_base (147)..(269): a, c, t, g, unknown or other
  modified_base (385)..(473): a, c, t, g, unknown or other
  modified_base (1004)..(1013): a, c, t, g, unknown or other
  modified_base (1924)..(1933): a, c, t, g, unknown or other
  modified_base (2536)..(2545): a, c, t, g, unknown or other
  modified_base (2988)..(2997): a, c, t, g, unknown or other
  modified_base (3616)..(3650): a, c, t, g, unknown or other
  modified_base (4519)..(4528): a, c, t, g, unknown or other
  modified_base (6847)..(6856): a, c, t, g, unknown or other
  modified_base (7323)..(7332): a, c, t, g, unknown or other
  modified_base (8028)..(8037): a, c, t, g, unknown or other
  modified_base (8539)..(8548): a, c, t, g, unknown or other
  modified_base (8760)..(8769): a, c, t, g, unknown or other
  modified_base (9286)..(9295): a, c, t, g, unknown or other
  modified_base (10225)..(10234): a, c, t, g, unknown or other
  modified_base (10483)..(10492): a, c, t, g, unknown or other
  modified_base (11088)..(11097): a, c, t, g, unknown or other
  modified_base (11843)..(11852): a, c, t, g, unknown or other
  modified_base (12147)..(12199): a, c, t, g, unknown or other
  modified_base (13379)..(13388): a, c, t, g, unknown or other
  modified_base (15284)..(15293): a, c, t, g, unknown or other
  modified_base (15497)..(15506): a, c, t, g, unknown or other
  modified_base (15740)..(15749): a, c, t, g, unknown or other
  modified_base (16431)..(16440): a, c, t, g, unknown or other
  modified_base (16761)..(16770): a, c, t, g, unknown or other
  modified_base (17093)..(17102): a, c, t, g, unknown or other
  modified_base (17530)..(17722): a, c, t, g, unknown or other
  modified_base (18591)..(18600): a, c, t, g, unknown or other
  modified_base (20345)..(20354): a, c, t, g, unknown or other
gccgcggcgcgcctgcacgccgcgctgatcggggtgctggcccacctggtgggccgcctgggcctggccgcggtggccgagccgcgcgtcggcgcgctgctggcgccgctcctgcgccacgccaccgacgtggccagcaccgacagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacgacgggctgcgcctgtggcgcggcgtgctgcagcactccacctccgtgtcgcccctgctcgcggtgaggaggccagggaggttgttgtgtgtgtgtgtgtgggggggggggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaccccccccagcaccttgacacacacctgtgcaccgtcacatcacccctcaaccctctccaccccctcaggacctgtttgcgcaccgcttcatgccgctgctggcgcgcgggcaggacatggtgcaggtctactgcctggcggaggcctacctgctgctgggcggcgtggaggcgctgggcccggccctgcagccgctcatggacaacgtggcagccaccttcgagcgcgtgctggccagccagccggctgtgggcgcggcggccgcgcaggcgaggaagacggggcagcatgcgggcgggggcggggcgcacgccgcggcgcgcgcccgcttcggcggccgcgccggcatgctgcagccaggtggggacggggggttgaggggatggcctgggtgggtgcagcgtgctggactcgggaccggcccgggccgctcagccaggcgcgagctggcaggggtgcggcgacgaggcgccttgggggctgctgttgtcctgggttgaccgtggcatgcatgggagccggggcaggnnnnnnnnnnagatcggcccgggctgctcagccaggcgcgagctggcaggggtgtggcgacgaggcgccttgggagctgctgttgttctgggtcgaccgtggcatgcatgggagccggggcagggaggggccggcatcagacgctccctctgggcttttcccagggtggcatcatgtccatacgacaagcccctcccctggaaggccccctttgctgcatccctgcccggcaaacctcctcccacaccctcccacccagacgagatccaggaggcgctcagcgccgcctcgctggcgcagctggtgctgcagcaggtgccgcgcggcgccacgcccccgcccagcctgcgcgccccgctggaggccgcggcggcgctggccggcgcggactttggcggcacggtcgcccgcctccccgcgcgcgccctgggcgtgctggaagcggccatgcaggtcatcagcgccgccctctggatcgacccgcgcgggacttgggcgctggtgatgggcgcggaggcgggggagggcggggacagccccagggccactcggtgagctcctgggggattggggtgggcaagcggacgggtcgccctggcagacgggagggggggcgacagtcagcgtgtgcaccagtgtcgcactcttggctgatccggacggcctttggggctgctgcatctccactggggcaagcagcgaggagccacgtgtcgtcccacgagggctgtggtacctggatgacgcggtaaagctcgcacatctcgtggttggggcccccctctcctgcacctctagcgccctgcctgcgtccaggcacccccccccggacgcaacaggccgcctgacatctccccttccacccgtccctcccgtcgccatcgcccagaatgctggaccggtgggtctccatgtccctcnnnnnnnnnnctccacccgtccctcccatcgccaccgcccaggatgctggaccggtgggtctccatgtccctcaccgtggacatggctgagctcttcctgccgccgctggcggtcacggcgcgcgcgcggcggcacgaggcggccgtcgtggccgccaccctgctctgcgcggacgcggcgccgcagctgcgcgatgcggcccgcgcctcgcgcgtcatcgtcctgggtgggttgagatgtggagggtgacgatcaggggaaaagggggggccggggcacggaggtggccgtgcatagcaccatgggctggggattgattgccgctccgtcgctggccgggtgatggaagggactgcgggggcgtcacctgtttaaccacccgcccctgcctgcaggtctgaaggccgtcaaggaggcgcccgcctaccgcaaggatgtcgagagcttcaaggagagcctggcccgcgcagaggtgagtgagtggggaggaaattgtgccgggaactcctgcccgggctcaccttcgttgtactactgccaaaacatagtaagggggtcttctggtcgggccctgccttgcgtgccttattccggcgtctgtcatggcgagcnnnnnnnnnnggctggtggggaggaaattgtgccgggacctcctgcccgggctcaccttcgttgtcctactgctaaaacatagtaagggggccttctggtcgggccctgccttgcatgccttattccggcgtctgtcatggcgagctgctggggtggcgcaggcagacaggcaggcaggctggtcggacccccgctttctccgatcctgcccggtttcccccctccgtacagcacgaggaggaccagctgaccctgcggcggctgtcggtggcgacgtcccatgccatcgccgaggtggacgtggccgagacagtgcgggcagccgcgcagaaggtgcgcgggggggcggcctgggtgaccgattggcgctcgggagcgtcacgtgatggtttgttgcatgcacggagccggacgcggttcgccaagaggcattgctcaagcatgcagcccannnnnnnnnnctctccgatcctgcccggtttccccctccttacagaacgaggaggaccagctaaccctgcggcggctgtcggtggcgacgtcccatgccatcgccgaggtggacgtggccgagacagtgcgggcagccgcgcaaaaggtgcgcggggggcggcctgggtgaccagttggcgctcgggagcgtcgcgtgatggtttgttgcatgcattaagccggacacggttcaccaagaggcattgctcaagcatgcagcccagccgaccaataccccgtggcggagctcggagccatctttctcctctccctccctccccaccatgccctgacaggtggcggcatggcatggcgaggaggcgctgctggctgccctgcgggccgtggacggcgcctaccccgaccagctgcgggcggtgctgcagggcggcgaggagagcgagatgctggccgcgctggaggccatgaacctgcagaagcccgacgacccgccccccttggactagacgagttcacgctttgcgctgcctgtgttcagggtggcatgtttctctttttccgcgagtgtgccgctcatcatgtgctgaaaccctgtgacatgaggcaagggggggggggggggggggnnnnnnnnnnnnnnnnnnnnnnnnnnnnnnnnnnntgcaggtgcgcagggaggagcagttgccagggtgctgatagcaggaaaagtccagggctgcagggagccctgcatgattgcaggtggcgcagggaggggcaggctccactggggagcgccgggggcaccagagccgagccccacccttcagtctatggtaactggggcgtccccgtccagcaggtgcatcaggtggacgttggtgacggagcgcagcttggcctgttttcgagccttcttcttgcggtcggccttctctcgcctccgcacggccttgcgtggagcgggtttgagccctgcacacggggaggaggggaggtgagcctccgccccactgcatgctggagcgcaccgctggcagaccctgccgatcgccacctggttgccccctcacccacaccagcatacctgctgcctgcacggctgctatgaggtcgtcctctgcctctggaacttcggtctgtgttgtggacacaacagggcaagggcgcagagagtggaaggagatgttatcagcagcctcgatcagcagcatattgatatggtggctcaaacaagcgggagcccttcccagtgatactggcaatggccacaactaaacttccccaccccctccacctgatgccataggtcgaccaaggctgcatctacccggaatcccaccagtctctgatctatgggaaagaggacctccccattgatctcagcctcaaacgactgaaaacctatgatcttgccctcagcctttaacgcctggaaacaattagaaaagggagataaagaacaggatcatacttctcccaaacaagttcataaagaaaatggcaatggcgttttcgacagcatccaaggaattacgaggctaagcnnnnnnnnnngtagaaaagggagacaaagaacaggatcatacttctcccaaacgagttcgtaaagaaaatggcaatggcatttttgacagcatccaaggaattacgaggctaagcacacctcccccctctgacgacctgcaccctccgcgaccaacagtggggtcatctctaggctgccacccacctggacgtcctgatctgccttggggtacgcttccaaaatggtctggaggaggacaggtttgtcacacacctggatcttttgcagcatggccgccttgttcttgacatttatctcaggctggtagaagatgcggccctcgacatcatcaaagccaaccttctcattccgccgcagttccctcatcagcgctgcatcatcctctattcgtctgcaggagtgggtaggatcatggtgtggggtaaaagctggacttcatcaactttaaaggcaaacacacctaccaccaggcagctctcacgtgttcaatgctgcgttcacttgtgctattgtacacagggccgcctctttctgcaggtaatcgactacagcctgcaatgtggacagggttaggggtgtgaaatagcccgccagagcttgaagttatcaccacctcagataatgccaaaatgggaccaatgattgggttgtgggcagcttgccttttggcggagcccaaggggcccctggggtgcacctccgtacaagtccgcgggaatggaggtactggcttgcgccgtggacgtcgagggcgcagaagaatttgattcggctgggtgtgttcggctcttggcctcagactctcttcgacgcgctggagtgtggaccggtcgtagtggggtttcagcggtgtgtcgctacaggatgcgcaaacatcttcgcctaccctcgctccatgcacctatcaagcacctttcatctctctctgtcgcgccagctttgcctcgcggtctttggctgcatcgtctttgagctgactagcctgcacctgcctcttccgaaagttttccagcacatttatggaagcactcccctgcatctttcctagcacctttccacggaaggcacctagttcagctcctatgcttacatcttttaatgcttactctttggtcaccgcaaacaacatcgggcacttctgactacggtacccgccctcccctcctccatgaccatgctgcgagcatgatctggatgctggacacacatcgaggagtcgcgcatgttgccccgggatttgcattcgacaaggagcccactccacaaacctcttgtttataggtgcaagggcgagagtgggagtaattcggatctgctcgaccgacatttctagggcggagtaggcgaaagccgtccttacccatgtctgcacacctcgcgacctgcttttgcacggccgcagctccgcccaggctacaaagatccagtttcaggccccggactcagcatgggcgcagagtcagctgccagtccctgtcttccttgccccacggtgcgttcccgggggccccactgacacctggggtcgccacatcggtggggtgccctcctcaccgaccatcgccgctcaccacgtgatccccgcaggcggcacatcggaggcgacacctcgcctgatgtccctctggactcccgacaccagcatccaggccgctcgtcagcccgcgccctcctctggagcacccggcgccgctgcctcctcgccgagcgagcacaagccccgctcccccccgcccgacctgccatccctcctcctggactcccgcatcgtgtacctgggcatgcccctggtccccgcggttaccgagctcatgatcgcggagttcatgtacctccagtacaaggacatccagtgcgtgcgcgcagggtgtggggtggaagtcatctcatcagggaggcagggctcgaaacttgggtcttgcctcacactttgcttgaagtgtccgcacagggtgtgttcagtctgcgctccctcacctccgcccccactccagcaaacccatcttcctgtacatcaactccaccgggacgacgagggctgacggcgagacggtggggttcgagacggagggcaccgccatctacgacaccatgtgctttgtcaagaacgaggtggggagaaggggccgatgtcagggccggccaatggtgcatcttcatgtcgcgggagtgcctgtgcagccgtcgcctgcaccctgcttgtcagcgagacgctgcagggcctttccccaaggcgcggccaagaataatcctcggcctgcacccggcttgggagcatgattcagacagagcagccacgacctttccatccgatcgagtgcacgtcnnnnnnnnnnttgcgagacgctgcagggccttctcccaaggcgcggccaagaataattcacggcctgcacccagcttgggagcatgattcagacagagcagcaacgacctttccatccgatcgagtgcacgtctctcacagcctcccacccaccccccattcccccctttctgcccttccaggtgcacacagtgggcgtcggcatcgccatgggccagtcctgcatgctgctgtcggcggggaccaagggcaagcgcttcatgctggagcacgccactgccatgctgcaccagccccgggtgccccccaccggccagcgacaggcggtggagattgccatcaagtggaaggaggtgcgcggtggggtgaggtgggggttccctggggcagggggccatgtgggatgtgtttgtgtgggtgtgggtgtgtgcgcgctgatgcctgctgcggcaccccgggccccgtcctccccctgannnnnnnnnngtgtacttgtgtgcgcggtgggtgtgtgcgcgctgatgcccgcggcggcaccccgggccccgtcctccccctgaccgttgaccaaccccagtgctccccgccccccgaccctccaggtcctgatccagaaggagaacatgctcaacatcctgtcctacaccacggggcacagcgtggagaagctggacaaggtgcagtggggtggcaggttgcagcggagtggtggcatggccagccgtgccctgggctgttcacccgctctgctcctcggccccagtgtgtgagtgcatgttggccagattcgtcttccccgagacacggcgtcacaccgccccctcccccccctccaatgcgcattgcttgcaggacctgcagcgcccgctgtacatgcagcccaaggatgccatcgcgtatggggtgtgcgatggcatcgtcaccccggagcgcaagatcgtggacgacgtgaagaagccagaggagtgggaccgggaggcgggcctggtgcagcgataggctgcgggacgggcttgcgcggccgccgggcgccgggcgcggggccccgccggcatgtgtattcctggtccagtggcccgggcaccgtggtcaagtgcgcagcgctgcacccatcctgcgtgcctgtttgtgtacgcccttgcattgtcaaactccgggagcaagctacagctgcggctggannnnnnnnnncccccgccggcatgtgtacccctggtccagtggcccgggcaccctggtccagtgcgcagcgctgcacccatcctgcatgcctgtttgtgtacgcccttgcatggtcaacctccgggagcaagctacagctgcggctggagggcggggtcggccccaaactcagcctgcccggggggcagagttccggtcggcgggcccacgcatgccggctgtgcccgcaaccagcgggtcacggactgggggaacacccacgccccgtctggcaggtgctggacgcaggcggtgtagggcgccgggagctgcagcgtgaccagggtgttgtagatctggtacctgacctggtgccgttgcttccacttctcaaagtacctggtttggtttgtgggggggtgggcagggggggggatgtcagagggccatcggcgtcttgatgtatggttggccgtgcagatgtggcgacaggtgcaaagggtgcggtgcggtttcggtgcagcaacgaggnnnnnnnnnntgggcggggtggggatgtcagagggccatcggtgtcttgatgtatggttggccgtgcagatggtgcgacaggtgcaaagtgtgcggtgcggtttcggtgcagcaacgagggcccctggaggggtggcaccctgcacgcacgccagcagtcccgttggtcagtcccagcaggcggcgcccacgcacctgggggccaggagctggaaggtgtgnnnnnnnnnntgccatgcacgcacgccagcaatctcgttggccagtcccagcaggcggcgcccatgcacctgggggccaggagctggaaggtgtggtcccgcatctcgtcattgctgaccagcacccccacctcgccggcacgcacagccgcatacatccagtacctgtgggtgggacgtgggcaggggcatcagtgggatgcagcatggtgcagtgacggggaccgggtgtggcacgtgtgagcggcggatgcggggcgcggcaaaaccagcaggggctgcggccccaccaggcccgcctccaacctgaaacagggcgtgccacccctcaccagtcatcgttggagccaaaaggggtgacgaagaaggacccctgctcctcaagcttggcgaagaaggtccgcagcgcagggtccagcttctgcgaagaggagttggcggctgaggcttccaccctgcgccgcgcaggctgcaggcgaggcacatgctgcgatgctgtgtgcgcctcgcacccgtgggacgcccgnnnnnnnnnngtggcggctgaggcttccaccctgtgccgtgcaggctgcaagcgaggcacatgctgcggtggtgtgtgcgcctcgcacccgtgggacgcccggctcacctggattcgctgcgcacgccccgcactcagcaccaccagaggcttcttccccgggaagacggtgcccagatgctccaccatggtcctgggatgggcggcggtccgtgttactcacttcgcatcgacgaagcagctcccctgggacaccctgtccccacaacccatccaactcacttcatctgtgggaagcaaaacatgcccgcccccgcgttctgcccatagaagccgacgttggctgcatcgatgatgatctccggggaccctcgctcctccagccaggcatcaaactgcgcggggggtggtggggcgccgcgatgctcacatgcgtgattgggcggcggcgaggcgtcctgggttccccgggcacggtgcccacctgctcaaacttgttgggctcgcgctgtgaccgcctggcgaggttggcaatgccctgcatgtgacatggtggcaggaagggggggcctggtcccagtcagcaaaccaagaaaggctgcgcgcagcacgcctgcgtcccacccctccgtaccttgatgaaagtgtccctctcggcgctcgacagcttgaccgcctggatgggctccccgccactgtcatcctgtccatcggctctcactgtctgcctggagaggatgaaggggccaggaccctcggcctgggagctcagtgcctcaaagtaggcttcgaccacctccagcgtgccgggctggagcacagtgagctcctcccccatggccaggaacacatgcctgatggggattccggggggtgggggagttgcggtgcgatgagaatgtctgatcacgaacagtctcagaggcgagtgctgtcacannnnnnnnnnccctgacggggattcgggggggtgggggagttgcggtgcggtgagaatgtctgatcgcgaacagtctcagaggcgagtgctgtcacacgaagaagacagcgcgtcccccggggttccacggtgctcagcaaagggctgagtcggggcgagcatggcgcaagtctgtgtaacaacatgccggccaacaacacttcccctttcccttgctctctaccaaactcactgcatgcttgcccagagggggctccnnnnnnnnnngcagcgcgtcccccggggctccacggtgctcagcaaagggccgagtcagggcgagcatggcgcaagtctgtgtgacaacatgccggccagcaacacttcccctttcccttgctctctgccaagctcactgcatgcttgcccagagggggctcccacaggcagccttgatgatcagcctgtaatcgtcctccgtcaaactcagcgacagggcttgaagcctggtgaagagactgagcgcctcgcgcgcctgagaacgagggtggtgatgtttggtttatgcgtgtgacacgtgcgccttgctgccgtaccccacagcgcatcaagcgctgcacacctacctgtcggtgggcagcaaacgcatgcaaggctggtgtgaagtttctgagctttggggggacaccctgggacaccagctcctcccccagcgccagggctcgcttcccatcgccagccatggcagccagccgtgccagcgccgtgaagctgaggacggatttcaagaagggggggtgcctttgaacataatgaccggagcaggttcatggctgcaacgccagggctaacgagccagagctgcgctgatgccggccccatgnnnnnnnnnnatggctgcaacgccagggctaaaaagccagagctgcgctgatgccggccccatgagttcagggtgtgcccgctcgcatgttcttcatgcagggccggtcacccatcctctccacacgcaccacatctccgagggcgtgccaaagagggcctccatctctgagaacagagactgcccgacctccagccgtgtctcacagctgggcacaccgtcgcaattttggggcccagtctcgccggcttcctgccctcgtgcacagagggcctcccactcctcgccccccgagcacatgaagaggagggagttgtacacatcggcagtgagcttgatgtcctgcttcttggcagactggtatgcctgccaggcatcggcccagctgttctgtcgtgtggcctgcaccagggcctgacgcatgagcgtcaggggcgtctcgatccgctgcttcttcctgcgcccccctgaggaggccgagtcgacggtctgcatgatgtgctgcgcgttcaggggaggcagagttgccctccaggcgaagtgctgggggatctcccgcctggaccgcccagggtggcctcctaccagtccctgaggcctcgcaccggtgcacctggggtcgagcaggggaagcaacccatccacattgtgagaaacgctacatatgagctgggccatgccctgaattcctgcatgatgagacccaacccgtaccgaaattggatcgaaccatgcaagttcgagacacacgccagnnnnnnnnnngcccatccacattgtgagaaacactacatatgagttgggccatgccctgaattccagcatgatgagacccagcccgtaccggaattggaccgaaccatgcaagttcgagacacacgccagcatccgttgtctgtgtgccctcgacagcgcattaacaaactgcatgcagcatcgagcgagcgatgaaaggggagaccatgcccgatggctgatatcaaggggcgtgctgtagcactgcacacctgcatgcatgtagcgactcccggggaggagcgcacgagcgagaacgagtgcnnnnnnnnnnnnnnnnnnnnnnnnnnnnnnnnnnnnnnnnnnnnnnnnnnnnnctcccgggtaaagcggtaccaccgccgactcgatgccggggatacacctccggtagggcacaggctcaaccctctttcagcgcagtgcgtgtgtggacaagaacctgcaaccatgggtgaggagggaagcgagctgtgggagggcggtgccaggcgtggggcagcgaccgtccgttctgccggacgcacgggatcgtttcacgagggtgttattgcggattctacatccatgaaattgcaatcgttgcttggctgcatggtgggcagtagcgacgctgcgtgggggaagggccgacccccgatggctgggggtgctcgaagccggacgaccatcccctctcaatgcttacaggtaagactcgtggtatgggagcggggcgcaagctccagctgctgcgtcgcaaccagcggtgggctgacaaggacttcaagaagtcccacctgggctccgagtggaagaagccctttgctggtgcctctcacgccaagggcatcgtgctggagaagatcggcattgaggccaagcagcccaactccgccatccggaagtgcgcccgtgtgcagctgatcaagaacggcaagaagatcgctgccttcgtgcccaacgatggctgcctgaacttcatcgaggagaacgtgagcggggcggggcacctgtcattctgccattgggccaggcgcctggatcgacgagcatggcgtgacgccaaacctcccaaccccatgccctcccgcaggacgaggtgctgatcgctgggttcggtcggcgaggccatgccgtcggagatattcccggcgtgcgcttcaaggtttgtggtgggaggaggaggggcgtgcggtgggtgtgccgcgcaggacctcttcgtgcctcgtcatttgcatgctggcggcgcagacggtgtgtcgccaccaggggcccaccgcgcgattgccagactgctcatcagctccctccatggccatccttgcaggtggtgaaggtggctggtgtgtccctgctggccctgttccgtggcaagaaggagaagccacgtaactaggctgtctgtaaacaagatctccctgcacacagccagaggtgtcgagatcaagaggggcctgttgctgtttaatgggagggagtatgccaaggtttgagaccacgctgatgggctggaaagtgacagtgggagcagtctgnnnnnnnnnncgaggcctgttgctgttgatgggagggagtacgccaaggtttgagaccaccctgacgggctggaaagtgacagtgggagcagtctggaaggagaagcactgaaactccagatttccgcgcaagggccggggcgtggcagggtgcggccggtggagccatcgaaatattgagccttcgctcatgggacaggcatccacgcatattctagaggaccagcagaggggccggtgtgctggctgacttgttcccaatgcagcatgagacgggggcgccagcgaggacagccagcagccatttagccattcctcctgccctgtgcttgccactgcatgccaagcatgggccctgtgcaggaagccgcctctcggcgagcaatcgagacccgcatttggacatgtcaacaccgcatcacgctcttgctcaacaggatggctggggcttgcaaagcgctggcgacagagccgcagggccgttgtgcagatgttacagggctgggagcagcaatcagaaggtttgggagagagtcagcggttcttgcgagcaacaatcgcctcgtagatgtcgacaccggcatcgaagatgaaggcccatgccatgagggagaagccaatggctgcacaggtttgacaggagagtggggtcaggaggagcaggcgtccacgcggtcagccagtgccccgcacgagaggcacacccgcagtgcacggcagccctgcggcgcagggcaaccctgcagggcagcgccccccatgtcggatgttgcgcacgatcccatgcagacattgcatgccctgtgagcggcagtgcccacgaggctggagggctcatcaccttctccccacctgccagaatggcgacggtgaacatgacggccccccacttgtactgcgcgagcccacgaacccatgcaccaaaggaccgcattgggaggccttcgaccggtgcagatgcggccccagtggtggccgcgccatcggctgcagacactcccgcacacggccccgcaccctcctggtagtagtagatgggatagcccagctttctgcggtgacgttgggagacgggtgagcagggcaaacgtgtgctgcaatgaggcgacattcagtgcagggtgccaagcctgctggtcgtgatgaggtctgcacgtcggggcagtgtccgtgcgctaaaggggtatggctgtgcccatcaacgtcacctggttcaaatctccacaacaggaaacaccccagccactcactcgcaacccgctaggtaggtgggcacggagatatagtggacgacgctgagggcgagctgctcggcaaagtactccgggacacaccagcaattccgggacggaagggtcgacttcgggccgtagtaggtggccaacgtctcgcagcaagatggaactgcagaggtccgagatttgagctgtgttggggccccttcttgaagtgcgctctctcacacacggcagccccgctcatcgggccccacaattgtaccagcgtcattcccctgccaggaaaggcatctcaccgggatccagataattggtcaacgtctcggagcatgtgtggtcggaagatgttatgttccacatcacatctctggagcaagccgtggtgtagtcctctggcaggggcacagcctctgctgcagaggccggcgcggcgaagcctgccaaggccagggcggcgaacaggagcaccctcatatggcaaggtgtatcacaaacaaccacgcaaacggtgttaggatattttggtttgctgcagtctgtgaaacgacgagcacgtttcctaacatcatccgggacatggcgcacgtcccgccgcgcgcgtgtgcggagcgtgccctccgcagccctagggttagggtggatctggccgagatctggaaactcccttnnnnnnnnnnccgagcacgttcctaacatcatccgggcatggcgcgggcgtggcgcgcgtgggagcgtgctcccagtccgcaaaagccctagggcgcgactggatctggccgagatctggaaactccctttcaagcgaggtgagcagcgcacgatcgccgactttccagtctagcttcatgacaagtactgacggtcagatcacacggtcgaannnnnnnnnngctttccagtctagcttcatggtaagtactgacggtcagatcacacggtcgcaggcggcggagaggactacgtcactcttaacactgtgctgggaatctgctcaagatctcactcgattgctcccacgtcccaaagctttgctatctccagtctcaattcccagaaacccgctaaatggtgttcatcctctgtccgattcatcatgtggggtgagcgacgtgacggccgattgnnnnnnnnnncgctttgctacctccaacctcaattcccagaaacccgctagatggtggtcattctctgtctgattcattatgtggggtgagcgacgtgacggccgattggctcatcgatggcggaggcgactcttccccgaaaaaacttcagctcgacaaagttgctgggcgagctccaacgccatcttgtgagggacggggcgtgaagagctcaacgagggtaagtatgctactgtatccccgataccgcgggcgcttttcctcatggtgccagaagaccatgtggcagcagcctctggcaagatgctggagggtccagcacatggcagcagtcagcggaggtacaaatacctttgggcggagtctgctgacttgcgtgttgtcgcagacgcactccatggatgatggcgccgtgcacccgccaagaaaggcaatctctccatcttgatggttggcaggtgcaatgagggagccatcggtgcaagcttggagcttgccgctgcttttgcagagcaggtgtttgggctggccctgtgaccagcaggcacggccgacgctcggctgctcagtgtgagctcggtggcctgcagcctgactggtggtcctgttcattccgtaagctgtgtgggcaccatgagctggagtgcagggtgtggagatctccggctgcagggtgcacagcaaatgaaannnnnnnnnnattcattccgtgagctgtgtgggcaccagagctggagtgtagggtgtggagaactccggctgcagggtgcacagcaaatgaaagcggccttccgcatttggcttcccggttgcccggcgatgccgcgacaattgctcagctgctggaggacgcgtctctcctctcggatgtcatggatccccaagactatttttgatctagtgagcatgggagggactcgtcaggcgctcacacttgtgagagtctggaagacatggtgcccgtccattgtaggatggggcgctcgacgttgtggctgatggtctgacccatccaagaccnnnnnnnnnnctggcatcccggttggctggcgatgccgcgacagttgctcagctgctggaggacgcgtctcccctctcagatgtcatggatccccaagactctctttgatctagtgagcatgggagggactcgtcaggcgctcacatttgtgagtctggaagacatggtgcctgtccattgtaggatggggcgctcgacggtgtggctgatggtctgacccatccaagacctcatgcatgtaaggcaccccgacacgcaaagcctcttgtttctgctcatacgaactcaaacaccaaaggcgaaggttctcctctgctcagttccatgcaggnnnnnnnnnnacccgacaaagactgcacgcgaagcctcttgtttctgctcacacgaactcaaacaccaaaggcaaaggttctcctctgctcagttccatgcaggctgccgcattgctgcactcactggagtggcgaggagtcgagggtaaattctgcatgcacgtccacacctcagtggctacagcaccttcaaaggtgtccagtcaagtcacagagacaggtgccagcgctggctcagttcttatcaagcccgccctctctacgctgaatgccaggcaattgtgacacagtgttgcggggctgacgatatgcctccgtaacagggacagatgtcgtactttctgagatagagttcttacaactgtccctgttacggaggcacatcgcctgccccgcaacaatttggtttcggaaaccaaaatgttgtgggggcgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacagaggcggtcggaaaacacaagcaaacccggtgtacttccccctgaccaatctctccttcagcccacaagctctcgaagtatattggcgaactcacacggtaaacctggaagttttgctagaagtcgtgcggcaaaatggcgtcgcggggccggactcccataacgagcgttgcgcttctcgtactaagccttggtgtgctctcacaggtaatcccggagggtgctggcgatgtgggagactcgtgctgcacggggtggttcacaggatcatcagcttatgtctagtgacgcccgccagccctccttcaatcctgaagggcgcgtgtacttccaagttcttctcactcccggcagccacgtgagcgtcgggctggcggtgttggttggttgatatcgcggactccccatgcgagcctgtgggcttctttctggatgcgcggttaccacacggcgaagtgactgcggcctccggactcttaccaccaaccgctcgaccctcagccgcccccctcccccccccctcctccccgacaggtatggaccacatgtctacatgctggagctcaatagcgctgatgccctctgcaagtgtgttctcggttcttgcatgtctgttgcttgaatgaatgtgctggacgatgttgggtatcctgtcactgcactaaccctatgcatcacctattccaggtcacaagggtacagcaaggcgggtgctgtcaggaagaccactcttcatgccttgggtctctcagtcagtgccatcaagttgcgtcctttcgaggtcatcaaggtccggtccactgacatcatagtcagcgtcgaatgtctgaaggtgggacagaaggcgtgcacggctgacaagaannnnnnnnnnatacgctgaatgccaggcaattgtgacacagctgagtaggttagccgggttttgagaagaatgttcctgccttccccatgcattggtgtggtgccctggcacccagcgctacacctccggcatttgtcttccgagccagccagcagagacgcagcgctcttgagcaggcctgcggtaggagggcggaacgtgcgctgcagcagcggccgtcgctgttgtggcgacatgtctggataggtgagattgaggtgaaggacagtaataattgacattgggggcgcaaggataggaagagatgcatggtgtcacccagcacgatggtcagcactgccattgaggagcactgtggcctgtatatatcagccagtgtgcctgctgcgcctctgcatcgaatcctttgattcgtggtatgcaatcggcattaggcttgcctgccgggcccctcttggggcccagtagctacttatcaccgcactctttgtgagcatcaaccccgatgcaagtttccactcctcatgcacttcacagacgtggcccggggacagttggagcgatctcttcatgacgggctggtgtaaccctcgcccgggggagtgcttgtctagacagtggcataaaaaatatgcatactggtgtctgatcccggcgctccacctgacaatgagatctggcagcgagtgcatgccactttgggggccagtagtacatatgtcgccgttgtgctggagctggccaccgcagtccggctccccttggagcttgctgagcgtgaatttgatgcatcggtgatcagcacgctccgtgctccgcgggcggcacaggccccgtaagccaaggacgctctggccagcgctctgctgcgtgctaggccgacactgggagcgtgcttgctgtcctggcttgatgagggtaagggatatgcgccccctaagtgcgtctcggagctggtggctacagcgagtgccacacaccagatcttgagctacgccatgcgctgcacacgctggtgcagatgctgccgggctgatcgctgaccatcaaggatgctcatgacgatggtgaggatggaaggagctctgagataatacacgggctggaggagaaagggcatattgcgatgctgacgccagggctctcatgctggataattgcaagtcggtatgcagagacccacggtccacatcctgtccagcaacatccacattctcctttccactttgcaatctacagggcccacagctggcaaagatgaggtctctatgccacagggcatcacgctgcgcctgccgtccgccttgacacgatttctggggacgataagcctgcgccgagtagggccacgggagttgcgcaaaggaggtctgctccttggctagagggctttggtgaggctgtagcaccaggcgagctgggccccctgtctgctaccctcagatgtctcttgaagctgtgagttggctgtcgagccttggtggtaccaattgacaccaggttggaggtgtgacaggttgatgggggcaccatggccagcttgcattgctgtgctcccgtagggctagcagtggaggtcccaccggtttgcttgctgccctctccccccccattgcagccgtagatgatggcgggattgctaaaggcctacaaccatgtgtcgatggcggccctcagccttctcagcgtggagcgaccaatgcgacagccgctggtggcgactgctaagaggcagcatggagcacgccagccgnnnnnnnnnnagggggggtaaacgggagaggggaagacaagggcggtggcccaccaaaagttgcagggcgaggcacaccagccagaaagagcttgagcaacatgagaacgtcgaacgccccattgacatcccggttgacaaccctgatgttgcacgcccagttgtcgcagcgcgctaagaggcagcatggagcacgccagccgccctgggtgacatggacacaccttgatcttgtactggagtgcatctgtagcaccaccgtggaggatgcaagtacagctgggcagcagcaaactgagtacaggagacctctgcaggtgaggtttgggatactggggtccatgctgttggcaacgttgatgccctcccggaactcgccaccacacaagcagggatgctgaagtccatggccaacccatgccagatcatcagggactgcgcactgtcccttctttgatgtgcacaacctcgtcgtgcctgagacttgggtattgcatgccgtacctatgagcttgaggactatacaaagccctggcgtcagcatcccatgacaagccttccacacctccatccttcaccagccaccatcttgtcttgttcctttggacac

SEQ ID NO: 43744 - DNA, 61 bp, Chlorella protothecoides
gacaaagggaggcgaggcagggagaggctaaagggcctgcaagcccacaaggtggccctga

SEQ ID NO: 43745 - DNA, 61 bp, Chlorella protothecoides
gtttcacgggggtgacggagcggcggcgggggtcacgtgggggcagccgccacctggcgcc

SEQ ID NO: 43746 - DNA, 99 bp, Chlorella protothecoides
cctctccacccgctggcgggatccctcccagaccccagccagccccgacccaccatggcgatcgccccggctccccctcttgctccaggaggggctcgg

SEQ ID NO: 43747 - DNA, 61 bp, Chlorella protothecoides
gtcgatgcccctggtggtggcggggcggggggtttttattagtttggggggggaggggagg

SEQ ID NO: 43748 - DNA, 61 bp, Chlorella protothecoides
catgggtgtttgagggagggcgggggggggggaggtgaagccggccccacgtcgacggggc

SEQ ID NO: 43749 - DNA, 77 bp, Chlorella protothecoides
cctgcgccgcgatagctcggtggccaggccttgccgcacgtcccgcacgttctccacctccatcagcacctccaggc

SEQ ID NO: 43750 - DNA, 61 bp, Chlorella protothecoides
tgggagagataaggtgggcagtttggcgggggtagggtgaaagcattgcttggagctgcag

SEQ ID NO: 43751 - DNA, 61 bp, Chlorella protothecoides
tgcagttctcggacgtggccaggctggcgggcttggccgagggcggcacggtctggtgggg

SEQ ID NO: 43752 - DNA, 61 bp, Chlorella protothecoides
cccgcattccacctgtctcagctgctccagagcgccgcggctggtgggccgcagggcatcc

SEQ ID NO: 43753 - DNA, 65 bp, Chlorella protothecoides
gacggggagggcgaggcgggagaggttgcggcgcagcaggtgtgtgtgtgtgtgggggggggggg

SEQ ID NO: 43754 - DNA, 117 bp, Chlorella protothecoides
cgccgccatgggcctggacccgctgccgccgcggggaggcgccgcgcccggcgcggcgcccgtggctgcccgcgacgccacctggatgctggaccccaggggcagcgtccagcaggt

SEQ ID NO: 43755 - DNA, 72 bp, Chlorella protothecoides
ctatgaggcatgtctgccccccccccccacccccccctcgttttgacctctgcatcccgctgctctcattca

SEQ ID NO: 43756 - DNA, 99 bp, Chlorella protothecoides
gggatgggtgggtgggaggggccgcatggtcaggggacacgcaggcagctgtggataaacgatctccatagcgtctctgacgcagccacttttcaggca

SEQ ID NO: 43757 - DNA, 124 bp, Chlorella protothecoides
gggcagccctcgagcgccgcgcgggtgccgttgcgcgcgtcgtcggcctggaagccgccgccctcgccggcgtagccgtgcgcggctgcctcgccgcgcggcgagaggcacaccaggggggcgt

SEQ ID NO: 43758 - DNA, 61 bp, Chlorella protothecoides
acgcctcccaccgccgacccacacccgtgggaacgccctgcactcccggcgacgccatcca

SEQ ID NO: 43759 - DNA, 61 bp, Chlorella protothecoides
acttgaagctgcatgacggaaagtggaagggctatgtggacgcagacgaactgggattacc

SEQ ID NO: 43760 - DNA, 66 bp, Chlorella protothecoides
ccccagcacgccggccacgccggcctgcccggttttcagcgccagctgcgtcagcgccaccgcctc

SEQ ID NO: 43761 - DNA, 194 bp, Chlorella protothecoides
ccgttatagttacggccgccgttcaccggggcttcagtcgcaagctttttcttaaaaaagaataacctacttctttaaccttccggcactgggcaggcgtcagcccccatatgttgtcttacgactttgcggagacctgtgtttttgataaacagtcgcctgggcctggtcactgcggccaaaagatgaaaaat

SEQ ID NO: 43762 - DNA, 628 bp, Chlorella protothecoides
  modified_base (94)..(103): a, c, t, g, unknown or other
gggggggcggggtagagcggtggggtggagggtgagtgtgaggagtgtgctgcacgagggggtggggattgtccccggaggcgcatcaacatcnnnnnnnnnngtgagcgtgagaagtgtgctgcaggagggggtgggggattgtccccggaggcgcatcaacatcctgttgagggagccagggcatcggtcggacaggtttctcaactgccctccctccccaagccctgacgcaagcgattggcttgcccgggtagacctaaaccccgcccccgaaggaccccagaccagcgttcaccgacctccaggggctggtgggcgaagcgcagggcaaagccgtccacatccagttcgacgtgcacggggaagggagcggggccggcatttggtgcagcggcttcctctccagaaccctggcggcgtcgggcgtgcccctctcgccccgccctccaggccccccgccctcgggtgccgcggagcgtcgcccgcgcccgcccgaggcgctcgagcggcacgctgagcacgctgcgcagggccgcggcgtgcagctccgcgtagcgcagcgacggccccggctcgacgtcgtgcggcaggtccagcgcgagcgaggtgacggcgagcgcgacgc

SEQ ID NO: 43763 - DNA, 976 bp, Chlorella protothecoides
  modified_base (147)..(156): a, c, t, g, unknown or other
  modified_base (259)..(268): a, c, t, g, unknown or other
  modified_base (611)..(620): a, c, t, g, unknown or other
  modified_base (739)..(863): a, c, t, g, unknown or other
gcggccgcggcgcagcacccctttggcgcgctgctcgcgcagtcgggccacttctccgaggccgagatcagggcgcaggtgggtgcagggggagtgaggggcggtgcagtggggtggggagaggctcgtgtggggggtgaagggggnnnnnnnnnnggggggcatgtggtggggggaagcagggcgccggacagatggcggcgagacgggtgcccgcctgacgcacgagccgtgcggcccgctcgatggcggggtagcnnnnnnnnnngtgggggggttgagggggtgggagtggggggcatgttgtgggggaaagcagggcgcaggacagatggcggcaagacgggtgcccgtctgacgcatgcgcctgcgccgtgcggcccgctcgatggcggggtagcagcaggcctccgctcccctcctctgcctggggctgcttgtccctgcgatcttgccatgccttccccggtgcaattcgcacatgtctcacaccctcccccgctttccccgcacgcgacccactccagctggagcagtttgagatgctgtccaaggccggcaccatgcccccgggggcggagcagcacgtggcgctgctgcaggcggcggcnnnnnnnnnnagcttttccctgcactcttgccatgccttccccggtgcaatgcgcacgtatctcacaccctcccccgctttccccgcacacgacccacccagctggagcagtttgagatgctgtccaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggggccactgtccctttgattccgggcgcgacggcggggccgggcccgaaggcggggccctgggcgcagggtcggggccagcccggcgcgacgctgcagggcatggtgctca

SEQ ID NO: 43764 - DNA, 61 bp, Chlorella protothecoides
ctcacgtcggtggaggatggggtgggggggggtatagtcttacatggggtcctgcagtgtt

SEQ ID NO: 43765 - DNA, 448 bp, Chlorella protothecoides
  modified_base (192)..(301): a, c, t, g, unknown or other
ggtcctggcgccgcccgagtgctggcagcaccacacggcgccctggccgcgtgcgcgcgcctcgccggagcccccgcccgagaacgtgggccgtctggcggcgctgacgcaccccacgctgggcgcgctgcgcggcgccgaggcggggcccgtgctctgggacgaagccggcaagcgcgtggcgctgggcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngactggtcctacgtgcggggcatccagcgcgcctgcgaagacctgcccgacccgggggtcgtggggggtcccacggagtggggcgcgccggcgggcgcccgggccgagaggatcgtgggcgacggcgccgagggggccgagggcgcg

SEQ ID NO: 43766 - DNA, 61 bp, Chlorella protothecoides
gcgttcgcatctcctactggccacgacggggcctcccgaaggggcgagaatggcccccgcc

SEQ ID NO: 43767 - DNA, 61 bp, Chlorella protothecoides
tggcctgacgccggtcatggctgcgccggggggaaacctttttgtttgtaccttcttcaca

SEQ ID NO: 43768 - DNA, 100 bp, Chlorella protothecoides
gtctggtattctgttgattaatacttatgcatttgacagccgtgcacaggaggacactggtccagggacggcggaggggatccgatgcgccccccccacc

SEQ ID NO: 43769 - DNA, 96 bp, Chlorella protothecoides
cccccgcggggcccccccccccccccccccttcccctacccattgctcctgccagatttcccatcccccccacaagaacgcccccctccccccttc

SEQ ID NO: 43770 - DNA, 477 bp, Chlorella protothecoides
  modified_base (190)..(370): a, c, t, g, unknown or other
cgccacccgcaagcgcggggagcgccgcggtgcgccgggcggtcgcgtccctgcccgccggcttcgccgcagcccccctgaccgccggggcggcggacccagacccggccgcctccctgcgcctgcccagtgccaacctcgtcccgccgaccgagccacggctgcgacccctgtgtcgcggggccatcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgcccgacggcttcctgcgcgccgcgcagacggacggggccgcctcgctctggtggtgggtgcgcgccgatgcgccggtctctgcgccggccgccgtgcgcgtgct

SEQ ID NO: 43771 - DNA, 61 bp, Chlorella protothecoides
tggtcctctggtgaggtgagattcgggggggggggggaccttcagcacggtgccgcagggc

SEQ ID NO: 43772 - DNA, 61 bp, Chlorella protothecoides
cctttcccagcactgctccccctcccttgctccccccactgcctattctcaccaacgcctc

SEQ ID NO: 43773 - DNA, 100 bp, Chlorella protothecoides
gcgcgtcaagcagctgggcacgcgcgaccccccggtgtggagccatgggtcgcgcgcctctggcggcttcgcgcacgtgctggaccccggccagcgctcg

SEQ ID NO: 43774 - DNA, 1337 bp, Chlorella protothecoides
  modified_base (499)..(508): a, c, t, g, unknown or other
  modified_base (820)..(829): a, c, t, g, unknown or other
gccgcggcgccgcggcgggggctggggcccgcggaggggctggccgccgcgcccgctgcggcccagtccacctcggagccgtcctcctggtcgtcttcccctgaaccagccccgccctcgggcagggcttctcggatgtacccagtcagggcctccacgctggggtagtcgaagaccagggtgccggggagggccaggccgaaccgggcctccagcccgttcttcagctccaccgcgcccagcgagtccaggcccgcggacatgagcgggtcggcggggcccacctcggcgccgacgatggaggccacggcctccgccaccgccgaggccacgcccgcgcgcgcgtccgcggcgtcggccgcggccgaggcgcccttgcgaccccgccgcccgccggccttgcccggtctggccgcggcttccgcgaactcggcaaacagggccggcaccgcggcgccgaagcgcccaatgaagcggggccaggcgaaggccaccgccnnnnnnnnnngtccgcgaactcggcaaacagggccggcaccacggcgccaaagcgcccgatgaagcggggccaggcgaaggccaccgccgccagggcggggggcgtggcgtgcatcagcacgctctgcaccacccccagcccgtcggcgggggccagcagcgacatgccggtgcgctccacgcgggcggcggtggacgcgtcgccggcggccatcccggccccggcccaggcgccccactgcacgctcgtcagctgggcgccctgttgtgaggggggaatggagggaggaacgcatgagggggggtggggaagcagtgaacnnnnnnnnnnggtcagctgggcgccctgttgtgaggggtgaatggcgggagggtcgcatgagggggggtggggaagcagtgaacggcttcgaggtgtggcagacctggcagacccctggtcagctggcggttgcagattgcgtgtacaagctgcctgtcgcagcgtctgccgaccatgcgatccattgccctcccgcacgatctcaaatcacccccgtcccttcccgacaggaaaccatacctgagcgtcgctgctagacgccagcgcgtccagcgccgcgttggccgcggcgtagttgatctggcctggggaccccagcagggccgccacggaggagaagaggacgtggaagacgcccggccccgccgctgcgcgcagcgcgcccagcgcgtcgaccttgggagcgaagacggcgcgcagcgagcgcgcgccctgcccgcgcagtgtggcgtcggccagcacgccgccggcgtgcagcaggcccgccaggcggcggccccggacggcgtgcgccacg

SEQ ID NO: 43775 - DNA, 69 bp, Chlorella protothecoides
gccgcacagatggacttggctacagtcctaaatgagaggattggggggggggggggggggggggggggg

SEQ ID NO: 43776 - DNA, 1454 bp, Chlorella protothecoides
  modified_base (119)..(128): a, c, t, g, unknown or other
  modified_base (830)..(839): a, c, t, g, unknown or other
gcgcgaggcccggccgccggcctctggatacgggccggcagggggtggcgacgtcgcggcggcgccgaccaggcccgtccagccgccactgccccagcgcaggcccgcgagattggcannnnnnnnnntacccgtgcacgaagtagcggcacgcctccggctggcgcgccgcgtccaacgccgccaccagggccgcctggcgcgaggcccggccgccggcctctggatatgggccggcagggggtggcgacgtcgtggcggcgccacccaggcccgtccagccgccgctgccccagcgcaggcccgcgagattggcagcgccggcggccaccgacgaggggtcgctggtctggcgcgggagcggggccgcccagggggagacggagcgctggcccagcgcgtccccagacccggcccgcggcgtgcaggcttcgctggaggcagggtcggtggcctcgtgcgaggggctggcggaggcagtggccagcgcaggccctggtgagggggccgtcgaggaggaggcaggggaggggcacgccgcctcggcccccagcgccgagggcctgggcaccgctcgccgtcgctccttttgcaaggccgcaaagtgctggcgggccgccttctcccgtgcctgcaggatctgatgaggttggacagaggggttggcatggcgagcgacggcaaccagttgtgcatgcatgcactcttggaaatgtgcacacggggagccgatcggggcctgtgctgcgccctggatgtcgacggcgcctgacaggcagtcccaggctcctgtcgagctgagctctcgccctctggcccttcatgcacgnnnnnnnnnngaccagttttgcatgcatacaatcttggagatgtgcacacgaggagccgatcggggcctgtgctgcgcctggatgtcgacggcgcccgaccggcagtcccaggctcctgtcgagccgagctctcgccctctggcccttcatgcacggaacccccaccaaaaccgaccttgcggtcggcctcggcctccatgcgtgccaggcgctcacgctccttcttctcggcgcgggaggcctcggcagacgccttgcgcagcgctcgctccgcttgcagcctgcagggaaatttgttttggggggagcggatggtccaagagtctctttgctgccaccctacgtcatcgccgtgcgccatcaaaggctcgctgcacctgcacacagaaaccctcgcgccacgatgaactttcaccatcccatcgacctccacaccacgccgtccgaggcccccgccgcggtccctctccccgacccacgccaacccaccgctccgcgcgctggcggtcggcggtctccttctcagtgcgggcggcctgcgcgcgctcgcgccggcaccgcgcctcctctgcccgcgcctcagccagccgcgccgcctcgcgctgggcgtcgagcaccgccccg

SEQ ID NO: 43777 - DNA, 61 bp, Chlorella protothecoides
agtgttggctgctctgtttctggaagcgacagtggttgtggtgtttaccagcagcgaagtg

SEQ ID NO: 43778 - DNA, 940 bp, Chlorella protothecoides
  modified_base (162)..(239): a, c, t, g, unknown or other
ggtgccgggggcggcggggcgccggcacgccgggtgcggggcccgtagcggcccccggagccccagccgacgccggccactcgcgcctcgtcgggcgccgccgcggggcgtatggggtacgcgccggggagcagctccccgtcgggctcggtggcctccagnnnnnnnnnnnnnnnnnnnnnnnnnnnnnnnnnnnnnnnnnnnnnnnnnnnnnnnnnnnnnnnnnnnnnnnnnnnnnnatgtatgccgccagggggttgcgggccagggcgccgaccaggatggggagctgctgggtgagcaggtgcgtggagatgctgcgctggtttgggtgtgtgagctcgatgtacagcgccctggggagcggaggggcgggacttgggtggggccgggcgtcggggcacggggagggtggggtggggagcgccggcatcgcgcgtgggccaggccacacgccaggggtacggagagcaggagcggggatggcaggctgggagtgcgtcgcttggatccgattctcccgactgggggggctggttacccccacccaggtgcacccgcggtgagcaaggtgcactgctcgcacccccctccaccacccagacgcaccgcagcctgggaaagttgagtcgccacctggaggccaggacggtgcccacgacaaacaggtcgtaggcagccgccgcttcacctagtggtgtggaccggaggggtgggctggaggtggtggcgactggcatgggtgcatgagagagcgccaggccccgatgccgggtgcagccgggtcctgtgcagcgacttgagctccctcagggtcggggcctcccaccccaagcacatgctgtccagcatgcgtctcatgcactccgccccctccagacccacgtccatgacacgccctgccacccaccccacccgccccgcccaccacccacccggc

SEQ ID NO: 43779 - DNA, 85 bp, Chlorella protothecoides
ggggggtgggcagggggcagggggcaggggcccaggtaccccgggggccccacgtgtccagggcatttgggcgccatgggcccgt

SEQ ID NO: 43780 - DNA, 61 bp, Chlorella protothecoides
agagcgagtggctgaccatcgtcttggcggggcagtgcatcctcctcctgttccggctcca

SEQ ID NO: 43781 - DNA, 75 bp, Chlorella protothecoides
ggcggagtcccccgcatgatcccccctccgccctgggccgaccaattgcccacgccgacgatggtagtcatgccc

SEQ ID NO: 43782 - DNA, 61 bp, Chlorella protothecoides
ggctggcgatactgtggcggagagacatggggcagggatgatcggaacgtgagagtgtcca

SEQ ID NO: 43783 - DNA, 551 bp, Chlorella protothecoides
  modified_base (88)..(333): a, c, t, g, unknown or other
  modified_base (394)..(403): a, c, t, g, unknown or other
gaggggcttggtggaaggaaggggctgggtagaggaggaaggctgggtggagggagtgtgctgggtggaaggaaggggctgggtggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgctgggtggaggtggggtgctggggggaggggaggggctgggtggaggaggaaggctgnnnnnnnnnnaggaggggctgggtggagaggaggggctgggtggaggaggaaggctgggactagtgggcgggggaggcgaaggcctcgagggtgagggttgggactttggggagggcgggggtcgggccttcttggatgggggcggtggagacttctt

SEQ ID NO: 43784 - DNA, 61 bp, Chlorella protothecoides
cggcgcggagtactgctcctttgacgccgccttcaccagccacgtggacgggacggtggcg

SEQ ID NO: 43785 - DNA, 61 bp, Chlorella protothecoides
gcaccgaggagaagctgcggcatggcggggggggaaaagggtggaggtgtgcataggctgg

SEQ ID NO: 43786 - DNA, 67 bp, Chlorella protothecoides
cagcgcgaccagcgccatcccgcgcagcgcctgctgatggatgctgaccggcgtggcgccgctcatc

SEQ ID NO: 43787 - DNA, 77 bp, Chlorella protothecoides
ggctgggactgccgggcctgacccgcccacgcgaccccatgtctctgcgcaccacgacggtgtccccgatggccagg

SEQ ID NO: 43788 - DNA, 4099 bp, Chlorella protothecoides
  modified_base (158)..(392): a, c, t, g, unknown or other
  modified_base (607)..(616): a, c, t, g, unknown or other
  modified_base (1588)..(1597): a, c, t, g, unknown or other
  modified_base (2052)..(2061): a, c, t, g, unknown or other
ggaggcgcggctggaggaggagcggggagtgggggccacgctgcgacaggtgcttgcttgtatttttttgtttgggcgggggtggggtgggggggtgagtgttgcaatatgactcatgagagctccaattgcggccctgcagtgccggacctctgcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgaggagctgtacgcggtgaggaggcttgggaggggggaagtagaggcagtggggggcgggagggcagcacatctggtgctgcagggcaccagactcctgtctggcgggggcctccaccgggcacgggcctcccccccccaacccatctctgcaagacacgacaccgccttgcatgcctgggaccagaaagggtgcctacgccaacaccaagacnnnnnnnnnntggggccgcgctgcgacaggtgcttgcttgtacttttttatttgggcggagtgggggtgggggggtgagtgttgcgatacgactcatgagggctcccattgcggccctgcagtgccggacctctgcaaccatgataacatcaccacatcttctctttaccccttcaaaacaggagctggaggtcgcggcccgggacgcgaggacggccagcgccgacgcggcggccgccgcggaggagctgggccggctgaggcgcgtggccggggaggacgcggcgctggcagggtcgcgtgccgggcgcctgcagcaggagaacgaggagctgtacgcggtgaggagctttggggagggggacgtagaaacagtggggggcgggaaggcagcacctctggtgctgcagggcaccagactcctgtctggcggggggctccaccgggcaggggcctcccacccccaacacatctctgcacgacatgacaccgccttgcatgcctgggatcagaaagggtgcctacgccaacaccaagacccgcgcggccacccaagggctagtcatggaggctcagcaacctgctctgcagatatctgtccgcaccctttggtacgcactgcctactcacctttcccccacaacaacccccaaaccgcagaccatgcaggtgctgcggcgagatggggacacgctgcgcgccgagctggcagcccagacggtgaccgtcgcaaagtacaagcgcatggtgggcgagatctcgcgcctcatcgactgggcgcagtgcggtctgggacggcgagcgggggagggtgccaagccgagtctcgccaggtgtggttggtgtggggggttggaggggctgacgagtgcgatgggtgctccacctcctattctttgtgcatgcaggggctgatccccaaaaaggatggtgttgagcaagcgggccaaagtgcaccccaaaaacaaaacaaaaaacctcnnnnnnnnnnggtcttgccaggtgtggttggtgtgggggggtggaggggctgacgagtgcgatgggcgctccacctcctattcttcgtgcatgcaggggctgatcccctaaaaggatggtgttgagcaagcggaccaaggtgcaccccaaaaacaaaacaaaaaacctcatccacgtcaagcaggatgtcggtggcttccgggtgcctcccgccaccacctcaccaagcgctcaaggacgccgccagccgagtgaatgctggggaggaggagctggggaagccgggcatgctggcccttgatcctgccgcggtgccatgccccatcccccgggagtgatcatgtgggcgcaccaaggagaatgcctgagaatgtctccttctcactttgacactctgtgcgggcgtccccgcgagaggaactccaatcctagtgcatggcccctgtccttttttccgggatgtcnnnnnnnnnngtgtctccttctcactttgaccctctatgcgggcgtccccgcgagaggaacttcaatcctagtgcatggcccctgtctttttttcaggatgtcaccccgcctgcaccatttacacgccatcgaatgtttgttgtacagatatttacacacacacacactctgttagggagagcggccagtgctaggcagggggggggatgtcttgggcaggatgcgccaggagaggacatgccgatcctctgccctcattagatacctattatgccatcacctcctcaccagggaccgggcgagcgccagctggcgacacagggatgcgcgccccctccagaccctgggagcggcggaaccccagcaggccgccggcggcctctgctgctgccgcgccgggcgcggcctcgccacccgatccgtcgggtgcggcgccaccgggcggcagacgatgcccggggtcaacgagtcgtcacccctggacatgctggggtgggcggcgagaaagtcctggcacggcttccaccaggcggggggtggggagcgaggcggccggcgagactcatcaaacctgcagtttggaggaaggggtcggatggggtgggtggggggagcatcgccgcgacgctccggctcaagtctggagaggccgcagcaaaaggtccccgagctcatgctcggctcagtggtctgaccccttgctcccgaccctcccccaacgtgcccctcaccagatctggacgtccctgccaaaccccgccaggggccgctcggcgctcgggtactgccgcacgtccacccccgccaccgccgcctcgacgtcatccactggaaaaggctggaaagggtgcgcctcctccatgtgcgcaacctgggcctgcgacagcgcggtcagcgcggccagcgcctcggcctcggcgaccttgcaggcgcggtatgcctcctcggcaagcagcacatgggccgccggcggctggccatcggcccgcgcggcggtgacgggctgcgtggcggccagcctcacccgtgccagctccttgttggctgttggtgggtgggcgcatggcgggggggggattgaaggtctaagggcacaacctgaggctcgggagatgggtgatgccaaatcccgccccgcccctcatacctctgggtgatgagtaccggattacgcatcccgcagtaacaacgctggattatgccaccaaatctctcccctgccccaccccaccagcccactaaccagccgcgatctcggcgccgatgcgctggcacgtcgggcacagcgcgtagacgtggcgcagggccgcgccctgcccgtcgtccatgaggtgctgcagcgcgctggccgcaaactgcctgccgctgagcggcagcgtggccagcgcgcacgctgccgggatcaggggctgcatggaggagctctgcggcgaggccggcggcggcgggcggggcagcgcgggggccaggtcctcgtccctcgagcgtttgctgggggcggcagggctctttggtggggggggagtccggggcgccacggcactcggcacgtccatcgctggggcccgattgtttctggatccgtgcgctttctcagccaactccgcgtcggcgccacctggctggcgtgccgcgccatcaggcctcgccgccgcctggtccctcttcagaccgttccttgccaatcgcccggcgccgagcgccggctgggcaccctccggcccgcacgactccccgccagccacaccccgctcggcgccctccccctcccccgctccctcctcgccgtcctccaccgccggctggtcgtgcgcgaggctggccaccaggcccaggagcgtgggcgccgccaggtcgtaggtgaagcggtagtcttgcacccggccgcgcgcgtacatgttgatcacccactccaggccggcgatgtagcgctccgcgtcgggcgcgcccaggaaggcgagcgtggggcgcgccgcgcgctccgccagcgggcgcgggatgggctccggggccgggcccagcgcccaggcgccctcgccgccggcgc

SEQ ID NO: 43789 - DNA, 79 bp, Chlorella protothecoides
gaagctggaccccgcccctcagccgctgccatcacccctccccccccccaaccctccaccacaacctagggtgctgcct

SEQ ID NO: 43790 - DNA, 72 bp, Chlorella protothecoides
ctccacgtcgctccccgaccccgccgctccaagatcccccccgcgggcctgacgctcggcctggccccgggc

SEQ ID NO: 43791 - DNA, 61 bp, Chlorella protothecoides
aacgcgggctttgcatctgtggactggctggtgaaaatgcaatctcgtgctgagttgcacg

SEQ ID NO: 43792 - DNA, 61 bp, Chlorella protothecoides
atgcccagtagctccttctcgtgcgcgggggaccggcactccgcggggcgcagcttcctgg

SEQ ID NO: 43793 - DNA, 61 bp, Chlorella protothecoides
cggtgggtgctttccgctgagttgggggggggtacttgtggcttatgcctgtccattatgg

SEQ ID NO: 43794 - DNA, 113 bp, Chlorella protothecoides
cttgcaccgcgtgtgggcgtgcagggcgccactgccttcgctttcgcctcactttcccgcaccgctcacacctcgttcccacggttacaatgccctccacccttctcctcctc

SEQ ID NO: 43795 - DNA, 61 bp, Chlorella protothecoides
gggaagccggccctggggctcagcgcctcaaatcccgccaacggcgagccgccccgcctgt

SEQ ID NO: 43796 - DNA, 61 bp, Chlorella protothecoides
aggtcagggtccgagtggatggcagacaggggacttaaattctcttaatcctggtggccat

SEQ ID NO: 43797 - DNA, 61 bp, Chlorella protothecoides
ggctgtgggggtggacccgctgaagacctccccctccacctcgacctgcacacgcatcgcg

SEQ ID NO: 43798 - DNA, 61 bp, Chlorella protothecoides
gtgaaagtgagcttgatatatgctcatgggcagaatgtgaccagactctctttgaggatcg

SEQ ID NO: 43799 - DNA, 123 bp, Chlorella protothecoides
ctacctgctcctccagctctgccacctgaacgggggggggtcgatgcgtcagaggaaggggttgggggccggagggcgaggcacgcgtgctccttgggcagcgaggcgagcgagtcccggcaa

SEQ ID NO: 43800 - DNA, 61 bp, Chlorella protothecoides
agacatctcctcctggagcggagggggggggaggcactggagacgcgacggcctcgccact

SEQ ID NO: 43801 - DNA, 61 bp, Chlorella protothecoides
tgctattaggagggaggcccggggggggggtgggccacgggccacaaccctccatgctctg

SEQ ID NO: 43802 - DNA, 7278 bp, Chlorella protothecoides
  modified_base (95)..(104): a, c, t, g, unknown or other
  modified_base (292)..(301): a, c, t, g, unknown or other
  modified_base (1187)..(1196): a, c, t, g, unknown or other
  modified_base (1259)..(1268): a, c, t, g, unknown or other
  modified_base (1413)..(1422): a, c, t, g, unknown or other
  modified_base (1728)..(1737): a, c, t, g, unknown or other
  modified_base (2211)..(2220): a, c, t, g, unknown or other
  modified_base (2304)..(2313): a, c, t, g, unknown or other
  modified_base (2804)..(2813): a, c, t, g, unknown or other
  modified_base (3079)..(3088): a, c, t, g, unknown or other
  modified_base (3369)..(3378): a, c, t, g, unknown or other
  modified_base (3876)..(3885): a, c, t, g, unknown or other
  modified_base (4319)..(4328): a, c, t, g, unknown or other
  modified_base (4435)..(4444): a, c, t, g, unknown or other
  modified_base (4667)..(4676): a, c, t, g, unknown or other
  modified_base (4916)..(4925): a, c, t, g, unknown or other
  modified_base (5183)..(5192): a, c, t, g, unknown or other
gtcggccgcgaggcccggccggccgctttcggcgccgggctggacgagccccgccgggcgcggcgacgggccgggccccgcaccgggcggccctnnnnnnnnnngcgtcggccgcgaggccggcccggcagttttcggcgccgggctgtacgagccccgccgggcgcggggacgggccgggccccgcaccgggcggccctgccagaggggacggctctttccccgccccatgcgccttgtggcccgcagccccgttgggcgccacctcggcgccctttgccccctccacgcnnnnnnnnnngcggctctttccccgccccctgcgcctcgtggcccgcagccccgttgggcaccacctcggcgccctttgccccctccacgccgcccgccgccccgcggcgcaggtagaagaggaggtaggcgcgctgggcgagcacgacgcgctcgctgaccgcgcccacgctggcgtcgtcgcagcagtgccagacgccgctgggcgccttgacgaagcagaaatagtgcccgctgtgcacgctgtgcccctggtgcaccagcacggcatagaggtcgtagggcaggggcccgcgcgcgccgccccgcccgccccccgcgccggcgccgccacccaggaagggtcccaggtccagcacggggccgaagtcgactcgcttggtcaccttgtgcccgtgcccgccgaagccaaagcgcttgagctggagggcgaggaccgcgggcggcgaggcaatgcgcaggctcttcaccgcccgcacgggccggccctcgcgcgggcagcggtaccggttggcgccgtccagcgcctcgcccgccgtgaagcgctccagcgcgccggtcacgctgcccgcgccggctacctccaggttcacgtccaggaaggggtcgcgcgtgcacgactcatagccgcaggaggtgcagcgcaccgcgctggccatgacgcccccaaagatgcgcgtgacgaaggaggccgggggggccgccgggggcggggcgccgggggcgcgccgcggcacgcaggcctcgtgcatcgcgtccagcagtgcgatgaggtactcatgcgcgtcctcctgccggcccagccggaagctgccgaagggggtgtgtgggggaggaggtgtgtgtgcgtggtgatctgaagggggagcagggggcggcggatgggggctgggccnnnnnnnnnngggcgggcattgcccgtcgccgccagagtgcgctcggcagccgaggcgcgcgtggtgtcagtnnnnnnnnnnggtgtgggggaggatgtgtgtgtgtggtgatctgaagagggagcagggggcagcggatgggggctgggccaaggggggcggggcaccgcccccatgcctccactgccaacccctggggggggggggggggggccccggggggggnnnnnnnnnntcgaggggtggcgttgcccgtcgctgccagagtgcactcggcagccgaggcgcgcgtggtgtcagtgtaactatgacaatgtaggaaggtcccgggcccagaccaccaatgactggggtgctgtgaggcctcgcctgaaggagttatcatcacccaccacgcgcgcccgcgttgccgccactcgtttgtgccagtgaggccccgggtggcgcatgctcacggacccacgcccctgggcacccatgcccgtcaggatcatgccccaccgacctgccgttcacccgccgcagcgacttggcgtgcgcnnnnnnnnnnggtgccagtgaggccccaggtggcgcatgctcccggacccgtgccctgggcacccattcccatcaggatcactccccaccgacctgcggttcacccgccgcagcgacttggcgtgcgcggccggggccagcacgccgctgcggtgctgcagcgacctctgcatcagctcgcgcgtagcggccagcaggtccggcccggcccggcccggcagcgggcgggggcaggccggcgagaggagcagctccgccagggggggggtgtggatcaggcactgcagcacactgttcatgaagcaggtgttgcccaggttctgcaggcccgccccctgcggacatggggttggacaggtgagggtgggcgcgcgcccctcgtgtcatgtgggggagcagggccgctggatccatgccccctccgcccaccctccgggcaccacctcgccggctcaccgctttgagcacggtggtccacctcgtnnnnnnnnnngctgcatcagctcgcgcgtggcggccagcaggtccggcccggccaggcccgggagcgggcgggggcaggccggcgagaggagcnnnnnnnnnntgtccaggccccctccgccccaccctccgggcaccacctcgccggcgcaccgctttgagcacggtggtccacctcgtcgccagctccgcggggccagcggccggcttcctggcctccagtcccttgaaaggtcgcatggaggagtcggcgtagccgttgaggtgaaactgtcggggtggagggtggagggcgtcgtcagctggcgggcatgcagacgggtgggaagccacgcccccggtcatcagtcaccgcgactctgtacctctgtgccggggttcagatgtatcaaattgggaacatctgcagcactgatggtgtgcgcatccttgcgcacggcggggacaaaggcaatccttcgcacttgcacccccccgccggtggtaagcatgcgggctccctgagactcaatgggtaaattcagagatgattatcatggcgtgggggggaatggacctcgcggtcgggatgccactcatgtgcctgcgtccgcnnnnnnnnnnaagactcaatgggtaaattcagagacgattatcatggcataggggggaatggacctcgcgctcgggatgccactcatgtgcctgcgtccgccgtaaagtagggtgcatgtccaggggggcacggctgaaaggaccctgagatggcaagggcccacacaagctgttccaagtccggcgaggggcaggctgctctcagcgtcaaaagggtactgcatagatttggaagattttgcaatacaccaggaaggtgggtgtgccatgcctgnnnnnnnnnntaaaagggtactatatagatttggaagattttgcactacaccaggaaggtgggtgtgccatgcctgatggggacgcccgagtctcagcaggtgtgtgctcagatgctcctctgctgggcaacatcaggtcacgacggctgaagctgatctctttgcccatggacaacatttcctctttggaaaacactcagtatcagcactatccagggatctgaaaatccactcctagatcaggttgggctgagtcaccccccctggcgcatgcgcagtgtgagaggcannnnnnnnnnttcctagatcaggtcgggctgagtcactccccctggcgcatgcgcagtgtgaaaggcaacctagagcggtatccgggcctcatggctggccaggctaccacgtgtcaatcacaagtaagcatggctgaggtgacggtgcccataggggatcagagtcctgagggtgcgagctgtcgcttcaagctatgcactgcgggcagattcacagaccagcgaggaggccagcctggcgtctgcagtggacaatgtcgtcccaagcaagcgttctacacaagttgagaaaggccaatgctctactggcatgcgtgggatgtcccaacctcacttgatggagggtgtgggcctggtgtccgtcttgtgctggatgggtggagaagggggcgctcctctcgggatgttgctcgtcgcgcaccaactgatgccttcccttagtctgtttgagggctcaggaacgagatccaatgagtatactgtgatggattggggcaactactctannnnnnnnnntggtcgtcccaagcaagcgttctacacgagctgaggaaggccaatgctctactggcatgcgtgggatgtcccaacctcacttgatggagggtgtgggcctggtgtctgtctcgtgctggatgggtggaaaagggggcgctcctttcgggatgttgctcgccgcgcaccaactgatgccttaccttggtctgtatgagggctcaggaacgagttccaatgagcatactgtgatggattggggcaactactctattcttcaacactccaggcccagagggttttagacctgatcttctagagggaggtggtaggctctgcccgagcacatgctgtgcatccctgaagttctctgctgttttgtcgtcgcccagtcatcgggcaaggaatattctcgagtgtgatcgcaatgaaggatctcaatgggtgcggcaggnnnnnnnnnngccagagggtttaagacctgatcttctcgagggagatggtgggccctgcccgagcacatgctgtgcctccctgaaattctctgctgttttgtcgtcgcccagtcatnnnnnnnnnnatgacatccatatcctgcagactccacctctgctaaggagtggggtgtgatgcgagtgatcttcagctcacacatgaaaacactctgtgtcacaacatgctgtcatcctcgcagtgcactgtccagcagacctcgtggacacgtgcggcaccggaggtctcgaatctcgcggtgagcgagagcacaggcctcggctccttgcttcgtcttggcaagatttgannnnnnnnnnagacacgtgcggaaccgcaggtctcgaatttcgcggtgagcgagagcacaggtcttggctccttgcttcgtcttggcaagatttgacctttcaattccacacagcgatctcagaaagctgcgaacgccagcatcctggtgcgacaggtgcacgtgcggcgactcgagcgtcatcatcgtccatcgatattccggacggattgccctccggggcgagtcggtccggaggacgacgcgaggnnnnnnnnnngaaccctgggtgaggaggccttttacaaaggaatttcacctaggtacgcatgcatatgtcagaacaagttcaacacccgttgtaaggaccttacgcgctaatgctaaccgggtcaatacacataaaacaaagatgttgcggaagtgcttccgcactacagatttacaccatgtactccactaatttcaagcaatagaaatgcgatgcgtacaggagagaagaggatccatgtatgacctggccaaaatgaccgagatnnnnnnnnnncaggtgcgggtaaggagccatcatacgaagcatattaatcactataaggaagaacatatcagccactgagtggagtgttgctgcgaaggggtaaatgcgagtaccttgttcaatgcatcgtaggacgaagatgctgcggcgttgtgcccgcatcacaaacttacatcatgcgcgataagaaaacacacaaatagattgcggtggattcagtaacggtcggttactattagggcacactgtcggtttctgtgtgcatccaccattgtcacttggggcacccggttgtccccggggagccgggccctcggcagctgcttggcctcaaagaggggaaacaggcgattctcctctgaaacaggctccgtatatagatcgtatttgtgaataacggtattttattcaaatcatcgagtcgttcaagatctgtagtgcacctacccatacaaagcactgcggagcctcaaagaggctactgggagtgcaaggtccagtctctcagtcatgaggcggaccaccccacgtctcctgctgtctattctttgcattcttgaagtcgtcagaacagtggtatgagcttatgccttaggatgactgacggcaatgtcttgaggaatttgcatttccgacgacaccgtccgacacgtacagtggcccctcaccgtgcaggccagctgcgacacgacattcttcggcctcccaagcgcaaggtgatatcttgtctcctgggtcgctctcaacgcatgcgctgcttgcttgcaaagctctctgctgccgccgctgcgagggggaagagttggctcctcgaatccggatgcggatgggtgtccgcgcggaacctgtgcaccagcctcctataagcattagtccacaccatactccgccccacaggtctggaagcgccctgttcttgctcacgcctggcagcagcaaccttttctgcaagtacgtgggcatgcgcctacttcctcatcagcaatcacgacgcatgttgcccatgttccccacccgttggcaccaagcacccgcaccaaatcattccacaggaaggaaggctttcacggggccggatcgattcgcaccgccaccatcgagttcacacggctgcatacccccgccgtgaacctggcgactctgggaacctgctccgccccctcgtgccaggcactggtggccgtggagtgcctgcgcaaggggcagaccgcctgcaaggcagacgggcaggggaacatcgggcccgggaacatcggctggcacaacttcggatccggaaacattggagataagaacatcggtgagtggatcgtgaacgtgctccgtaccatcacgggtcgtgtgcgagcctgcacaggctgacgcactccggctgcttacccaaggaggccccagtggggtctcaatgcatgaccctggacccagtgtgggagcacaagacacttgccagcacagtatgtcttctccctcggtctgccaatcgccaagcctggcctctcacgacgcaggcgtcaagaactttggcaacaggaacattggcagccagaaccaggggaaccacaacatctgcaatggtcttcagggcaacaccccgcaatgcaagctgtcggcactcaatactccaaacaccatcgtgttgagcaggccttccagcccgaaacccaagccctcgccgcccccaccacccaagcactcccctccaccaccaaagaagaagtctcccccaccccccaccatccccgtcctcgtcgtcgactctgcggtgtgcacggccctcaccaagtccacagcctcctgcacggtcaaggtcacctccgacaaggttcgatcccccttgacagtgaccctggcgttccaggacgggaccactcgcagggtctccatgcacccaaaatccaggacagccgtgggcacctggacggtgctcaccgcctctgccattggcacagcccaggcctcattcaccgatccgtccaccgggaagactacgacgtcgccggccaaggccatcaagcaggtggctcctccccctccctcgccaaagagggggtcccctccccctgcttccctcccgcacccccctccctctccccct

SEQ ID NO: 43803 - DNA, 61 bp, Chlorella protothecoides
tgaatgcaaaagggtgaccattgccgcagggttcggttctccatgcagagatagcaagata

SEQ ID NO: 43804 - DNA, 61 bp, Chlorella protothecoides
tcagggggcgaagacgctcggtgtggaggggggggaaggtttcacgggagctgactggaac

SEQ ID NO: 43805 - DNA, 61 bp, Chlorella protothecoides
gagtggcttgatatattatgaagcacaggggggcattccgaaagcttcgaaggagctcagc

SEQ ID NO: 43806 - DNA, 61 bp, Chlorella protothecoides
gaggcctcccggtaggaggggtgggggggggggatgttgggcagacgcctgtcatcctgat

SEQ ID NO: 43807 - DNA, 61 bp, Chlorella protothecoides
cccctccctcgcatgtgccgatgaccgaggagggaaggaggaggagggacagcgcgagcac

SEQ ID NO: 43808 - DNA, 61 bp, Chlorella protothecoides
tattgtacactggggcgcaggtgtggaagggccagcagtattgctggtcccactccatccc

SEQ ID NO: 43809 - DNA, 61 bp, Chlorella protothecoides
gggcgtgtggtatggcggtggaagcaggggtgggcatgtgcgacgaggcattgggcaccga

SEQ ID NO: 43810 - DNA, 75 bp, Chlorella protothecoides
cacttgatccgccgtgcgcacctgcgtgcctccatgtccctctgtggcacagtgcatgcccatggccgccaaggc

SEQ ID NO: 43811 - DNA, 464 bp, Chlorella protothecoides
  modified_base (252)..(314): a, c, t, g, unknown or other
gcacgcctgcgccgcgcgcttcccggccgtcgccggcgccgtgctggacgggctggcggacttcctgggcgacgccagcgcggcggcggcgctggacgtcgcgcacttcctgcgcgagctggcggagaccaacccggagctgcgccccgccgcgctggatcgcgcgatcgagggcttcccggccgtgcgcgcgccgcgcgtggccggcgcggtgctctggatcctggccgagtactgcgcgtcgcgcgaggnnnnnnnnnnnnnnnnnnnnnnnnnnnnnnnnnnnnnnnnnnnnnnnnnnnnnnnnnnnnnnncgtcgcgcgaggacatccaccgcgtcatccagctggtcaaggagtgcgtggggcggctgcccctggtgcccggcgagggggaggaggcggccgacggtggcggtgaggaggggcgggacgcccccgcctcccccgccgcggcctcggtgg

SEQ ID NO: 43812 - DNA, 71 bp, Chlorella protothecoides
acaagagcaaggcagcagctggcgcaggcgggccggctcgcacaccgccctctcaggcctgggactcaagg

SEQ ID NO: 43813 - DNA, 434 bp, Chlorella protothecoides
  modified_base (161)..(296): a, c, t, g, unknown or other
ggcgacggcggcgacggcggcgccgcggcacctggcgtcgcggcgtcgccctccggcgctgcatcccccccctcccaccccctggaccaagccgtgctggacgtgctgctggacaacgtgggcgtgcccttccccggcctgaccgcgctgctgtgcgggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccggagccaccgcgctggatgcggtgctggatctggtggccgacgcggggctggccgaggcgcggccggggacgtacgagaaggcgctggccctgctgcacgcgctggtgggcgggcgcggcgcggggcgcggcgccg

SEQ ID NO: 43814 - DNA, 61 bp, Chlorella protothecoides
cgcctccaccgcccccgccgcgcccagcaggtgcccgatggcacccttggacgagttgatg

SEQ ID NO: 43815 - DNA, 61 bp, Chlorella protothecoides
caagagcggccggcagattgacacgggaggggtagaatgatcggacttggaactgagccag

SEQ ID NO: 43816 - DNA, 10739 bp, Chlorella protothecoides
  modified_base (134)..(210): a, c, t, g, unknown or other
  modified_base (1163)..(1172): a, c, t, g, unknown or other
  modified_base (1343)..(1352): a, c, t, g, unknown or other
  modified_base (3842)..(3851): a, c, t, g, unknown or other
  modified_base (4357)..(4366): a, c, t, g, unknown or other
  modified_base (5084)..(5093): a, c, t, g, unknown or other
  modified_base (5276)..(5285): a, c, t, g, unknown or other
  modified_base (6220)..(6229): a, c, t, g, unknown or other
  modified_base (6664)..(6673): a, c, t, g, unknown or other
  modified_base (8189)..(8198): a, c, t, g, unknown or other
  modified_base (9487)..(9496): a, c, t, g, unknown or other
gtggcgcgccgggcgcccggcccccggcgaggggccggggtgccgcaggggcgtgcccggggacgaaggcccgcgcgggggcgccgtttggctggtggggaccggcctgcgtggggggggggggggggggggcnnnnnnnnnnnnnnnnnnnnnnnnnnnnnnnnnnnnnnnnnnnnnnnnnnnnnnnnnnnnnnnnnnnnnnnnnnnnnacccaggcgccgcggggctgcaggtgcagtacgccactcatcagtgtgctgtcatgacagcaacgcaccctctgctgctgtggggccggccgggctgcggggggctgaggccggtgcccaacaggcccattgtaccactctggaacctcctcatgctgcgagatgttgggagggggtggggtcgagcccaggcaagcgctgagatgccaacacacgggcgccagggagactgtgggagcaggtgggaaggatatcccgtgcaccacacattgctgtgcaggactcgccttgatggtctcgggctgcagcagcaccggccgctcaaagggtcgctggggtgggtgctggatgaagccggatcccacgatgttggggttctgcaggggtgaatggagctcgatatgctcgtcaatagacgtcgggtatgccagcaccatagcgcggggacattccccggcgggagggcatgctgaggtcgaccgaccgtcgcgcacactccatcactcacgctgatttgcagggtcagggcatctacccgctcctggttggtcctgtacgccatcctggcttagaaaattgcaaaaatgggaacgttcagatgtattgtccactgccatagcacggccggggtctcgctacttgctcagctttgagtcgcgggtggggggtactaccatgtgtactgcgcgctcttgttgaccggagagccagtgcaggagcagctggggagcctcatcacgatccgccagctcttaaatgagccaccatcgcgcaaccatgcctgtcgctggctgatgccagctgctggcgaagagttgttggcctttcaccccagagcctgcaccccggtcgtacatggtgggagcgaacctgcgcgacgtctgctccctgcgacatcttcagacaattaatatggagtgggcgcaagcatcgatactttgcagctgatttcnnnnnnnnnnctggaagggggtgccggggcaggccagctgcgcaccagccgcctgaattcgagcgggcatcgaaaacacagtccgatctcttcctcctcggatgcgtagatggtggagatgctgcgtgccaggtggtgcagaggtgctccttgatagaagtcagggtccacttggacctgnnnnnnnnnntatcttcagacgactaatatggagtggacgcaagcatcgatactttgcagctgatttcaggtcctaacgcggcgatgggagcatcgccaggcctgctcacctcgacccctttgaacctgtgctgggaaggtgagtctctggaagagggtgccggggcaggccagctgagcaccagccgcctaaatctgagcggccatcgaaaaaacagtccgatctcctcctcctcggatgcgtagatagtggagatgctgcgtgccaggtcgtgcagaggtgctctttgatagaagtcagggtccacttggacctgcaagagcagtgccgaccctcatcatacaagctggaggtcgcagggcagagcatcagactgtctgaccctgaaaccgatgcagtggtgatggaggtgcggcctggcgctgtgcccaccacgtgcaaggatggggtgctggtccagggcgtatgcctgtgctgtgttgaactgccgagagcaccaccgactctgggtcagaagctgttgctctgtgtcccgccaggcccagagctggggtgctctcgattccgtgaccaccaatgtggacgcatcggaggcccgcacgatgaccgtccagctggcaaaggcggcgagcaccgtggggtcctggccctgggccctccggtgggtggcggcgcgcaggcaccatgcattgcagccgctgtgggcggcgccctcgggcgggcacgaggggctggatcctgggcgcctgcgccgcttccagcccctgttggaggacctaggcctccggcagctccgcttcaaggtgagcctgggctggggtgtcatacgttatgtcggcctcccctcccttccacagtgaccgggtgcatcctgggaccttgagtcaccctcctgtactgcaatgctccgaccgtgcagtgtctgctcagcctgccaaccaccctggcagaggcagacgacgtcctcgctggcacgactcatctgccagctgtgcagcgtctccgggccgcctgtggaggtgctgccttcctccccgccgcccccgccgcggcgcgcctcctggtggcggggctggcctccatagaagcccagcgagcacagcatggcatggcggccctgaggagggtggacctggtggcgggcagcctctggccctgcctggtgtttgcgggcgctctggacctcgcgaccgcgctggcggccgccgcaggggcgccggcgctcccggccacggcgctgtggcgcagcgcccgcgtggccgtggtctgcggcccggaaccacggctggtgcggagcgcggagctcctacgggccgccgcggccctcgacgcgagcgcagggtccccgggcgcatcgtgcgactggccagccgaggaggtgctgaacgggcggtcctgtgggtgggcggcacactgatcccctggccctccctgcaaagctatgcagcgtcatgctgcaacccctcttgctcgcgctttctccttgaacccactggtttctggtgtacaaaagggcccgcgagcactgcgggatgcagtcaaaaatggggccgcacagaggcagcaaatcacgttcacagggggaggatcgacaccgtgactccaagaggccgcatggatctgggcaggcaccggcgaaaattgtcgttgaaggagcgctacacggacgcaacaccccgggggggggggtccatacaaatgtacggaattttactagaggacgcgccgggcccgtcgccgcctccagaggtggacggtcagggctgcgacgcaggccgccacgcccagggccgcgcccacctccttgcttccggcccgcccccacgcggtgaggaggctggcccttggtcccagaggggcctcggagacctccaggaatgcctttgcatactccacgagccacaggtcggggttgacgaggaaggcctccatggctgcccgggccgaaggatcccccagcaggaatctgtgtgcaggccgggggttgccgggtgggatgggaggggcttggatctgggtgaagcacgcccctctgggtcccaggctagtaaaggcggctgcaggaggaactttgccctctccgcaaaccccagaacgtgttttatggcttgtggttcagacctggctaagcagatgccatcaatcggtcgatgcacttgcagcacctgcaagacacatgctcaccccaccccccagggcagactgcttcactcacatactcagggggtccctgccctccaggatgtcccggtagatctccacatcaaaggtgggcgggggctgaggagcgacggatcgccgcgggctgcctcccgcgggggactctggggtcagggcctccagtgacgggtacagctgtggtgatgggggtgcgggtcatgcaagttgcgagggagggagggggcgatggagctgcggggagcccgcgaagggcccgatcgcccaagcgtccagcccgccagccgtccccgaggcccgccgcagcatgacgggcatcgnnnnnnnnnntgcgggtcatgcaagttgcgagggaaggaggggggatggagctgcggggagcccgagaaggggccgatcgcccgagcgtccagcccgccagccgtcaccgaggcccgccgcagcatgacgggcatcggggccgctccagggcacactctcagggtcacattccctcccatgcgtgccaggtgccctgccttcgcacctcttcccaaaccttgggagagctccagaagcgcccaaaggggtgagcgccacacagggccacaccctggcgcacactcagccccatccgccggaaggaggcgagcagcgcgccaggtccgaggctggagcctgaggcgtgggcagggaggcaggccgatggtgggtgggaaacgagcggcgcagccactgccacagcaggtgccctgctccaatcccgcagcactgtgcacagatgacagtctcccaaactcagcacccagggggattcctcagccgcatgggctgggtctcacatgtgtcataggtgnnnnnnnnnnttcctgcagcactgtacacggatggcagtctcccaaactcagcacccaggggattcctcggccggatgggctgggtctcacatgtgtcataggtgggcaggcgtgccgatggagggggcacgcggatatcccgacgaccgaggcggatggggatgtggggccctcccagcgcctccacggccacggcacctgccagctgaatggcatcggccatgctcagcccggggtgcagggccatgaggtcctcgaccacgatcaagccgggctgccggcccccgttcccggggcgtgcaagctccaggggcacggcgatggaggcattggctcccccaccccgggagctgtcgtcccacgtcagggcgtcgtgcagggccagccggagcagggtggggccatgctgggagaagatggatgggtcgtgggatgaggttctgaggtgaaagaattattggggcgatagggtgccgagctctgcgaaaggtggcgtggcacacacctggttcaccccagactccaggtccaggcgagccttggcgacatccaccaccgggctggggcccgctttcgacatcgcacaggcgtcaagatagagcctgatgttctaggatttcggctggtgcaatgatcacactgcgcacacgggcggagcggctgctaaatgtaggtggatcgcttccgaaaaaaacaagcgggagaggaggatcgtctactcgtcctnnnnnnnnnnaggctgctaaatgaaggtggatcgcttccgaaaaaactagcgggagaggaggatcgtctactcgtcctgcacaccatcgctgggccagccccggtgccggctgtcggcacggtctcgaagttgtgcaaaacatacttgattgtacaaacacgggacgcgccgagctaccagcgacgagagccnnnnnnnnnncctcgaagaagtgcaaaacatacttgattgtacaaacactggacgcgccgagctaccagcgacgagagccgaggagtgcgtttgcagggtgtgcaggcctcgcccaagcccatgcgggccatggatccggatgggacgcccctgcctgtctagtcgtcttggaaggtcaatagcaagaaccaggacgtaatgggaatgctgggacacgagcaccgcccccctccggccatctcgcccgggggggggccccagggtgatgcagcgccggaagtggacgaggagcagcgcaagaggacactgctgcagcaggagctgggcatcctggaccttaccaatccagaaatacgtgagtacggtttgaatgggtcccaggggctccctggggccgggcctcctatgaacggccccatgtcaggtggcatggggagcgctgcaggccggaggcctggaggcgtcgggtctgcccaccatttgctacctcccccagccgggcctgagcctcgagcctcttccctgacacccgcagccctggagcggcaggtggagctgctgaccaccagcatcaaggagcggcttgagggcgccgtcaacacccccatgagccccgtggtggtcggcgccctgtttccagccctgatgcaggtgctcggccggcaccccgccgacctatcgctgccgctggacgcccccgccagccgcctgcggactgcggccgttgacctgctgggccggctgtcaatcccggagctgcccaagagcttcgtggcggacctcctgtcggcctgccacgccgtgctcatgaccgaccacgaggcgaacggcatggtggtgcaggtgattgcgtcttgtgtggttgtgtggcagaagcggccggagggacataatgcatgggcatgccggccatgaggtcggccgtgcagcgctcggcttgcagnnnnnnnnnngtgggtggcaggagcggctggagggacatgatgcatgggcatgccggccaagaggtcggccgtgcagcgctcggcttgcagccctgggggcaaggaaggagagctttccactggcgtggtctgagacctgggcctctgcggtgccgccgtggtcccacgcacgtgctggttcactgctttgcgaccctcattcatgccgccatcgtcccgccctccctcccgtcccctgccatcgcacagaggatcatgtatgacgtgcacaagatctacaagctgtcgctggaggaccagagcatcccctttttcgagtggctgaagcaggtgactgcttgtcggtgtctgggggatggaggagcagggtcggcggtgcgtgcatggtgtgtagcgcgccacacccgtcagcagatgcgcatgcagtccctcggcgtgcgcagnnnnnnnnnntgagtggctgaagcaggtggctgcctgtcggtgtctgggggatgggggagcagggtcggcggtgtgtgtatggtatgtagcgcgccacacgcgtcagcggatgcgcatgcagtccctcggcgtgcgcagccccttcctcctccccgccgatcccacccatcctcggctcaacgcgcccccccccaaaccccgctgcagctgtacgagtccatgcccgccgcgtacgagcgcttcatcggctcgcggctggaggacctggggccagccggctcccccccacccctggtccccgcccgcgcctccttcaagctggcggcggaggtggcggtgttcgtggtgttcctgctccagtcctaccccaagcgcatgcaccagtacgctgcgccgctgatcccggtcattgtggcggcggcgggcatccgcggccccgaccccggcgccacgccccctgccctggcgggcgcggtgtacgacctgcgcatggcccagatcaagatgctggccttcctcacggtcatggcacggcccgccaacctgcaggcggccatgctggagcaccgcgacgcggtctgcgcggcgctggtgcgcgtaatgaccaccgtgcccgaggtggcgggcatccgcaaggagctgatgatcgcggtgcgcaacctgctggccaccaagctacgcccggggctgctggccagcatggacgtcctgctggacgagcgtgtgctcatgggaacaagccgggcctgcatcgagagcgtgcgcccgctggcctgctccacgctggccgagctggtggccagcgtcaaggcggagatgaccctgccccagctgaccaccatcgtggacatcttcgtgcgcaacaccaacgactgcaccgcgcccgcggcgctgcagtccacctcaatgcgcctgctctacaacctgatcgagaccatcttccagcgccgatcaggcaagagggctgaggggttgtgggtgggggtgtgggtggggggggtgcgcgtctggagggggtttggatgtgagcgagaaggggatgggggcgcagggaccgtgttagactgggtctatgccgcgcggcgcggggcagggaccctgtgggaggccgtgcaggggatgctgtgggcttctgggcgcggagctcactgacctcggcaccctcccgacaacagccaaagcgttcaaccccccctcaacgccacctcgccgtcacagagagcagcagcacctcggaggagtaccgcaacctgctcagccgcatcctggactgcttcgtgtgcaggctgcgtgtcctgaaggagcatgcgccgcgcttcgcagagtgagatgcagggtttgctgggttgcttgggtgtcctggaaagtgctgattccgtccatctgtgcatcagttgccctggaaaagtgggcgtgtaccaatctaatcggtccttaacacccacggtctccacaccctaaccttccgtctggtgctcgtgcgcagggaggctgcggccatggtggccgcacaggccgccaaggnnnnnnnnnnattgccctggaaaaatggccgtgtaccaacctaatcggtccttaacacccacggtctccacacccttaccttccaaccggtgctcgtgcgcagggaggctacggccatggtggccgcacaggccgccaaggcggcagaggcgtcggccagtgaggcaaaggcgaggaggatcgtgcaggccaagcgcaagcagcaggagaggcgtgcggcggcagcagaggccgccgctgcggcagctgctgcggaggtcacgccccctgcgatgggagacggcgacgaccagccgaccgcggcggcgccaggtggtggccccgcccctggtggagaggtggctgacaacgacggcgacgtgaagatggaggaggcgggggtaacccccgcactcggcagcaccgccgacccaggctcgactgcgcctcccgccgcacccgcaaccaccgccgcgccggcagcgacggctggtgccgatgcccgagagcccatggaggtggatgagggcgcggtgaaggaggaggaggccggggagcccgcctcggctgaggcgacgcaggcgtccgtgcaggcgcccgaggatgggagcgacgctgcgcctggcgaggcgaccggggacgcggccgacgacgccacgatcgacgccgagtttgacgccctgcgccaggtgggccggcgcgggtgttgtggatatgtatgcttgaggggtgaattgaaagctggtcccgagccctggctgtcctgctgcacaagcctgtcgcccttcaacgatgggcttgtgccatgacgatgacaggaaatcactgccaacagaggcctgactcccctccccccccccaccctgcccccactcaggatgcgtacaagccgcttatccccgccatggcgtccgtccctggcaaggacaaggagctgcaggagtacaagggcctgctgcagacggtgctgagctgcctgaagagcgtgctgtacacactggtggccttccacagcaaccgtgggctggccaccccgctctccttccctgtggagccctggagctctcggccaggcgacctggcggtggtctcccgcatcctggccgcgggcctgcccacgctggcgctataccgcgcctggccggcggccgcggcggccgacatgcgtgagcagttcgccgacctgttcaccgtgctgcaggacgggcgcgacttctgcgacgtgctcgcgccgcggctgcccgcgctgttcgacgccgtggcggcggacgcgtggtacctccccgtcgtgcgccacctggttgacggcgaccaggcggnnnnnnnnnntgacttctgcgatgtgctcgcgccgcggctgcccgcgctgtttgacgctgtggcggcggacgcgtggtacctccccgtcctgcgccacctggttgacggcgaccaggcggcgcgtgccggggtcaaccgccacatggtcgtggcgttgctgcgccaccttgtgggcgagcgcctgggcgcgctgggcgagcccggctccgcggaaggcgcgctggctgcgcagctgctggagacctgcttcgaggcgctgccgcgcatgcaggccgccgacgcggccaaggccgcgcaggtgccgcccgcgcccgcggcggggggcggcatcgaggacgcagtgctaccgcacgtcctggccttcacccagcacgtgtacgcgcgcctttctctggatgggcccgatgcagaggtgtgggagtgggatgtttgtctgtgtgtggtttcaagagagcaggttggagggggtgagtactgtgtgtgtctgtctgtggaatgggatactcttgttccgtctcaagggatcccgctgcgcggcctacacggcacaggcccggcctgcacagcctgactgcccccctgcccccaccccgaattactgacccgtgaccccaaccctccaaaacaataaaacatgaaggtgcacatgcggctgttgcgctcgctcttcttcgcgctggcgacgggcaagtttttgaaggtccaggccgcctttgggcacaccgggctgcacgtgcgcgtgatcgacctgaccctgggcatgatggcgggccccaccccctcccccgcggccggcgagctgtgcgcggagctgtgcctcctggcccccgcccgactggagcacctgatcccggtgatgccgcgcctggcggcggcgctggtcacggcgctgaagggctccgaccgcgccgccagcgtggcactgcgtgtgctggacgtgtgggtggactccttcaacccggagttcatcgagaagagcatggccgcacacatccgcccgctgatgcaggcgctgtggtccctgatccggccgccgcctgcgccctttggcgcgcgcgtggccgagatcctgggcaagatgggcgggcgatcgcggcgctggctgctggacccggcgcaggtggcgcacaaggccatccccgagtacggcttgcgcgtgatcctgtgcttccaggcccacacctccttcctggtgcccctggaccgctccatgcactacgcgctgggcgcgctggctgcgggcgagccgcac

SEQ ID NO: 43817 - DNA, 68 bp, Chlorella protothecoides
ctgcatgatgattatggatggtgggtttttctaaaaagagggggggggggaggaagacaggatgtagg

SEQ ID NO: 43818 - DNA, 69 bp, Chlorella protothecoides
gaagggggggagacttcgggttttgaagggggagggggggtgtgtgtgtggctggagggggggtggagc

SEQ ID NO: 43819 - DNA, 443 bp, Chlorella protothecoides
  modified_base (100)..(277): a, c, t, g, unknown or other
accccggcgcgccgcgcgccccaccccccaccccacgcgcacgtgctgcgcgcctcgacccccccccacgaaacacgcagggcttcgcgagcgggagccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncggggggctccctgaccgacggcggggtggcctggagcgcgccgcggcgcccgccggcggcattgacacacacacacacaccctttcccatctgcttcctgcccgtggctgggagctgcgggatgcaaggccgccactcccctcctcctgatcgcacccctggccg

SEQ ID NO: 43820 - DNA, 79 bp, Chlorella protothecoides
cgccatgatcttctccgccaccggcagcgcaaaggccagggtcttgccagaccccgtgcgtgcgcgcgcgatcagatcc

SEQ ID NO: 43821 - DNA, 61 bp, Chlorella protothecoides
cagcgcgcgcgcgccgtccctgagcgcgcctgggccgtcgcgagcggcgtgcgccagcgct

SEQ ID NO: 43822 - DNA, 80 bp, Chlorella protothecoides
acgtgctgaggggtcggagccatgcagtgccggggccacgagaggggggcgcgaggatggcagccgcgatcacttggaca

SEQ ID NO: 43823 - DNA, 99 bp, Chlorella protothecoides
ccgctcccgaccgtctgctggaatggtgggtggggtgagggggtgtctggagacggtgaggagagggaggttcagtgcctggtcctgagctgagacggc

SEQ ID NO: 43824 - DNA, 61 bp, Chlorella protothecoides
gctggctgcatggacaggtgcagacaggggggggcattgatcctggacccgagtcgcaact

SEQ ID NO: 43825 - DNA, 70 bp, Chlorella protothecoides
ccccgtcctcctcccagcaccccgtcctcccagcaccccgtcctcctcccacatcgccgcagatcatgaa

SEQ ID NO: 43826 - DNA, 61 bp, Chlorella protothecoides
ctggctgtagcggacgcactgatgtggagggatgcgccaggaagacgactggtgggaggac

SEQ ID NO: 43827 - DNA, 99 bp, Chlorella protothecoides
agcctcttctccgtgcacaaggtgggtgggtgggtggggtgaggaggggtttagtgaggaggtggtgggaggatgaggtgggaggggatggagccacgg

SEQ ID NO: 43828 - DNA, 61 bp, Chlorella protothecoides
gcgccgtctacctgctgggcgcggacgactacgaggagggcgacgtccccgccgacgcctt

SEQ ID NO: 43829 - DNA, 61 bp, Chlorella protothecoides
gttttaatacaaatataattgaaaccaatgcattaaatttagctgtagtattagctgttgt

SEQ ID NO: 43830 - DNA, 61 bp, Chlorella protothecoides
gaacggtcgaggcagggcacgagttcaaggccctcgagccggcaatacaaagcgttgcggg

SEQ ID NO: 43831 - DNA, 17103 bp, Chlorella protothecoides
  modified_base (284)..(324): a, c, t, g, unknown or other
  modified_base (743)..(752): a, c, t, g, unknown or other
  modified_base (2661)..(2670): a, c, t, g, unknown or other
  modified_base (2893)..(2902): a, c, t, g, unknown or other
  modified_base (3548)..(3557): a, c, t, g, unknown or other
  modified_base (5439)..(5448): a, c, t, g, unknown or other
  modified_base (6562)..(6571): a, c, t, g, unknown or other
  modified_base (8271)..(8280): a, c, t, g, unknown or other
  modified_base (9080)..(9089): a, c, t, g, unknown or other
  modified_base (9954)..(9963): a, c, t, g, unknown or other
  modified_base (10671)..(10680): a, c, t, g, unknown or other
  modified_base (11268)..(11453): a, c, t, g, unknown or other
  modified_base (11826)..(11835): a, c, t, g, unknown or other
  modified_base (12296)..(12305): a, c, t, g, unknown or other
  modified_base (13298)..(13307): a, c, t, g, unknown or other
  modified_base (14573)..(14582): a, c, t, g, unknown or other
  modified_base (15072)..(15081): a, c, t, g, unknown or other
  modified_base (15342)..(15351): a, c, t, g, unknown or other
ggggggggggcctgagctgagtggggtggtggcagggcggcaagggggtatcgtgttgagagccggaagacaggtggggccggggggtgcgcagggaggccggagggaggcgcggtcagcgcctcgacaaccgatggggcatctccgggggcatgctcacctgcgctcccgtcatccccgcgtcaccagcccaccctcgacccctagcaacctctgcgaaaatcccacgccaaacaggttcccacccctgataccccccccccccaaaaaaaaaaccccccccnnnnnnnnnnnnnnnnnnnnnnnnnnnnnnnnnnnnnnnnngcagggccgccatctgcgcggcgtcgtcgcggatgacggggtactgtccctccaggtagtcgtgctgggcctggatgtaggacagggccatgaagcgcggctcggtgatggcctcgtcggtctcgcggaacatcttcttgcggaagagcaggcgcggcgcggtgccctccttggccttggccgccttgaagtcgaacagaacgtcggcgatgtagcgcgtgtcgtccagggacacctgctcgtccccgccgcccaccgtgtcctgcggctgcccgcccttgctctgcagattgcgtgcgatgggagggggggagggggcattgagatgggcatggccgggcaacatcagatgcaggcatgggggtgccaccgcagagttggcacaggcccgtggctccatcccctcccacctcatcctnnnnnnnnnnacgaggggatggggggagggggcattgagatgggcgtggccgggcaacatcagatgcagggatgggggtgccaccgcagagttggcacaggtccgtggctccatcccctcccacctcatcctcccaccacctcctcaccaaccacctcctcaccaaccccctcctcacccccccacccaccttgtgcacggagaagaggctgaaggtctggtagtgctccagcttgatctgggaggcgatggcctccacggcctctgccacggtggtgctcatgtcgtaggccacctcctcaaaggtctcgtccaggaagtagaccacggtggcgccacgcacgcctttgagcagcgcatcgatctccgccatctccggcagcgtgcggcgctggccggccttggtggtgcgcttgagcgcggcccaggtgcgggccgccagcgcgcgcacgccctcgtcctcggcctcgtcgcggctggcggtgtgcacgtactccgacaccagccccgtgaagtcgcggccggggggcatggaggcggccaccaccagcagcagctgccaggcgcggagggtgggcgcgccgcccgggccgccgcgcgtctgcttgatgagctgcatgtagagctcgtcgcgcagctccgcgcgcttcagcccctggtgcagcagcttctggatcagctccagcccggccagggggggcagcgcgtcgccgtgcacaccctggtaggtcaggatggaggagaacatcttcaccgcacgccccgcgttgtcggagccatgcttgagcagggaggtgggtagcccctcctcgctgaacaccagcaggtcgtcggtggacagcgtcaggtgctcgggcgtgccgggcgacgccgccgcggcggcggggcgtgggctgcgcgcgaagcccagcagccggcccaggcccttgccggaggagccggagaggcgggcgcggttgaaggcgtccagctggaagcggtcggcgtggtccgccaggccgtccagagcggggctgcgcgggacggagccgggcgtctcgcccccgcccagcggggcgcgcccactgggcgtggacggctcctgcctggcgaagccggtgccctgcgggggaagggagtggggggggggttaggacgggtgagggcggggacgcacaggcatgggtgcggtgcagtcgacacaagcctccaagatggcagttcaaaggccccgttaaaccaccccgggcgctgccgcagccccggggcacacccggtacgtacgttctcataggcggcctcgggaatgacgacctccggcacagtcatgttgcccgggccctgcaaggggagggcggcgggagaaaaaggtgttggctcggcagctgggcgcatcccagatctggcaagcgcgggggtgcctcagcgaaactgggccccggcgcatgtcccaatttatgagaaacgaagcgtggagatggcgtgaccccgtgcttgccacagacgcgcggctgtccgcgaaggtgggaccccaagtggcccactgagctccgcgtacgggtaaggctcgctgcatctcaacagctgtccagatccagaccctcagcaatacaagcaccccagatcctcgctagacacaatggtgtaccttgctgccagaagacagaattgggctgggaggtgggctggcctgtgctgagacgagatgctcggcaaccacctgggatcccacgggggcaggctagcctgcggccgcgctttgctgagttgggtttccttatttgctgccaaacactccggtgagaacgaggggcgatatctatcttgctggtatgtctaagacggggcgcgaccatactggccatctacttcgtcgtctgctccgccgaagcggatctgagaatccttactttccttcctcactctgtttgacttgaccnnnnnnnnnnacgcgactatactggccatctacttcgtcgtctcctccgccgaagcggatctgagaatccttgctttccttcctcactctgtttgacttgacctctgtggagcttttcatctggcatgagtgcatttcttaccaatgagatacgagcgatctttcttcgatacatcaaaaagcatatccatgctgtaagcaccggtgctagctggctcagggcatcgaagttnnnnnnnnnnttggcatgagtgtatttctaactaatgagatacgagtgatctttcttcgatacatcaaaaaacatatccatgctgtaaacaacggtgctagctggctcagggcatcgaagttggcagtcagccagatcggagctgctccggacgggactgtcctcggcagccaccgaccgacttgcccgatgccatgccgcactcacacacgacgacaacctttgaacagccatctgagtcgcgaagatttctacgcagcggagatgggtgggccatacgccaggatgccgtgcgcactggccgccggtacatcccgagaggaggccatgtcatggacttctcccagtcagtcacaccgaggacgagcatggatcggggcatgcagggagggagtcggtctgggatgaaggaacactcgccgtcccagaaagaggtttcggatgaggagtgtgatgtgttagtccggcatcatgcgtcatccctgagcggcaggagccatactgtcaagatctccctggggctgccctctccaccgcggaaggaggatcgacaggtgggttcaggtgctgtagtgatcgtaatttttggatgaaagtttgcaatagcatgcatttgcccgcgattataccttatggcattgctggtgatggctccnnnnnnnnnngttttggatgaaaatttgcaatcgcatgcatgtgcccgcgatgataccttatggcattgctggtgatggctcctcagggccatgttcatgaaaggcaatgttcctgttcagcacacacagaggcatgagagacgaggcatgcagcgccttggctccccctcaccgtcagaggccggcagtaagcggtctggtaatcagcatcaagacagccatggtgtgccattgtccaggaacgcctcacccaaggcagtgtgcacacagcagacagaaggtggttttcacaaacaggtacagcgagaggtaatggtgcgtgtgtgactgatgtacatggttgcatctccgagaacagtgcgtaccgagtcttccaactccaatctgtatgccagcaacaggatgtccagttgcttcatctgtcgggtacccatctttccatctgcatcgcccacagcctgaccaccaggatgcagccagaaactctccgactcctcttgctgggcccccgacccccgagtctgagaccctcgtccaggaggtcagccagcggtgtggcagtgcaccatgctcacgacctccattgccgtccggcatgtcactctgatgatgaaacctgcactgagcacgaagcaccctgcactgctacagctggcgcaggaggtgcgtcagctgggctccgaacgccagcgggtgcaggagctcaggctgcgcctgtcccaggaggccgacctcatggagcgggagaaggtggcttgggcaacccgcaaggtgggtgcaagcgggtcctgaggggggacaccatggctgcgcgagtgcagccgatcatcccgagtcacgccgctggcagcgccctgcattccgctccagcagcgccggaccccgtgcccacaggcgagtgccgacgcggccgcccaggctgagctggcggagcagatgcggcggctggagcgagagcggcgtgtgctggagaagcagggccgggcgctgctgaagctgcccacccggcggcagaaggccgaggtggcagagatccaggtgtggaggaggagggggtgagcgaagcccagagcggtcgggctactgatgccatgcatctccgtctgacatcggcccagactctgtgagcaggctgccatgcaccacgtcccccaggaggttttggagagggagcgccaggaaaggagggcgcgggacgcgcgccatcgcctcgtggaggagcggctgaagcgccagctggccgaggcgcaggtgcgcggggatggggttgggccgaaacaggttgctgaggagggtgtacacgatgcccacatggtgcctaggggtcagttgccaatcgcctcgccctccaggatcggtgtgcccgcctggaggaaatgatgcgagaagtggggagcagggagcaaaagagcccgcggtgtgcccgctgcagtgcttcccagatggcagcaagccctgtgcctgatggagggaggctggcctgcaagggggtggcggcgctgccagcaaggtctgggcgtctggcagcagaaacgctgaactcaggagtggacccttcgccaagccgacggggtgtcaccttccgagggggcgggatggggaggggcggctcggagggcggccgcagcccaacagggcagcagggtggtgggaagggcccagcgattgatcccatctgcgagccggcgcacgctcctgcctggcgccaggacgaaggggtgaccgaccgctcccccagcggcagtgggcctgcccatgcatttggccgcgcagagattgcaagaggatgccaccatgactgcgctgcagattccactgctggagctgattgcagaccactgtctcaaacctcatatgggaaatggacgcaggcagcgacttcggaccctgnnnnnnnnnngttgcaagaggatgctaccatgactgcgccgcagattccactgctggagctgattgccgaccactgtctcaaacctcatatggggaatggacgcaggcagcgacttcggaccctgagcagggctgcactgtgactcgcttctccaacggtgacatccatcggcagctgccggatggtgggtcacacggtcttggagcacaagggctggcctcacatgcgtacttggggcatggtttgcaccacttctgcttgcatggtggtgccatgtggtgggttgtcaaagatacgggcttgactgtcttggaaccccccacacgccccaggcactgagcagtactggtacagcgaggtcgacacctggcaaatacagcacccaagcggagtggaggtggtccaccacgccgatgcgacggtgtgtgggaatgggtgtgtttgcatccaattcggtgacctgcctcttcgcctggcggtgggaacttgaggggttgactgtggatcaccgcgagtgtgcccaagcctcccctgcttcttccccttgtgcaggtggaggccagccaccctggtggtctggaggagaggttgaacaggtcgcgcggcgccagctggcggctgccggggtcggcagagtttgtgcccatttctcgggcccagctatcctgggagatactgcagcccaggccaaggacatgccactgaagcattgcaccttgctgttgaggctgaatgtcgtcccaatccctgtcagctccgtcacccttgctgcctgaacacccagtactgacccaggaaggcctgaggcagctatgcacacctggcatggtgtcaggaacccagtcgggcagtcagtcatgaggaactcggtgtcagtgccatcacactcacatcctcctcgccatcctcctccccagaagcctcggtgccagagatgtcggtaaccaggtcgtcatcatcagcctctgcctcctcgagaatgctcgagatttgcttggcaggctctgcggtccgggaattatgtagggagtggcatgatcaaggcagcagcgtttgggcgcaaagcctgttcaccttcatcgtggcacctcgggatctggagctgaaggactgagcagcaaannnnnnnnnnaaaattatgtagggagtggcatgatcaaagcagcagcttttgggcgcaaagcatattcaccttcgtcgtggcacctcaggatctggagctgaaggactgagcagcaaaagaaccaatgcctctgacttgacctggcactgatgaagactccctcatcccagcacccgggaagcatgtcaagcctccctcaccacacctggcttgggggcctcgggaaagatgagatccgtcttgccactcacccaatccgctagaaattcgttctgcacgaagaacctgaaggcttgcaacacgtagctgtgatcctgcctacgcgttcacatggtgggcaaaggaaacataactgaaagggtcggcattctgcgaggcataagagccccttccttatcaccattcatgagcagctgaacaaacatggaaatcctaacagcacattcaccagcacggatgttccaagggtcaccaccatcccaccccctcccaacctgatctccttggcaaacagcttgtggagcaggcttggcttgcccagtcgtggcgccggcggctggcgcgagggaacacccccccgaccagtccttccacctcgcccgcccctcccgccgggcagagccgtgcctcgacgaccccctcccatccctcgtcgccgctggaagtcctcctgctgccgctggtattgctcccgctcccgccggtaccgctcctcaaccgcgctcgggcctgacccagccgcctcgccgcggcccctctcctccggctgcccactcgccagcgagtcgctgtcgtaccctacgagcccggcgagcccctgtgcagcctcaactttagatccaggctccgtagggggggcgctgggtccctcccgctcctcccgcgcctgcccagggtggggccgcctggacgttggacccctgcccctgcccctggccctgcctcggtctcccggcgccctgccatggcccccgagctcggccatcagatcctgggtccctgccagcttgtcgacccccagctcgcgctgcttgagcaggatctcctgcaaacgggcagccctttcctgcctgtgcgctcagtggtgtagaggaggggaaatcatttggatgaaattccatgccattcctgagcacatgcctgcgtgggtcacatcgaccagtgcggcgctgcacaggccatgcttccttgtagccagagccaggccagctcccgccagccccgaccatggcccccgccgccgcctcaccgctgcagctcttgctccccgcgctcggcacgcgccttcccctccgcctcccgcttggccaggttctcgcgggtggggaagtgttttctccgctccgctttccacctgccgggcagggaggatcggaaaaacatgagtgctggtcgaagagtcagcagagatcccgaaccatctctttaaaaagggaaacccgcatcgcttcagcctccacagcatctccccctgatggggtctttcaaccctgctcactgttcaatctcctccttctctgctgctgttctgggctcacgcaccgcaggctcctccgtcatgggctccaagggcagcacctgtgggggcgggcatgctcacactgttcagcacctgcttcctccctgagtgaggagcaccaggggccatgctccctgccacatgcaaagtgcacaaaagcacgggcgccttcggagcagacacccagcgnnnnnnnnnngggagcaccagcggccatgctccctgccagatgcacagtgcacaaaaacacgggcgccttcggagcagacacccagcgctctgagaagccactcactcccggcgccccaccttgtccttgctcttcttctgtcgcttgtgcggcggggccgataccaggtggtgctgcggccttggcccaggcgtgagcatcgacgggggtggaggcggcggctggaggggccgcatcccccagggcgcactcattgccatcatgggagcctgcggcatcatgtatgcccccgggggcggacctgccatgaaggcacgctgctgctgcatgtgctgctgcgccagctgtgcctgctgtgcctgctgctggtggacaaacagtgctgcctgggcatgggtgggctgcatgggtcggaactgcatcccggccggcatgcagctcatgactccgggggagaaaccatatccccatggctgctgctgctgctgctgctgctgctgggcgggctcgcgcgggggcggtcggtgcggtgccatgctcagcgacgtgctatgggccctgggatcttcaggtagctcctcgcgatagcagaagaggccagagattatctaaaagaattgtgaatatggtagtcgcgaagtggccaagctcccactgtaagccgatagcacagtgaagtgggaagggtggttgctgggaaaaggtggcagatgttgtgcaaacgctggtcggttatgtgcgcatgattggttagcttaaagctaagctctgcatgcacattttcaccgggaatcgtcgacactgactgnnnnnnnnnnttggttgattaacttaaagctaagctctgcatgcaaattttcaccgggaatcgtcgacactgactgtgtctgaagtgctcgccgggatgcacgcgcgcgatgaatgcggggttgactaggatgattttcttgcgattccccgtaagaccttgacggaacaagtgatccaagacaatctccatggaaactcaagttcatgacagtatgcttagctcatcagtgatgctgccagtaaggatcttccgagataccttactgcctctgtgacgagacgaggcccatcaatcgtagacgtcggtctcccgtagcaatggagatcagcgaggcacgacagctgatccgtgatctaggagccatagatgtgacgcaggtgacagaactggttcttgattcgcgaaggaggtccgatcatgcattcattcatgcgtcgccgagagcgtcgagccaatcgtagcgccgccaatgcgatcctagcccatcatgcagatcggttcaccatcctggactcgacaacacgatgctcttcaacgcctcactaccatggcccagctccaggctaggtgccaggaggatgagtgggtggtggacctcctccacgtctcagggaagatggatgtgctgatcaccgacctcctaagccatgaggtatgatcgcgaggagctgtgagaactggcgaggggcattctgtcatactgacagatgacgagggcgcaacttctgaaatgtattggcatcaacttgaactcaaccgctgcatgggtcttccatcggctcgcacccgctgcctctgcatcaaactcctcccgcccatgcctcaacaggcatggtgcactcatgtcctgccttctctgctcgaggaggctnnnnnnnnnncatttgcatcagcttgaactcaaccgctgcatcggtcttccatcggctcgcacccacagcctctgcatcaaactcctctcgcccaagcctcaacaggcatggtgcacgcatgtcctgccttctctgctcgaggaggctcaggcaagcgagtgcaacactgtaaatatcgccctttacagcctgcagtcccactctggagtactggcagccctgctggaggtcgcattcttccacgaggtgggacgggcgagggtttgatccagggagcagccagcaactggcccgcgtcctccctgacacatgctctgccgtgctctggctcagaaagtcttggaggactccgacgaggatctactcctggaactgggcggctggtgtgtgcgcagactggtggacgcccagggtcttggtgaaggcaagggcggcgaggatcaggctacagacggaccgaccaaggagactgccgctggtctggacttggcagggttgcagctggccacctatgccatcaccatcgtcaggtggaggattgtgcagggctgcgtagggttggaagcaagcccaggacagtctaatggggtcaaaagcaactgtgatcattcccaatccggtgcacaatgccccgcaccacgtcgattgcagaccgtcgtggtagggtttgcatccccactctctcacatgtctcatcaaagggcgccccggtgccannnnnnnnnntgtcaggtggaggattgtgcagggctgggaagggttggaagcaagcccaggacagtctagtgggggcaagagcaactgtgatcattccccattcggtacacaatgccccgcaccacgttgattgcagaccgtcgcggtagggtttgcatccccactctctcccatgtctcatcaaagggcgccccggtgccagaccgctcgacaccccaacccccttcacacaaccgcccccaggtacctggttgaccatgggcgtcagagtgcgcccagcctgctcacgcacctgatggacaccctggacctcctgcacctggcctgccgcctgctgctggcaccgccatggcgcgacgcgccctccggccgcgctttccaggacggcgcatggcgcccggtcccgccacccaaccgccgcgcgctgctgccccaggaggtccaggcctggctgaccgtccacggcgcggtacgggacgagggcgtgcgggcgcggctggacgcgaccccggcgcgccgcgccgcgctgtgcgcgctgggcccgccgctgggcaacggcgtgctgacccagatgccggtcctccgcccgctccacgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctgagccgagcgagcgtggcggcaacattgaggggcgccgaatggggggcggcgcgccgcgccgcgcgtgcccatgtgctgtgtccggcggccggcgaggcgctgaggcagcgtctgcccaccctggcggcggcgctggaggcggcgtgcgaggcgcaggaggctacaggggtccaggtgggtgttgtcacgggattggcgtggggtgcttggggtgcacagatgacagagtaacagatgtgctgtgcaggtgccgggctgcgcccccaaacaccccaaccagagcgcctccagagcactacctcgtgacgtacccctgccgcagggaaaaacctgtccgccgggcaagctgagtgtcaggctggaggtgtnnnnnnnnnntgattggcgcggggtgcttggggtgcacaggtgacagagtaatagatgtgctatgcaggtgccgggctgcgcccccaaacattccaaccagagcgcctccagagcactacctcgtggcgtacccctaccgcagggaaacacctgtccggcgggcaagctgagtgtcaggctggaggtgtaccgcctggccaaagagagcgcatgggggtggtgggccacgtatgattacgtggccaatgacgaaccctgccaggaggtccagcccagcgaggggcagcgtgggcggcggcaggtcatggtgctgcaggcgggagctggtggaggggagccgcgtgcgctgcccgccaggggaaaaattgtggtgatgacggagggcaggctgccgatggaagcgggattcatgctcccggcctctgagagcaagtgcgtctgtggatgggtggggggccagcgaggccgcnnnnnnnnnncgctcccggcctctgagagcaagtgcgtttgtggatgggtggggggccagcgaggccgccgcgcactgacgctgcttgctctcttctggaattcaagcccctcccggggccgccctgcaggaacaccgctgccctggagccagtgctctggttgactgtgggtcggctggccgaggggggggccgtcttacagctgcagctctcccgccttgaccaacctagggagagggacctcgtgacaggcacttggtatccttacatcccggggaaggcggcgtggacgttggagaaagggcaggactccacttccacctgatcacctgccgccatgacactccaaaagctgctgggaagcatgctccgcatgatcaccacctcgacactcacatcgccggactggatcctgcgcatcgtcacaccattccatcgcttgtgtacatctcattgcgtcctgtcaagagaatcagctgacgctccaccctttgagtcgcggccgaacgcgcaccgaaggaactgatccgacgcaggcgagcccaataccctgcgcctggagggatctatggcgcacgccatccctctcaaagctagcattcctgctgcaggggcggcagtgaaagagcatgcgtcttggtccccgtgagtcctggagcgcggtgatccacacagggttgtatccccatcatcccccccgcgtctcatcccaccaattccttcctgtgcccgttagatatgacgacaacggtggcacggtggtggcggtcgcaggcaacgactactgcatcgtgggaggcagcaagcgtctgtccaccggctactccatcctcacccgcgaccagtcaaagatcctcagactgtgcgtgtagcagggcagcccgccttggccatccttgagtcctgtggacagtgatgcactggcattccaagtggttgcagggatctaaccctcccccaaacccccctctgacaggtccccaaaggtggtcatcgcctcgnnnnnnnnnncctgtgcgtgcagcagggcagcccgccttggccatccctgagtcctgtgcacagtggtgcactggcattccaagtggttgcagggatcaaacccctcccccaaccccccctccgacaggtccccaaaggtggtcatcgcctcggcaggcatgcaggcggaccgcgatgcgctgcacaagacgctgcactcccggcacgtcatgtatgccttcaaccaccgcaagcccatgagctgccctgccatggcgcagctgctgtccaacaccctctactacaagcgcttcttcccgtattacaccttcaacatctgcgcgggcctggatgaggagggtgcgccgggagggctcagggaaagctgagtctctgtgaagatgctattggaacgatgggctatcactgctcgcttgcggaggggctgtcatttgcaaccggccggctcaatgacagcagtctggtttgcatgccgctgctgcccatcccctccgattcgcgtggagctctcatcctccacccatgcagggaggggcgcggtgtacacctacgatgccatcggctcctacgagcgtgtgggctacgggtgccagggatcagggaaggagctgatgcagccggtgctggacagccagttgaaggcggcgtcgcccctgctcttgccaccacaggtgctgggcgggtgggttctgggaactttgcaggggatagtcgtgatgcttggcgagcttgctagatcaggggaaacatgccgtcgtgcgttgtgtgctctggaggggctgtttttgaggaactaagctgcctccatggcacacttggtgccttgctgtttctgttattgattgaaggggccgctgtgagctgatccatcccccccaaaccctgcagccatggttgagctcgctccctctggaggtcgccatcgacctggttaagtccgccttcacatctgctggcgagcgtgacatctacacggtgcgaatggctgggaatggggatgggatgcattatcacgtcagacctgcccgcctggagttcacagcacctgcccggtttgcttgccattacagggcgacgacgtggagatcctcatcatgaccaaggacggcgtggaggtgcagaccctggaactgaaacgcgactgattcatgcactggtgcaaccgcagccactagtgggtgaaaagagggaatgccctgggattggttgcggcagaggagcacagacatggtaattgaccaggaagcagaggcatggctgcgacatcttgagctnnnnnnnnnnagcagccactattgggagaaaagaggggatgccctggggttggttgcggcagagtagcacagacatggtaattggccagggagcagaggcatggctgcgacatcttgagctccacaatgagctacgaaagccttaattcctgccagcatggcgtgaggaactcctcagcgtgctcgatccctgcacctcccgctcctgctgtctcgcctcagtggtggcccgccttgctggaccccgtgagcttgtcgaaggcgacgtacaccgcgaatgccgcgatgccgatgcccaatccgggcatcatcaccctctggttgccggtgagcaaggggtgctggcgccacttctctgctgcgcgccagttgtacgccatggctcctcgactctcttcgcccgttcccccaaattggatgtcgacagactactcgttacgtatttctaggcgatggtgaaaatggttagcaggccggagggtttcccaaaccaccctgcnnnnnnnnnngtctaggcgatgttgaagatggttaccaggccggagggtttcccaaaccaccctgcgggcccgtgaactctagaaaggggggggcgtctcccaaatcacgcgcatgaagggagaccaaaacagcaccctgcttgatcaaacagccgtcaatggctccaaataaaaaacaactctggacatcatcattctgagattgaaagcgatgaagctgcaaggccatgcgagtgtagctgctgtagtctggcccctctccaccaggcnnnnnnnnnncgagaccaaaacagcaccctgcttgaccagacagccgtcaatggctccaaatcaaaaacaactctcgacatcatcattctgagattgaacgcgatgaagctccaaggccatgcgagtgtatctgctgtagtctggcccctctccaccaggcccagagccgcagtggcgcagggctctcgatcactgagagggtgcgagcatgcagaggcagcatcctgggagatctgaagcctgaagaatccttttgaagtcccattccccgtcatgcccgcaggccatgggcccctcgagggccggaggaatgtggacggcacatgaggaggaccaggcgcgtgacggttgcgacgacagcagacatcccacaggtcgtggagaggccacccccagccctggactctccagtggaagggtctagagcttcctccttcgactggaaggaccactggtaccccatcgccttcaccaagtgagccacttgttgacttgcgcgggtgcctgggaacatggctgttggtagctgtagcgatctgccttcgggacaccctggtgcagcatcatgtcgagcatcatggctgggaggagggtgctggtgggttctctggtaggcagcttgcatggccaccacagaaccgctcgcctcccaccccggaggcccctacgccctgcccgcgcgtgaacccctcccagggacattggcagcgcgccctaccccttcacgctgctggaggagcccatcgtgctgtggcgcgacggggcgggcgagtaccagtgcctggcggactcctgcccccaccgcctggtcccgctgagcgaggggcgtgtggcccccgacggcacgctgcagtgcgcctaccacggctggcagttccgcggcgacggcgcctgcaccctgatcccgcagggtggcgaccccgcctcgccccgcgcctgcgcccgctcctacgcctgccgcgccgcccagggcctggtctgggtcatgctgcgccccgcgggcgacgcgcgcgcggccgccgcgctgccgcccacgctgccggagctggacgagggcggctggctggcctttggcgacatgtggcgcgacctgccctacgacgcggtcaccctgatcgagaatgtgatcgacgcggggcatgtgcccttcacccaccacgccaccgtctccaagcgcaccagcagcggcagcttcgccgacctggcggtcaccgagcgcagcgaggccggcttccgcggcctgtggcccagtgggccgcgccggggcgcgctggggccgcaggccaccgagtggcgggggcccaacctcatgcgccacaccatcgaggcgcaggagacgcgcggcttctccaacatcaccgccgtctacgccgtgcccatcgcgccggggcggtgccgcgccatcgtgcgccagcccttcaagttcaagaaccgggtcatccccgcggtcatgggcctggtgccgcgcttcgccacgcacctggatgcgctgaagattctggacgacgatgtcgtcttcctgcacctgcaggaggagaaggtggtcaaggcgggactggccaccaagccgccgggccaggtgggggtgttttggagggggcatggctgggagtggggggagggagcttgtgtgggctgtgcgggccagtgagacgatggagacctcctggcaggcagaacggacgggcagcccagggggagtgtcccttgacaacatgagggctcgccttcgcgaccccggcgcgccatcaacagcccctc

SEQ ID NO: 43832 - DNA, 80 bp, Chlorella protothecoides
cagactcatgcgtggtcacctttggtacattccccctccctcgcccactccagcctggagggagatggtgctgccctcgc

SEQ ID NO: 43833 - DNA, 80 bp, Chlorella protothecoides
cacgtgagtcggcgcgattggtggaagggagggggaggggggggtcctgtgtggttctgggtgagtgagagggcgacttg

SEQ ID NO: 43834 - DNA, 106 bp, Chlorella protothecoides
ccacgtgccggtctgccccctgctccaggtcagagggtggggctgatgcgccgggtggcggcgcgtggagggggtgcatggagggtggagggggagggtgacagcc

SEQ ID NO: 43835 - DNA, 61 bp, Chlorella protothecoides
cccatggagggggtacgtgggaggcgggagggaggtcatgtcgccccttccccctccattg

SEQ ID NO: 43836 - DNA, 1614 bp, Chlorella protothecoides
  modified_base (262)..(271): a, c, t, g, unknown or other
  modified_base (472)..(481): a, c, t, g, unknown or other
  modified_base (620)..(629): a, c, t, g, unknown or other
  modified_base (832)..(841): a, c, t, g, unknown or other
  modified_base (1061)..(1070): a, c, t, g, unknown or other
ggcggccctggacctggaggccaagccctttgaccccgggcaggccgccatggccgccacatacacggggcgggggtcggggggcccggcgcccccgaccccggagggcggctgggacggcgggggcgggccgccggggccgggcacgggcccggcgcacaccgccagcggttcgttgtccacgctgcacgaggagggtgggctgtcgcccgtgaacaagcgggcccggacgggccccatcaggccagagccgcgcctggcnnnnnnnnnntgccagcggttcgttgtccacgctgcatgaggagggtgggctatcgcccgtgaacaagcgggcccggatgggccccatcaggccagagccgcgcctggcctccatccccagcaaccccctggtgaggggaggatgggtgggagggtttatattatggggggaggtagggtaggagtggagcccaacgggaccgtgaagagnnnnnnnnnntgggtaggggagattagccgctgccatgctacctttgccaaccctccaagcgctcatgaaaccccaccttccatcaccacccgcagctcctgtccaagctgctgagtctggggcaggccgggcaggaccagctgcgcannnnnnnnnngataatatgggggaggaaggggaggagtggagcccaacgggaccgtgaagaggcgactcgaacgccgccaaccttgtgttgctgcggggacagagtctcgtgtttgtgcagaggggcgggtaggggagatgagccgctgccatgctacctttgtcaaccctccaaacgctcttgaaaccccaccttccatcaccacccgcagnnnnnnnnnntatgcccagtgagtcgtgctggcggggggatggagtgggaaagcagcgctggtgacattacatgtggcaggagggcagcaatgggggctgactcggccacacttgtgtttcctcctatgtccacccttgtcgctgaatgagagtagcggagaacaccgcacacatgccccctgtccggcccacaattccgcaccatgtcaacccctgcagtgcaaccctnnnnnnnnnncatgcccagtgagtcgtgctagcggggcgatggagtgggaaagaagcgctggtgacatgacatgtagcaggagggcagcaataggggctggctcggccacacttgtgtttcctcctatgtccagccttgtcgctgaatgagagtagcgaagtacattgcacacatgccccctgtccagcccacaattctgcaccatgtcaacccctgcagtgcaaccctctcccagcacctaagttcccttcttactccttgccacaggcggccccaacttccagatgatcgagcagccgcccctggggctggagagcctggcacccccctctcctccgatcgactacgccgccatgctcagggtcagccctggggatggtgcctggggagtagatgtgaggctttgccacacgccaccaaatcatggcaggaacggttgcgccaagccccaacccaacccctgaaccccctctgtcacacaggatgcataccggccttacgaccccgaccccgcccccctgccgggcccggctggccccggcccgcccccctc

SEQ ID NO: 43837 - DNA, 61 bp, Chlorella protothecoides
ggccaacctgtcctttgccgtcgggcgcgcccacctgctggcggcagaggacgcgggcggg

SEQ ID NO: 43838 - DNA, 61 bp, Chlorella protothecoides
gacacgtacatatattaaagatgtacgtgtgcgtgcttgtagctcagtggactagagcaca

SEQ ID NO: 43839 - DNA, 61 bp, Chlorella protothecoides
agggagagtgagacaacgcggatcttacaacccgcctgcgcagactctctgaccagcccct

SEQ ID NO: 43840 - DNA, 1767 bp, Chlorella protothecoides
  modified_base (305)..(314): a, c, t, g, unknown or other
  modified_base (1088)..(1097): a, c, t, g, unknown or other
  modified_base (1335)..(1344): a, c, t, g, unknown or other
  modified_base (1415)..(1424): a, c, t, g, unknown or other
ctgcgccacgtggcgcgcggcggcggcggcctcggccgctgcggcgtgcgtcgcgcgcgcctccgcagtggcggacgccagggccgtcaccaggcgctgcttggccaggtaggcggggggagaggggggcggcggggtcccggcgaccgcctcctgcgccgctcgcggccgccgggcggccatgttggccgcctcggcgaagagcctggcctcgctggcgcgcagctgcggtggtgtgggtgggagagatgggtgggtgtgcacacgtgcataccatgtgtgtttggtagggtctgcgatagccnnnnnnnnnnagcggtgtgggtgggagagatgggtgggtgtgtacacgtgcataacatgtgtgtttggtagggtctgcgatagccttgggtggcggcaacggcaaagcacacagggtcgacagggcgggtggtcttcagttggcattttccggtctccaagcggcaggacctgaatgcaacatgctggcgtgcttggtgcaagattccgctcccagtgtctcctcacgcccacgatgatgcccctgctgtcataacccccccatcccatacccctctccaaagtacccaccttctccgcggcggcctgctcggcggcggtggcgtcggccgcggccacctcggcccccgccagggtcaccaggaggcccgtgtgttcccgccgaccgcactggcgcgggccctgcaccatttcgtaggccagcttggcgtccgtcaggctggcggtcaggttctgggctgcgaggaagcgcgacgccgcgccctccagccaggtctccaggctgggcagcgcccgctgcgccagcgccagggcctgctgcccctggttctgcacccaggcggggagccgactctgggcggtgcatggagcggggccctcccgcaatgcgctcgatgtccccttgtcctctatcacgccacgcggcagggcgctgcttacgttcaggctgacctcgggagtccccggcgacccacacgccgcctcctgccccgcgccggcacccaacgcgctgacgcctggggcggcgcaactttcgccagcgctgacattgcaggccgctgcgnnnnnnnnnnctctgcacccaggcggggagccggctctgggcggtgcatggagaggggccctcccgcagtgcgctcgatgtccccctgtcctctatcacgccgcgcggcagggcgctgctcacgttcaggctgacctcgggggtccccggcgacccacacgccgcctcctgccccgcgccggcccccgacgcgctggcgcccggggcggcgcaactctcgccagcgctgacattgcaggccgctgcgnnnnnnnnnnagccctccgcccccccgctgccctcgccgccatcctcggaaaagaggcgcgcgccgcgcaggcccacctcnnnnnnnnnnggccctccgcccccccgctgccctcgccgccgtcctcggcaaagaggcgcgcgccgcgcaggcccacctcggaccaggcgctggggaaggcgtcgcgcgcggaggccacgacgctgcgcccctcctgcgccacgcgcaccgccagcaggcccgacaggccagagctgcccagcagcagcgccgcgaccagtcccgcagccacgatggggtgcaggttgcggcgcagcgacaggcgcgccgaggcctccgtccgcgcgtacacctggcccagcgcgcgcagcgcggcctgcaccgcgccggccgcgcgcgcgaccggcgaggggtccggtggcgccgcggggcc

SEQ ID NO: 43841 - DNA, 61 bp, Chlorella protothecoides
ggaagccgtagaaggcgcgggcctgccagggggtggtttttgggatggtgggggcaaggga

SEQ ID NO: 43842 - DNA, 685 bp, Chlorella protothecoides
  modified_base (167)..(229): a, c, t, g, unknown or other
gcacgctgcgccacctggcaggtcgcccggccaggccaggacggcagccgcgtcgcgctctgccaggtggcgcagcgtgcgcagcgtggcggagcgcagcggcgcgctgcgcgacgccatcgggcccgccagcaccgccaggtgggctgccgcgggcagcgcgcccnnnnnnnnnnnnnnnnnnnnnnnnnnnnnnnnnnnnnnnnnnnnnnnnnnnnnnnnnnnnnnncgcgaacagcaccagcatctgcgtgtgcagcaccaccaccagcgcggcggcgggcgatgccggggcggcgacggtggtgagagtggagggcatgctaccactgccgccgctgttctcgccgacgccgccgacggcactctcactgcagtcatcatcgccggtccccccgcccagcgccgccgccgccgccgcctcggcgacgaccagcttgcagaggtcgtgcgcgcgggagcccagcgcgtactctggccccagcgacgcgaccgcggcgttcaccaggcgcccggcggcgggcagcagccccggctcgtcgtacaggtcggcgcggagcagcgcgtcgcggcacagctccagcgcaggcaacacgtggggcaggaaggcggggcccgcggcctcagcgcaggccagcagcgcgtgcagcgccgtctgcagcgcgggcggcggggaggcggtggc

SEQ ID NO: 43843 - DNA, 115 bp, Chlorella protothecoides
cttcaccccccccgtgcccctgcaagcgactccggcgcctgccggctgggaggcgggcgcagggggccaggcccgccctgctatcccccccgccggcgccggcgccgtggcaccg

SEQ ID NO: 43844 - DNA, 161 bp, Chlorella protothecoides
gagatggtgctggtgaggagaagggggcgggggtccaggggagcggggtgccgatcagggtcgggctgacggtgccgtaggaggagcggggaccgtgtggatgatctggagcacagggcggcgcggggaccgctccatgccaaatgagaggctggccacgg

SEQ ID NO: 43845 - DNA, 76 bp, Chlorella protothecoides
tgtgcaccccccacggtagccgcaggtgccgcgccctcgcacctcgttgccctacccctgaccaccacaggtggtc

SEQ ID NO: 43846 - DNA, 104 bp, Chlorella protothecoides
ggggggggggggctttgggaggtcgatggcggcgtcgaggcaccgaggcgccattcttctgcatgcacagagcggcgcaccgggtcgttcaggcaggcggccac

SEQ ID NO: 43847 - DNA, 61 bp, Chlorella protothecoides
gtgctgcgcccggggctggggacgggtcccagcctggtacaggaggttcgtctgccgctgg

SEQ ID NO: 43848 - DNA, 68 bp, Chlorella protothecoides
ccgcggggaggagtgcggtgggcggagtgcacggcgacgcctccgacgacgcctctcgagacgcctcc

SEQ ID NO: 43849 - DNA, 139 bp, Chlorella protothecoides
agtgcgcctggccgcgcccgacggtgggtgtgcgccctcggccgcgccggtcgccgccgggcttgccgcggagccctggctggggctggggttccgagacggcgtcgacgagccggccccggtccccggcctggcctcc

SEQ ID NO: 43850 - DNA, 61 bp, Chlorella protothecoides
gggcgtggcggcggggggcggcggtgggaaattggtcccctggctgccgctgaccgtggag

SEQ ID NO: 43851 - DNA, 7440 bp, Chlorella protothecoides
  modified_base (360)..(369): a, c, t, g, unknown or other
  modified_base (1241)..(1250): a, c, t, g, unknown or other
  modified_base (2011)..(2020): a, c, t, g, unknown or other
  modified_base (2758)..(2767): a, c, t, g, unknown or other
  modified_base (3152)..(3161): a, c, t, g, unknown or other
  modified_base (4128)..(4137): a, c, t, g, unknown or other
  modified_base (4684)..(4693): a, c, t, g, unknown or other
  modified_base (5203)..(5212): a, c, t, g, unknown or other
  modified_base (5433)..(5442): a, c, t, g, unknown or other
  modified_base (5816)..(5825): a, c, t, g, unknown or other
  modified_base (6160)..(6169): a, c, t, g, unknown or other
  modified_base (6610)..(6619): a, c, t, g, unknown or other
  modified_base (7371)..(7380): a, c, t, g, unknown or other
gcgacgcgacgggcctgcgcggcctcggcctgggaaaggacggcgcgctggaggcgcggtgggcggcgccgctggccggccccgggcgcgaggtgctggcggtggcgcgctcggcctcccgccccaacgcccccggcccctttgccaaggcctttggcggcgtggacgtgcggtaccgctacctgaaccccagcctgacgctggtggccaccggcgccagcgccgggaccggcccggggaccgacggggctgtgcccccgctgaccgtgcacctgctggacggcgtaaccgggcgaactctctggtccgcgagtcacgagggcggccgcggccccgtgcgcgccgtggtggccgacaacnnnnnnnnnngaccgggcggaccctctggtccgcgagtcacgagggcggccgtggccccgtgcgcgccgtggtggccgacaactgggcggcctaccacttctggtcggccgccgcggggcgctggcaggtgggcgtggtggagctgtacgaggccggggagcgtcgggtcagcgtggcccagctggcgctggccggcccgcccaactccacgctgcccgcctggcgcccgccagcgctggaggcgtacgccgcgagctatcacaccaagctggcggcggcggcgctgggcgtcactcgcacggcgcacggcaccaccgcgccgcagctgctgctgggcacgacgggggggcaggtgtacatgctggaccggcgcctgctggacccgcgccggccggtcgtggacaagcccacgccgggcatgctggccgagggcctggcgccctacgccagcgagctgccgctggcgggcggcgcctttgccacgcgcggagcgcgcgtcgcgcgcctggccgacctcctcgccgaccccgccacgctggagtcctccagcctgctcctggcgcgggggctggacctgtacggcgcgcgcctggcgccctccgccaccttcgaccaggtgcccgacgacttcccctacgccctcctggtcctcatcgtcctgggcatgggcagcggcgccgccgcgctgcgcaggctgtccgcgcgtcgcgccgtcaaccgcctgtgggagtgacttggggggcgggcgggcgggggcggataccgcgtctatgacacggccctcgccgtgtgtaatcagtggatgagaggtgtcgtccgcgaggactgtgacaaggcggtatgtggtgacttagggtagagggcgatggagacgcgagcannnnnnnnnnggaggactgtgacaaggcggtgtggggtgagttagggtagagggcgatggagacgcgagcaggcagaccaaggagcaactgttcctttcataatgaaccgtacaacctcgtcttcagagctgggattgtacaaggtctgtctttgtcaggaacgttacatcgcgtgtgggagaagggccaaacagtacaggcggtaggtcaagagcagggtcagagcacacagttctccgccagcgcggcgcgcagcctccggacctccggcttctccaaggcggccgccgccgaggtgcggggccggcgcatgccctcgttctcttgtccctcgcccacggtttcctgcgccccgccgccatcgctgccccctgcactgctgccggcatccgagtcttcctctccttcagagccgtcgctttcgctggaggccgcgcggtacctgacgccactcgtggtcgagcggcgcggcagccgccgacgcggggcggggccgacggcagcattccccacctcgtcgtcatcgtcttcgtcgctcgtggcatcgtcagcgtccggctcaccggccccaccaccagcaaaagcagatcgggaggcgcggcgcggcgcggccttccccgccccctgccgcccaaacggcagcgggcagcctgtcgtgagttctgcgtgcgtggcatgcgagccctctgcggcacactgcagagcgtcgctgtccacctgctctgccgccgcctcgtggcgctcccgcaggcgggccgctgcggcgcgcnnnnnnnnnnagcgtgcacggcatgcgagccctctgcggcacaccgcagagcgtcgccgtccacctgctccgccgccgcctcgtgacgctcccgcaggcgggccgctgcggcgcgcgcctcccgcgccagcacgctgccagcctggcgtgtgaaggccgcatcgcccacgagctcctcgagcgcctcgtgcgccgctgccagcgtggcggcggcgtcgctctgcagcccggcgcgaaggggcagcgtgctcagcaggcgggcgatggccgaggcgtaggcgcgcgccgcggccgtggccgccccgctctcccgccacgccgccagctcacgcacgagcaccagggccaggctctcgtggctggaggcggcgcgctggcgcggctggccggggtcagacgcgtctgcggaccacaccggggtgtgcagcagctgcgccacaaagcgcatgaccacgggggccgtggccgccgaggccggagctgtgcggctgcacgctgcatccgctgccgccgccctgtgttcgtgtttgagtggacgtgtctgacaggtgccgtcgtttggcgcgggtgcctgggtcgaggagaggcccggcacatggaaggtggtggcgctgagatgcagcagactggccagagaacggcccctagatcaccttatgcttttaaaactgtcgcacaaggagcgggaacacagcgggatgaattgcctggtgctgtagagcacccacccaacccccaaaacccaacnnnnnnnnnncagatcatcttatgcttttaaaactgttgcacaaggagctggaacacagcgggatgaagtgcctgatgctccagagcacccacccaacccccaaaacccaaccatcccacctgcgggcggcggggaggagcgccgatgccagcagggactgggcctgcagggagagggaggccagggtctccagggccacggtcagggtctggcggaactggggtgctgcctccgtggccggatcaaaggccaggcccaggacgctgatcaaggcctgtgggaggagggtggaatatgtagaagtgggaaagggtatcttggaaacggcgagcccgggagagggactccccaggtgcacaggaggtggtgctggtgtccaatgcagtatacagcnnnnnnnnnncattttggaaacggcgagcccgggagagggactacccaggtgcacaggacgtggtgctggtgtccaatgcagtatacagccaaggatgtcgagggtcacgccggcgccagacataaaaccccatgccgtgccttccacccagcgccaatgccagccccagccttcgacatgcaccaaacgcacctccagcgcctcgctctccggcacggcgcgacccggcgcgagctggccgagcaccatgaggcgccccagggcggcggccagggcggcacccgcctcgtccctcgcgcgggacctctccgggccctcctccccgccggccaggaggtcgtggcgccaggcccccagcgcgcacagcatggtggggatgcagggacggctgtcttcccccgccagccactcatcaaccctcgcgacgccgtggcgggccgcgatatccccgagcgccttcagatgtcgtggggggagggggtgggaggcatgggatcgtggcgacgcagagcacgtggggctgggagaacagcgcaaagtcggggcccaatgctgccatgcctgacccctgcgtgagcctcagcccctcccaaaccacccccagcaccgcatacgcttgcctgggcagcagtgccggcggcggtccaggcatctgcctctccgtcctcgacgccctgcgccaggaggcgcgccaggcgcggcaccgccgccgccacgacaccgcgcggggcggcaggcgaggcggccaggaggccggcggcccccgccgcgaggcccgcgggaccccagccggcgtggcctgtttccggcgcctgccggggcatgcagcggctcaggaccgttccccagaccctgtccagcaggctggagactcctcgcggcggcagggcctgcagggccagcgccagggcagacaggaggcggggcgaggcgggggccgacgatgtctcgcccgcctcgcagcgctcgcacaggnnnnnnnnnnggacaggaggcggggcgaggcaaaggccgacgacgtctcgcccgcctcgcagcgctcgcacaggcgctccactgcgacctgcgccagctggcccgacgcgggcgaggcgacgcgcagcaggcgggccagggcccgcgccgcgacctccctgatgggcgcagccaggccgcggggctcggctgcgagctcgtccccctctccgaccagctcgcggaggaccaagtcggaggcggtgcgccgcgcggcggcgtcccccgtatccaggcaggtcacaaacatgaggagcaggtggtcggccgcctccggctgctcgcccttcaccgccgagtgcgtcgcggcagcctcctcccaggatgaagggaggaaggcgtccagggcctccagcgcggcgctcgccgccgccgcctcgatgtcggccgtcgcgcccgcggcggaggcggcggaccggccggcggcgtgcgcgcgctcctgcgtcgcctgcgcaaccacacaccacgccagggccaggtcgacgctgacgtcggcgacatgcagctggtcgccctcnnnnnnnnnnccgcctgcgcaaccacgcaccatgccagggccaggtcggcgccgacgtcggcgacatgcagctggtcgccctcctcggcctgcccagccgccgcatccttcgcctcgctctccgaggtaatacaccgcggcgtgacccctgcctccgcccaggccgccatgagcctgacggggttcagggtcccggcatccagcagcgcgcgcagcgccagctcgccggcgtcgcgcccgtgggcatccagcaaggaaagcagggacaaggggtcgccgtcacagccggccagccaggcctggaccaggcgcagcgcggcagccgccacggccgggcagcggtcacgcaggccgcgcctgatcaggagcgcccgctgagctggcgccaggtcacgcggccccgctccgtgcgctgcggtcaggtacgccacgcgcctcacatcgtcgtcggggtccagcgagcgctcgagcacggccccggcagccagaacgcagggtggcagggaggccagcgcgccgnnnnnnnnnngtcgtcgtcggggtccagcgagcgctcgaccaccgccccggcagccaggacgcagggtggcagggaggccagcgcgccgcgccgcacctcccgacttgcatcgtggctcgccaggcggatcagcgcggcggtgatggggcaggcggcaaagtcgccgtcctcgcccgggtccgggaggcgggccagggcgcgggccgcggcggcgcgcaccgccggtctgnnnnnnnnnncgcatcgtggctcgccaggcggatcagcgtggcggtgatggggcaggcggcaaaatcgccgtcctcgcccgggtctgggaggcgggccagggcacgggccgcggcggcgcgcaccgccggtctggcatcggctgctcgctccagcagcgccgcctgcaggccgtcagcgacgtcctcggacagccccgcatcggcgggtaggcccgacagcagggcctgggccagctgacaggcgcgccagcgcgcgggcgcgtcctcggcgtgcgtcagtgaggccagtgactggagcagctgctccagaaaagtcaggcgcccctcgtctgaggcctgggctgcgaaggtggccaggaagcgcagcacccggtccacatacnnnnnnnnnnatcagggaggccagtgactggagcagctgctccaggaaagtcaggcgcccctcgtctgaggcctgcgctgcaaaggtcgccaggaagcgcagcacccggtccacatacatcgtgcgctgtacattattggttgtgggcaatgcgttggaaaagagcgtgtggcccggcagcggggcggtgggcgagggtaaggggcggcatcgtgcgagtcctcccgagcatcatgccgcacggacacccacacgacaggtgtgcgtcggagaaggccaccctgcagacaaagggcccacgcctaacacacccacccacctctccacatgtcatgatgagcttannnnnnnnnntagcccacgcccaatacacccgcccacctctccacatgtcatgatgagcttaaacgcgtgcaccaggtccgcgcccgcacgcgcgggctcctcgtcgcatagttcccacagcgccttcgcaaggcggaggtgggccccggacgagccccgctgcgcctcgttcaaaaagacgggcacgctcataacgttgagactgccccgttcccgcgccatggtgaaagactggcgtctggtgtgcgaagagggtgttccagctcttcgagctgttccgggaatggttgaatcggggtcgggtggatgccaggctttccaccagtgtgtcactcccccggaacagaacacagagcagagcggaacaaatcacgaaccatacgcgtccataggcttggaagcatgtaaatctccacccgatggctctgatcaagctctgaaggtgccctnnnnnnnnnngacaaatcacgaatcatacgcgtccataggcttggaagcatgtcaaactccacccaatggctctgatcaagctctgaaggtgccctcatggcatagacttgtcttaccaccgagctcaaaggcagtgtcacccggcagtctcgcgacccgagcgatcggggcccgatccccatggccctggtcacccagcgcccttcgattgcctcgcaggatcctcttgatgggactgtcgccgcaatggaggttgggaggcccgggtccagtgcctccaaaaacggcaacaggggcaccagtgaggaggaggcagcctatttctcccagctgctgggctacagcatggagcgcctggcccgggagccggagctcctggcctccgagcagcagtacctggcccgccaggccgcggaggtgacgtccacgtaccgcggcgccctgctggccagcgctagcggcgcccgcgacctcgccggcatcctgggcgatgcaagtacccgcctgcgcgccgtctccgatgccctgccgcgcctgcaggccagcggcgaggccttcgagggcgtggccacgtcgtctgaggccgcccgccgcgtcaaccgccagctcgcaggtacaaaaggggttaggattcaggggattcgcgtgtgtgtctgatgcaggcaccttacccaactggttgagggaatcaaacccccctcagacctgggtgtcgttttcatatcccctctgctcctctcctgacagccccaccccccccnnnnnnnnnngtaggattcaggggtttcatgtttgtgtcagatgcaggcaccttacccaactggttgagg

SEQ ID NO: 43852 - DNA, 61 bp, Chlorella protothecoides
gcgaaaccaatccgcggcatttagtagcggcaaagttagaccaaaccatgaaaccaacata

SEQ ID NO: 43853 - DNA, 61 bp, Chlorella protothecoides
caccgtccggggccaggcttggtcggcagggccctccttctctaatggcactcgcatgagg

SEQ ID NO: 43854 - DNA, 74 bp, Chlorella protothecoides
cgtcgccgaccccgggaagccagatgaggcactcggggacctcgtccccatggcgcgcccgatccacaccccca

SEQ ID NO: 43855 - DNA, 61 bp, Chlorella protothecoides
ccttcatgccacggtgtcccgccccacctcaagaaacgcccgcccccctccctccaggccc

SEQ ID NO: 43856 - DNA, 67 bp, Chlorella protothecoides
gggccccgcagtctccgcagcgccagccccccctcgcggcagggcggctgcgtggtggcatgtgcca

SEQ ID NO: 43857 - DNA, 72 bp, Chlorella protothecoides
cagccccagcccatctcccagccccagcccatctccgaggctgtctcccagccccagcccatctcccagccc

SEQ ID NO: 43858 - DNA, 65 bp, Chlorella protothecoides
cccccccccccaccccccccccccccccccaaaagaacctcaccatcatgccgaagagcgcgccg

SEQ ID NO: 43859 - DNA, 61 bp, Chlorella protothecoides
gcattacatccccatatagcggctgcaaggggcatgatgcgagtgcacgtcctgaggcagg

SEQ ID NO: 43860 - DNA, 70 bp, Chlorella protothecoides
cctgcccaggtcccacgggatcgacacgccccccccccgtcccacctccctcaccccctcgcctcgcaga

SEQ ID NO: 43861 - DNA, 77 bp, Chlorella protothecoides
gccagctcctcgggccccgcgggcgcgtctccctcctcgagctcctggtccagggtgtcggaggcctggcgcccaaa

SEQ ID NO: 43862 - DNA, 77 bp, Chlorella protothecoides
cagcatcttctccgtgccgccttgggggggtgggggtgggggggggttcagtgcggtgggcttggctgcagagagac

SEQ ID NO: 43863 - DNA, 61 bp, Chlorella protothecoides
caaattcgatataggcgtcggaacggcagggaggtggtcgcgtaaagagtgaaaatactcc

SEQ ID NO: 43864 - DNA, 61 bp, Chlorella protothecoides
gtcggtgtcagcatcggcgtcgcacaccgcgcagcgctcccccgcccaccgtacccggatc

SEQ ID NO: 43865 - DNA, 61 bp, Chlorella protothecoides
tccgtcatccatatctgtcgatgccgaaggcgtgggatacgttgggcaatcttgcggactt

SEQ ID NO: 43866 - DNA, 61 bp, Chlorella protothecoides
agctcgccgcaagaaacttgaatggcagggggagtgggtcaccccatccccccatatggca

SEQ ID NO: 43867 - DNA, 3935 bp, Chlorella protothecoides
  modified_base (93)..(102): a, c, t, g, unknown or other
  modified_base (1059)..(1068): a, c, t, g, unknown or other
  modified_base (1192)..(1201): a, c, t, g, unknown or other
  modified_base (1894)..(1903): a, c, t, g, unknown or other
  modified_base (1990)..(2022): a, c, t, g, unknown or other
  modified_base (2163)..(2172): a, c, t, g, unknown or other
  modified_base (2268)..(2277): a, c, t, g, unknown or other
  modified_base (2373)..(2482): a, c, t, g, unknown or other
  modified_base (3445)..(3454): a, c, t, g, unknown or other
  modified_base (3818)..(3827): a, c, t, g, unknown or other
ccagccccacccccccgctccccgaccaccagcgcgctcagtcgaagccgcggtggacgcgggcgcgggtgacgcgctgcagcgctttgacgnnnnnnnnnnggcgcgctcagtcgaagccgcggtggacgcgagcgcgggtgacgcgctgcagcgctttgacgaaggccgcggtgcgcaggttgagcccgtcggcctcgtggatctcccagatggccttgaaggcgtcggtcatgaccacgtccagcttggtgttcacctccgcctcggaccacttgaagttctgcaggttctgcacccactcgaagaaggagacggtgacgccgccgccgttggtatagatgtcgggcagcgcgacgatgccgcggtcgcgcaggatctggtcggcctcgggcgtggtggggccgttggccgcctccaccaccaccttgcactgcaggtccccggcgttggcctcggtgatgacgccgccgatggcggcggggatgagcacgtcgcagggcacggtgaggatggcctccttgggcacagtggaggcgcccgggaaggtggtcagcgcctggcggtcggccaggtgctggcgcagcgcggggacgtccagccccgtctcgcagtggatggcgccggagacgtcggagacggcgatcacccgcccgccgtgctcgtgcaggatctgggcggcccaggcgcccacgttgccaaagccctggatgacaaaggacttgccccggatctcgcccatgcggatggcgcgcaggagctcacgcaccgcgaacaccgtgccgcgcccggtggcggcttcgcgccccagagacccatgcagccacaccggctgttggagtggttgaggggtaggggtgaggggtaggggtgggtgggaggttgtacgggaatgggggagggtgggagacgggggcggaggcgagggaggtggtgcagaaggaggcgagggaggtggtgcagaaggaggcgagggaggtggtgcagaagcagggagtgctgcatggcccagccgcgcatgccgtagtagcacccacctctacacacgcatgtacgccnnnnnnnnnncagctgcacggcccagccgcgcatgccataggagcacccacctctacacacgcatgtacgcccaccaacccctttcactcctgctcccccccacccccttccccccctttcctaccttgccggnnnnnnnnnngccaacccctttcactcctgctcccccggcccccccccttccccccctttcctaccttgccggtgacgatgcccggggagtagccctcgaacttggtgtactcgtcgaagatccaggccatctcgcgcgcacccgtgttcatgtccggcgcggggatgtcctcgtaggtgcccaggatggggcgcagggcctgcaccagcttgcgggtcaggatctccagctcgcgctcggagagggtggaggggtccacggtgacgccgcccttggcgccgccaaaggggatgtccatcaccgccgtcttccaggtcatgagagaggccagcgatcgcacgtcgtcgatgtcgacgtcggggtggaagcgcaggccgcccttgtaggggccgcgggagttgtcgtgctgcacgcggtatgcatcaaaggtcgccacctcgccgttgtcgcgcaggatggccagctccacggaaacctcgcgctcgggtgtcagcagcagcttctgcaggcgctcagggtactccaggtgctgcagggcctgcgtggatcagtgaaggagggaggggaaaggaaagggtgagattgaatggatcctcgaatggggtccagacagccagatcgagcacccagcgcggagagtgctggatgggggcatctgcaacaaaggtaccactgctgggagcagtgaaagggagcgtgcgnnnnnnnnnnggatcgagcacccagcggggagagtgctggcagggggcatctgcaacactgatacaactgctgggagcagtgaaagggagcgtgcgnnnnnnnnnnnnnnnnnnnnnnnnnnnnnnnnnacgtttggccccaacagcaccgttgccgtcctacgacaccaccccaactcaggtatgcggcaagataaaatcacctagataccacccgcccagtccccacccgcccagtccccaccgcacctccacgatgaacttgttggnnnnnnnnnnaccatagggtgataaagctggccaggtcaaagaatgtcccagctccaacacaaaatgatgccagaagggacccccctggaccgccaccttcggagnnnnnnnnnncccttagggtgataaatctggccaggtcaaagaatgtcccagccccaacacaaaatgatgccagcagggacccccctggaccgccaccttcggagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaaatcacctagatcccacccgcccagtccccacccgcctagttcccaccgcacctccacgatgaacttgttggtgttctccgcgtgggagctcttgtaacgggtctgcgagttctgcggatccagggacccgccctgctgcatacctccgctcatggcgggggccatgcgggacagcagggagcgggcgagggagcggcgggccagcatcagggccatggctgccagtacttgtcggaacgcgggcagtcgggactcccaccctgagaaatagaaggaaggctgatcggcagacgtagaaagattcgagcaatttaaacaatatcagaaatatggtaacgggcagcctgatcacgcagactcctaagggtcggctcaacacagccgcgggaatgccggaactgcgtgaggacgcgggtgggcccacgtgtgcacacagggctccgtctctggaacggaacctggaggaactgggttaaagctttacatcaagggtctcgtgcggcgcatgcaggcatatgccctcacattctcagcaggtatcgagctcattaatacccaccaccccctgtttcggatctgtctctgcccatccctccaccgccagcatgtgtgattggaatcagccgaccgagcctcgcaccctgggacagcacctcgcccaccgtctgtcccagatcggcgtaaagcacttctttggagtcccaggtaagcgatgtttggagtgggtttggcacctggcagggcatgctggcggggtggtgcctgcttaatgctgttggtcatgtgctcggaagccatttcaccgatgtcgacccctgcctccccatctcacaggggactacaacctgcaggtacgagactctgaggactcaatggcccgcattcgggctcatactccgtcatcggcagtgcttgtgcatgggagttgccgctgcactcccatcttctcgccattgggcnnnnnnnnnnccgagactctgaggactcaatggcccgcattagggctcatactccgtcattggcagtgcatgtgcatgggagttgacgctgcactcccatcttctcgccattgggcatgggagtggctgccgtctcccgccctctcccaccctccccacactgccttcccacgtgcagctcctggacgagctggtcaaggacaagttcacggagggtcgctggacctgcaatgagcttaatgctggtgtgcacagggtcggggactcagtaacaatggcgtctggtgggcgtcgacaggggattggcttaacacactgccctcaaatgagaatccatcggatacgcacgcaaaccctcccccccgccccccggnnnnnnnnnnggggtcggggacttggtaacaatggagtgttggtgggcgtcgacaggggattggctcaacacactgccctcaaatgggaatccatcgaatacgcacgcccaccctccc

SEQ ID NO: 43868 - DNA, 93 bp, Chlorella protothecoides
aggggggaaagggggggcaaagggggagggggataaaactcagggggagcagggcggtggagtagcaggccctgtggccggctgggcaaaggg

SEQ ID NO: 43869 - DNA, 61 bp, Chlorella protothecoides
ggagactcctcagggcttggagagggtgacgcctcggggctgggagagggcgactcctcag

SEQ ID NO: 43870 - DNA, 61 bp, Chlorella protothecoides
gtcgcagggcgttggttgagcggagtacatcccagacgagacgtattatcaataccacgaa

SEQ ID NO: 43871 - DNA, 99 bp, Chlorella protothecoides
ccgcagggatgctccctgcacccgctgatacccgcctctaccaaacacccacccacccacacccacacgcaggcggccctggcatggctgagtgcccag

SEQ ID NO: 43872 - DNA, 61 bp, Chlorella protothecoides
gctgcatcttggacctgaagcggcggcgggggcgcttgacggcaaacagctcgccggaagc

SEQ ID NO: 43873 - DNA, 61 bp, Chlorella protothecoides
agagatcagatacctgatcggaggggcgggggttgggatgagcatggaggtctgaggacca

SEQ ID NO: 43874 - DNA, 61 bp, Chlorella protothecoides
cacggagggagactggcggcccctcaaggggatccacctggccctagatggtggtgcctgc

SEQ ID NO: 43875 - DNA, 79 bp, Chlorella protothecoides
agagggagccgccgagtacctgcacggcgcgtgctgactgaaatggccgcgtttcagctggctgagtcagcgccccagg

SEQ ID NO: 43876 - DNA, 61 bp, Chlorella protothecoides
ttgatggtggtctcaagaatagagcggctaatgcgatgaagcatagcgcacttggtctgcg

SEQ ID NO: 43877 - DNA, 61 bp, Chlorella protothecoides
cgcgctgcgccgcgcggtgccggccaagactctgacccagatcaagaactactaccagaac

SEQ ID NO: 43878 - DNA, 61 bp, Chlorella protothecoides
gtgagcgggttcaggatgttgtggaagggggagttccagggcacaatggcgcccaccacgc

SEQ ID NO: 43879 - DNA, 61 bp, Chlorella protothecoides
ttgatcggaggctcgagggccgaatgggggggcaggccagggcatgtcggcaatccagcct

SEQ ID NO: 43880 - DNA, 7924 bp, Chlorella protothecoides
  modified_base (260)..(296): a, c, t, g, unknown or other
  modified_base (371)..(461): a, c, t, g, unknown or other
  modified_base (527)..(536): a, c, t, g, unknown or other
  modified_base (865)..(874): a, c, t, g, unknown or other
  modified_base (1114)..(1123): a, c, t, g, unknown or other
  modified_base (1792)..(1801): a, c, t, g, unknown or other
  modified_base (4195)..(4204): a, c, t, g, unknown or other
  modified_base (4922)..(4931): a, c, t, g, unknown or other
  modified_base (6201)..(6210): a, c, t, g, unknown or other
  modified_base (6316)..(6544): a, c, t, g, unknown or other
  modified_base (6907)..(6916): a, c, t, g, unknown or other
  modified_base (7225)..(7234): a, c, t, g, unknown or other
  modified_base (7511)..(7520): a, c, t, g, unknown or other
cccacccccctcatatcccccacgcccccaccccagggagtgcaattcatcctctgccccctcctacaaatacatgcaggctcgtccgggacgcagcacaatgggctctgcggccccggcatgccctttgtgagcatcggtttcgggggcatgggctccggcgggcccgccccgggcatgctccctgtgcacaccgccagctgaggcggagccacgcccaggtgcgtgcgaggatcatccctggccgaggggtggagggnnnnnnnnnnnnnnnnnnnnnnnnnnnnnnnnnnnnncgtgcacaccgccagctgaggcggtgcgacgcccaggtgcgtgtgaggatcatccctggccgaggggtggagggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaaatgttccagggctctctctcttccccttgaccgggggggtgcatcggctgggctattggacnnnnnnnnnntgtgcgccgccgagacgggggtggaggggcggcggctggtggatgccgggggggccagggggtgtggggtgtcttggcccaggagctgtggccgtgccccagcagcgttcacacacactcctgtgcccctccttaaatgttccagggctctctcttccccttgacgggggggtgcatcggctgggctattggaccgtgagcaccgtccaggctgtgccggggatccgaaggtcccctctgtgtgagccaagtcgtgtggagggtactgcaaaggtccgccctccacacccctcgagcccccctctcaccgactccctctcacgcgaggnnnnnnnnnngccgtcgaggctgtgccggggatccgaaggtcccctccgcgtgagccaagtcgtgtggagagtccaggagaggtccgccctccacactactcgagcacccctctcaccgactccctctcacgcgaggagtcgcctccatctgagcggcatgggcaggcgtggaggggccccctgggcgtggcgtgtctatcccaaaaacccgcgcagggccccggcattggatccccatgtgcaaacggnnnnnnnnnngcccctgggcgtggcgtgtctatcccccaataccccgcgcaggcccccggcattggatccccatgtgcaaacggtcccaacctcccatacgcctgccatgtgtcagcacccgctctgctcagcaggccgtcccggcctgcagcagccaccctccaatgcatcccgcttgctcccttcctcccttccggccgtcgccggattttgacttgtggcgttccagcgcagaagcggggccgagccccgcaaacaccatcctgcacccaacacctgaaatgtcgaacaccctctgcgctcactttgtggacggcggcacacgcactcctcactttgaggagcacccctccccgctctcccagagtttttcatcgttccagggttttgttagtatggcagactttgagatacactgattgagcacacatgtggcagaccgggacgccacgtgtcagagtgcacgcgaaccggatgcgaagggcccgatggtcgtggcgagggtgataacagagagcagggacgcgaatgcacagcaatcgtgctcttatgactcattaaatgaagtgacaagtctcatacgagccgcaattttgacctgcacgtctgacgaagtgttcacagttcacacccggcaccctctcaaccctcgaaactcccttctgccatcacaccatnnnnnnnnnngacctgcacgtctgacgaagtgtccacagttcacacccggcaccctctccagcctcgaaactcccttctgccatcacaccatcaccaacaagcagcttttgattgttttacacagctggtgaggttgtcgcatgatcatggcccggccaatgcggccagtcgtagcttattgatgccgagtgcagattgcgttggtgtcagactctaccaactcccgtacgacatgttgacccgtggcccacaccacagtgcaagaaggactccgcattcaagattaaccagcacggtgcagcatgtcgagctaccatacagtgatcgggatggtcaagcccaaagtcatccccggagacgtcgacactctggcccaatacagccctgaggggtgcctggagcgggaagctcgtataaccgctgcactggaaaccctcgcacatcctttgatcgtgtttggcagggatgctgccgtcaatgttggcttcagtcaggcggattgccaagctggaggccccgtaatgcgcctccggcagccctccgacggtcaagcgggtgcggagaaacacgtgtcgggagtgtggtggaggcggcccacacacggcatcagcgataacgcacaaccacatgcagaacctggtccggtaacaccaagcctgtctaccatgttccttacctccaccttgactcccgaccactgcagactatggatgggaggattgccgagtgattcctcccaacagaaaggacacctggctgcccgcacgcttgcgcctcctgtgccagggcagcgtctcctccagggagtgcctgcgtgacaggctggcttctgtggaactccgggccagcttcccatcctgccaggcaccctctcaggtgattgcaggggcccttgccggggaggcacccatgagtgctccgcactcgcatccatgcaccgcatgggtgtgctccatcaagccaaacctctgccctccccacccaacccttcctcccatgacgtgctccagttcgaggccatgagctgggcgctgtacaagacacggaaatttgctagcaacctgcgcaagctcagtctggagactatggctgcccacccagacatgtatgcacgcttcctcggcgccgatttcccagcttacctggcgtgagtaggggagggggagctatgcctggcgcctgcagcggaccagcgtggcgagacgggtgacgatgttctgacctgctgacaggagttgcaagtaaaagagccaggcagggggccatggacctggagcatgcactttcttgtaccgtcattcctggtcacggttgccctcctcaccatgtcccaagctgcctgcaaagttgtacacacgtgcacctagaatccataatctcctttgttcgcaggcacatgtccctgcctgccacagcgggtgacgagctcactctgagggcgatcgggcaccatttcggtatccacatctgcgtggcgacaggggaggaatcgcagtggctgctgcgcttccctccccccatcacattgagcaggcggcagctgatcctggcctggtgccaaggatcctgggccccgatcaggtatgggatcaggtatggggagttgggacctgcgatggaagaggagcggtgtaggcagcaggctgccgcaagtcccactgtgaccagcgcttgcatgggccaattatgagttgccgagggttctctcatcattagtctgcgccccttacgacgatcccatttcgcctactgcaggggtcagactgtgtttgaagactttaagcaagcaatgctgctatcaatccgccagcagcccatccacctgatctgagcagaagtctgtgcctgtcaggttctctggcgacaggcgatcgtaaggtgtcgctcactttctattccaccaggccatgtccatcaccgctcgccgcccctaccgggattcgatgcaatcttttcgcctgccgcttttccgagtttcatatggcactcaccatgtgcctgtacttttcattttagtcttcttcctcgcctcccttccccacaatggtgaacagcatgccgtgatcgattccctccaatatagccttccagcatgggtaaagtgttatggaagctccttatccttctcacatgacattgtgtgggatttacaccagaaaacctggtttacatgtaaacccactggacctgcagtgcctctggtgtgttctgatgcaccaagaaacgtggcgatgatgatgttccgcaggggggggagagcaccgatgacataatcgaccacccccacgttgggattccttgtcgtgacgggcatctctcccataagctaaaacgtatacatacttggggtttaaaagggggcaatcttctccgcgtcatcaggatctaggctctcctggtgcnnnnnnnnnncgctaaaacttatacattcttggggtttaaaagggggcaatcttctcagcgtcatcaggatctaggctctcctggtgctgccaggagtgtttgcggccgagttctgcgcgcacgctgtcccgtcgaataatccgccttggcttcgatccgctgtacgccgccctccccattgcttcagaatagctcaaggttcggcagggcaagcctccagggccgttggcttggcctaggcaggcccggattgtcgcgtgaaaccctgattccccggctccaacacgtgcggatgctgggagtaggggtcgcaccacccctggacaccatgggtacgcagcgctcccgcaagagcacatggaccctggaggatcccacagccttcgacgccatgcagtacatgctgtacaaggagagggccatcgctacagcagtctgcagtgtgtccaatccatttgtggtgccgctgggcgatgcggccgtgaacgtcggcttcgggctggacccaccctgcaaccgcctggtgcgtcttgccgcgctggccagccccccgccagagggcaaaggtgggccctgagggagggagcggggtgttgcgctgactccctcccatgcatggctgggatgctcactgtgagatggacacctcgacccctgttgaggcccatggggatgaatcctggcccacggcctgatcctgcatcctccctcagacgttgggtggcgnnnnnnnnnntaaaggtgggccctgagggagggagcggggcgttgcgctgactccctcccatgcatggcggggatgctcactgtgtgatggacacctcaacccctattgaggcccatgggatgagtcctggcccacggcctgagcctgcatcctccctcagacgttgggtggcgtgaggcccgcaagaggctggaggacgataccctcaagaggcatcggctcaatcggttggtgctggaaggtgacgtgacagccagcaggaagctgctcaaggctcgcctgctgcaggttgggctggaaacgaggctgagcaggctccccggcaagcctgactcacaggtaggcatctgcggaagggtgtggccggcagggggactcaatccttcctgctacctgtacctgcaaaggaagggggggttcacccttgccttccctacgtgcgcagttcgaggcattgagcacggcgctgtgggggagcaaggcgtttgcggggacgctgcgtgcgctgtgcttggagaccatggcggagcagccggacgagttccaggctttcctgggacgggactttgagccctacctagcgtgagtgcaggggctgggctggtgtggtgcatccagtgaggcgcgccgcgccacagcgccgcccagcgagtccccgcctcccctctgcctgcgcagccgcatggcgctgcctacgatggccggcgacgagctcacgctgcgcgcgctttgcagtcgtttcggcatccacatcagcgtcgtgacgggggagtgttaccaatgggtactgcactactccccaccccgcaccctgtcgaagagggaggtctatctggcatggtccaacggcacatgggcgccagtgaggtgaggcggtccagaactgtggcagggtcggttcctgtataagaggatgcggtgactctctcctgggagttgttgtatccacaaggatgcctagcccgggtctctccctggggtcttactcttgctttcaaggcatgaggggcgtgccgacgcccacccattttgagttgccccccccctggtcaatctgcaggcaactctctgcgcttagggcgttgcgcatggctatcaccggcagcggggaagttccagtcgcccctgggctggagaggagaccctgctgcatggctggcgaggagcgtggcgagtgaacgcctgcacgatttcctgatgacggtctgcatttcttggatacctcaccatgccacatgctcctaccaaaactgtgttcttttcttactttattactgcnnnnnnnnnntggcccagaactgtggcaggttcggctcctgtataagaggatgtggtgactctctcctgggagttgttgaatccgcaaggatgcctagcccgggtctctccctggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttctgcatttcttggatacctcacctcaccatgccacatgctcctaccagaactgtgttcttttcttactttattactgcatgcatacgagccgtttcccttttgcaccgcccctcccgggcccttttcttcaatcgtttgcttattatgcagatccattgagatgttgcaagcagtgttacatcgcagtctaaaatttcgtgtggagtggatttgaaagagtaccccttctctcgccaccgtttccatttgaaatgaagttacgaaatcccggaagagatcctcccaactacctggcgacagcctgtcctgccaccaaggtccgaagttggaatgtcattcaactgatgcccgctctgagannnnnnnnnngattacgaaatccccgatgagatcctcccaactactggcgacagcttgtcctgccatcaaggtccgaagttgaaatgtcattcaactgatgcccgctctgagaccttccccactcggttctagtcctcgcattcactcgagctccttgacacccacaggactggagttccaacaagcacttcacgtgcgcccgcggcccgggcacacccgagtgggtggggaagggtggggaaggacgtcgccagccagcgagaggggaagggcagcaaagctcgccacagctctcacaagaccagctgcgagcaccannnnnnnnnnaagcatgtgaggcgggagccagggaagtccctcatctttttccatgccttcccgcactctggccgcgacagtgacaccctgccccctccagaggatgctaggatagacaagtacgtcggcatcgacccggggcgcaccaagatgttcgctgcggtgcatgaacacgctaatatgacagcctgctcggcgagggagtttcactccacgtcgggatttaagcggcggcaaaagaccatcgcgaagaaccacgccgaggccccagactttgtcaaggagnnnnnnnnnntatgaacacgctaatgtgacatcctgctcctccaaggagtttcactccatgtcgggattcaagcggcggcaaaagaccatcgcgaagaggcacgccgaggccccagactttgtcaaggagttgcacaagtgggtggtgtttggtttgtggagtgtgtgcaaggacaggccccacaggggcgggcactgtgtcacgacatctcacatcgctccaactgtaccaaaccccctcctcaacccccccctcttcccgcaggtacccgacccataagacagccagcacagaggtgcttctgtcgcaggtcgcatggatcctccctaacctgcgacggggcctggcctggcacatggacggaagccgtcctggaagctgcagcaccaggcctacgtcggcagggagcgggc

SEQ ID NO: 43881 - DNA, 103 bp, Chlorella protothecoides
cctgtacaccgacgcgtcccttgttgcggcagtggccctagccggccgccacctccccgcccgccccttcccagacagcgcgctggatgtgttggacgaggcc

SEQ ID NO: 43882 - DNA, 105 bp, Chlorella protothecoides
ggggggttgggggtgggtaggaggggggggttgagttggggagagagcttcaggcgcccccacgtgatgggccaggggctgcgccgcccagggcgcaggccgaga

SEQ ID NO: 43883 - DNA, 614 bp, Chlorella protothecoides
  modified_base (227)..(236): a, c, t, g, unknown or other
gcgtcggcctccgccgcggcgaccgctccgccgctgcgggggcggggtccggatggggcttgagtgtctagggggtggatgtgagaggtcgggccccgccgggtgtgccccaggggtcgcactcgaagccccagccatgcgggcgctcggcaagacgaggcgcgcctgtggggcccggcacatcatgcacgacaggtgatggtccctcctgcccacccccgactccnnnnnnnnnnacgctgcgggggcggggtccggaaggggcttgagtgtctagatggtggatgtgagaggtcgtgccccgccgggtgtgccccaggggtcgtactcgaagccccggccatgcgggcgcacggcaagacgaggcgcgcccgtggggcccggcacatcatgcacgacagctgatggtccctcctgcccacccccgactccctcctcctcagcatcgcccacctgtgccggtcgtcctccggtcggtcgtccgcaaactcccccggccagggccccgcaccgcccttgcgaggcaggggcgccgcgcgcggcgaggccggcagcgcgtccatgtccatgccggtgggcgcgcgcgcgcaggtggcgggcttgcgccggcgccg

SEQ ID NO: 43884 - DNA, 116 bp, Chlorella protothecoides
gtgaggaccctgaagcggctgggggaggtggtggcggtcactggtgatggtaccaatgatgcccctgccctcaaggagtcggatgttggactggccatgggcattgcaggtgggca

SEQ ID NO: 43885 - DNA, 69 bp, Chlorella protothecoides
gagtggtactggcacgctgcgccagggtgcgtggaggcggtgcaggaggtgtgcggctgcgcagcggga

SEQ ID NO: 43886 - DNA, 75 bp, Chlorella protothecoides
ggctgccgaggacgagcgcctggccgcgagtgactaggcgccggggccttgcaagtgcgctggacgacccgcgcc

SEQ ID NO: 43887 - DNA, 61 bp, Chlorella protothecoides
aaccaaacacgaccaaggcaagtgtcagggggcacaagtggggtcccaggccacggcaatg

SEQ ID NO: 43888 - DNA, 64 bp, Chlorella protothecoides
cggaggactcccccagcccttctccagaggtctcccccagcccctcgcccgaggccagccccag

SEQ ID NO: 43889 - DNA, 444 bp, Chlorella protothecoides
  modified_base (150)..(327): a, c, t, g, unknown or other
cctcgccgcgctcgccgacctggcgccggccgccttccgcctcgcgctggccccgggcggcgaggaggccccgtcggccgcgccggaggacgcgcgtgcgctgctcgagtacgtgtcccccggcgcggctgcggagctggacgaggcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgccgcgctcctggcccagcgcctggcgccgctgaccctggcgcggggcagggaggaggcggtggggccctacgccctgccgcgcgccgaggcgcgggtgctggtggacgccgcccc

SEQ ID NO: 43890 - DNA, 401 bp, Chlorella protothecoides
  modified_base (117)..(325): a, c, t, g, unknown or other
tgcgtgtgcgacggtggtgatgtttgcgctttacttatgcgagggagaatgggatgggaaagggaaggaaggcggcgggggagggggaggggtttcagcaatgagatggggccgagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtacctgaagtgtcccctgacctctccctacgtaacccccctattggcactcatgcagctgatgtgcctgtgcga

SEQ ID NO: 43891 - DNA, 61 bp, Chlorella protothecoides
ccctgaaactctgcacaaacagtcgcagggaatcgtggatgcgctccggcgacaccatgct

SEQ ID NO: 43892 - DNA, 61 bp, Chlorella protothecoides
catcccttctaaatccattttaataatttcggttgtacaagtcccaatccaaacgattacc

SEQ ID NO: 43893 - DNA, 95 bp, Chlorella protothecoides
ccttgcgccgctgccccttccccccgacgcgggttcagcgctgggcgagtcggccgccgccgcctcctctggccacatgccggggtgcatgcgcc

SEQ ID NO: 43894 - DNA, 61 bp, Chlorella protothecoides
ttgaagaatgagccggcgacttagaaaaagaggcgtggttaaggaaaaattccgaagcctt

SEQ ID NO: 43895 - DNA, 61 bp, Chlorella protothecoides
gggttttttttgcgcagactaggtgggaggggttgataattttcttttgggaaaattggag

SEQ ID NO: 43896 - DNA, 204 bp, Chlorella protothecoides
ggccggcgcgcagctgtcacccagcacgcgtgcggcggccaacgcggcgcgcgaggcggcagccgccagccgggcatttggcgccgtgccgatgcacggcttggggcccccggactgggctggcctgcaggcgtcggggtacggcgcgtgcatggcgccggcctcaggcgcgctgccgacctgggacccgttccaggcgctggc

SEQ ID NO: 43897 - DNA, 61 bp, Chlorella protothecoides
tcagccgctgatgaattgtgccgggggggggacagcgtgtagtaacatcaatgtcaggcag

SEQ ID NO: 43898 - DNA, 639 bp, Chlorella protothecoides
  modified_base (109)..(118): a, c, t, g, unknown or other
acctgatcatgtggcttctcccggacaacatccaatgtttggcaccacctctccctcttccgccccctgctgccctccatggtcacctttccccttgtcttcatgcaannnnnnnnnnagagtgggcacacctcagcacctttgcttgtcacctgatcatgtggcttctcccgaataacatccaatgtttggcaccaaccctccctcttccaccccctgctgccctctatggtcacctttccccttgtcttcatgcaaccccgcatccccccccacacacacaccagggtacgacgaggaggcgcgatactttgaccccgacgtcagcgccgccaagcgcgcgggcctgacctccgacctgctggacctggtgcggcccgcctacgtggcgcagctggacgcgctgcgcggcatggcactggcgggcttctccgcgcagctggcggacccgcaggcgcccgagggcgaggcctgggtggaccgcgtggcgcggctggaggccgaggcgctggccatgtttgacagcacggcgcccgacctggcggtgggccccgcggcggaggcctgggcggggctggaggccggggcgcgggagggcctgcgctcggcgctgggcgccgaggccgccgccacgcgcgg

SEQ ID NO: 43899 - DNA, 71 bp, Chlorella protothecoides
ctcagctgcttgccctggagtgtggttgtgggagggggggagggggggatggtggacgctgatggcggcaa

SEQ ID NO: 43900 - DNA, 61 bp, Chlorella protothecoides
ctcgccgcgctgccctcgctgccactcgccccgctgccctcgctgccactcgcctcgctac

SEQ ID NO: 43901 - DNA, 61 bp, Chlorella protothecoides
tgaccaagcatcttacctcctcgccccccccccccctccccccccttgcatgaagcgcctg

SEQ ID NO: 43902 - DNA, 172 bp, Chlorella protothecoides
cgcgacgggggcctgcctgggtaaaacccctgcggcccatgccgggcgcgtgatttcgctggcgcacgacgcgcgtgccggcctgctcgcctcctgctcccaggacggcagcctggcggtctggcgcctggccagcagcgcgggcgcgccacgcccggcgctggccctggcg

SEQ ID NO: 43903 - DNA, 63 bp, Chlorella protothecoides
gccgcgcagcagctgctgcagcagcaggcgacgcagcgcgccgcggcggcggggccccagcgg

SEQ ID NO: 43904 - DNA, 61 bp, Chlorella protothecoides
cgacagcgcggcacatggactcgtggcaggggccgccatgcaaaggttcgaaacggcctga

SEQ ID NO: 43905 - DNA, 61 bp, Chlorella protothecoides
aggggcgcagcggcgggccgagcgggggggggaaacgctgcactggctccatgatcgtgca

SEQ ID NO: 43906 - DNA, 108 bp, Chlorella protothecoides
ctggccgactgcttcgccgcgccgctgggggcggcctgcggcggtggcgcgggccacgaccacgcggccgaccaccgtgcggccgacgaccacgcggccgacgacccg

SEQ ID NO: 43907 - DNA, 90 bp, Chlorella protothecoides
agcgccgaccctgcatgccggccatgccactgcacgcacgatactctgcgacaaacaccaccgccacagcactcggccgccccgacacca

SEQ ID NO: 43908 - DNA, 8587 bp, Chlorella protothecoides
  modified_base (243)..(252): a, c, t, g, unknown or other
  modified_base (1072)..(1081): a, c, t, g, unknown or other
  modified_base (1547)..(1751): a, c, t, g, unknown or other
  modified_base (1885)..(1894): a, c, t, g, unknown or other
  modified_base (2177)..(2186): a, c, t, g, unknown or other
  modified_base (2624)..(2633): a, c, t, g, unknown or other
  modified_base (2893)..(2902): a, c, t, g, unknown or other
  modified_base (4022)..(4031): a, c, t, g, unknown or other
  modified_base (4097)..(4188): a, c, t, g, unknown or other
  modified_base (4261)..(4270): a, c, t, g, unknown or other
  modified_base (4534)..(4543): a, c, t, g, unknown or other
  modified_base (5068)..(5077): a, c, t, g, unknown or other
  modified_base (5466)..(5475): a, c, t, g, unknown or other
  modified_base (5744)..(5753): a, c, t, g, unknown or other
  modified_base (6097)..(6106): a, c, t, g, unknown or other
  modified_base (7463)..(7617): a, c, t, g, unknown or other
  modified_base (8056)..(8065): a, c, t, g, unknown or other
cagcccgccgcccgcgcagcgaggccgcggggacgcgcgcggcgcgccgccccccgccggggtccgggccgtgtccgccagcgggcacaccaaccgtgggcgggtgaagcagaagagccacaagtcggcagagctggtggacgtcggcgtcctgtggtgagcagggccttgatttctttctcttcttggtagggggggcggggcatgtcttgatccggtctcagctgactctcctgtcggccnnnnnnnnnncccttcatgggggggggggcggggcatgtcttaatccggtctcagctgactctcctgtcggcctgtgcttgatcctgggacgcccatccttgatgctcaaagccagcgccaccctcctcacctccctctctccaatccaatccaaaccatctgaccatgtctgccaggccggagcgcggttggcacaacgcgggctacattttccccctaggcttcgtgtcgcgcaccctcttccgctcctcggtggccctagaccagctctgcgtgcacgactgctatgtgcagggcgagggtggcgagcactggcccgggcccaccttccgcgtggtggcgcgggaccgtcccgacgagccgctggtggccaagtcctgcacggggtgctggacgggggtgctcaagcgcatcaacgccgagatcgaggcgcgacgcgcggcgggggaggacctgccgcccccgcccaagaccgccatcgccgggccagagtactttggcctcaaccagaccaacgtgagtgtgcctgtgtgtggagggaagggggggtgggtgataggcagggtagaacctgagaggctcggtgaatgggagcgaggacatgcacgagccaggcgctgggcagcatcgcggcgagaccctcggcctgcgtgggcattgtcgcggcatgaaaaggctgtgaactgtgatggcagacgcagggcagaactctgtcgctgtcatcccctgcaaaggtatgaaaacactgtacccctctacaaccctcgcacaaccagccccctccccggatacccaaatggtgcagatccaggaggcggtggaggcgctnnnnnnnnnnccccccctacaaccctcgcacaaccagcctcctccccggattcccaaacggtgcagatccaggaggcggtggaggcgctggacccgcaccatctttgcgtcgagtactgggcgggcaaggaacagcgctgccgcgcggcagccgggctgcccgcccagcccggcccgccgcccgcccgtgctggccgcgccgcgggcccccggccggcgcagcacgggcggcggcgggccgggcgtgaggacccggacggcaccgcggacgacgaggcggaggaggaggcggggtacgccagcaagtgagtgcctttgggttagcgtgcgcgagcctgtgggtgggcagagggagaggggcggttgcggacggcggccgcagctccaggaacaggtggctggagccgggggcgccgctctgtgagccctgcctcgccaggctgcttccaagccagagcaagcctgaccctcgccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgaacaccagggttcgccgtcccgacccgtgtctgagaggcaaggcctcctggggcgctggccacctggctgccctccgaccaccgtgccccaccccacgcacgcagacgaggacaacccgctgccagacctgnnnnnnnnnnaccgtgagccctgcctcgccgggctgcgtccaagccagagcaagcctgaccctcgccgattcctccgccccaggtggtcgggcatcaacaggtcggagcggtaccggaaacggcgggaggaggctggggacgacgtgacggcgctaggtgcgcagggaggggggtgatgggatccatgggatggggcagacagcctctgtggcggcaagaccgcgctgtgccggggtgtcactcgggcccagcgggcctcgagcattccgagtcgcaatctgctggcagtgtnnnnnnnnnngttccatgggatggggcaggcagcctctgtggcggcaaggccgcgccgtgccagggtgtcactcgggcccagcgggcctcatgcattccgagtcgcaatctgctggcagtgtgcatccggaacaccaaggttcaccgtcccgactcgtgtctgagaggcaaggcctcctggggcgctggccaccgggctgccctctgaccaccttgccccacctcatgcatgcagacgaggacaacccgctgccagacctgctggaccccatcaccctggagccggtggtgcgccccgccatctcgccctacggccacgtcatggggatggcgacgtggaaggtgggtggatgtgtgtggggcttgggttggcgctgctgctgggcgggggcgtggcggggcgtgccggtgggcacagcgtgcaggcaaggcagccacgaccccgaannnnnnnnnngcttggggtggcgctgctgctgggcgggggcggggcggggcgtgcccgtgggcacggcgtgcaggcaaggcagccacgaccccgaagcctgcagcgcagtgacagggcgcccagccgtgcagagccccaggcccgcctcttctggcccagggtgcccgccctcccaggccctgcgcctcgtcccacccaccctccccatcctcgcaggctgtgctgtctgagagcaagacctgccccttcaccaagcagccgctgacctnnnnnnnnnntgtcccagccaccctccccatccttgcaggctgtgctgtctgagagcaagtcctgccccttcaccaagcagccgctgacctgggagtcgtgcaaggtgctcaccaagcacaacatccacctgcacgccgaccgcatcatccgctgagcttgtcgttgagggcggcctgtttgcagagccaacctccttgccatccctgcctggatggacaccctcgaaaagtcctgtgcgcgtccaaatacgccccagacttgccagccactttccaacccccacccctacacccccatgtacactgtttcctacaagtagacccgcaggggggtggtttacagcagtgcgacgcgttcactcggtggccggggcaggggcgctgccgccgccgcggccgaagccgccggagcggaactcggggcggtactcgccgggggcaccggtcttgtcggagcggtagccgccgcggtcgccgccgccaaagcggtcgggcctgtcgccgccgaagcgggggcggtccccgccgaagcggtcgccgcgggggggcctgtcgccgccgaagcccttctccaaggggcgggtggacttcatgagcgtggcggggaccacctcggcgggcaggttcaggtactcgcgcaggtactcgatgccggagtcggtgaggaaccagtagaagtggcgccaggcgtaccgctcggtgaccagctccttggagcgcagggactggagcagcttgatgacctccaggttggacacgccctccaggtccttctcggggtgctgcttcaggttgaagtccttctcggcgtacatcacgccatctgtggtggggtgggtgggcgtggatgaggggggcgggggccgcgccgggacccatgcgcggcggggcatctcaaaaggagcctcgaacgacaacaaaatgcgcaccattgaacagctgcttgtagaccgccctgcggttcttcttggagatcaacatgatgtattagtggttgtttcgcgttggcagaatgccaactcgattccccggtctgcagggaaggggggagggggtgagcggggcacgacggcgggcggcccagggagctcccagcatccagcgcacagtacacagcctcgcagagaannnnnnnnnnacacgacggcgggcggctcagggacctcccagcagccagcgcacagtacacagcctcgcagagaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccctatgacattggtggaagagagcaccatccggatctagcgggtcgtggcacggtttacacctacttagatnnnnnnnnnnccagctcatatcgcgcctgccctgctttgcgagagacctctcctgcgccttgcatggcacccataacattggtggaagagagcagcatccggagctcgcaggtcgtggcacggtttacacctacttagatcccataaagcattgtggactggccatcagcgcacacagttgaagtagcggcgaggggtctcaagtctcggcagcgtgcgtagctcaacatggccaaaacgaggagggtgagcgaggagatcgtgtgcgctgcannnnnnnnnnctagcggcgaggggtctcacgtctcggcagcgtccgtagctcaccatggccaaaacgagaagggtgagcgaggagatcgtgtgcgctgcaatcaggaaggtaagcacgtgttttaagccttattccaaacatgcttctccctcctgccctgcccgtgcagaggaagaaacgcacgcatgtgccagaggccgacgcccccaaggctggggagccccggtcctttgtcatcaggcggggcaagtacgcccccatgctcaaggacctggagaaggacttgaggcagatgatgatgcccaacaccgcgaaggagctcaaggtgtgctgctgtgtgctctcctgggtggattgtggttgggactgtgatggccatgcgtgaagttggggcggccctggcctgggcagggcgccctggacccagggaaccatactttcagtatgctgcacatacaatgggctggcggcatgttcgaacatcagcgcacgggcatcgccaaactctgcatgcaagccctccccgatgcctcnnnnnnnnnntatgttcaaacatctgcgtacgggcatcgccatactctgcatgcaagccctccccgatgcctcgggacaccccatgatgcaggagagccgcaagaacgtgctcaaggactttgtccaggtggcgggcccactgggcgtgacccacttcctcatgctaagcgccacgcagcgggcaggctacctgcgcgtggcgaagacgccgcgcgggcccacgctgacgctgcgtgtgctggagtactccctaatgcgcgatgtgcagtcggcgcagcagcgcccgcgctgcccccaggtgagcctcgtgcgcagggtggtgttttgtggtgggggtggggggagggaggttgaaggttgacaaagtttctgacacatgtagcaggtgtgcggcacannnnnnnnnntgtttgtggtgggggtgggggggagggaggtggaaggttgacaaagcttctgacacatgtagcaggtgtgcggcacatgttaccttccggaaacaagggacgcctcgatgcgcggtgcggacttgtactgaagcgcgggcctctcctgggatgccggttcaagcagcataccttggtacctcaccttgccccccatacccgaatccaccaccacagacgatgtggcacggcccccccctggtggtgctcaacaacttcaccgggtccgnnnnnnnnnngctgggatgctagttcaagcagcataccttgatacctcaccctgccccccatacccaaatccaccaccacagacgatgtggcacggtccccccttggtggtgctcaacaacttcaccgggtccgagcacctgaagctggcggccaccaccttccagaacctgttccctgccatcaacgtcgccaccaccaagctctccacctgccaggtccaggatttttgatgggggttagtcttgctcaatgcaaaggagtccatgcccaatgaacgagccgtggcttccacccagctatgcaccctgcccagtccccctcctctccagtactttcccccttcactccaagnnnnnnnnnngtttttgatgggggctggtcttgctcaatgcaaaggagtccttgcccaatgagcgagccgtggcttccacccagccaagcaccatgcccagtcccccttctctccagtactttcccccttcactccaaggaccaacccattcaccacacccatccattgcagcgggtgctgctgctggaccacgaccgcgccagcgggcgcatccgcctgcgccagtactccatcgtggtgcagccctcgggcgtgaccaagaacctcaaagccctgctggggcggcgcgcggtccccgacctgggcgagtgcaaggatgtgtctgagttcctgacacgcagcggctacggctcggagagcgagggggacgaccccgacaccacacgcgtcgaattggcagaggacctgggcaagggcaaccagaaggctcgccagtcgcgcattaggctgcacgaggtgggtgggtttgtttgtgtgtgtggggggggggtttgcgataatggaggggggggaggttggaagggcgggggagtgaggcagttgggtaggtgtccgcggttgcggcggtgcacggcttggcagtctggaatttcaaacccagggtgggagcagctgcggatctactcctttatgtatgcgtaattaacaacaacaatgcccccccaattgagcttcaggtcgggccgcggctggagatggagctgatcaaggtgcaggacgggttgtgtgaaggcaacgtgctctaccatgcctacatccagaaggacccggcggagattgcggagcgcaagaccaaggaagaggagcgggaggcgctgcgacgccagcggcgagccgaacaggtgtggaggatggcgtcgggtgattggtgatgggatggcactctctgtgagccagggttcccggctgggccagaggccgggggtgtgcggggaggggttgagcccagtggctgcggtgcacggctcttggcgggtggaggggctgcaggccatgtgcagatcacgcatcttgcctccatgccatcctgcagcccacacatgtgcgcctcggtcagcctctggtgagtcaattcccgacctcgcggcccttcccatcgcaggaggagaacgtgaggaagaaggagagcgaggcgaagcgccgccggcggccgcaggacgatgcgcgcggagccaagcgcccccggcccgaggtggacggtccctccgaggacgacgacgacgccgagtacttccgccaggaggtcggggaggagccggaggagggcatgctggcagcgggccacagcggcggcggcagcggcggcttccgtgggcgcgggaggggccggtttgggcgagggcgggggacccgtggcggcggcggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcccgtgggggtgaggggggcggcaggggccgtggtggctcccagaggggaagctttggcggcggtggcgggtctggacgaggcgggtctggatggggatcttccagccgcggcggggctggacgaggcggcgggcgcggacgcgggggtcgtcgatgatgttgacggccactcgacactcccacctgcgacgtcactacccctaatacacttcacatggcttctgtaccctgatgtaaccctatacaacgtttgtgcgattggcaaatgggggggccatggctcaagcggctggggatggctagcagcggaactggcgagagtgcaagggcccaatcctctacatcgccaatctcagccgccgcatcgctccccgcccaactcatccctcatcccagggccaggcctgcctgggccacaaaggtggtgacccacaggnnnnnnnnnngagcagcggaagtggcgagagtgcaagggcccaatcctcttcatcgccaatctcagccgccgcgtcgccccccgcccaactcacccctcatcccagggccaggcccgcctgggccacaaaggtggtgacccacagggtgacgggcagcgtgcccagcgcgtacagcttgagcagggtgcgggcgaagcgcggcgcgtcctggcgcgtgccccgcgacagctgcagcaggatgaccaggttctgggcggggggcatggtggactgcaggagcaggaccaggagcggcagggggccgaccccgggcaggggcaccgcgcgcagggccagggtcgtggccaggggcaggaagaggaagcgcgtcaggccgacggcggccagcgtccgcgcctccagcgcgtcctcaggccggagcagggccgccgcgcggcgcacgaggcccaccacggggccggggccctcgccggggtccgcctgcgcgtcgtcgtcgccgtcgccgccgtcaccgccgccgccagccgagcg

SEQ ID NO: 43909 - DNA, 61 bp, Chlorella protothecoides
cccgccgcgccgcgcgccgagtggccggcgtccgccctgcgcgccgtcttcgcccggctcc

SEQ ID NO: 43910 - DNA, 61 bp, Chlorella protothecoides
ggggatacactccctattccatcacttgcagcctgtactcaaatgtcttcttcaaactcgc

SEQ ID NO: 43911 - DNA, 61 bp, Chlorella protothecoides
cctagacaaggccgaggttgccgaagccggggccgcaaaaagcagacatgccaccatgagg

SEQ ID NO: 43912 - DNA, 61 bp, Chlorella protothecoides
cgacagcgaacggtcgaggcagggcacgaggtcaaggacctcgagccggcaatacaaagcg

SEQ ID NO: 43913 - DNA, 61 bp, Chlorella protothecoides
tggggcgacgaggacaacgacggctcgcgggctgagcgcttcctgcgccccgccgagccct

SEQ ID NO: 43914 - DNA, 93 bp, Chlorella protothecoides
gtaggcgcccagcgccgcggccgcgttggcgtgacggtgcgggtgcgcgcccaccagcaggagcaggggcaggcctgcggcgggcgcggcggg

SEQ ID NO: 43915 - DNA, 61 bp, Chlorella protothecoides
ggggagggggaggacgcggggctgaccgtctgggatggcgacgatgcggggctggccgctg

SEQ ID NO: 43916 - DNA, 61 bp, Chlorella protothecoides
gggatggtcttgaggtgcaaacttgtatccgagcttattcacgcccagcctgtgccgccgc

SEQ ID NO: 43917 - DNA, 10614 bp, Chlorella protothecoides
  modified_base (115)..(124): a, c, t, g, unknown or other
  modified_base (2058)..(2067): a, c, t, g, unknown or other
  modified_base (2214)..(2223): a, c, t, g, unknown or other
  modified_base (2400)..(2409): a, c, t, g, unknown or other
  modified_base (2982)..(2991): a, c, t, g, unknown or other
  modified_base (3264)..(3273): a, c, t, g, unknown or other
  modified_base (3501)..(3510): a, c, t, g, unknown or other
  modified_base (3928)..(3937): a, c, t, g, unknown or other
  modified_base (4476)..(4485): a, c, t, g, unknown or other
  modified_base (4957)..(4966): a, c, t, g, unknown or other
  modified_base (5465)..(5474): a, c, t, g, unknown or other
  modified_base (7079)..(7088): a, c, t, g, unknown or other
  modified_base (7375)..(7384): a, c, t, g, unknown or other
  modified_base (7491)..(7500): a, c, t, g, unknown or other
  modified_base (7829)..(7838): a, c, t, g, unknown or other
  modified_base (10513)..(10522): a, c, t, g, unknown or other
ggggggggcggccgggggaccaggctccgctgcagctgccgccaggggtgggggtcatgcgtgatgcatccccacatgacattcagggcaagactccccagggagcctgctgcannnnnnnnnncggccgggggaccaggcgccgctgcagctgccgccagggttgggggtcatgcgcgatgcatccccacatgacatcgagggcaagactccccagggagcctgctgcacagagtgcctcgcgccccggcaatttgactggagcttggagggtccaggtggtgggcggcatggcttcaagcgcacggggattggtgcagagcaatcccccacaaccaaaaaacattccccaaggaacccaccttcccggtctcgtgcccagaggcgttggggacggcccggaacacgccgtcgcggcggggcgggagggagtagcccgaccagtaggaggagtagacgctctgcacctggatgggcggcgggcggcgcactggggctgagcggacggggcgtggcagatttcgcggcccagatcaggtgcgcttgctggagaggtcattgcagtgcgcacagagccccctgcggtcggcgcccccatgcccatgccccgggttccaccctcggccagccaggcacctgcgaggcctcatgcttcgacttcatgcgcttggtcctcgccaggtccgtgtggggttgcttggatgtcttgccgccgcgcttgctgcttgctccctccgtcagcctcttggtggcggtcttcctgtgcaggattgtaggcacgactggatggtgacagccctttcactgcttgaatttcactgcttgcaggacacatcgcatgcagtgacgattgaaccaccacttgcatcctacaaaacatccttcccctatcaaggttcacaatcatccaactcactggtaccttgatacatcttctttggtgccctgacggccacagacgcagtactggccctcggggctcctggagaagatgaggacatcgcctgcctgcatggcataccggttcaggacgtcctgggtgttctccagcagatacctgagtgtgtgatggaatggaaggggagtgggcttcagatcacgcagtccttgacatgcaagaccctgcgcatgtcgtaaacctcatgccactccatctcacatgcgggaggcattgttgatccagaagcgaaaccggaaggtgtgcttcttgccgtaggtgtccatcacgacgaagttctgcccggtctgggcctcaatctccggaaaatggctctccgcctgaccctgtgggtaacaccggcgtcataagactcagttatgtattatatggcgctgcgaatcttcacatgaagacatccacccgagccgagggaggacatggttccgcggtaaggggccctggtttcaactgccatggccggctcacagatgcaaacctacatgccatcagtccaccgcacattgctccatggtacattgcacacctttggaatcacaatccttccatttccgctggcatcgcttccggtgaggaccttctcaaacaagacggcagtgcccatcgagagcaacttcgcatgcgcctcctccttcagaggggtttccggtcgcgaagatgattttgaagccatgatgagttgatcaggatggcggggccaatgggagcgagcggtgacagatgcttccccctcttccccgccgggactgcaggacgagcaatatggctgagaacagagtggcaacccccctatgcaacggtaagctgattttaagacataaaagattgcctcatggctgcctgtggacttcgtgtgctcgtatgacagcagcatgtacgcacgccaggccgagagtacagccgggtgccattggaaagggagagattcctgttcatgaagcagggctgctcattccagatcaccgagcagatcctccaagcagacacactttcctacgagcgcgctgtatttgtgcaatttggaaggtcaacttatcacctctggacaatcagagacagtgacgcgaagcaggtgtttcccaggctgctctgatgatgtnnnnnnnnnngggacgagcagtatggctgagaacagagtggccacccccctatgcaacggtaagctgatttaaagacatacaagatcgcctcatggctgcctgtgggcttcgtgtgcacgtatgaaagcagcatgtacgcacgccaggccgagagtnnnnnnnnnncatcaacagcatgcgccacatgaaagtacaacttcttagagagttaaatatcccatagctcagtcgagcataattcaatttgattctgatgtagcagttcgtctaaccagagactacattcggccgtcaatgcattccctcatctcgcaaagtgcttgtgagcaaccatctgagccnnnnnnnnnnaatcaacagcatgcgcatcatcaaagtacaatctcttggagaataaatatcccatagctcagtcgagcataattcaatttgattgtgatgtagtagttcgtctagccagagactactttcggccgtcaatgcattccctcatccagcaaagtgcttgtgagcaaccatctgagccgcaatgaattcacgtacaagctcataggcagtggcaccgcttgaccaatacgcccaatccaagacgctgctgtagtgcagtcaacaatgcttaatatctagggtgcactcagaatagggtttgaggatatgaggaagatatttgaaactagggcttgatctttaccagaccctgtggccgtttatggaatcacactctcacacacagggggcatgatgcgtagcacgtctccttatcacacccacagacatacaaatggacctctcgtttcatggggacagggaggatgtcacacacttgtgtgacaatggggaaacttagtattctactccttgcttagcatacctgtggtcggggccctgcatccttcagggcagatctaccattcagccccatgnnnnnnnnnncggacctctcctttcaaggggacagggaggatgtcacaaacttgtgtgacaatgggacaacgtagtattttactccttgcttggcatacctgtggtcggggccctgcatctttcagggcagatctaccattcagccccatgcgtctggaacctagaaccagcacgcacatggccgaatgcatccttcggctgaccagggtctcgaccattgacgatggcgggcattgcctcaccaccggcaccaacatcttccactgggaactgccttcaatnnnnnnnnnncaatgcatccttcagctgaccagggtctcgaccattgacgatgggaggcattgcctcaccaccggcatcaacatcttccactgggaactgccttcaatctccggcttcggaaggcatgatcagcccaaatttcagcctcggtataatctgtggactgttaaacatgcgttcatgataacatcttggtaaggtgtggttacaccaacatctttcccgattgtggatttnnnnnnnnnncgaaggcatgatcagcccaaagttcagcctcggtataatctgtggactgttaggaatgcgttcatgatgacatcttggtaaggtgtgggtacaccaacatctttcccgattgtggattttggttggtcccacagtcgaccagtacgccgattcctgccaacttgtagcggttcggatcaattcaagccaaatgtatttccacatatcggatttggtttcagcagcttcctatgcaacgcaggcctacacagccgggtgctggctctgcgcagcatggcgtggattccgggttccggaaggtgttgcaaaatcctcgtcagagtcctcgtcacaagagcgcaccgtagaaacaagttgcaccgtacatgactcgtagaaacaaatcacacgagggctgaagactgtgcccagatctccnnnnnnnnnngaaatcctcgtcagagtcctcgtcacaagagggcaccgtaaaaacaagttgcaccatacatgactcgtagaaacaaatcatacgagggctgaagactgtgcccagatctccttaggattgggggcttggcatcgcaggccagccgctcctccgacgcgcatccaccatctgtgcggctggagagcgcgtccacccttggccacgacaatttccgttgcgatggaggggaccatgcaggatgacgtcccgctggtggtcacccgctgcctcgattacgctgccaagtaccatggctccacggaggtggtgtcccgcacggtggagggccccatcgtgcgcaccaactacaaggaggtgcactccagggcgcaggcctttgccaatgccctgctgagcatgggtgtcaggtgcggtagggttgggagggggccaggggagggcatgccggacaaggctaggttccgtggtcctgtctcagccccagatggacatggttttcttcttctccgccaaatcacacaggaagggcgaccgcgtgnnnnnnnnnngggttccgtggtcctgtctcagccctagatggacatggtggtcttcctctctgccaaatcacacaggaagggcgaccgcgtggccaccatggcctggaacacgcaccgccacctggagtgctggtacgccatcatgggcattggggcggtgtgccacaccctcaacccgcgcctcttccacgccgacctggagtacatcatcaacgacgcgcaggactgcatcatcctggcagatatctcctttgcaaagtctctggaggagcttggccccaagctgcccagcgtgcggcgatacatcttcctgaccgatgaagggtgggttgtagatctgcgtgtttgttaaatggggggaagggggcggagggtgtctctgcgtggagtgggtgcatctgtgccgtggtgcccctctttgaataccacaatccaggtgctctattatttatacacaatcatggtcgaagcctgctacacnnnnnnnnnnatgtttgttaagggggggggatggggccggagggtgcctctgcgtgcagtgggtgcatctgtgccgtggtggcccactctgaataccacaatccaggtgctctgttaatcatacacaatcatggtcgaagcctgctacaccgtccacccctgtcctccatatctcatgccacaggcacatgcccaagtcccccagtctgagggcgcagtgctacgagactgtggtggctgactggctgccccgctccaagggtttcagctggcccgagctcgacgagcgacagggctgcggcctgtgctacacctctggcacgacggggcgacccaaggtagggccatgcaggcttgcgttgtccatcccgagacggatcaggcgtgtgagcggaggcccgtacccctgcacgccagtgtgtggagccgaagacgccacatgcacgtgtaatctcccaacctcctcctctgccccgctcccccgccgctggaccccaacgcccaccttnnnnnnnnnngggcttgcgttgtccatcccgagatggaccaggcgtgtgagcggagacccgttcccctgcacgccagtgtgtggggctgaagacgctgcacgcacgtgtagcctcccagcctcctcctctgccccgctcccccaccactgaaccccaacgcccaccttgcacattcaaactccatggtagcatccctccgatctctcccaccccgttcccacaccccagggcgtgatgtacactcaccgctccaacgtgctgcacgccatggcctccgctacgccggacggcctgggcggcggcacctccgacaccatgctggcggtggtgcccatgttccacgccaactcctggggcatcgccttctccgcacccatggtgggcatgcgcctggtgctccctgccgccgcgctggatgggcgcagcgtgtacgagctgatggcggcggaggaggtcaccgtcaccgccggcgtgcccacggtctggctggcgctgcaggcgcacatggaggccgacccgtcgcgccgcctggagcgcatgcgcgtgctggtcatcggcgggtcggccatgccgcgcaagctgctggacttcttcggcgaccggcacggcatcgacgtgcgccagatgtggggcatgaccgagacctcgcccatgggcacctttggcacgcccgtgcactcggggggggtggagcccggccccgaggagcgcgcagcgcagcgcctgacccagggccgcccccacttcttgtccgacctgcgcatcgtggatgaatcggggcgggagctgccctgggacggcaaggcctttggcaacctgcacattcgtgggcccgtggtgctgcagtcctacttcaaggcggggcgccccgcggtggacgccgaccgctggttcgacacaggggacgtggccaccatgagcccgcgcggcttcatgcagatcacggaccgcgccaaggacgtgatcaagagcgggggggagtggatctccagcatcgagatcgagaacgcggcggtggggcacccgcaggtgggcgaggccgcggtgatcgctgtgccgcaccccaagtggaccgagcgccccctcctcgtggttgtgcccaagccgggacaggtttgtttgtgggtggctgtgggggggggtgtgctgggggagtttgcatcgggccaatgctgtgctcaggaatgtggaggacgctgcgcgcgatcgcatcaccgaacaggcaatctgcctcgtcccctccaaaccggtctcttacgccgcttcccacccccagccccaacacacacgcctcaccccacccttcccgctgcagaaccccagcaaggaggacatcctggggtacctggctgggaaggtggccaagtggtgggtccccgacgacgtggtcttcctcaaggagatcccgcacaccgccacgggcaagatctacaagctggccctgcgcaagcagctgggcggctacgattttggtcccgcctccaagctctgagggcagtggggtgggaggaggggagggcctgcaaggctgggagttgcgcggagcgatgcggcaggttcggcggcctagcaataccgcagtcgtacctaagactgccagcagtggaccctgcnnnnnnnnnncgtgccgcacccaaagtggaccgagcgccccctcctcgtggtcgtgcccaagccagggcaggtttgtttgtgggtggctgtgggggtaggggtgctgggggagtttgcatcgggccagtgctgtgctcaggaatgtggaggaggacgctgcgcgcgctcacatcaccgaataggcaatctgccttgtcccctccaaaccggtctcttgcgccccttcccgcccccagccccaacacagacgcctcaacccaccctccccgctgcagaaccccagcaaggaggacatnnnnnnnnnnggtgcttgcttgctgattgagctccctcgctgggtgtcgacccacttgaaaatgacgcggtatcgatcgtcacgacgagcaaaatcagccaggcagcttctgctcannnnnnnnnngttggtcagagagccctgggactgagtatctgcaaaccatggagtcgacgattggctgctcttgtgcttgctcgcttattgagctgcctcactgggtgtcgacccacttgaaaatgacgcagtatcgattgtcacgaagagcaaaatcagccaggcagcttctgctcacacgtggcagagcatgttgaaggccagatgcacaatgcccaaagccaaagtacatgccgggtggctccacacagtccgccagcagtatccatggttgccatagctctccacacacattcaaagggcataggtttggtgatgcaaaattggacagcatttgnnnnnnnnnncagtacatgccgggtggctccacagagtccgccagcagggtccatggttgccgtagctctccacacacatccaaagggcatatgtttggtgatgcaaaattggacagcatttgcaagatgtagctttgatacagtgccctccaggccttgccagccatttcattcaatctctggcacctcaagttacacccacttctgcttgttgttccaagcatcggacagggctggctgcttgaaggggtatgcagagaacgccgtcctggcaatgatcaggagcgggaagagaaggtagggtgcgtagaaagcagaaaccatggctggcttgtacccaggcgccttgtgaaaccagagctcgaagaatatggggagcatggtggccgtcacaaagctcgcatacatgagcgccggtatgcgtacccagttccggcgtgctgcgatgggatggaagggcagagggggtggtgaggtccgcatccgtcatcgtgaggctcaagcgcatgcaatcatagaaacttggcgccttaagagtgagcgtgatctacagaatgccacgtgccgagatgcaggtcatccatgcagctctcacccaagaatgcataggccccaacgaaaaagaagggcagctgcacgaagacctcagagtacacaagcgacaggaaccagggcttgtacggcggcgtcatctgcgcatgtgaatgcataccggtttgagtgccacagaacattgacgacaaacgctttgcgtcgtagttgccctggatttcatctcacccctcaagcaacacacggcacaatggcaggcatcagccagaccaacccgcgcaccagtggatcgccataggttctcaagtaccactctgtagtttcccgaatctttgcatggtacagctcgccgctaaatactgcgggaggaggaacctggttatcgacctctaggctaaccagcaggcaaaccccccatcactcccctctatctatcgccccacctgcttgggagtcgacaaatatcgtgatagggatgtgggagatgaagaagaaggcgatcgcgatctcgacgaagcgcgacatggtgatctgggggtggggccgggaggttgagccccctctcacgcacgatcagcgagatgaaagcaaaccctgtagccctgcttttcccctggtctcttcttgttgcaagctacatgcgtgcactgggcgcccgggaggcgcagggtgacggtgcgggacgcacggagcatgcgcgcgaggaaagcagggcaggcgggcctcacagcttaaccgcctcctccttgacctccagcaccaccgtgacctccgccagctgcacggtgaagtccccgtcgcgcagcctgtccccaagcagcgccttcttcgcctcggcctgctccgcggcccactcagccttggtggcctgccactcgcgccactcctccatctgcttctcgcgagcggccaggaactcggtgtccgcctgtgtgagaggggagcagggcgcggtgatcaggatggctcgggcgccttcccaggtcacagaagtggcagaactcaatccacgctcgcaggcagagaggactggccatgtcgaggtgggagtcccacactgcatcacgcgtcgcaacattgcccgacgccctccacccgcgcgccatcccccgagcccaggaccccccccccaaaacacacacagcgcccacctgcatgagaatggcctcgtcctcctcgtcgtacttcttgctgtagtgcttcaggttcttcaggatggccttctgcttctccgccgacagcagcgtcggggggcggggcctccactgaaactggtagaagcgattcctctccaccctgggagcagatggaggagaggaccaagtgctgggaggaggtgccatgcagcgctgcccggaggctcagtacagggatcccatgcgggcgctctattccgccatcagtcctggccaaggccaggtcgacgtgccacaaagaccctccccatctagcccatctgcctggcctgttcccagtctccaactcgggaccccccattgagcacccacttgtagagcagctgcccggcaaaggaccagatgtagtacccattgtcggtactgttctgggcattcaccacggttgtcaggtagcggcctggcacggggattcgcggtggttggggtttagggagagggagagggggagcatgctgggcgacgacactttgtgggtgtgagagggagcagctgggagcacctggcctgatacgggttgcccagcgttcagcacatcccctccgccaacaaggccctccatgactggcaggctggcgcgcatcacacccggtccgcccatgcaaagccggtacgctgtccccctgatcatcaagctcctcccaaagcattactgcgtggtacacccttacaaccccccagccagctcacctgtggggtcccactggacctcagtggccatgtagtgctcgccagcagacagcaggctcatgtcctccgtgtcccagaactccatgagcccattctgggtttgctgcagggcgccgagcgagggggggaaggggggttcagagacgagggaaggcaggcggctgagaccatgcgcctgcggctatatgtttacgttaccagcggccccggcccagctacggcatccaggactcccaccccttcttnnnnnnnnnnccaggcggctgagaccatgcgcctgcggctgtatgtttacactaccagcggccccggcccacctacggcatccaggactcccaccccttctt

SEQ ID NO: 43918 - DNA, 61 bp, Chlorella protothecoides
ggaccccaacctcgcgctggacgagctgggcgtgccctggggcatcgcgctgaccctgacc

SEQ ID NO: 43919 - DNA, 61 bp, Chlorella protothecoides
gcctcggaggtcagagaggcctggcgggagggcaggtccccgacgccggagacggtgcggg

SEQ ID NO: 43920 - DNA, 61 bp, Chlorella protothecoides
agttgcgatcggcaggtgctgacggcgaaggtgggaaagtcatgggtctcgcaccagtgcg

SEQ ID NO: 43921 - DNA, 61 bp, Chlorella protothecoides
acatattctactgcaatgttctgttcgcgcaccagccgcttccaacaggctgcctccctgc

SEQ ID NO: 43922 - DNA, 61 bp, Chlorella protothecoides
gtgccggtgtcttgccgggaagcggcgggggggtaggggttctgcagtactggtgattgct

SEQ ID NO: 43923 - DNA, 92 bp, Chlorella protothecoides
gcgccagcgcctgggccaggggcgggtgggcagcggtgtcactcccgacctcctcgccaccggtgcgggccttcttgagggccggctgcgcc

SEQ ID NO: 43924 - DNA, 71 bp, Chlorella protothecoides
gcccgagcgcacttcctcaccgaagctcccggacgcaccccccccccatcctttgcaggagagcgtgctgg

SEQ ID NO: 43925 - DNA, 61 bp, Chlorella protothecoides
ggggccctgtgtcccagcaggctgcgtgcccaggacccaccacgagcccgcccagcctcgc

SEQ ID NO: 43926 - DNA, 61 bp, Chlorella protothecoides
gggaaggtgggatgcttgctcatggcaggggtagagagaaacatgggcttgtaacgatatc

SEQ ID NO: 43927 - DNA, 77 bp, Chlorella protothecoides
ctcctcctcccagccctcccccatcccctctaccacctcttccgccactgtctcctcctcccagccctcccccatcc

SEQ ID NO: 43928 - DNA, 61 bp, Chlorella protothecoides
gttccatgcttccactaccactccggaaagtttttggagaccggccatggcgatcggccgc

SEQ ID NO: 43929 - DNA, 79 bp, Chlorella protothecoides
gcggccccgacgcccgccccgccgtggtggggaccccgcccctgcgccccctgcgcgtgccctgccgcgccggcctgtc

SEQ ID NO: 43930 - DNA, 150 bp, Chlorella protothecoides
agggggggggagggtgggagctctggcagggtggcgtacccaagaaccggggcctggcatgggagccaggtcctgcaggcaggcccgggaggctgcatgggttaacaacgccgtgccgtccgccgtgagtttcacctggcccgagggggg

SEQ ID NO: 43931 - DNA, 61 bp, Chlorella protothecoides
gcgcgcatcagtacgccgctgggggggggggggggaaggcatgcgcactccatgcccctgg

SEQ ID NO: 43932 - DNA, 61 bp, Chlorella protothecoides
ccgccctgcatagcagcggacgcaggagggggaacaggcgtgctcctggataattgcaaac

SEQ ID NO: 43933 - DNA, 61 bp, Chlorella protothecoides
ggtccagcgcctcgcgccgccgcgcctccaggtccacgacgcggcgcagtgcggcctgcgt

SEQ ID NO: 43934 - DNA, 65 bp, Chlorella protothecoides
taaacctaaacctaaccctaaccctaaccccaaaaacaccactcaacagggagggttagggggag

SEQ ID NO: 43935 - DNA, 61 bp, Chlorella protothecoides
agccctgggagtacctggccaagaggcgggggcagcaccatggcatgcgatttgagtatgc

SEQ ID NO: 43936 - DNA, 61 bp, Chlorella protothecoides
agtcaccggtctccacgtagcactggctgggatccaccgactgcgctgcaatgtactcgtt

SEQ ID NO: 43937 - DNA, 63 bp, Chlorella protothecoides
gttgcgccctcctccaccgccgtcgatcgtgacgacacccacgtcttccgagtcaatctgcgc

SEQ ID NO: 43938 - DNA, 146 bp, Chlorella protothecoides
ctcgcactggaactcactgttgccccttttccccatggcctcctgtccttactttcccatctccatcccccgcaccccctcgcttaacccccccaccctccctaccgccgcagacgccgagggcctggccgcctggatccccaggc

SEQ ID NO: 43939 - DNA, 1358 bp, Chlorella protothecoides
  modified_base (194)..(203): a, c, t, g, unknown or other
  modified_base (576)..(585): a, c, t, g, unknown or other
  modified_base (812)..(821): a, c, t, g, unknown or other
  modified_base (1020)..(1029): a, c, t, g, unknown or other
cctcgccgccggtgccgacccgacgctggtggactggaccaacctgcgctcggcgctgcacctggcggcgctggggggccacgtggccacgctgcgcatgctgtgcgacgagggcacgcgctgggcgccgcgcggcggcaccggcccgcgcccgcccggccccctgcgcgacaccgtgctgccggacgcccagnnnnnnnnnngccggcccgcgcccgcccggccctctgcgcgacaccgtgctgccggacgcccaggtggggcaggccaagttcctggacctgcgctcctacggcggcctcacccccctgcactgcgccgtggtgacggggagcctggaagcggtgcgcgtgctgctggccgccggcgcggccatcatggtgcgcaccgacggcgaggcctttgtcggctccgagttcctggtcccggggtccacgcccctgcacatggcggtgctcatgggccacgcatccatcgtccatgccctgctgcaggtgtgggcagtttccttgtgtgttctttgagtgggtgggtgtggtgtgtgtgtgaggggccggggggggggggggggattcnnnnnnnnnngcatgcatccatcgtccatgccctgctgcaggtgcgggcagtttccttgtgtgttctttgagtgtgtgggtgtgatgtgtgtgtgaggggggggggggattcgaaggagggtccgcctgtctgcagcggcgcccgcctggctgggggtgcgccacaaggcagcgccggcaatgggcctgacctggcagaggggacgggcagcttgttcgactcatgccagtgggagnnnnnnnnnnaggaggatccgcctgtctgcagcggcgcccgcctggcggggggtgcgccacaaggaagcgccggcaatgggcctgacctggtggaggggacaggcagcttgttcgactcatgccagtgggagccgtggcccggcccaatgggctggcggaggctccagacaaccctcttggtggtgctgcaacaggccatgtgcatgannnnnnnnnnagttcatgggggccatgggtcagaccctggacgcgcgggggcggcgcccctgggagggctcctcccgctccgacatccgctcggtgcgcaacagcctgcggcgcctgcccttccacctggcacgagagcgcgggctgcccgcgctgcaggccctggtggacccccgcgtgcccatcgacgtggcgctggacgcgtcgcgcgactccaaggccggcatcggccccaagcgcctgtcgaccctctgcgccatgtgcctgcaggcggccctggtcgactggttggacgcctgcgcggcgcaggtggccgccgagggcacggcccgtggcgcc

SEQ ID NO: 43940 - DNA, 61 bp, Chlorella protothecoides
cactgccattcgatgtgtggcgcgggcagggcccctgccctttgagatcgctgatgctggt

SEQ ID NO: 43941 - DNA, 61 bp, Chlorella protothecoides
ccgccaacacccccgcaccatttgcaagcgccccaggcaatcactgcagcatgtcgactag

SEQ ID NO: 43942 - DNA, 61 bp, Chlorella protothecoides
tcgcccacgttgtcggcgatgacggcgggggtgcgcgggtcgtcctcggggatgtccttct

SEQ ID NO: 43943 - DNA, 103 bp, Chlorella protothecoides
cagcaggcccgcccactgcgccgggctggggccggccgcgccgaggccgcacaaccaggcgacggtgtgagggtggggcgcctgctgcgaggcccggagcgcg

SEQ ID NO: 43944 - DNA, 73 bp, Chlorella protothecoides
ctccgccccaacccctcgccccaacccccctcccaatcccctgcctctcaatccactcactgctgcacgccat

SEQ ID NO: 43945 - DNA, 61 bp, Chlorella protothecoides
gtacaagggcatagaacggctacccagaggggctcttctcctgccacattaccgtacctcc

SEQ ID NO: 43946 - DNA, 131 bp, Chlorella protothecoides
gttcagctcgccgcgcagggcgcccagcgaagcgcgcctcgcctgctgggtgggagggtggggccgaacggtgctgggcagggatgtttcaagggggggggtggcctcaatgccttgcagccgcgatagca

SEQ ID NO: 43947 - DNA, 119 bp, Chlorella protothecoides
atcctgccacgggcaggcgtccgcggccgctcctgcggcgacaaacgggcgccgtttccgccgccgccgaccctcgccctcgtttggcgggggggctcgccgtgcgggggccctgccgc

SEQ ID NO: 43948 - DNA, 61 bp, Chlorella protothecoides
agggcgacggcatcggccacctggcgggggggggaatagggcccagtcccggccaggctgg

SEQ ID NO: 43949 - DNA, 22127 bp, Chlorella protothecoides
  modified_base (125)..(227): a, c, t, g, unknown or other
  modified_base (784)..(793): a, c, t, g, unknown or other
  modified_base (1372)..(1381): a, c, t, g, unknown or other
  modified_base (1445)..(1474): a, c, t, g, unknown or other
  modified_base (1709)..(1786): a, c, t, g, unknown or other
  modified_base (1914)..(1923): a, c, t, g, unknown or other
  modified_base (1993)..(2002): a, c, t, g, unknown or other
  modified_base (3121)..(3130): a, c, t, g, unknown or other
  modified_base (3893)..(3902): a, c, t, g, unknown or other
  modified_base (4442)..(4451): a, c, t, g, unknown or other
  modified_base (4531)..(4670): a, c, t, g, unknown or other
  modified_base (5791)..(5800): a, c, t, g, unknown or other
  modified_base (5999)..(6044): a, c, t, g, unknown or other
  modified_base (6241)..(6250): a, c, t, g, unknown or other
  modified_base (6329)..(6338): a, c, t, g, unknown or other
  modified_base (7244)..(7253): a, c, t, g, unknown or other
  modified_base (7389)..(7491): a, c, t, g, unknown or other
  modified_base (11552)..(11561): a, c, t, g, unknown or other
  modified_base (12050)..(12059): a, c, t, g, unknown or other
  modified_base (12743)..(12752): a, c, t, g, unknown or other
  modified_base (14076)..(14085): a, c, t, g, unknown or other
  modified_base (14298)..(14307): a, c, t, g, unknown or other
  modified_base (14644)..(14653): a, c, t, g, unknown or other
  modified_base (18317)..(18326): a, c, t, g, unknown or other
  modified_base (21521)..(21530): a, c, t, g, unknown or other
gcgcagcgcaaacggcgccgcgcgcgcgaacgtggcctccgccagtcgccgcacccagcggcgcgcagcggggtcgggcaggcgcgggcgcgctcggcgggagaggcgcacgaaccccacccggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgccgccgggggcccggtctcggtctggctcgactggcacgccgccccgccgacatcgaccaccccccttgcccccgccggccagccgtactgcaggcaagacagcgcggccgcagccagggggccacgcagtggcacgccgcggcggcgcgccatgcgcagcacggcgcgcacggcgggcacgccgccgtccacgcgcgagaaggcgttgagcaccgaggtcagcagccgcgcgtcgatccgcaggccgtgccccgcctccagcgcggccgccagggcctccacgcgggcgggggagcccgcctcgcagtactccagcagcagcgcccggcggtgccagcggttgggcggcgtgggacctgttgtgtgaagttcagggggtcagggggcggggttcatggccaccgccaagggtggggggcgtggcctggtgtcagggtcaggcgcggaatggggagtcctggtccctcgagatgctcccccgcttccccccagcccccaccctccgactccgcacaccctcgctcatctcccgcagcacggccaggccctcctcnnnnnnnnnntagggggtctggggccggggttcatggccaccgccaaagaggggcggcgtggcctggtgtcagggttaggcgcggaatgggagtcctggtccctcgagatgctcccccgcccccccagcccccaccctcctgcaccgcgcaccctcccgcatctcccgcagcacggccaggccctcctccggctgccccgccccgccgtgcgcgcgcaggaagcgcatgcccagctcgccgtccagcgggatgccgtcctgcgccatgccggcgcgcaggcccggcagcaggtctgcacgccccgtcagcgcgcacgcccgcaccgccatcatgtacattccggcgtgggtgtccgcggccggtgcggcgcccgcgtcggcggctggcgtggcgtgcggacccctcgccccctctccctccccctccccgacacccgcccgcagcgcctggcgcctgtggccgcggaaggcggcgagcgcggcgccgggcagccccgcgcgcatgcaggccgccatgacctggccgacggcgaagcggctggcctcacccaccccagagcgctggacctcggccagcacggcgggcgcnnnnnnnnnnggcgcggaggagggcagtgaccacgaagggtgaggccaggagggcgggggactcccggagcagnnnnnnnnnnnnnnnnnnnnnnnnnnnnnnaaggcgcggaggagggcagtgaccacaaaaggtgaggccaggagggcgggggactcgcggagcaggcggcgccagtgcgccagcgccgcgcccgggtcgccggcggcgccggccgcctcgcagtacttggcaaaggtgtgggggttggccgcgccccggccccgcatccactccagcagccggagggcgaggcgcgcctgttgccgctcgcccagcaccttcaaatgggtggggnnnnnnnnnnnnnnnnnnnnnnnnnnnnnnnnnnnnnnnnnnnnnnnnnnnnnnnnnnnnnnnnnnnnnnnnnnnnnntgtgtgtgtgggggggggttgggggtgatgcgccaagcatagcggtatgggaagcattatgcgaggtgcttcacagcaactccacgtgcctgttgcgataaggaggctagcaagtagagaactttggnnnnnnnnnnggttggggcccggcgctgtggtgttctggccgccctccacattgcgcagctcgggtgagaggaggtcctnnnnnnnnnnagactcacaccgcaccgccgcaatctgctccccgcactcaggccggtattcatcaaagcaaaaaagtcccccctcccccgcaatgaagaccgtcaccttgatcacccagttcagcgtgtgggtgggaacggtgctcaggtaggcttcgtcgaaggagccagacagcaggtgagccacgacctcgccctgccagatcttgggtggctgcctgtatgtggcgccgatctcgaggcccaggtcgtcgagatgatcattgtgaacgttgggacacggcgctgtggtgtgctggccgccctccgcattgcgcagctcgggtgagaggaggtcctcgtgccaggtggacctgaagtcggcttcgagacgctcaaaggtactggcggccagggggggtgagctgcgcgcccggtaccctgggaggccatgcagaccccttcgagtgccagacttggcggtcctgacgaatgtgcaggtggtcgcgccctggaccgggagtaaacaggagacacgcccacatggcaccgcgcgcatgatggatcgatttcgctgcaggattccgtcggtatcaacgcgggcgcgtcattgagcgtctctccgagtttctgtccgaaaccaacagaggagttcaaggccctgagcacctccgtttctcctcggcgagccagacctcgtagtaagatattttataataattgcaatacactgcagagcctaaagtacctgcacagtggccctacgctaacgcatcgagactcggtcgcgcatagctggctctcggcctgccgtgctttgccacgtcagaaggacgtcgacgtgagattacattcgaccatctactgagcatgcatgacctcactagcattcgttgaataataaaaccgcaatgtgtgggtcccacggggtgcgatgcatgtccctagccatcgatgcctgtgcaacctctcgtgcctgtagagatggatgctccatgagaacgatagccattacaagcatacggtccccaactttatgcattactttatactcatgttccatttcaaaaaaaaccatactgcttttgaaaacggaaagagtagagcaggtttagtttaagccttcggaaagcggtacacgactgtacannnnnnnnnnccagagctggatgctccatgacaacgatagccactacaagcatacggtccccaactttacgcattactttatactcatgttccatgtcaaattaaaacatactgcttctgaaaacggaaagagtagagcaggagtttcagccttcggaaagcggtacacgactgtacatcctcaatcacatgtctcggcaaatcggatcctgaccctttccagatcgacatcagagcaaggtgcttgaaggtcgtcaaaccacggtgtccaagcaaataaaccagcattctgatcaacatggcgacctgtgctcttggcagcgccctgtacaggccggccacgcagttccgggcgagccctgctccaccctcgcgtaggtcgaccgtccaggtccatgctcgcggcacatggtacccaggtatggaggacgttgatgccgaagatgcacgttctgaattcacctccttgtcgggaccatgaccgacacaccacctatgagcaggtgccaagcgccccaagcacctggacgggagcctgcccggtgactatggattcgacccgctgaggctgggtgtcaagccggagctcctggcttactatcgtgagggcgagctcacgaacggacgctggtgagcctcattagcctatcaagggaccagatggggaatctgtttttgggaggtattggatatcctgcatagatgcaagggtcctccttcctgtgcataggttgcagctccatacaccctacctaatgcttgttcatgcttgnnnnnnnnnntattagcctatcaagggaccagatggggagttttgttatgggaggtattggatatcctgcataggtgcaagggtcctctttcctttgcataggttgcagctccgtacaccctacctaatgcttgttcatgcttgagccactccacacatacttgttgccatggccactccaccgtgtttcagatggtttgtcaagcttgctcactcacctggaacctctgccagggcaatggcggctgtggctggaatcctgttcacagaggcagtcggtctgcccccctggtggaaggcgggggcggagcagtaccccatcgacaacaagaccctcatccttgtagagattgccacgtttgcggtgctggagggcctgcgggcccggggctgggagaagaccggcgaggtgcgggtcctgaagcaggcaacggtgtttgagttgtgttacctgtgcaaaggacggaaaggggagagtgtggtagccgggcatgtttgatgggcccgatggacaacaaacgcaatgttccgccccgtgtgcagtccggcnnnnnnnnnntgccagggctatggcggctgttgctggaatcctgttcacagaggcagtgggtctgcccccctggtggaaggcgggggcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcctgaaggaggcaacggtggctgaatcgtgttgcctgtgcaatggacggaaaggggagagtgtggtagccgagcatgtttgatgagcctggtggacaacaagcgcaatgttccgccccgtgtgcagtccggcgcatttgggatgcacccctttgaccccgccaagctcctgagcgacgagatgcgcgagaaggaggtcaagaacggcaggcttgcgatggggagacctgaatttggatgtggtggctcacaaaggctggcttgagttggaaacatgagtgcacgatcgaagccgcagcaacaatcgacaacatcatcatgctgtctttgaccactctcatccaatctaccctctgctcaattccaggtggcactggttgggtttgcatcccaggcagcggtctggggcaagggccccatcgagtccctgcagtaccaccttgctgatcccgggcaccacaacagtgagtggtttctgggatcaaataggatgcagtctctgctgatttcaactcgatttgcatctgccccttcactaatagcagcaactcaagtatcataattatgcggcatcaagtctgaaggattattccaacttaccttcccccctttgccattccccctgccagtcttcacaagccccgttgggaccgaggccaccgtggctgccattgccctcgcaattgcccccatcgtcgtcgaggccaacaagtcgctgggaggtgagagccagagtggcagcaaacgtggggggggtgggatagcggtgttggttcattgcttttcatgtgtgtcaccctcgggtggctccatgactttgatgctgcatcagtggcaatgttggctggcaggtgtaggctcaccaaacgacatccctccccatctgcagatgacgaggaggagttcaaccccatccccttgtgatggtcttctgcttgcctgagaagaattcatgtttgtaaggacctcctcacccggctagtcagtttctggggtcccttgagggtacaacgttgcgccctgacaagccccaggtatgccccaggtatgggctcagagctacttggtttgagtgtcatacaacaaaactgcatcaagctggcaaggactcgtaggccagnnnnnnnnnncttgcgccctgacaagcccaggtatgcccaagttatgggctcagagctgcttagtttgagtgtcatataacaaaaccgcatcaagctggcaaggactcgtaggccagcagcttatgagcagctgggtacccgatgggggtgcatgaagagtagcaatacaaacaaaaaggaccagaggggcttgatatgaaggccaggnnnnnnnnnnnnnnnnnnnnnnnnnnnnnnnnnnnnnnnnnnnnnnggaaaatgcagcaggccacacagatgcatgtcaatggcaagagcaatgcaagcgatcacccgggcgcgcgcagtcagtccctgccctcctgcgcccgcgccgcagcggggctgtcccccgggtctggcccgtcgcccgggggagaggaaggcgtcctgcccccgcccctctttccagccccaccctcctccctctcnnnnnnnnnnagcagggccgcaaccagggcagtggtacaggggggcaatggaacagtgatgagtcatagggtggctgagcaggggagannnnnnnnnntccgggtctggcccgttgcccgggggagtggaagatgtcctgcccctgcgcctctttccagccccaccctcctccctctcgtcctcgccctcctcctcccccagcacctccccaagctccgcgctgtcgatgaagtggtcggagatggtgctccccgtcagccggaaggcgcgcaggaccgaggagctggggtccgggagcagtgtgcgccgcggcgcgccggcctcgtcccgcgccgccagcacgatgcggcccgggatgaagggcttgtacacccccgtcctgctgcgctgccgcccgccggcctcggtgacgccgtcggggtgctcccggttgcccatgtgctccgcggcgccgcgcacgtcgctggcggcgtgggacagcgcgcgctcggtgtcctccttgccctggccgccgccggcgccgccgccccaagggaagaaggagctcagcgtctgcatcagctccaggcccttgggcacgccctccttctcggccacgggctcccagtcgaattccaccaggtcctccaggaagctggtgtggcgtgggggatcgggcgttggcgtgagggcaggcgagcagcggcagcaagcaggggggtgggggagagcggcagatcgatgcgatgagaagcagcgtggaccgtgccaacccccccaccccgaccgtgctggagctgcggtcagcatcgaggcagctggcgttgcctgactgcagccacatgaccacgctgcccctgccaacgcgcccccctgacgcatcggacatgccctcgcacacaggcgagcccactcacgaggccagcgattcggcgcacatgcgcggcaccacgtcgtcgccatgcaccaaggtaagcacgacgtctgcgcggggcggaggaaagcgcggcgtgggctgggcgannnnnnnnnngtgcaccagggtgagcacgacgtctgcgcggagcggaggaaagcgcggcgtgggctgggcgagcatggcggggctggcacgagctgcaccacaccctggacgcacaagacaccctctcgtgccagccgacgggccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccttccccgccgtcgccacgtcccttaccttggcagtcccgggcgaggctcaggtccatgcagggcggcgtctcgtaggccacgcactgcagccggcgcgggtccatacccttgcgcttgaagtaggcggtgagcagtgaggccacccccgcgcccagcgagtggccaacgatggtcacctggtaccctgccggggacagagcgggtggggtgggcgggtgggtgggggtgctgacttggagcggcagcacctcccaggacctgccgccaggaagggcagggcggggagggatctcggccgctccaagctcttccaatggggaggggaggtgcaccaccaccccggcccccgacccttgccccccctcacctgcttcctgcatgggcatgaggagcgcgcggaagcgggcgctgaggtaccgcaccgccttgcacatgcctgagtggcacaggatgtcctcgtcgtcaaaggactcgcccgtggccagcacgtccatgaacacgtcctccgggctggcggtgccgcggatgacgagcagcacctcccgcccttcctcgtgcaccgcgcagaagaaggcggggcagccggagcccatgtccggctcgaactcggcgaagagcagggtatagccccgctccgccagcgcctcgctcaggctcgactcggtgatggcgtcgtagaccaggacggcgtaccgccggtaccgccgcagtgcgcgcagggcgtcgggcggggcgggggtaccctcctcgatggcctctgtcacgggcgcgcggcagtgctcgcagtacatgtagtacatgcgcgccgccagctcctgcggctgcaggtgatcgtgcgacagcagctccgcgatctcctcgttgtcatcccgcatcctgggcaggcgagtgcagggagggagcgtgctagggatgtgagaggggtgcgctgggacgaggcaggaattcctgttctccggggggtccgccgtcctgagtacgtcagagggccagctgggtgacggcctcggcggctttggcggtccatccgggcaaggcacagtctacagcgcaggccttggcgccgcttcagctcgatgcaagcacgccatccccggcggtgacacagagacacattccccacccaagaccccatgcctcactttccaaaggagatggcgagctggcgcagcacgctccaggcgcccgactccatgccgtccccctccggcacccagtcccagactgactcctgctccttgaagccgtgccggcgggcggtgatgaccaggacgtaggaggcgcgcgccagtgtgcacagcgcgacggtccgccaggcgatgcccaggggcttgcccgggcccaccgcatacgccaggatggccagctctgtgcccaccaccacggcgccacccttgggggagaaggtgaaggccaggccctcgactgcacagggttgtgtgatgtgtaggggcactgcttctaacatcggggtgcaaagaggattgcaagacaggtgctgggtatgaaattccaacccagagcacgtcggcgcggtatgccgccatgccgccccacaacctactcactgaaggcatgagagagtcgggcgatgagcgtcgtgagcatgcccgctgtaaaaatggcagctttgcctgcgttgccgcggtgggcgacggccttctccggcatagtgacggccgtgcgatcagacccgcggcaagctgtgaaggaagatggacccttgggaaaagaatcgtgcactccccacatctgcgctgcccttggcgcgccaggccggtgggcttgatctccatgtctcttgatgtcgtggatctccattgcggcccccgatcgtgtttcgtacagtgtacagccaaacgtctctgatatggacaaggacggcaactctcacaccagacaagcatgatggccaaggagatgagttccagacggaggacctgagagcgagggggtgtgacaccccccgcggccctgaagtaaactcagagcgaggcgtcaaagtcaagggaccgcacggggtcaaaagtcaccctgtccagctccctcgcggcgacatctgcggatagggggatgttggcatgtggaggtattgagctgtggtgtccgtgcttgtcattgcgccccgaggcatcggatgccacacgtgtgccaggcattcagctgtttccacaacccccccttccccatgcccactccccaaaaagccctgccccacacgctcgcctgtcactgagcaggcggggtagcgtatgcagtagtccaaggtgaataccgtgaggggcacggccaggagcaggccccagacgcccagggagtgctcggcgaagaccagcactgacagcaccaggagcgggtgcagcttgaggtgcgcggagtagatggctggattgaggccgtacgcctcgacaaagtgtacgcccgtcaccatgaccagcaccagcgccagctggtggatgtgttgggagggggggattgaggagggaggggccgcaaggggatctcacgggactcagcaaggttgccagggtgaagggggcggggtcgaccccgcgcctcacaacccacacccgcgcaccttggtgaagccgtactctgtgagcgcgacaaatgcgatggggaaggtggagatgatgacgcccgcgatggggatgaagccgcagatgaagacgaagagggagagcaggcccaggcccgggatctggagcacccacatgcccagggcggtgaggcaggtattcaccacagcgatctgggcctggcactgcagggccttgccgaagagggtggcaaagacctccagggagggcgccacggtgttgtagatgggggccagacgggaggtgcgcagagaggagacgccaaaggcgatggtcggcaggtcccataccatcataaaggacaggatgagggacacacccagctgcaggatggggaggggagagggaggggggaagggggagtgtgagaggtgtgcagggcaggtggcacgaggtctgagagggaggtggcgacgcaggtgttgtggtggtgagtatgaaggatggagggacggaggctgggagggtgcaaggacctcgaaggatgaagatggttgctcgtgggaggatgggaaccctcactcgacgatgcggggacagagaaacagcaggagcacagtgaaagcatgttgaaaaatcgaggcaaacgtcgcctgctcaggctaacaatgcacgcgtgtgtccaaaaatggcctcagattcgcctttactgtcagcatatgccacgcactgggtgctgcggcggtgacccgggcacagggggggacccagcagcggccgaggaggctgccgcgcaggccccctctgcgccccagggaacgagggggaggggcgagcacgggcgcacggtgcctcggccacgccgccaccttccctcctaattcgcccctgccggtgagggcaagggagaaaggagggagggcagcatggccgaggcgccacccagggcccctccagtcgttcttagattactgatactctcttcatgggcagggaaaggggacaaaaccaaagctgccagggccaaatcaagaagagagacgagggtggtatcagacatgttggcatcctttgtgcaaacgatgtgggtacagtgtgggtaagaaagttacgactgcctccggcctcccaaagactgtgagccggcggcatcaagaggagctaccctgccacactccaggtctttcttaccagcccctccatccgatgccacagcttgattccactctcagattccccttccaccaccccgcccaaacaagacctggatggcaaatcgggaggtgaaggacagaatctccgtggtgaaggtggctgcggcattggtgtactgccgcagtaccttctgcagcgccacccccaggtactgcgtccgcgctgtcccgatgacctggcgtgggtgacgatgggtgtgtagtcgggatgttgctgcgagcgcaggcacgccccgcgcggcagacccccgcagcgcctgtgccacctggatttgagacacctgggcgacagcaccccctcccnnnnnnnnnnggacgatgggtgtgtagtcgggatgttgctgtgagtgcaggcacgccccgcgcggcaggccccggcagcgcctgtgccacctggacatgagacacctgggcgacagcaccccctccctaggatcccacgccctgccccgccgcgctctcccacactcaccgcatccagctcagtgtagttgatggcgtgtgtcacgtcctcgctggaggcgatgaggaggaagcgctccatggcgtccatcacgccatcactgttttgggtggaagggattttgagggaggttggttggttggttggggcaatggaacgtggggtgggcggccagacatgggcacacgtcgaatggtcgatctgagaagcgcagcgccggtgctgcaaccatgtcggattctgtcattacagcaagcagtagaaattttggccatgagtcagcttccgtacccctgtatgggtcccacaccctgtgattgtcacggctcccttccccannnnnnnnnntgtcgaatggtcgatctaagaagcgcagcgccggtggtgcaaccatgtcggattctgtcattacagcttgcagtagaaattttagccgtgagtcagcttccgtagccctgtatgggtcccaaaccctgtgattgtcacggctcccttccccatctgcaccagtccccaagcaccccagcctttctcctgctccaccgcaccaatccacgacaacccatccaagtaaaagtcactcaccctaggccatcgcgcatcttctgcaagaccaccacccagatgttgtcggtctggaggcgctgaacaaagtcgaaaccttcgcgcacaacatccgggatgatgaggacgccaaagaggcagaacatggagatgatggcgatgaagtaggcagagaccaggacgtgccggcgcgcgctgggcgtcagccggcgcagcaggggggtgttctgggccgagttcacgaagccgttgccgatgaaggatacgatgaaggtgcccatcatgatctggcgagcggggttgggttggtggtggcaggggtgggtgcttggggttccgagtcgaggggaatggcaggaaccaagcatcccatcgccacacccatgtaggtcttgctcccaccaggcaccgacaggttcccatctgttcctcctccccgccgccaaagagactcagcaccacgcaccnnnnnnnnnngaggggtgggtgcttggggttctgagttgaggggaatggcaggcaccaagcatcccatcgccacccatgtaggtcttgctcccaccaggcactgacaggttcccatccgttcttcctcctcgccgccaaagagactcagcaccacgcaccccaaagaattcgcgcagctggtaaaacgtaaaggcggccgccgcccaggaggccagcttgggccagggcaggttgatgccggcatccaccacgtctgacaggctgcgtgccggcccctgccctgctgggaccctggatagggagggctgtgccgtgccggtgcttgcgccagccaggtcttcaggatccagcgcaccgccattggaggcgtgcggccgatggcggggtgggatgcacgtcctggtcggcgggaccgttcggagctggggggtgaggctgggggcacaccccctcgaggccctccccaggagggcgccgcggggcgtcgtgaggtacaaggtgcattgcatggccattccctggcgcccggggttcccctgtccgctgaggcagcaggtgacaccgggggggctcagcacatcctacgtgcgagctggggcgccgcgagactgtcagacggggtgcatgtgtcggatttcgagatcggtgggccctgaggaggaatgatgatctttcgacaccatccccatgccaagccggggatggctggaagatgctgctcagggaatgatggcgcgatgggtctcccttcccggagcatgctcgacagcagggaattcgcgcccgggcgcgaacaagctcccattgcttggcagttgtgaggactgcaatgcatgtccacagccgacatattcagacggatcatctcaacacattttacttaagcgacacctcctgccccccggcctgaccagcttgcatgtggctggaggacgtcctcctgggggccttgagcgacggtgtcaacgtgggagcatggggactggggattttgcacgagaggatgtaaatgtgatgtggcatggaatttcgaaaggagagccgcgcccagagtgtgcaagcgatgtgctcgtagttttacaggagccccccaccatgcccacatcccgaatcttgagtgcagaaacccacgctgatcctgctgaacgtggtgctgaccgcctgcgcgctcaccctgcttggcctcctgtacgctgtggggggaagctcgccagacctcctcctgcacctgggcgccgtgctcctgctggcagtcggcctcactgcctccatcaactggtgggcggctgctttgggggtgtaggggggcggggggaggagattgcattgtgcnnnnnnnnnntcacctgggcgccgtactcctgctggcagtcggcctcaccgcctccgtcaactggtgggcggctgctttttgggtgtaggggggtgggggggcggggggaggagattgcattgtgccgacactgtacctgagtgagcacgcagtgcgtttggtactgttgtgccctggtgcccctggtgccaccccataccctcccctctcatcctccccacnnnnnnnnnntcgtacctgagtgagcacgcagtgcgtttggtgctgccgtgccctggtgcccctggtgccgccccataccctcccctctcatcctccccacaggctggtgatccagaccgggacgacggccgtggaggagcagcgcaaggccatctttggcgagggcgacgcgcgtgagaaggcggagtgagggacgctcctcggcggcacaccggagcgcgagtcgggcgccatgctgggccggtgggctgttcaaggcacgcgctcgtcacgcgcctgtacgggacgcgctttccactgcaccccgcccacccatgaccgcatcgccgtgggcatctccggcggnnnnnnnnnnccggagtgaggaaagatcctcggcggcacaccggagcgcgagccgggcgccatgctgggccggtgggctgttcacggcacgcgcttatcacgcgcctgcacgggacgcgccttccactgcaccccgcccacccgtgaccgcatcgccgtgggcatctccggcggcgtggactccgcggtggcggcactgctgctgcagcgcgcggggcacgatgtgcagggcctgttcatgcgcaactgggacgagggggaggagaccgggaaccgcaactgctcagtggaggccgacgcggccgcagcggcgcgcgtctgccgccacctgggcatccccctggccgaggtggactttgtgagcgagtactggacgcgcgttttcgagggtttcctggcgcaggcggggcggggcctgacccccaaccccgacctggcctgcaaccgccacatcaagttcgacctgctggcggagcgcgccgccgcgctggactgcggcgccctggccacggggcactacgcgaggctggagcccggcgacccgccacgcctgctgcgcgcgcgcgacgcggcgcgcgaccagacctacttcctggcctcggtgcggcctcaggccctggcctacgcgtgcttcccgctgggcggcctgaccaagcccgaggtgcgcgcgctggcggcgggcgcggggctggccgaggcggcggggcgtcgctcctccgccggcatctgcttcgtcgggcggcgccgcttcggcgcctttctggagcagtacctggcgccgctgcccgggcgctaccgcgacgtcgactccggcgccgacctgggccccgccgccaacctgctggcgctcaccctgggccagcgcgcgtcggtcggcggcggcccgcagcgggcctacgtggcaggcaaggacgtgtgcgcgcgcgtcgcgcacgtcgccagcggcccggaccaccccgcgctgcgctgccgcgccgcgctcctccgggcgccgcactggctggacggcggcgccgccgccgcggcgctggcggacggcggggagctgcgctgcctgtacaaggcgcggtacgggcaggagccgctgccctgcacgctgcgcgcgctggggaggggggggttccggacgagcgcgctgtgcacgctgctggaggaggacgagcggatcgggccgggcttcctggtcgcgcactttgacgagcccgcccgcgccatcacgccccagcaggcctttgtcatgtacgacggcgagcggtgcctgggcagcgccctcatcgccaagccggggcccagcctggccgaggaggccgggggggggtgcctggatggcgcatgcccggcagcggcggacgcctgagagggcctgtaattctgcatgcacgacgctgactgtgtgcggcggggggcaaatgtcgagcactcatgcatcctgccctgaacctctgaggtgcgctggtgtagatttagggacgcggggcctcctgacctccttgatcgtgggaggggggccggggatgggatgaaccattaccgcgccctgtggggagattttcgaacgctgaaggagcagatgcccggctcgcgatcacgctcgcactcctcgtggcgcatttccagaaacagcacccgcaggatgagacgaatggaaagaatcgcattgtgctgtattccaacacaagctgtgcggtgcatggcactgacttttacgaattgatcacaaggaccataataagccatgaccgtgcccaacgagtacgagcggcaaagattggctcgaatagagcgaaacgacaaactattaaaggtgtggtggtggctcccgggtgtgattgaggcacaggatttagttgctttaagagttatccgcaagaccctgctgccctaaccttcacaggagcttggcatacagaggtgtcacacaactgtggcagctagacctcccaagtccacccgtccccgtgtcaagccagacaaccttccagatgaggggggaccacgccggcgctcccgtaggcttcagggatctgaggcggatctgggtgacgacgtgactggccaatctcagttggctcccaaaaggtacccgtccatgtgcagcccggtcggctgtggcgcagggcctgctccagagtgccactggacagtgatatgcatgacaaggcggtggagatgggagttcagcacccagccccccggcaccccctcctatgcaaacacagcatggatcaccgcggcagggtgaaggcgtatcggcccccgccggcgatggacgagtcggctctggatgcacacaacgtgcaccgcttcaggaccatgtcccacgccgcgctgcagaagcgcatctggaagatcaggcggccggagaagctccgttcgttcatcaatgtgagtggctttgtgcgtgtcaggatgcagtgacggcggacgcagaggtcccccaagattgatggagagagtcccaaggcaacaggcactgacaccgcctttgccctctgcctcccacgcaggtgctggaaggcttccaggaggccgagctcgcggaagaggctcggctggccctgggcgaattggaagggagttgagtcctattctgagaagcgctatcatggccctgacccggctcggctggcccagacaggcacgcctgccgcggccctcgagtgtgcttgccacattacatggcactctccaaacagtgcgagcagctgctggggacccgctccccccagctgccggggcggcgatctgacgggcacggcccaccggcatcaccccgctcaactgctcactccccaccccgagtcaggccaggcccaggtgccctccctgcagcattgcggtggccttgcgcagcgcgcccagcgtgccccacatggacgccaggttgacggccagcgcaccgcccgccacgcgcaccgccaagcggccagcgcccacctggccctggcaggcggagggcaggcgatccaggtaggccgcggtgcgctggtgcaggctgggcagggccagggctttctcccacttgtggcgccaggcacgggccgtctcgcccgcgtcgtggatgcggtcgtcagagtagccggcttcctggcgccgcagcgcgtcggcggtgcgcttggcgttggcccgcgtggactgcagcgccagccggttcccggggtcggcgccgccggggtccagcccagacagcagcgccagcgcgtccttgtgggtcaggggggtagattgggagcccagacgctcctccactttcctgaagaggtgtaatggaaaggatggtggtgagaagggaataagggagggggtgctgtcagcccggtagggagtgaaacacagcactgatccaaacctggacttcagaggagcaagcccccacaaaaacaacgcacctgatcaggccggaggtggcggccatggcacgctccaggttgctgagcagctgcgggtactccttggcggtcagggcctcgctgccggtctcatgtgcctccagccgcctgatggtctgcgtaggggaagaggggagggggcatgggatcggggccaggagatagagtcaacttaactctcatcgcagcttggtcaggccaatgtagcctcccgatgccaccacagtctgcactatcagttgggccagattctattgattgagcagggccacccctgcagcacgnnnnnnnnnnaccaggagattaagtcaacttaactctcatcgtagcttggtaaggccgatgtagccgcacgatgccgccacagtctgcatcatcagttgggccagattctcttgattgagcagggccacccctgcagcacggctggagcacatgccatcgctgaggaccccttcacccctcctgcacccaacatcccacctcctcggtggcggcgaagagcacctccaggtgggcctccagcatctgggcgtcctccacgctcagctccgccctgaccctctggctcagggcgtgcagcttcccgtcgccttcccggcgctgcctggtcagctggcgcaggacctgctgggcgtgctgcttgaagcgcgccacctcggcctggatgtcggacgcgtccgacaggcgccaggtgtgcagcaggtggtagcgccgcagcttgtcggcggcctccggccccgacagcagcgcggagtcgtgctggaactctgtcagcgtgtggtccatggctgcctgcgggggtgttggctggatgcgcgtcggggctcctggccagcgaatcgggtggctggcacgcactgccaccccacaccctgcgggagcccgaggcccccacattgggaaagtacagggccccgcatacccgcgatcgcaaaatcctggctgccgcgttttcttccccatgccagcactcaccatgcgcagcttcaggacgtccagcacagcactcttctggccgctggcctcgtccatgtccattgccagccgctcctgctggagctccagctgggccatggcgcagtcgaccatcatggtgcgcgacacctgcgggaattgcgcgacattgctcttattagctgttgccggggcccgaaggggtggagcaacaccacccacccgtcatctactcccaaagcatgagtccacccttcacctcatctcattcccattccaagatacccatgtgctcagagcagagcaagctaatccctgcctcacacctgggacaggaactcccaggctatgaccagccagagcaggctcaggacaaactgggctgcggcggacttgagcccatagttcaggtgcacccatagtcccaggaagccgctgaacagcagcaggcccccaagcaccagtccatggatggccagagacgcctcaggctgtatggaggagatgacggctaggcagggccccagcagaatctgtggggccgggaaagggactcctggaccaaacagacagtgaccttgaaggaagtcacgtctgtagaggacccacagccgcgtgtgcagcgcaatgcaatgacttctttctccttatccaagagtaaagggaatgtcaggacttagcaatgcactggcccatgctctgctacatcgcgcgcccgcggcgtacctgagctgcgtgcaaggcaaagggccaccagctgcctgtcttgcgccggccccgggcagaccccttgggtacgacgaagttcattggttagcattacattattcctggcgcgaccgcgaggtgtcaaacatgcgccatgaaaggttacggggggggagccacgtgggtcccatgggtcacgccaaggtgcaagccgcaactcttcttgcaattcacttgaggacctcggattgggagacaggcaatatggctggtgtggtaaaataggtttccactcgtctttgatcagcacaaagtatcatcttgtcgtcctacacttgccctacaaggagctaccaccttgagaggttgtggtagacgcgagatgggcatgttgatgaaatacttgctcaaaccgactccatagattctatctcacacataagcataacatgaaaagttcagcattggtccgtcctgcatgcacgcttgggctgcgcagcatcggcaaggtcccttgccttgtggcatgaggccaggtgagctttagttgtctatccccagctcccttgaatgggcaatggaattagacgattgcatgcataggcagacatcgcaataatcctgcattgccccgtggtgcgggatatgcctcccgcactccgtaagtgatctggcagtcttcccctgtggaaagggggactctgtgcccatcgtctcgggcgtggcaaaaggtgcccacgccccggttcccgctccataccgcgtaaaatcaccttggcaccgatgacggtgtcggcatgactcgccagggcaagagggcaagggagcacagtcgaacacccaggagccccgataaggtctcacgtcaggcctcagaagcgcccctgcccaccccagcccaagaccagggccccacagccccttccaccgagcacagactcacccgacatcgggccagggtctctggcgagacacccctgcccgcccagcccgaaccggagcgcctggcacatcaccaacctcgggagggggcccaggccgaccatcagccaggcatggacaggaagtccagcgccggaatgcacgtgagattgaccagatgggggtgggggatcggggagtaaagtagaggtttggtgcccgccctgcacatggctccacccccttggatcccaggtccccctgcaccctccggtgggtctgagggggaggccatgcagcgaccttgctgcatggtcactcgcatctccccctccccaaaaaaacaattccccgtttactccccagcatgaggaggaggaggaggaggagaggctgcagcgcgggcacagtgcgctgcagggcctgctgcgccggctgggcgccgggtttgaggacgtgttccacaccggcgcctcgtccgccgccggcggcggcgcgtaccaccccggcaacgcacgcgtgcgcgccgcgctgggccagctgcgctcccacgacgccggcgagcagctggctgggctggccgagctatgcgagtacctggcggtgtccaccgaggagagcctgctcaccttccccgtggacaccgcagtgcccctgctggtgagcgtggaggggtgatgcgattgaggggcggacggatttcgatggtggcgggcatggtagtgagtgttgaaactgggattctggcgagtggaggagtaccacatcataatgacagcccccctttcaaacttcctgtgacgtgtggtctgcggcgcacgaccctttcaccatggggaaccagtgctgcatccacagagcggcacaaatttagaagcagatcctggagtctacactggtccnnnnnnnnnncatggggaaccagggctgcatccacagcgcggcacaaaataagaagcagatcctggagtctacactggtcccctcatccatcacttgagtcttcatgcaccccaacggcccctctattcacacccacccacttcccagatcaagtgcctgaacgaggagggggagccggacgtcgcgctcctggcggcgcgcgccctgaccttcctggccgacgtctccggccccggcggcgcggcgttggtgcgccacggcgcccccgccgcgctggtgggccgcctgctgagcatcgagtacatcgacctggcggagcaggcgctgcaggccctgcagaagctggcgggcgagcacccgggcgcactgctgcgcgccggcgcgctggcggccgtgctcgcctacctcgactttttccccctgagcgtccagcgcgtggcggtggacaccgcagctgcgctttgccgcgcgctgggtgccgacgcgctggaggccgcggccgccgcgctgccgtcgctgctgggcctgctccagtcgcaggacgcgcggctggcggagggcgcggggcgcgcagtcgcgcgcatggccgagcgctacgcgcgcgac

SEQ ID NO: 43950 - DNA, 68 bp, Chlorella protothecoides
ccccccccccccccccacacacacacacctcagcctttcgcccccaccccacccattgtactgcagac

SEQ ID NO: 43951 - DNA, 61 bp, Chlorella protothecoides
acaaatgcgctgaggtctggctgccggcgggggggcggtcatgcagtgttgagtccctcca

SEQ ID NO: 43952 - DNA, 20762 bp, Chlorella protothecoides
  modified_base (434)..(443): a, c, t, g, unknown or other
  modified_base (591)..(600): a, c, t, g, unknown or other
  modified_base (1324)..(1333): a, c, t, g, unknown or other
  modified_base (1465)..(1474): a, c, t, g, unknown or other
  modified_base (2038)..(2047): a, c, t, g, unknown or other
  modified_base (2561)..(2570): a, c, t, g, unknown or other
  modified_base (3879)..(3888): a, c, t, g, unknown or other
  modified_base (4346)..(4355): a, c, t, g, unknown or other
  modified_base (5496)..(5505): a, c, t, g, unknown or other
  modified_base (5713)..(5722): a, c, t, g, unknown or other
  modified_base (6136)..(6145): a, c, t, g, unknown or other
  modified_base (6718)..(6727): a, c, t, g, unknown or other
  modified_base (6779)..(6788): a, c, t, g, unknown or other
  modified_base (6919)..(6928): a, c, t, g, unknown or other
  modified_base (7006)..(7015): a, c, t, g, unknown or other
  modified_base (7599)..(7608): a, c, t, g, unknown or other
  modified_base (8295)..(8304): a, c, t, g, unknown or other
  modified_base (8455)..(8464): a, c, t, g, unknown or other
  modified_base (8980)..(8989): a, c, t, g, unknown or other
  modified_base (9336)..(9345): a, c, t, g, unknown or other
  modified_base (10134)..(10143): a, c, t, g, unknown or other
  modified_base (10664)..(10673): a, c, t, g, unknown or other
  modified_base (11760)..(11769): a, c, t, g, unknown or other
  modified_base (12346)..(12355): a, c, t, g, unknown or other
  modified_base (14000)..(14009): a, c, t, g, unknown or other
  modified_base (14472)..(14481): a, c, t, g, unknown or other
  modified_base (14785)..(14794): a, c, t, g, unknown or other
  modified_base (15162)..(15171): a, c, t, g, unknown or other
  modified_base (15496)..(15505): a, c, t, g, unknown or other
  modified_base (16701)..(16710): a, c, t, g, unknown or other
  modified_base (17208)..(17222): a, c, t, g, unknown or other
  modified_base (17629)..(17638): a, c, t, g, unknown or other
  modified_base (17728)..(17859): a, c, t, g, unknown or other
  modified_base (18113)..(18122): a, c, t, g, unknown or other
  modified_base (18735)..(18744): a, c, t, g, unknown or other
  modified_base (19022)..(19031): a, c, t, g, unknown or other
  modified_base (19604)..(19613): a, c, t, g, unknown or other
  modified_base (20333)..(20467): a, c, t, g, unknown or other
gacggtgggtcgccgctggcgccgctgcccacgggcgcctccccccgctccggcgcttcgtccggcgctccctttgggcgcgggtggcgcgcgccggcggccagccgcctggcccccaccccgcccctcctgcgcctggactcggaggtgtcggagctgtcgcgcaacgtgggcgcgggcgagtaccgcggcatcatgaatctgtgccgtgtgctgcgcgcgggcgccgacgccaaggaggccgtggacgccgccatcgacgcgtgcggggccatcggcgacctgcgcgccgacatcgcgcagtgccgggcctcttgcgccgctgcgacggacggtgagtccgcgatgactgattggaaattacgagggaggggttaaaatcccggggaggtactgatcgtaattgctttagattgaaccagggagcacgggcnnnnnnnnnngttaagatcccggggaggtgctgatcgtggttgctttagattgaaccagggagcacgggcttgtgcttccttgcgtctgcatggcctgcccctttcgtcaacaaacgggacgaagctgctgggacgcctgttgtcgaggtggcctcgnnnnnnnnnncctgcatggcccgcccctttcgtcaacaaacgggaagaagccgctgggacgcctgttgtcgaggtggcctcgtgccgtgcccttccttcctcctcatccccaacaacagttcctcttcccacacgatcaatcgcagacgagggcggggacgtggagcacacgcatgctgcggcctcggcggcgcgccggctgggcctgcactacctccagcgctacttcctgctcatcgcctacatgggctacatggaggccgttgccccgccccgcgacgtctcctttgcgcagtggatgggggagcggcgggagcaaaagtacctgctggccaccctggagctcgagtgagggcgggggagagggtgtgaggaggcgaggggagcgaccaggctgccagcagagagctggacagtggcagggcagccacaaacagggaggcaaaatgcgctggatgcttctgaatggcccttggcaactggcactgcctcgctgacccagtaaaaggcgccttgcaggctggggtatagtgcatggagtcttgggggttatatgcccctggctcttcgccacagaccagcagcccttctgtttgccgtgctcacacacaggcctcccagcatgcctctactcatgcctgtgaatggggacacgatgtactgaaagccggtacagacaccatgcaaaccaaagggactgccgctccgacagaccctccatcctttcctcttcnnnnnnnnnntcaaaaagcgctggatgcttctgaaaggcccttggcaactggcactgcctcactgacccagtataaggcgccctgcaggctggggtatagtgcatggagttttgggggttatatgcccctggctcttcgccnnnnnnnnnnagcgcaactctgctccaacaacgactacgcgccctgattgcctgatctaaagatacttgggaggaagccgcagccctggcacgccccacacctcaacaccttttcactgatcagtggaccagtttgaacacccagtctgctctacccaatggcattgcaggcctgtcacgtagcacgcaccccggccttcgggggcagggtggccaccctcgccacccgcagggtggccacagctgcaggccacggcacattcttcgttggaggaaactggaaagccaatgggagcactgcatcggtgaacacgctggtgaaggagctcaatgaaggtacaccgggcggcggagcgagggtttaggtgctggccgggggtgctgtacgggggcgaacacgggctttagataccttgtgttgaagcgatgttggaaaatccactcgactgcagacatccattggttcccagcggatgaggttgcagggtgtgtggttggcttcgtggaccacctgatcagtgtccttgttacatgcaaccaactacctggtagcctggcctggcaccctggcacnnnnnnnnnncgggaaatccactcgactgcaggcatccattggttcccagcggatgagggtgctgggtgtgcggtgggcttcgtggtccacctgatcagtgtccttgttgcatgcaaccagccacctggtagcctggcctggcaccctggcacaccgggtactctcgactgagcatgcacgcctcgaatctccctgttattcagcggggagcctgcccaagaatgtggaggtggtggtcgctcctcccttcatcttcctggatcaggtccagcagagtctgcaggccccattccagctggccgcccagaattgctggaaggggaagaacggggcctttactggggagatcactgcggagatgctggtggacaagaaggtgccctgggtgatcctcggccactctgagcgaaggtgcggcgccaggggaccgcggggcaaggccggttgtgctgaagggcggtgtcgatgcccatggtgacggtccggcggaagtcttgcatgcatgcatgcatgcatgcaagcnnnnnnnnnncgcccatggtgggggtctggcagaagtcttgcatgcatgcatgcatgcaaacatgtctcccttgcggaccccacagggcactcatgggcgactgcaacgaggtggttgccgagaaggtggcgtacgcgctgtccaagggcttgaaggtgatcgcctgcatcggagagacgctggaggagcgggagacggggcacatttgggacgtcctggagaaccaactgcggtgggtgtgacccgggaggtggggttgagggcgagtgctggagagcttggggttgtgagggggcgatgtgggttcaatgcggtacagctgatggctgtcgcgcggtgtgggcagcctgcagggtttcatcatacatagcctcgtgattggtctcagaggaacagcgccaccacagtcctgtgcggtctcaaccctggcctctctctgtggctgtgtgtctgcgtgacgcggcgcgcctgtcaccgcggcactggcccatgcccacgcgagcactcacaaccccaaacatggccgataccaatgccatacagctggccacgtctcccctccacccatccccctctcccctcacttcacccctgggcaggcatattgcggatgcggtgacggactggggctcggtggtggtggcctacgagccggtgtgggccatcggcacgggcaaggtggcctcccccgagcaggcgcaggaggtgcacgccttcctgcgcaagtggctgcgggagaaggtgggcgcggacaccgccgctggggtgcgtgtaatctacggcggctccgtcaccgacgccaacgctgagacgctggcggggcaggaggatgtggacggcttcctggttgggggggcgtccctcaaggggccgtccttcgtcaccatctgcggcgcggcgactagcgtcgcgcagcccgcctgagggcgacgaaggccggaagaggttattcttccccccatgagaaacgtgttgcggcctgcggcacaggcccttgctccttcccaagctgtattgttccacactggccacatgggatcagcagaactatgtagtgtgctcgttgtatggcgattgaggcagaccccgtgtaagcaaccagaaacgtacagtcgcctgacgtcaccgaccgggacggacgggggtgggagcgcgccacgcacggacgctaggcccgaccagccgaggtcgctgggcagaagtcgacgcagggctggagagccttggaaactggattcgacgttccgattgcacatgccgggcgcctacgaggattgaaaagatggtaacacgcaaaggaccggacctggaaggttgnnnnnnnnnntagattgcacatgccgggcacctacgaggattgaaaagatggaaacacgcaaaggaccggacctggaaggttgtgtggggtagaccaagtgcctgctgggtgctcccacagcggacgcacctccatgctgatgcatggaccgtagactggcgccatgctgcaacccacggaatccatgcgagccctgcgcggtccggatgagctgtcaagcactcccatggacatgccgggcttgcctgcctttgccaggcgcaggagcactcctgcgtctcgctgggtacgtacgggctgcagcctaggcgtgaagacgggttacatgtcgtgatggatgtttgccagccagttgaaggggtgcctgagctggtgctcgctccagctgagtgataaagccctggcggttcccccacaatccccacccaccacctttcttgccctgcagcgcccctcccggtggacgnnnnnnnnnngcagccctggcggttcccttacaatccccacccaccgccttccttgccctgcagcgcccctcccggtggacggggcagcgcgttctcctgggcacggccatgctggcgctgctgacgggaatgctgctcatcctggtccccctctccatcaatgcggcccggcgcacgaatgtccagcggcagactggacacgctccacccccgcccccacccctggtggacgccgagggcgtgcccctgttcggagcgggtgacggcggcggagcgagcgaggacgggctggactgcgcaaccacgctggccgtgccctacgaggcctacgtcgccggcgcggaggccgccgatgcagccctcttcggcgcccccttgaacgacctgtcagctgagcgggcgaacacgaccctggcggccctgtcgcgctggacgctgcgcctcgccttcttcatgctggtggagccggggcagaacgcgaccgggctggccgcctttgccgcaggccaggcagcgctgctgaccgccgccttccgcggcgcgggcatcgccttctcccccgccacggcggtggccgtgccagtcgggcccggaggtgcgacgtgcggcgtggacgccgccggcgcgccgtcacccgccgctctcgatgcgctgggcgccgccgcgcccgtggatgtcatcaccgtcctggcctgcgacctggtcggcggcgtgcgcggtgccagcgccgtgctttccagtaacgcttcaaagatcccggcgctggtgctgctgcaccgagcggcgcttgtctccagcgagacagcgctgatccaccagattgggcacctgctgggcctgccccaccccttcccggaggtcgccacctgcaagcgggacggcgactgtatagccgacacgccgctgcagcacgccgccaacacggggtgccccgacccctccacctccgacatgaacctgtgtccggggaccgacggcgcagtgcccatctacaacttcatggacctcaccgacgacgcctgcaggtgcatttgcggggggggaggggggccctaaattttggggggagggaggtatggaaggtatgggagccaaggtcatgcaggggaagactgcagcccggccagtgggcagagagcttgggctcggnnnnnnnnnnggtatgggaggtatgggagccaaggtcaagcaggggagaccacagtccggccagtgggcagagagcttgggctcggtgtgaagctgagcttggggctccatttgtcgtgctcgccaacctatggcacttctagtagacacaggcgctggcctcgcaatgaacacaagcccacacctcttcccaatccccatccctctacaccttgcannnnnnnnnncatggctccatctgtcgtgctcgccaacctatggaacatctaatagacacaggtgctggcctcgcaatcaacacaatcccacaccttttcccaatccccatccctctacaccttgcaggcgcaccttcacccccctccagacgctgcgcatgcggtccatggcgacagcctaccgccccctgctggcggcggccgcggcgacggcgcggctgcgacggccgctccccctcgccgacgccttccagtccggccccccgccgcgcgctgcgctgctggcccagctggcggcggcgcgggcccggctgcagggcaacgccagctccctgccctgcagccccacggcgctggaggtggaaagcgccgggggggacatggccgcggcatgcctgggcggcgcgggggagggcgcgcgcnnnnnnnnnntgcgctggaggtggaaagcgcggggggaaacatggccgcggcgtgcctgggcggcgcgggggagggcgcgcgcctgctgacggcactgtcggacgtctggcgccaggccgtcggcgcgctcgtcggcggtgctggggtgggctctgctgtcctcccgcccgccagcctggcgctggacggctgcgcgtgcctgggcccctcgccggggtcaaacggcagcgcgccctcctggaccgccgacctggggaccgcagcctatgtggacggcatacgcctcctcttccccgcgcccggccccgccgacgcggccgtggaggcgctgacctggcgcgtcctcgtcagcggcagcgcgacgcccggcaccggcacgccgtgcgcgctgtggacccgcggcgggccggcggcgcggtcgaacgccgcgctggtggagctggagtgcccgcgcccgctgccgggccgctgggtccacctgggcgtggagggctccgatgatgcatctctggccgccgctgtcgccggcaatcgggctggggcggccgtggcgccggccgccgcgctgccgtgtgtctgcgnnnnnnnnnnggcgggctggggcggctgtgccgccggccgccgcgctgccgtgtgtctgcgnnnnnnnnnncgtgacctttgtccccggcacggtgctcgacgtgtggtccagacgccgggccggtggtcgggggatgacaaacggcagcatcagtttgggcccgggccggggcaactgcagcgtggcgggcgacgacgagnnnnnnnnnntctcaccccgccgcgcgtaggagtgcggtacgtcgccgagctgtaccgcgagggcgaggcggggagcgccccggccgnnnnnnnnnngcgtgcagcccctcagcttcctggcccgggatctggccgtgccggcctggccggatggtgaggcggtgacctttgtccccggcatggtgctcgacgtggggtccagacgcccggccggtggtcgggggatgaaaatcggcggcatcagtttgggcccgggccgcggcaactgcagcgtggcgggcgacgacgaggtgggcggcgccagctggcgcctcgagctgggtctggcgccgccccacgtgcgcggcgtgcggctcttcctccccgccccgccgcgcatgggagtgcggttcgtcgccgagctgtacggcgagggcgaggcggggagcgccccggccgcgctctgcgcctccgcgctccccgccgctgcgggcccggtgctggagctggactgtcgcgctttcttccccgccgccgtgattgtcgtgcgcgcgacggggcccggccccgcaccggccttgtgcggcgtggagctcgtcggtgggcgcgaggcgggggtgctgcgccgcctcgccgaccgcgccgcgtcgctcgtcgtccgggatgacccatcgtcccaagcggcctacgcgccgctggtnnnnnnnnnnaccgctttgctcgtcgtccggaatgacctatcgtcccaagcggcctacgcgccgctggtcgtggacgggcggctggacacctgcctgccccggtctgtgaattcggacgccgaggagatgacctgggagctggacctaggcggaaggcccctgccgctgctggcgctgggggtgagtgccaaggcggcaacggcgggcgccaccggtgccgtggcggtcgaggtgcttgacgcagggggcgcaagcctgtggagaacgtctgtattggcaaactccactgtgccgggcatgccagcgatgctggacatgccacgcgggctggcggccaccggcgcagtccggctgctgatggatagtgccaccctgctctgcgagctgacgctggtgacgctggcaggtggggaggcggggctgcccatcgaggcgcagattgactcggaagacgtgggtgtccttacgatcgacggcggtggaggagggcgcaacctcacggccgcactcgccggccgggactaccgcgattgccccgacacggcggcggcaggcgaggacctcgagctggaaatctccctggacggagcgttgtacgggtgagttagtggcatgtttgcgtgaactaaggttgattggtgaggtgcagaaaggagggggggagagggggggggggatcctgacgaccaggacatnnnnnnnnnnaggtgagttggtggcatgtttgcatgaactaaggttgattggtggaggtgcagaaaggggaggggggaggggggggtcctgacgaccaggacattgtctcctgggtttgtcgacccatccagggcaccagcatctcaatgagcctactgcnnnnnnnnnntctctcttgggtttgtcgacccatcaagggcaccagcatctcaatgagcctactgcgctagtgacttagccagtcccataccagtcttagaatctctgagccacaacctccctctccgcagcacctccctggtgcaaatcgtgacggcctcgcccctgaccaatgtgacgctcactgaccaccgtgagggcgcccctggctgcgtgcccagcgtcgcctccaatgacactgtccctgccggaggagtgaccacctggaactgcaccccagcgctggagaccagggagctcgtcatccgggcgcagctggaggatggcgaggacacccctcgaatatgcactgtgagggtatttcatgagctttgactccctcccctcctgtaccctcactgatcttgctcgagccgggactcggccatttgtagcctggccattgtgaccatgaggcatgaaaggctgtggtagccgtcaagttcgccttgtggtcaggggcggggtgcaaagcgtggggcttgtnnnnnnnnnngcgagccgggacttggccatttgtagcctggccatcgtgaccatgaggcatgaaaggccgtggtagccgtcaagttcgccttgtggccaggggcggggtgcaaagcgtggggcttgttgccccccaggaagagggggcttggatgggtccagaggcggtgagggcctggtccagatatcgggcgacagacgctggttgtcaaaggagatgaacaagtctccaacaggcgttatacaacaatgggaaaacggtgctattagtgcaatcacaacacatttgctgtcgtgaagtcgagtttcgcatgaacccgtggccatcaacatgcatgcactgcatgggcgatccannnnnnnnnntagatgaacaagtctccaacaggctatacacaacaacgggaaaacggtgctattattgcgatcacaatacatttgctgtcgtggagtcgagtttcgcatgtacccgtggccctcaacatgcatgcactgcatgggcgatccatcaccgcgagcggtcctgcacaaaaggctctgcgcgcagcagaaaccaactgatctggttgccacgccgcttccataccacacttcattccgcagtccgacccgcaatcaggcagaggtggaccgtctctgtccacccctctcccccgacgcaacgagccctgcttggaaagcagccaatgcaaatctctctgcccgcggctcacaacgaagcactaaatcaagtgccctcatattgacacaaattcgtcattaagtcctatttcttgtgcttgatgaacacgtcaaaagcaatggcacggtgcatggcgcaaccagccaacccgccgcaacccatgggggcactgcgcgcaggaaactggcatcccacgcggcatggggttttgccgtccgccgggcctgtaactgcaatccctggcatgttttgcagatcacaatctgttcctccaactcgattaagccgcgcagtccttgcctgtcaagctttgcatcaggtggcaccttcacctgataccctcgcacagcctgcgcacggaggtgggtggagggcctgcctgcactcgcccctgccatgatggaccgacggctccaccttttgcatcatattactccattacgccctagggttggagcctgaaaccatgcctnnnnnnnnnncgcctgcctgctctcgcccctgccatgatggacccacggctccaccttttgcatcacattactccattatgccctagggttggagcctgaaaccatgcctgaggagaagatcgagtacaaggtcgccgtgttcagctccagcgagtgggtcaccgactccttcacggagcccttttccgtcttctccaccgtcaactacttcccggtatgagttactctgtcacctggatgcgagcaccgcgtgatcatggatgcatcacgggcctagggtcgctccctgggcccagcacatgtacttctgcaggtgaccatcaaggtgagcggtccccgcccttaccccacctcaggcccgccttgagcccaagagcgccaagctcgctgcagggcacgatgctgtctgcatctttgtcaatgacgacgcgggcgcagaggtgagagggattggaggcagacagacctctggggccttgtgcacagcgggtgccgcgccgaagccacctgaggcatgcgcctcgatcatnnnnnnnnnntggcgcagaggtgagagggattggaggcatgcagacctctggggccttgtgcacatcgggtgccgcgcggaagccacctgaggcatgcgcctcgatcatgcctgcagccctgtagatgagtcaagcagctaggtcaacttgtcaagcctaatctgactcatgcacactctctcaaacatgcgcgcagtccatcgctgccctggccgaggccggcgtcaagctgattgccctgcgctgcgccggcttcgaccgcgtcgacctggaagccgccgagaagcacggcatccgtgtggtccgcgtaccggcctacagcccacgctctgtggccgagcatgcgctgaccctgatgatggccctcgccaggtgaagagggggaaggggcgtcgcagccacacctggccagtagctctttccttggctttggcggtgggtttgaggtgcagcaaatattccatgggtggggttttgacagtggctacggcagctgtgcaaggggtgcccatgctccagccgagatgtaaggcacctggtgtgcagatgcaatcgcagggctgcaatccatgtaccccctgtcttcccttccctggttgccaatgcagaaacctgaagctcgcgcagatcaaggtccaggccggctcctacaccctaaatggtgggctgggaagatcaaggaaggtggctgaagggtgacacagaagcatgccaggggcagcgatggtgacattgcagcgtccaattcctgtcgtgctcgcatgaaacgagatgcccagcatgatctctgtctctcttccttcctacgcaaaggtctcgtcggtttggagttgacgggcaggacctttggcattgtgggcaccggcgccatcggcctggagctggtcaagctgctgcgggtgagccttttgcggggggatttgacccacccggagcagtgcatgctggcgtgattgtgattgcgtggcgagccggggctgtgctcgacgagccaaaactgccgctgtgtctaatcatccgctcagagtccattaccatcccctgaatcgtccaccttcccccgctgtgatgtcactaaacttgcagggcttcgaannnnnnnnnngaccatccgctcagagtccatcaccatcccctgatcgtccaccctcccccgccgtgatgtcactaaacttgcagggcttcgaaggcaaggtcctggcctacgacccctacccctccgagaaggccaaggagctgggcgtgtcctacgtgcccctggagcagctcatgcgtgaggccgatgtggtcagcctgcacgtccccctgctgcccagcacccgccacatcatcggccccgccaacctcaagctgctcaagcccaccgccctggtcatcaacgtgtcgcgcggcgggctcattgacaccagcgccgccatcgcatcgctgaccgatgggaacctgggtgggctggcggtggatgtctacgagggcgaaggtgggtgtgacgtgggggaggacggaagggggggtaggtggtttgggccaaccgtctgtgccccgaggcatcaggaatgctcccccaccccttccattccatttttagaacgtatggacactcccttgccattggcatttccactcattacctctcccctccccaatcacccgttgcacccctcacagagtccctgttcttcaannnnnnnnnngcgtggggaaggagggaatggggtttaggtggtttgggctaaccgtctgtgccccgaggcatcaggaatgtgccccacccccttcctttccattttaagaacgtatggacactcccttgccattgacatttccactcatcacctctcccctccccaatcacccgctgcacccctcacagagtccctgttcttcaaggacatgaccaacctgaatacccagaagcgcatgaaggtgtgggacaagaagttcaacgagctgctgggcctgccccaggtcatcgtgaccccccacatcgccttcctgaccaccaaggccctggacgccatcgccagcacgactcgcgagaacctggccgcaggcgcccagggacgggagctggtgaacgaagtcaagttcaagggatgagggaccgcgcgagcggggaataaacctacatcattgtgcatcaggcacattcaagaccacacagctggggcggggggagacgggtgtcattggagcttgtccacgagcccgctgcttcttttggagtgatgcattggcgtctccacgccacacagtctcgcctcaatcgcctgaataacctcctcgataaacatgcaaggggtctgggtcctgaatcccttttgtgaaattgaatcgagctcacccatctgacatgtaattttgtggtgaatctcgcccatgggatgcaccaaacgaggtgggccgtcatatagcagggagcataggtcgtccggcggtgggctcccagatgcttgaccgcccagttcctcacagtgaaccacgacgatagggcatgcacggcgaggattggcagcatgtgcaaacaactctgcacatgacccagaacaagcagaaggaagcatagatgaacagaatgtcaacaaaatcattcctgcctgtaatgcggggacagtacaaggctctcctggctttgtcaaacctcagaagcctacttcaagagtacataaaacattacaggttccaaaagaggctattggacagattggagggatcttggagagtcttgagggcggaaattccttctcagccaaaccatttgggaggagggtggacggcgtatcgcctttggctatgccaccatggtggggctctgcacaaaccttcaccagagctcagcacggcgccagggccaggcttggcagccatcttgatggcacagcaggatcaaagggctcaccagaccatgctcaggatgatccgccgcctcccccatctggctccagactagcaatcagccccgctcccctcagctgctcacagtactcttccgcagtttcctgagcgcatgccgtcacgagtgcgagcccattcatgtgtgcttcctgagagagtgtgggtcggagaaggatgcagtgagagagtgcatggcctgagacccaggcaagacgttcccatttgtcctggactgcagcacattgaagtgccaaagcatcagcccgcccaacatcaagggagtctagccgatccttccaccatacctgcatgacattgacggcatcctccatagtgtacccgtctatcacgcgcatgagcactttgaccacataatctcgccgatttacattgtcattgtgcaggagaacccggtagatgggtggctgcttgcccttcgacttnnnnnnnnnncacattgtcattgtgcaggagaaccctgtagatgggtggctgcttgcccttcgacttggtcctgtcatgtcagtggtgattgaaagttgggagatgcttcctttgaatattagcaaggaggccatgggcagcgtcacgccgcccctcagttgcctctcacccgtcccacctcttgtcgatcacggtctgggtacccttggacttgataggcgtgggtgtggagggggctgcagccacagtcacctgtctgcttcctcttgggtgacctcgagcccgagatggaactgaaatacataacacaaatgaagggagagggatattggaggtaagcatcccgtgcatgggatgtcatgatcccgcgagaggtggcccactcgaggccccctcccaccacatggagagctcctccggcagagtttacgccagccccaggcaggacgatatgggatctcaatctactggnnnnnnnnnnacagaaattacgccagccccacgcaggacgatatgggatctcaatctactggtcagatggattgaaactgcatacgtaccggccaagaggtgcctgcccttgatgcacctccgatcggcccacaccagcgacctcggggaggaggtgggctgtaccacgccagcgagcatgccccttgccaccgacggtattgggctcagaaacaacctaatttaaagaggatatgcagtaagcagtgaggagtgccttgccatgcctggtccctcgactttactggccttgccgatcctttgcgggaaggaannnnnnnnnnaattgggctcagaaacaacctaattcaaagagggtatgcagtaagcagtgaggagtgccctgccatgcctggtccctcgactttgctggccttgccgatcctttgcgggaaggaaacccattacaggaaaatgctagcatcaagcctccacagccttgggtgcctcgcccttgctcttcttcttcttcttggtcttgagagaggtctgcaacggcaagatggggatgtggtgggaagtgtgaggtcagtggtgggatgtgagccgatactagaagcttattcatcatggtatactgcccgtgttcccatccagccatcaggccgccagattatctggatccccatcttacgcaccgccagtagcgccnnnnnnnnnngcgatactagaagcatattcatcatggtatactgccccgtgatcccatccagccatcaggccgccagattgtctgaatccccatcttacgcaccgccagtagcgccttcacttctgcgtcctcgatgctcttgtcgctctccagggcttgcagggtgctgttggtgatgcggtcgacgcccgagggcaccaacagcaccgtgcccttgaactgcaggtggggatgaggggggagtcgtgtgggtgatggtggctgggagcggttcggcaccagggctgcaacagcatgcattcactcaacaaggtgtcttgatggttcacaaggnnnnnnnnnnggagcggttcggcaccagagctgcaacagcatgcactccctcaacaaggtgtcttgatggttcacaagggaggagtgcagggccagtagccttccaatccctgccccccctgcaggctgcctctctccaggttattccgctggtatggacatcacagccacctgagccagcccaccagcagatactaagccccacactcacgtgggccaccagggcgtcgggcttctcgtacagcacggggaagggctgcaggaggttgtgattgatgcactccaacagtccatacctgtgggtggggagtttggtgggtggttgagggcctgggtcttccacacagcaggaccatgcgggggcgtcgctgaggatcgtcaatcgccacatcccagggggaagcccaggacactgcctctcttgtaaaagcccggtagcaagggtttcctgccaccctctccatattattgcaccgtgtctcgtcccccttgtcgaggtggacccctcccttccccctccactaccattcccccgatgcctgcctggtctttgtgctttcgagccccctgctggagaacatcatggtggggaacttcttgttgatctccgacaggacctcgcgggacgcctgcgcttgtttgagagtggaaagcggggaagggtgaatgctgacggcatggtaggctggagaggccgactgtgtgggcggtcacgcctgcgaccgagagtctaccagcaatgctcatgacctccaatgctcctcactaaaaagtcccccccccgccccactccactgctccatcgcgcccaccttgatcttgagctggtactggacgtccagagcgcgcttgaagacggtggtctccttctcatccaccaccttggacttgccctcgccggtggacatcacgatgtcgatcgcgtacacctcgccctcctcgatctcaaagtcgtcggcctgcaaaagatgggggttagggggttgtgtaagtatttgtggatggcattcaagaagtactttgcatgtggatgagatggggacgggaggtgaggcaggcaggcgggtgcgcgctgcgcccaggcaggacaggggagcccggcatgaagtcacggaccccggccctcgcccgggcccccccgccacccccgtgccccccccgcgccttttggtcgacacccgggcgcggcagcaccgccttgctggnnnnnnnnnntgcgctgcgcccagacaggacagagggaagcccggcatgaagtcacggactccggccctcgctcgggcggccccgccacccccgcgcgccccccgcgccttttggtcggcacccgggcgcggcagcaccgccttgctggcgtcgatgatgaagcgcttcatctcatgggacagcacgccctccaccagggtgcagccataggcctcggcgatcttgctcagcacggggcccacctccttggcgcgccgaccggcacgcaccagtcggctggcggcctcgtaggcggcgtgtgcggcggccaccacgtcggcggcgcggcccttggcagggccatccaccgccaccagcgagtgcgcggcctgggcgatgaagccgtcgatgtgcgcccccaggtcgatcttcaccacgtcgccctccttgagggtggccgtgttgtcggcggggggggagaagtgcccgatgcagctgcgagggagtggtgccgggggaggggagggnnnnnnnnnnnnnnngcctgggtgggcgggtctgtgggggtatggtgccccttctcgccactcatgttgggcctccaggccaaggcagctcctcaaagcacgccctctggcggtcagccatgaggaaggcacggcatgagcggcgtcaaacaccaccggggtacccacttgttcacggagacgcaggtgggcacggcaatgcccttctcgatgtccttgcccttgaactccttggcggcagccctgcacgggtaggagtcagggtcgcggcgtgaggtggtgccaatggatctcacgagggccccccctcactacgccactctcgtccccccaatcaccctccacgtctccagaagtcaccagcactcactcagtgatcagcttgtcgccgagggtgcacaggtccacgatcttggcgccgnnnnnnnnnntcgccctctggctgccggccatgaggaaggcacggcgtgagcggcgtcaaacaccaccagggtacccacttgttcacggagacgcaggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtgaggtggtgccaatggatctcacgaaggccccccctcaccacgccactctcgtcccccccatcaccctccacgtctccagaagtcatcagcactcactcagtgatcagcttgtcgccaagggtgcacaggtccacgatcttggcgccgggcttggcggcatcgatcacggcagccagtgtgtctgcatggggagggcgtgtggcgaatgcttgctaagcagggcatcaggccgccctgcacgtccacatcnnnnnnnnnngtgtggcgaatggttgctgagccgggcatcaggccgccctgcacgtccacatcgaatcaccctgcacaggattcaagctccaggagcatgatctggggcgtggggtgtccccttcggccgagctgtgattgcgagacccgcgacggtgggcgccccttcccactccgacaagcactcaccgttgacgatcttggccgcggctttgtacttggtcacgacatcggggttggaaatggactcattctcctgcacaggtggcgtatcgggtgtgtgagtggccacgctccgccacgccgtcggtgtgctcgcaggcttccccgcctcacctccccatccctcactctgctctcgctgtcgctgctgtagtcagacatggtgagcggtttttgcggccacaggattgaatggaccaaagggacctcctcggctgcgacaggctgccctcaatctgcccgagaggcgtcactactggggagatgttatgccacgtggttccagcttggacaacctcctgaaatctggcgtgagcgcgagagcatcatgccgtgctattgtcgaggctaggcatgggaaacctacgaaatgtatgcagatcgtgcagaataacaaacgnnnnnnnnnngatgccgtgctattgccgaggccaggcatgggaaacctacgagatgtatgcagatcgtgcagaataacaaacgctcacctgcgtgtaaagcgtgagctgtgtgcaatgcccagatcataccgctgaggtcgcctgcgccatgtctctctggaccctgctccaggtgcgtaagaggtggtaggtgctgccgacatcacattgttccatatgaacacttgagtgagggcctttacactgcaactatattcaggcgtgtgtgttggcggtgaacgctgcgnnnnnnnnnnctccatatgaacacttgagcaagaacctttgcactccaactatctccaggcgtgtgtgttggcggtgaacgctgcggccatcctcaacaacgaccgcttcttggagcgacgtgagtcgggccgggctattcttttttaatgtaattgtttctatgggagctttttcgaccgcgccaggcttgcattggacgaacgtaaaagtttgtgggacccacccctctctcgttccacagatggctggggtttctcacagctgggagggggcgcggcaggcacacacagcccaggagccctgaagcagcagatcatcggcgcgctgcacgccacccagtacctacgaggtgagctgtgaacctaatggaccgaatgttcgtcgctgggtggtcgtgaagggcccacaaattgacctgacatctcgatgctgggccgctatcaactggtctaaagacgaaaaaatgagtgtatgcacccattcctcgtatctccctacacctttgcgtctatctaacgatgactccatcctcctgcttcacaaacatatgcacagttcctctggtggtggtcaacgtcatnnnnnnnnnngttgacctcacatctctatgctgggccgccatcaactggtctaaagacgaaaatgattgtatgcacccattcctcgtatctccctacacctttgcgtctatttgacgatgacactatcctcctacttcacaaaaatgtacacagttcctctggtggtggtcaacgtcatcatcatcctcgtcaagttgctcttcggctgaggctgattgtcgtctgatgatgacatgtacttggcatctccagctggtgtatggtgccatctcttgctgaagctaaccccagaccccaggaacccccccttttgcctggcgtgctcttctttgacgctgcaaggcttgttacagtcccgtctgtacacgaggaacacaagcagtaccagcgcatcgcaacatcggctgcatcggatcgacatccaatcagcccagcatctggttggcagtgtcgcccagccctccctcctttgcaaaccactcctggagggccagggggcaggaaggatgggctgccagggccgcacccagttcctctggcgtcacttgcagatgcaggggcataaattgcctcccccccgcagcggcgtcgtttgccctgtggggagatgtgggtgaccgtgcttgggcatggagcgacggggaggttgagcagggagcatggcgatggtcaggatcaatgcatattccatggttggggcccagtatgagcaacaaataaaccgaggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcccacccaccgcgtgccggcccggctcagcacccccagggccagcagagcgtccagcgcccggagcgctgcgcctcgcgtgtagccatccacgtgctgcccgcgcaggttgctgaagcgcctgaactcggcgtgggcctgctcgaagcagagcgcgtcggcggggcggcgctggctcacgcggtgcgcagccaccgccaggatgagctccagcacgctgagctggcacagcgcgcgctggctggcgccgtcggccgcctcgcgcgccgccagcgccgcggccagggcgccggg

SEQ ID NO: 43953 - DNA, 79 bp, Chlorella protothecoides
tgaacctggcggggggggtgggggacaccaaggggaggggcctgggggaaatcatggtgtgaacccctcgagcgaatcc

SEQ ID NO: 43954 - DNA, 1323 bp, Chlorella protothecoides
  modified_base (109)..(243): a, c, t, g, unknown or other
  modified_base (462)..(603): a, c, t, g, unknown or other
gccccggggccctcctcctcgccaccggggtcgccgggccctccagccccccccgcacccccaggccccgccatgccagctgctgccggcccgccggcggggcccccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngccggccgggcccagcctggcggcgggcatggcgggagccgggcacggcgacggggctgggtccccgccgccagaggactcgagcgcgcgggagccggccccccccgccagggccgccatcgcgtccaagaggccagcgccgggcctgctgcccgtcgcaccccccctgagcgccggggtgccgtcgtgggggcgcggccggggatccccgcccaagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaggagtgcgccgggatgtcgggaggacgagtggaggaggccggggggaggggtggtggtggggtgggtggttgccaagcttctggcgggggcgacgccttgacatgcctgcccctggatgcggggtgggcggggcatcacgtgctggtcacgccgcggtggagcaaggggccacccgccgcgcgcctcccataccccgcgcagactttggcgccacgccctctgggtcggggccggcacctcagcccaccccaccgcgcgtccccgacccgccgccccgcggcaagggcaaggccgacgccaccgccgccggcaccacggcaagccagcagcccgagcctggttcgcagcccgccgccgccggcgtccaaggtgggtgggcctgcgagcgtgtgagcgtgtgtgtgacggggggttaagaggccagctgccatgctgggcaaggcctcgcgctgccacccgccgcctgacccccggtctcggaccccctccccaccccaccccgacaggcggcgtgtcgccggtgacccccctgctcaccccccccgtcgaggaggcgggccccggccagccgcccgactctcgggcgggtcccgccgaggcgacgcgctctgggctgcccggccccgagacgcaggcgacgcgcacgccgccccacagccgcgtgctacacgggccacagtcccagcccaccccgccgccgcccggcagcacggcggc

SEQ ID NO: 43955 - DNA, 61 bp, Chlorella protothecoides
gtgtgtgtggtgtggtgtgtggggggggggggggggaagaggggcgatggtgtcccaagga

SEQ ID NO: 43956 - DNA, 61 bp, Chlorella protothecoides
tctgccctcaactcagaggctggctgggaggctgacccgcctcaccgcatgccctctgctt

SEQ ID NO: 43957 - DNA, 61 bp, Chlorella protothecoides
atagttctcggcggcggccagcgcggcaggggcatccttgtacccacccaagacctcctgg

SEQ ID NO: 43958 - DNA, 61 bp, Chlorella protothecoides
tggtcatggaagtcgaaatccgctaaggagcgtgtaacaactcacctgccgaatcaattag

SEQ ID NO: 43959 - DNA, 76 bp, Chlorella protothecoides
ctcggccgcatctgcccgggcctcggccgcatctgcccgggcctccgccgcgctcgcccgagcctcggccgaggta

SEQ ID NO: 43960 - DNA, 72 bp, Chlorella protothecoides
ctggcctggtcgagggagggagtggcgacgcggggcagacaggcacccgctcggcacacggacgacccacct

SEQ ID NO: 43961 - DNA, 97 bp, Chlorella protothecoides
gtcggcggggccggtgcccggacccggggtgacgcagcccccgcccggggaccccatggcctccagccgcgaccacgacacgttccactgctcaccc

SEQ ID NO: 43962 - DNA, 67 bp, Chlorella protothecoides
ctggaagtagggagtttaggggggggggggtgtgagggagggctttggggggaggatgcatgcaggg

SEQ ID NO: 43963 - DNA, 5250 bp, Chlorella protothecoides
  modified_base (97)..(151): a, c, t, g, unknown or other
  modified_base (592)..(631): a, c, t, g, unknown or other
  modified_base (1860)..(1908): a, c, t, g, unknown or other
cccccgcccccgccccccgcctcgcgcgtgatccccgtgtcggggccctcggccaggccggcctcgccgggtatcaacggcgggggggcccccaccnnnnnnnnnnnnnnnnnnnnnnnnnnnnnnnnnnnnnnnnnnnnnnnnnnnnnnncccccagcccgacgagaagctggtgggtgagctgcgcgatcgcctgctggcgctgctgcccagcctggaccgcggcgtggctgcgggccccgaggtcgcggcgcgggtggagagcctggccgcacagctgggtgctgctggcggccccgtcattctcagccgcgccggcgggtacggctctgccggcgggtatggggcctccccctccgactccaccctgcagcagctgggtggccggtggcgcctggtctactcctccgcctttgccaaggcggggcgcctgacgctgcccctgccccttcccgcaaatgtgggccagatctaccaggacatcttcaccgacaccaatgagctggacaatgtcctcgagctgctctcgcccatcagcctcgcctcggttgtgccaggtgccgtggggggggggggggggggggggggggnnnnnnnnnnnnnnnnnnnnnnnnnnnnnnnnnnnnnnnngggacagggcaaggagaaggggtgttattggctgtggctgggagccggggttacccggactggatggtcagtgtgccctgctcacccttcttgccgccctttcacatgtctcgagtcccttattccccgcgctctcagccctggcacatgattcctcgtcgtccccacaaacaagcgcaggcctgtctggaagccggcccacggccacggtgcgcctgaggcattccttcgtactggaggggccgtccacgctgaaaatctcgcagaccagcaccgagattcgaccctctggggggctccagggctggctcgactccgtgcccacactgaagccccccagcctgccccgcggatcaggggtgaggagagggacagggggggagggcaaggcggaggttgtatggtcagagattggacttgggcctgttgtctttctttggctttaatatcgtccgacacaggttgccatccttccttttatgcttggacgagctgagattcgcggtgccctgcaaccctcacacgccggaaatccctaatcctccaccgctgatgcagggatctgccagctttgagatcctgtatctcaaggatgatctgcgcatcagcaggtccaggggaggcatccgcgtgttcctgaggggccaggcctgagtcgaatgttctgggaaggcgggtgcgcgctcctgttgtgaccctcatgccgccccacccgctctgcaccactccctgtgcctggcatgtcgtgagtcccaatgagttaatcggtgcaacagagatgcagtgcaggaggcgtctgcagcaggggccgcatgcccacacagtgaaaaagacggcaacaccagccgcgcaggggccaggagctgcggggtctcgttccgaggggatatcagcgacagcgtggaaggggaaggcgcgtctcaccctcgagttctttgggtcagactccggcgggaaggggtacggggaggaagcacagggcagcagcgtaagcggagctgggcatcaaggggattggaaagcgcggacgtggccggcggctgggggttggggttgccctcaggcgaaccggtcgacacgcaccgagacgacgcggccgccgatggacgcgttgttcatcctttccaccgcgcggtccgcctcctccttgacggggaagcgcacgatgccaaagcctctgcgttgggcggcgggcacaaggtgagtaagggggggggggggggccgacnnnnnnnnnnnnnnnnnnnnnnnnnnnnnnnnnnnnnnnnnnnnnnnnncaggcttccaaagttgtctacagcagcggggctgccacccgcctctagacctagccaaggtgcttgaaatttccctgtctggggctcagagcaccacaaattgcctgcaacccccccatgcatcctcatactgtagctggcctgaacagccgtcttccctctcgacaccccgcaggccccaccttgaccgccccctgctgtcgaagacgacgtccgcccgctcaatctccccacactcctggaaggcgtcccgcagctgctgccaggtgcagtcccagggcaggttgtgcaccaccacctgcaggccggagctgaagcccggctggccgggcggcggcggccgcgcccctgcccagttcctgccgccggggaagaagccgccgcggccccgggggtaatacgacccctgcgcgcccggcgggtagtaccccggcggcgcccccggcggcggcatgtagtaccccatgtacgcgttgggcggccagctatagcccggcgtcgacccggggggccccggcggggccccgccggggatgggggggcccaggcccctgccccgcccgccagggatgatgtcgcccaccggagacatgtacccgccggggacgaagccgccggcggggcctggcatggagccgactgccgcggggttgtagggatcgtacaggggccgggggcccactccccgggggcccccgtacatgatgcgcatggatggcgtggtgccctgtggaacggggcggggccggcggggaggagggtgagcggatcgcctgggtgacgtcgcggcgcgggcagccactgtgcccagggcagggcacccagcgcggagcagtcggcgcacccggcctacctggggcggggccccctcaggaccggtgacctgaaacgctttcttcttgccatcctccccctctgccagctcaaactccacctcctccccctcccgcaggctgcgaaacccctcggcctcgatgttgctctgcagggggagggggagcgggaatggggctcggagcggggacggggtgggagctggcgaggggcggggtctgggcagacggtcgtcgctcatgtcactgcgccccgctttcccctgggacccctgcccggtctggacacccaacaggcaccctccaggcgcgtcccctctgccacccccgtcccctctcatcaaggtaaggatggggacccccacctggtggacgaagatctcttcctccgacccgtccagggtaatgaatccgaatcctgtgtgcgggtcgggctcggaccggcatgggtacaggtccttggcacatgatcccgtctttatccgacccccaggtcccctaaacctacctttggaggagttgaaccatttgacagtccccctgtgccgttcctgtgcgggcatggtgcgctcggggtcggtgcctccctcccccggctgctgcgaggtgggtgactcaggcacctccggcgcaatctctgggctgcccgaaggctcctgccggtctccttcaacggactgaggcctctccatgccgcgccggggctcccggccgggccgccgagatgtgcttaacgacgtgcgagatgtttaccccccgcgcagatcaagctccccatccaccccatgaaccggctcgggatgtcattccaaggctgcgagatgtatggcttcacgatttgcatccctcccacccctggtcgagccatgtctcccctgcagcccccgccgcggctaagctgctgatccgtccagctcaacagggtgtcaagattgtatcttggaaaggagggaacggctctccggctgcaagccccatgccggaccccgatccggcgaatgcacggcgacaagccgcagatgcgcggctccgatgcacatgtgtcgcagcaatacttggccagcaagctccctgggcctccacgccagccccctgggcaggctcgcacctcacgcgatctggcacatgcccccctggctgggggcgggggcgaccgtcgcccgccgtgccaccggcgactcctccctgcatgtgtgcgggagcgtggcgggctggagcggtgcgcatgacctgcagccccggtcatggcgctctggtgcctgggtggcacccaccacggatgttttccacactggttgcgatcttggctgcaaccctcatcccacaccccccgccgccaccgttccagacctctgactaacccctcacctggccccagcgtcgctccgggtcctgacatgggtgctggaggcgttccgccggatgccctgactctccacgtcgcccggggccgggccggtcgcatccgacaaacccccgctgccctgcggagccgcgatgagggcgccgcccctgccccgctcctcgctgggcgatggggacctgcctgcagggcccagcctggagtcgccattgcgcaggccgtgcgtgccggcgtgcatgctgccgctgcgcccgtgcgtggatgtcgtgaccggcagcagcggctttccctgcggtgcggccgaggggaggggtgaatgcgtgactgtcaggggtcattgccggaggaagagcccacgggcatctgcatcgcaggccgcggtcgtctgggcgccccaggcctgcagcgcaagggggaatctcccagcatcacccttcctacccggggcccacccctgcccaagagggccttcccccccccgccccgcgcctcccacctccgagccctccttgacggtgagcatctggacgcccagaatctccaccccctcctcccccacgagcggccggtggggccagtagtcctgcagcggccgcttggtggtccagcggcggtgcatggcgtagaacaccaggggcaccacgtacctggtggaaagggggacagaacagggcggggtggcatgttctgcagggggtgggggttgagtccagctgcagggtctgggcaagcacccgggtcgccctgtgtgtcacgagttacgcgccccctcctgacagcagaatgcacatgggtctgtgaacgcacgcgtgaggatacaactcgggggcccgcagccgcccaaaactccccccctcccacagcgcaccatgcgaccacgacgtccacggtgtagtgcttgcggctggcgatgatgcaaaggcccatgatgccaaccccaatccagcccaccacctgcacgcgggatgacacatggatggcgctgagggtcaggggggtggggagccgggtgatgtggcgcagcgcccggtctcatgctctgggctgcttgtcgcccccaggtcttcccggttccccaccttttcagggcttgcacatggggtcccagggacaggcagcctcgccctccacctgtcagcccccccc

SEQ ID NO: 43964 - DNA, 61 bp, Chlorella protothecoides
cgtgagtagccatggctgctttgcttgagggggtctcttgtcaccctcgacactggggtgg

SEQ ID NO: 43965 - DNA, 67 bp, Chlorella protothecoides
gctggaggcaggccgacggggctggaggcaggctgccgggggctggaggcaggccgacggggctgga

SEQ ID NO: 43966 - DNA, 61 bp, Chlorella protothecoides
gtcgtcaatgatttgctgtgggggcaggaggggtaacttgttgagattgccttgtgacaga

SEQ ID NO: 43967 - DNA, 81 bp, Chlorella protothecoides
aacatgccagctgggccctcacaggcccccccctgcacctcacctgccacacagacccaccaacatacacctgcctgcgcc

SEQ ID NO: 43968 - DNA, 71 bp, Chlorella protothecoides
gatccctccttgccagctgcagcaagggggagaggtgaagcgggtggtggggggggggggggggggggggg

SEQ ID NO: 43969 - DNA, 61 bp, Chlorella protothecoides
atgaattgtgattcagccttggaggggggggacaccttgcacaactcacttttttccctcg

SEQ ID NO: 43970 - DNA, 61 bp, Chlorella protothecoides
tcggcagccccgccgccgtcggcacccgaaccctgcgagtcgccctcgcctgcagcaccag

SEQ ID NO: 43971 - DNA, 63 bp, Chlorella protothecoides
ggtgccttgcggtggtcggaggggtgtgggggtgtggggcgggggaatgaaggagtggggagc

SEQ ID NO: 43972 - DNA, 70 bp, Chlorella protothecoides
gccgcttggagctgaggccagcgcccgggaccgaggcggcgggcggccgggggtttgaccccggggctgc

SEQ ID NO: 43973 - DNA, 599 bp, Chlorella protothecoides
  modified_base (111)..(120): a, c, t, g, unknown or other
  modified_base (448)..(457): a, c, t, g, unknown or other
cggctccgaggtccaggtcagggggccgggagtgacgctccactcgctgtcctgcgggctgagtgcgccgctggggacggccggcaggcccccgtcgtccaggaacgagtnnnnnnnnnnggtgacgctccactcgctgtcctgtgggctgagtgcgccgctggggaggaccggcaggcccccgtcgtccaggaacgagtcctcctgcatctccagcgaatcctcgcccgcgcccagggccgacactctcccgctggcggtgcggccggggccggggtcgccgcgcgcggaaaacacgccgctgcccgccgaggcggaggaggcgggcgagggtcggacatcgaactcgcccgaccccgtggttgtccgcaacgggccaactgtgtgttggccggccgtccccgggtggagggcgtcgtcgccgccgcgtcgcacgccgcccccgccnnnnnnnnnngtcaaactcgcccgaccccgtggttgtccgcgacgggccaaatgtgtgttggccggccgtccccgggtggggagcctcgtcgccgccgcgtcgcgcgccgcccccgccgtcacctcggcggcccaggcgtgccgcgccggca

SEQ ID NO: 43974 - DNA, 61 bp, Chlorella protothecoides
atacatacatacatacatacatacatacatccatacatacatacatacatacatacataca

SEQ ID NO: 43975 - DNA, 1315 bp, Chlorella protothecoides
  modified_base (132)..(258): a, c, t, g, unknown or other
cggcgccgccgccgcgccatgatcagcagcatgaccaagatggccagggcggccaggccgccaaaggtggaggtcagagtgatgagcaccacgtggtcggaggaggagctggaccccggcggcagcggcggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggcaggatgggcaggtcggcccccgccatgtaggccgcgctgtaggggttgagcaccagcgcctcctgctgcaggtcggcgcgctgcggcacggcctttaggatgcccatggcccagctggtgtagtccatgccacgcgggtagtaggcgaagccggtgcaggcgctggtgtagccgcaggctgccaccacgtcctccagcccgccgcgcagcgcgcaggcgccggggacgattgtgttcgcgcagtcgaagtcgtgggaggagccgaagtcgaagccgatggccagggtgtagccgggcacctcgcgcgaggtgatgatgaagggcgcgcccgcgatcagaccgctgtccgagtccgtggtctccatgtggatgtcgtccggctcataggctgagaaaccggggacggagagcaggagacaggtccccgcggcaaaggtcgtgttccccgccccgcagctgctgtgtagcgtgcacctgcacaggtggcgggtggaaagaaggagcaggggtcgaggccagggcatggttgcgcaggttgtatctgatcggcagatggaagggggggccagctgcattgggacaccgtgcgctgccatggcacaagcgggaaagttcgtggcacgaggcgagacgcgcaagaccaggcagccccatgccaggccactgccatcacggcctttttccaaaggggtcccattccaggacaggccgcgtccggcacgagccttatcgcagcacaactcaggcgcttaccctgcgacatgaccgccggcggtgcccaacagcccccgcccagcacggccgtcacacccacatgcctccacactacaaaaatgcacgccgcgcaccactgccaggcatcgcaggacgtgttgtcgtggcaggcggagcagcagttgttgacggtggcgttggctgcagtgatgttggacaggatgtaggtcgtgccctgggtgttgagcacaaagtaggcattctgcttcacgatgcattgctgggccaccagtgcatcctcctggctctccacgggattgggggggggggggcccccgg

SEQ ID NO: 43976 - DNA, 61 bp, Chlorella protothecoides
cgcttccctgcaagcgctccacacggcgggggacttggcggctcagaacaggtgtgtttgg

SEQ ID NO: 43977 - DNA, 61 bp, Chlorella protothecoides
ggaggaggagacggagtacaaggtggatgccgtggcccacgtgctggccgaccgcgtggtg

SEQ ID NO: 43978 - DNA, 61 bp, Chlorella protothecoides
gcaggcctggcgagatgcagctggcggcggggacggcctccagcgccgcctccagtgcctt

SEQ ID NO: 43979 - DNA, 61 bp, Chlorella protothecoides
ctaaagataaatgcatgatatggcaggggggacagatgtaaggaattccgcagaccctctc

SEQ ID NO: 43980 - DNA, 10336 bp, Chlorella protothecoides
  modified_base (156)..(165): a, c, t, g, unknown or other
  modified_base (396)..(405): a, c, t, g, unknown or other
  modified_base (632)..(641): a, c, t, g, unknown or other
  modified_base (1500)..(1509): a, c, t, g, unknown or other
  modified_base (2037)..(2046): a, c, t, g, unknown or other
  modified_base (2504)..(2513): a, c, t, g, unknown or other
  modified_base (2815)..(2824): a, c, t, g, unknown or other
  modified_base (3880)..(3889): a, c, t, g, unknown or other
  modified_base (4090)..(4099): a, c, t, g, unknown or other
  modified_base (4343)..(4352): a, c, t, g, unknown or other
  modified_base (6605)..(6614): a, c, t, g, unknown or other
  modified_base (7670)..(7679): a, c, t, g, unknown or other
  modified_base (8048)..(8140): a, c, t, g, unknown or other
  modified_base (8392)..(8401): a, c, t, g, unknown or other
  modified_base (8853)..(8963): a, c, t, g, unknown or other
  modified_base (9913)..(9922): a, c, t, g, unknown or other
cgctggccgcgccaaagcccccgaacgccggcgcggaggctgcgggcggcgcgccgaagccgccaaaggcgggcgcggaggccgcgggcgtgccaaacccgccgaatgcgggggccgaggcggcggcgccaaaggcgggcgcctgcgtcgtgccannnnnnnnnngaacccgccgaatgcgggggccgaggcggctgcgccaaaggcgggcgcctgcgtcgtgccaaaggtggacgtggccccgaaggccgaggtctgctgctgcggcgccccgccaaacacgctggtggagccaaaggcgggggaagaggcggcctggccgaatgcgggtgtggaggccaccccaaagccgccgccgcctttgggaagggaggggggggggttaggaaggtgttnnnnnnnnnngggagaggtaatttgggagcggaccagctgccatgccagcgggaggagtagggacagggcacatcgaaacccaggaccagggtgccacagacgcgagcgagatccggccctggagatccgtgatggtgcagcatgcagcacggcgtccccgaccttctccctgccttgatcccctcacgcgagctgccgagcgccaccctctgccactcaccaaacggagacgggcnnnnnnnnnnggaccttctccctgccttggtcccctcacgcgagctgccgggcggccccctctgccactcaccaaacggagacgggctctgggagccaaacgcgggggcgctcgccgccccgaagacggagggcgcggaagccggggctgcgccaaacatgccgctgccggcggcaggggcgcccgcgccgcccttgcagccgtcctcgtaatcttcccgtcgcagctcttccaccgacttgttggcgtactctggcatgcatgagatgctgttcaggtacactgcgcagggaagtgtgtgtacgtgtgtgtgtcggcgtgagtgaccctagtcatgagtggcaggtgagtcgagcccctggccgcaggcggcaagcactcgagaggcgcggtgcgagagcccgtctcgatgccagcgagcaggagagcgttcctgctcccccccgacatgcagaccctgggtgagggctggcagccttccgtcccacaagtccccgttcattcgcagcccaatacagcctgggcgagcgcgcaggcacgagacacccccacccccacccccaaccccaccgacccaccggtggtcttggggccattggccgcgccgtcttgttcctgggtcttgcgccagggcacgccgcgagtcccccggcctgcgttggcagcggtgccgccgccaaacccgccggggctgccgaaggagggcgccgcgccgaaggacgaggcctgcggctggccgaagggggagggcgcggcgggcgcgccgaatcctgaggtcgcctgctgctgtgaaaggggcaaagggggggcggcgagaaatggtgggatgtcgccctcgagcttcctggtggtgaggcagggcagccaannnnnnnnnngggtcgcctgctgctgcgaaaggggcagaggggggggcggcgaggaatggtgggatgtcgccctccagcttcctggtggtgaggcagggcagccaactttctgcaccacttccccatgcatgccctgtcgagttcacccgacgatgtgtccgcaatcaacgtgccaccacacgagctcctctccaatgtccagatgaatacctgagctggctggccaaagatgccagtgctgccaaaggcaggggtggggctccctccaaatcccgtcccgggctggctctgctgaatggatggtgggcaggccttcagccaggatgcaccatcgatcgtcctgaaggacctggccccaggcccgccgcgcagcagcacctgaatctgcattggcaacccccccctgcaccccagacgcgcagcgagagtgccatccacagggtcgtaagaccgcaagaccctaaagacccccccatcgctcgtgacaggccgataatggccgtcttgacacccccggggtcccagacctgcgcgaannnnnnnnnntctgcacccagacacgcagcgagagtgccatccacagggttgtaagaccgcaagaccctaaagatccccctatcgctcgcgacgggccgataatggccgcctcgacacccccggggtcccagacctgcgcgaagaggctgccccccccgccgaaagggcttgcggtggtgttttgcggtggcgcaccaaacgtcgacccgggggtggcaccgaacgccggcgaactcccggccccaaagaggctggaggctgacgaggcagcattgaacgcaaagctactgcccgtggccgcctgcaggaagaggggtcggcagaagggtggcggagggacagattacagatgcttaggcagcagtgcaggagcgctgccaccccccccacacatgaagtgcattcccatccaaaatatcagctccttaccccaaacgctgtgctcccaaagcctgatgcgcttgcannnnnnnnnngcccccccacatgaagtgcattcccatccaaaacatcagctcctcaccccaaaagctgtgctcccaaagcctgatgcgcttgcagcaccgaatgcgggggtaggagtcgcgccaaaggctggctgatttggctgttgggatggcgacgtggggagggttgaggctgatcatctgtcaaggtccttctaggcgcacttggcaagcagtcggatgccttgtcaaagtgaagtattacattcatccattttaaaggtatctagtgccctccagtactggatcatcctgcagagtcagccagatgnnnnnnnnnntttaggtatctagtgccctccagcactggatcatcctgcagagtcagccagatggccccagggagggctacagccagcccattcaacctgacacaccagagatacacacctgcccaaatacgttggtcggctgagtctgtccgaagggactggatgcagctggagcgccgaatcctggcgagagggagaaagcttctggagtcgatcgagtgccaagccgagcaaggtgtctcacatgggcactcggaaggacagggcacaccgtggcggggggaagtcgcatcgccctctcacctgtgcctccaaagaacgacatgctgctctctgctagtcaggctggattgcgcccagcccgatggcgctgctcgctcgagcgatggggacctttgatcccctgtctccgtggagagtggcagggcacggccctcccacctccgatgagggttcactcctccttgcacacgtcttcgatgccgatgagaaggggacgggtccgcatgcaggcctagcaaagtacgctgggggggagcccagccccatcgagcgcgggagaactcacatccgattttcggtgggacaggtgttgtgggctaagccttcgtgcgtatctcttacacttcacctcacaccacagacgaccgcatggcctcctgacatgcctctacctctgccttaccccccagacatacaggacccttggccccatgctctgctatgaccttgtcgagggcgggccccgcctcgtcggtcgccgccccgcccgcggccacggtgacgtatgccaggggcgccacctcgtacaggaggcgcagcttgggcttcgccccagcagaggtggggttgcagaacacgcccccgcccctggtgatcacgtggtgcaggtcgggcaccagggcgccgctgtaccgcagcgtgtaccgctcctccagccagcgcctcaccaggcccccatacgcctcgttctcggcgctcgccctgcgggcggctcgggcgcagtgaggagtgcggggggcagtgagccgacagctgagcggggcaggatggcatcggcacgtnnnnnnnnnngccgccctgcgcgcggctggggcgcagtgaggagtgcgggggccagagagccgacggctgagcggggcaggatggcatcggcacgtgcaggcccaatctccacaacccaccacaatcctgagaagcaagtgcccaggcccaggcgccacccacccaaccccccccccacacacactcacctcaggttggcaggcgcaaagnnnnnnnnnnatgcccaggcccaggcgccacccacccaatccccccccccacactcacctcaggttggcaggcgcaaaggtccgcaccccgtccccgatggcgatgccgtccctcgccagggcccacgccccaccctcgcccagcgtgaactcctggcacaccggggacgagccgcccaggcccctggccaccacgaggagtgttcggggcccatacagggcatacgccgccgccacctggtccgaccccggtnnnnnnnnnncggccaccacgaggagtgttcggggcccgtacagagcgtacgccgccgccacctggtccgaccccggtcggccaaccagctgcgacccgggccagacgccgaagatggagcccacggcccagccggcggggatgacggaggagccgtccagcgggtcaaatgccacctgggggcgttgcgggagacagggatggtgggaggtagggcggagtttaaggtgcccggcatgcggtgaccttcctgagcctgcaggcaggggccaggcgcggggttgtgctcatcctcaaggcggcgtctcgaggcacgcaggctactgctcccttgtttgagggacagccggcgagcgtgatacactgtcctgggaccctatcttgccatccacaagcctggcaaagggcaccaggagtagagcgccctcccggcctcccacagcttccatggccaccccgcccccctcaccgagtacccgaagccaccaagtgcgatgtcgtgcggctgctcctcgctgctcgcagtttccaccgcgcctgaggagcgcaaggctttgaggaccgcttcgtcggccaccacatctgcagccagctgcctgtcacccaggtcattggaggtgcctgtctctgccgtcgatgctgtcctcagggcatgctgagcacgattcagatgggagtggggggtggggggtgaagtgagggcagtgagagaagggggagctctcagatccattgtcacggcaaggtgccacaaccgagcatctgaggtcaccgactccatagtacgcacagatatgtcgaccacggcgactgcaatcgcttccagaaccttaatctgtgagatgaaaagttccaaatgagatgtgagtgggccatgtgagcactctcgaaggtgcaccaaagacttgtagcgtacacggtcgccgcaccagtcctgggtctgctccctgaagcgcctctgtgagagtcggcatgcctattagatacaatcctttcctgctcagactgaatcgatgatggcactttttcaggagtgcccaagaattgcatggtgcaagggggggttgggtggaagtgatctagtcgcgcgctcgacggacgcagcacagcacgagccccttcgacaaaaagtgccactctgagctcgaccaggtacaatgccgatgcgtccctcctgcagatatcctgaactagcacatcggctcctatccctgctccccccgcctgcgccaggtcgactggccgtgcggcgcaaccgaacccaacgagcactggtctggacacaatggcgccgagatcccgcaaggcagatgtaaatccttttgttgaggaaactgcggaagcagctgcgaaggacaagctggatctgggtgatgcggcatcgatcaagcgtgccctggacgaggctgctgcggaggtgagccggggtgatgcccgatgcactcgagcaccggaaagaagccctggcattgactcagcgaggctccccccgccccattgtgcaggcccttcagggggagggctgcgccctggatcactctgttgtggacaccaggattgcggtgggcgcagcggcctgcctggtcgccctcgtcgcacaattctggccggccaagagcccccacgcgtggtacgtgctggtggtctgcgtctcctcctatgcggtgctgagtgccaccctttccctgctggccgccctggtggagaaggagtccatcgcgcgcaccaagcccggcgggggaaggccggccctggtgctatccacccacctcccccgctggagcgatcggtacaccctcatcctggcaccggccgggggtcagggatcccatcaaaaaaggtgggacagtctgtgggaatgagctgacgtgatccccttgcatagagtcaggactgcttctgtatcgtgcttgtgcatcagattgtgtcccgcacttgcacatttgagtacgttttcccaccctcctcctggacacaggctggccagcgtaacagcaactcatgggctgggagagctcgtccatggcgacggcgtcgtggccgtggagcgtgtgcatcgtgcaatcaaggacctgctggcacggttggcaggcgcgcaggccaaggagcagtgacgaggttgcactgcctccctgcgtcgcctgatgtagccctatttacggagtggtaaagacttgcacccagtggatgtggtgagcgggtggacacgccaactcggcgtggccatgcttgtagacttgctgagaggtcatcatcgcacgtnnnnnnnnnnagtggtgagcgggtggacacgccaacccggcgtggctatgcttatagacttgctgagaggtcatcatcgcacgtgctccgagacgaatcttgggtcgcgccctgacgtaacgcgagttaccgccgctgtgcagacatatggccaagcacccaattccccggcactcctctaaaccttcaatacatcatttcaacgcatctcgtcatgcgtgccgtccgtgtgctctccctcctcgtgctggccattgtggcacggtgcacctctgcggaccttgagggcacgtgctggagtctggggccagctgaatgcttcctgcgtcccggatgcgagtactgtaacttcttcggtcgcaagaatgtctgtatctgggatgccgtcgccgagtacattcccacgagtgaggaaggaaggatcttgacctggaatgggctgagggcgtgcaagcctctcgtgatcaggcatgtgcagtacttgggtatctaactattgaatctgttccacttgccaggcattgctaattgcacggtcaccccgggcccaaagaagccggaccatgcgtgcgatgcgtacgcggagcaggagccttgcaacggagcacagggctgcgtctggtgcatcagcgctgcagtaaagccagcatgctatccccaggatgaggcgaagctgctcccccccgcagtcttccagtgcgacgccccgtctctgctggagagcctggtgtcccgccaccgcagggacatcatctgagggcgagagaatgtttcctgcgaaaagggctacaagcccattggaggcggagcccaagaggctgcgcacctgaaagtgcaggttcctgccatccatatgttctcgcaaggcttgctacatccgaagcgcccttggcctgatggagagcggcacctgaccttccatcctctggttcatgtgccctcctccatcctcctcggcttacttttggcccatacatgccttgaagtagaaccaggttgctgcccgattgtctgctagacgaatggcccgattgttctgcagcctattcatgcaggtgttgtggtnnnnnnnnnntaaggttgctgcccgattgtctgccagacgaatggcccgattggtctgcagcctattcatgcaggtgttgtggttcatgtcaccgtgttctcatctgtgggcatgacctgtgtgtaacactttcatggctatctgacagattaggcaatcgtagcagggcaagtgatgcgcacacaaacaatattcactggcaggggacaatgctgtgcagtattgcatgatgaagtaatagcaggggctctcagctcctcgatgatgttttgcaggcgcccattcccagacgcacacagcctccagtcttcactcgggcgagttgattgggccactctctcctgtgtgcggatcaggggacattgcaacattcccttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacgcaatgccgtccagactgcaggccggacggctcagatgggggtggcagatgactacgacgccctcatgcgctgggccagtggcacctccttatggatcacaggggcactcgcccttgcaggcgacctcagcgcgtgcaccctgcgcaatgcactcgttgccataggtgacattgttggtgccgcacacaggcgcatagatggctgcgcaagaggccacggggcaggggcactcgccctggcacgcgaccnnnnnnnnnntatgttttgcaggcgcccattcccagacgctcacagcctccagtcttcactcggcgaattgattgggccactctctcctgtgcgcggatcaggggacattgcaacattcccttacacctgggcacgggcaacccttccagcaggacacgccgacccttgccgccgccgcagcgcattcatgcgcaatgtcgtccagaccgcaggacggacagctcagatgggggtggcagataactacgatgccctcatgcgctggcccagtggcacctccctatggatcacaggggcactcgcccttgcacgcgacctcagcgcgggcgccttctgccacgcactcgttgccgtaggtgacattgttggtgccgcacacaggtgcatagatggctgcgcaggaggccatggggcagggacactcgcccttgcacgcgacctcggcgcgggcgccttctgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggggcagaaggtggggaggatgctgccagggccatctccctttgcagggcaggggcactcgccctggcacgcgacctcggcgcgtgcaccctgtgcaacgcactcattgccatacgtgacgttgttggtgccgcacacgggcgcatagatggctgcgcaggaggccacggggcagggacactcgccctcgcaggcgatggtggcaccctctgcctctccgacgcaggtgttggggtgggtcttgttggatgtgtcgcacactgggaggtaaatgaaggggcaggcaaccgcctccccgattggtgcatccaggctggcttgggaaggatacttgggcttcttcacaatcttgtcctccacaagaccagcagccaggggggagcaattggcagcctcgaggctggacaagtcgtgatcgttgcagcctgggcggggagagtttaccgacgggaagtgtgaggggccgtgtggcgcacattccgctcagggtgggcgctgcgtcttctgcctgatcagcgcggaacatacattgaaactataccgacacagtgacaggcatcttaaagatcttctgtccggattcgaggggacacgcaccttgtcgagcaagggccaccgcgaggagggctaggatacccacaaggacggccctcgggcccttcattctgttgatcaaggatggccgggccgcacaaggggagcagagtcttgatctatgactgtgtaagattggctttgtttatatgtagttgtaaactgaaccttgccctggcgcgtttgccactgtctaggtgtaaaatcctcaactcaacgcggttaccatggaaggtaaaagaagtcgagcgccgcgcagcagttgcgcgtactactgccgagtggtttgtaatgtgttgggcatcccaaatatgtgatttgcaactgtcatgacattcgtggatgcccacaatgcnnnnnnnnnntgcatcccaataatgtgagttgcatgtgtcatgacattcgtggatgcccacaatgcgctcgggtgggcgccgacgagcgttagcgacgtatctcagacgagttgccgtcgattcctgcacgatccatccggaataaagttgcgagatcatgcaaaagaattcccaaatcttccgcaacaggacctttacatcaaatgcacacttatagctggcagaaaagcaagatttgcccaagctatccgccccccctccccaagagtggttacactatggccgacctggtggccgccacgcttaccttgaagtatcgcttccattgatcccttcaacctcaagtcacaattcccttggagcgcgtggatgagttcctgccgggcgagggctgcagcttcaggtttacctgcaatcacacca

SEQ ID NO: 43981 - DNA, 94 bp, Chlorella protothecoides
ccagaaataggattctcagctcgagggtcgcccccacgcaacctaaacccccaacaccccatccatccgcagagctgacggggtcggacgagcg

SEQ ID NO: 43982 - DNA, 61 bp, Chlorella protothecoides
tgcggccacgaggtagtccagggtgcccagattgtgctccgccaggcccgccaggtcggcg

SEQ ID NO: 43983 - DNA, 348 bp, Chlorella protothecoides
  modified_base (103)..(279): a, c, t, g, unknown or other
cgccgcggctgagcgcggcggcgacggtccggacgtcgcgctggcggcgctgctggaaagcgtggaggacgagtcggccgccgtggcggggggtgggctggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncggggcgggtgcccctcagggcgcctcgccgggcgccacgccgggcgccgcccacacgacggcgtcccc

SEQ ID NO: 43984 - DNA, 763 bp, Chlorella protothecoides
  modified_base (176)..(185): a, c, t, g, unknown or other
  modified_base (657)..(666): a, c, t, g, unknown or other
ccccgcaaacgcgtgcccgctcaggctgtccgacgacgcgtcgttgtccgaatcggggccagacggcgtctcgcgcccgtcctcatcactgggaggcggcctcgcttcggcgtgctgcggcgccgggctgggatcgccgggctcggcctccctcggtcgcaccgagacgggctccnnnnnnnnnntgacgacgcgtcgttgtccgagtcggggccagatggcgtctcgcgcccgtcctcgtcactgggaggcggcctcgcttcggcgcgctgcggcaccaggctgggatcgccaggctcagcctccctcggtcgcaccgagacgggctccaggcccagtgcgacatcgccctcgcccgagcgcgcgccgcgcggcgcgcgctcgggcgagggcagcggcgagaccagcacaaacccttcttcagaggtctgagaggaagcccccgactgcacgtcgctcgtgggctccggcgccagcgggtgccgcgccacgctgcggcggacctcctggggcgccggcgattcggtcctgcggcccggtccggggaccagagggacgtggcccaggcctgtgcggaccggcgcagacccggccgccgcccagcccggcaggaccgggggcgacgggggcaccgcgccgcccggcggcgcggcgtcnnnnnnnnnnacgcgcgccgcgccgcgcgcgctcgggcgagggcagcgccgacaccagcacaaaaccttcttcggaagtctgagaggaagcccccgactgcacgtcg

SEQ ID NO: 43985 - DNA, 72 bp, Chlorella protothecoides
tctggtgaggggctgggagggtggggtaaagggaggggaattttggggaggggtgtcttgcaagggcagagg

SEQ ID NO: 43986 - DNA, 61 bp, Chlorella protothecoides
gctgctgcccgccgccgggcgcctggtgaatgccgcggtcgcgtcgctggggccagagtac

SEQ ID NO: 43987 - DNA, 77 bp, Chlorella protothecoides
gacgcggaggcccgcctcgcggaactcgccgagaaggtggccgccctccagcgccgcgtggaggcgggggagggcga

SEQ ID NO: 43988 - DNA, 61 bp, Chlorella protothecoides
ctgggggggggaccctgcagctgtggagggggtccgatctcatcacgcgcccggaggagga

SEQ ID NO: 43989 - DNA, 61 bp, Chlorella protothecoides
cggtggtggagacttcttggcaggcggtgggggagacttcttggcaggcggtggtggagac

SEQ ID NO: 43990 - DNA, 19830 bp, Chlorella protothecoides
  modified_base (139)..(148): a, c, t, g, unknown or other
  modified_base (233)..(242): a, c, t, g, unknown or other
  modified_base (468)..(477): a, c, t, g, unknown or other
  modified_base (911)..(920): a, c, t, g, unknown or other
  modified_base (1134)..(1143): a, c, t, g, unknown or other
  modified_base (2987)..(2996): a, c, t, g, unknown or other
  modified_base (3255)..(3264): a, c, t, g, unknown or other
  modified_base (4077)..(4086): a, c, t, g, unknown or other
  modified_base (4275)..(4284): a, c, t, g, unknown or other
  modified_base (4372)..(4381): a, c, t, g, unknown or other
  modified_base (5409)..(5418): a, c, t, g, unknown or other
  modified_base (5496)..(5505): a, c, t, g, unknown or other
  modified_base (5579)..(5817): a, c, t, g, unknown or other
  modified_base (6167)..(6176): a, c, t, g, unknown or other
  modified_base (6245)..(6254): a, c, t, g, unknown or other
  modified_base (6314)..(6323): a, c, t, g, unknown or other
  modified_base (7001)..(7010): a, c, t, g, unknown or other
  modified_base (7882)..(7891): a, c, t, g, unknown or other
  modified_base (8322)..(8331): a, c, t, g, unknown or other
  modified_base (8548)..(8557): a, c, t, g, unknown or other
  modified_base (8892)..(8901): a, c, t, g, unknown or other
  modified_base (9840)..(9849): a, c, t, g, unknown or other
  modified_base (10266)..(10275): a, c, t, g, unknown or other
  modified_base (10374)..(10383): a, c, t, g, unknown or other
  modified_base (10617)..(10626): a, c, t, g, unknown or other
  modified_base (11780)..(11789): a, c, t, g, unknown or other
  modified_base (12056)..(12065): a, c, t, g, unknown or other
  modified_base (13097)..(13106): a, c, t, g, unknown or other
  modified_base (13283)..(13292): a, c, t, g, unknown or other
  modified_base (14686)..(14695): a, c, t, g, unknown or other
  modified_base (16114)..(16123): a, c, t, g, unknown or other
  modified_base (17940)..(17949): a, c, t, g, unknown or other
  modified_base (18010)..(18019): a, c, t, g, unknown or other
  modified_base (18104)..(18113): a, c, t, g, unknown or other
  modified_base (18198)..(18207): a, c, t, g, unknown or other
  modified_base (18425)..(18461): a, c, t, g, unknown or other
  modified_base (19172)..(19181): a, c, t, g, unknown or other
  modified_base (19265)..(19274): a, c, t, g, unknown or other
  modified_base (19411)..(19420): a, c, t, g, unknown or other
ggcggccgcggctgggccctccgcctccttcgagccgcaggcggcggagagcgcggcggtggaggaccggcagagcatcaagagcttcaagcgtgtgcgcctcagcatcggtaagaaggatgggggggggggccggggnnnnnnnnnnaatggagacctgtaaaggagaatggggcagggtcatatgtaccagggcagtgtggggcctgagggcaggtgtgagcgaggggtannnnnnnnnngaaatggagagccgtaaaggagaacggcgcagggtcatatgcaccagggcagtgtgggcctgagggcaggtgtgagcgaggggtaaccatcaacaccagaccgacacgcccacgcattcccgcgctcgcatggcccaacatcctgtgcgtcgccgatcgccccacccatcaagaacccccccacccctcgctccttcgaaaggtcacctggacctgctgaccgacnnnnnnnnnnacgccgaccgccccacccatcaacaacccccccacccctcgctcgaaaggtcacctggacctgctgaccgacgaggccttcctggaggccatccagtccttcttcgcctccatccccaccgccgacgtgtggcaggaccaggcgtggcaggagcagcagcgccggctgctggccgcgcagttcgggccacgtgaggtggagagcctggccgtcaacgccgtggtgccggcgctggaggaggagaatggcgcggacgccgctctggactgggtcatcgccaaggagacgcaggacctggcggtgctgcacggccagtccgacctctcttcctggtactttgtggagcatggtgagcgaggttggggggctgagggggcgaatgtttgggaaatttgttggcacaggcttgggaaggattcctgtggctccctccnnnnnnnnnntctgagggggcgaatgtttgggagatgtttgtggcgcgggcttgggaaggattcctgtggctccctccaggggcgccaccagttgacggggtgcccccgctgcatctgccccccggggtgcaccacactcctggctcgagcgacctggtactgggatttcttgtgccctgctccaccctttttcctgccaacccctcgtcctttcagccctctnnnnnnnnnngggggtgcaccacactccgggctcgagcgacctggtactgggatttattgtgccctgctccacctttttccctgccaacccctcgtcctttcagccctctccctccccaatccccacatcatccacaccgaatcatcatccactcccctccaaccaccaccccgtgccgcagccgagatcgggggcgtgctgatcaacgtgacggtgtcgctgacctcgcggctgctgacgggggagcgcgccctggcgacgcgcagcgtgcagagcgccgacgccttccaccgcagcctctccgcctcgggcttccagctggtcaacgtgggcaacgtgcccatcgggctggggcgctgggtggtgggctccgaccccagcctgcgcggcggccgcttcagcaacggcttcctgagccagcgcgcactgcagagcaacctgctgcgccactaccgccgcgaggcgctcaaggaggcgcataaggtgctgtccggcgcggggccggccatcgcgtcggtgccgctgaccgtcatctgggcctcgggctccgccttctccctgctgcgcgccatctcccgcggcgccaccgggcccggcgccgcggcgcagcagttcgtctacgtccccctcatgggcatcagcatgatcgtgtcggggttctcgcgcatgctggcggcggtgctggcggcgctgccccccgcccgtgccgacggcgacgcggccaccgtccagcgcatcatccagcgcccggggtcctccctggaagccctcttccgcgtgggccaggagctgggcctgggcgtggcggcgggcctgtccggcatcatcctggaccccgtggccggctggcgcgcggggggctgggccggcttgtccctgggcctggccaagggcctcgtgctgggcctgctgggccggcccctggtgggcgtgctggaggcgggcagccagctcagcggcgcctttgcccgcgcggctctgggtcgcgagggcatcctgggcaagctgcagcgccgcgtgcgcgccccgggcgcgcacggcgacgaccccggcgactcgctggacgagcggacggggggcgaggcacgcgtcgcgctgcgcgcgctggtggacgcctggcagcgcgtgctgccgcagttcttccccgtcctggcgcgcgaccgcgtgctggacgtggtcaacctgcgccccagccgcgtgctgctggtcaccgaccgccacctggcctacctgcgcgcgcgccacctgcgcgcccactccgtctaccgcgccaagtggctggtcccgctgtccgaggtccagaacctgacggggtccgcggagagcatgaagctggcgctcacccacgtccaccgctacgacctctggctcctgggcgtctggcccgtggccgcgcgcaagaagatgcgctgcggatcgcgctccgtctacgagcacacggtggccaagctgtcgcgcctgctccaggccgccaaggccggcggcgggcgcctgggctggggagaccgcgaggacgcgctgcgcggcggggccgcacagctcaccatcctctccgcgccctaccacccgccggaggcgggggctgtggcggcgggagcccagaggcctgctccacccgccgacgccaagtgacgtcgctgaccccaggagagatgagagagtcggaagcgggatggccaatgtcattgggcgccagtgggtgcctgcagcctccatccacaccaaaacattcagttcctgctgccttctgctgcttgggggggagggcacacgatgcactcccatcccttccttgtatcgctgaataaagagtccttgatcgcatgacacctgtaactacagccaatcagctnnnnnnnnnngagggcacacaatgcacccaccccttccttgtaccgctgaataaagagtccttgatcgctttcatgacacctgtaactacagccaatcagctggtgggatgacaatcgatggcagaagcactcttgaatgatgaatgacatgctcacgtccatcaggaccgaaccggtatgcggtctctgggcgatgactggagttggtgtgtgttggagtcctgccttgaatgactgtgagagaggaccattccgaatgtcagggcgnnnnnnnnnnggatggcagaagcactcttgaatgatggatgacatgctcatgtccaccaggaccgaaccagtatgcggtctctgggcgatgactggaattagtgtgtgctggagtccttcctcgaatgactttgagagaggaccattccgaatgtcagggcgcgagatgaggcgaattctctgcgtacccacagacccatccagctgcgagcctcgcctgccatgggtgatctgatagttttatgtgaaatgttgcatgctagtctaggcatcgcctgcgttggatagggtgtccaggcctcgcgaggcagccataggtgctcgagggtgagctgcgccaacttccgagaccatgcgcccactcctcacgcatgcattccgcgccttctcagcctcggccagggcaccatcgagacctgccttggcgtggcgaggccaggcaaaacggcgatgggcggcgagcagtgcacaaccacgggcccagagcgcacaggggagtactgcatcagacgagttttccatcacctgccctcttttctacgtcaatgctggtgcgaagggatggaccctggaatactcgtttggattattgcgtgaatgacaagggcatgcgtgagcaaggggttgtggatggagcatagagtagattgtacatggaaaacttgctcacgtccatgcagacatgaactcagtcacatctcggcccatgcaacatctgcttcccaccctccccaccacgcagccccacacatgggcagtgcctactctacaatatcgaccgatgtgtttgctaggttccaggcaaggcattgcgttgggtggnnnnnnnnnngtcatagagtagattgtacatggaaatcttgctcacgtccatgcagacatgaactctgtcacatctgggcccatgcaccgtctgcttcccaccctccccaccacgcagcgccgcacatgggcagtgcctactctacgatatcgaccgatgtgtttgccaggttccaggcaaggcattgcgttgggtggnnnnnnnnnnttccttgggttttccagcctcttctgaaaacataacatccggctttccactgctccgtcctttccagaggatgcaaggacgaagggtnnnnnnnnnnactattgggttttccagcctcttctgaaacataacatcaggctttccactgctccatcctttccagaggatgcaaggacgaagggtgaggtttgtcgtgggcaccgacgagcatggggagaagattgctgccgccgccgccgcgcgtggactggagccccaagcccactgcgacgacatagtcgccagctacaccaagctgtgggcagatgtgagaagaagggggactgagatgtgggaaggacacagctcagtggatggctctgcatgagccctgggaagcaggcacagcagcaggccgggaatacactaccgtgtccacttaagattgtggcttgatggaccctgacagtaggagggcattcaaaccactccaccacataaacccagcagcttctactccatctcaacggtcgcatgctcagtctcatgcacatacacaattgcagctcggcatctcctacgatgtctttgtgaggaccacccagccggcgcatgcggaggtggtggcccaagtactggagcgggtgtgggacaaagacgtctacaaggcggcctacagcgggtggtactgcgttggctgcgaggagtacaaggacgagctggagctgggtccaagtgaggcaggggggttgctggtgggtgttgcaactcgcgcacaagctggacaaggagtaacgaaagctgaaagtgggagcctctgcatgtttgagatgtttcaatgccgtgcatcgacacattcatgcatacccaaagagcaagccgcccacgccctgcccaaaagttcactcttcgaatcccgcagatcacacttgcacgacccaccagacactgtgccagcacagggaggaggacaactacttctttgcactgtccaactaccagcagcagcttgaggtggggattgtacatcaatgcgtttctttccctgagcagtgtcaatggctcgctatggaggggattggctttttaactctctgtgctcggcaacctttcagatgctgaggctggtcccccccaacccctctnnnnnnnnnngatggaggggattgtttttttactctctgtgatcggcaacctttcaaatgctgaggctggtcccccccaacccctctnnnnnnnnnnaccctgccccaaagatcactcttccaatcccgcagatcacacctgcacgacccaccagacactgtgccagcacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntacacacacaggacttcctggagacacaccctgactttgtgcagcccgcctcggccaggaacgaggtcctggcctgggtgaaatctggcctgcgcgacttctccatctcccggtctgcggtgtcctggggaatccctgtgcccctagacccgagccacacggtgtacgtctggtttgacgcgctggtgggctacctcaccgccctgctccagacgccacccgggggtgtgtcgctcggtgcgactggcggggcaccgcctgacacggcgcgtcccaagggcgagacgccgggctccccccgcctggacgacctgccccggcacggctggccggctgccgcccacatcatnnnnnnnnnntgagggcgagacgccgggcttcccccgcctgggcgacctgccccagcacggctggccggctgccgcccnnnnnnnnnnaagacatcttagattcgggacgtttgataggggcgtctgaggtggagggaaacatggctnnnnnnnnnncggcaaggacatcctgcgcttccatgccgtctactggcccgccatgctcatggccgcaggtgttgggctggggggtgggacatcttagattcaggacgtttgattggggcgtctgaggtggagggaaacatggctggagtcctgtgcttctactcatctgcgtcctttctggagaagcttgggtccgggggcggttgtgcctgcacctgcaccttgctccccacccgagggactctgacttgccagggaaagatgctgtgccagcccttggccatgatgttccccggtcttagcatcagctcgtcccattgccccagtccccccccaacccatctccaccctccctctccttcaaccaggtctgcccctgcccggccgcgtgtttggccacggtttcctcaccaaagacggcaggaaaatgggcaaatccctgggcaacgtgctggacccacgggctctggtggatgcctacggcgctgacgctgtacgcttcttcttcatgcgcgagatcgcgtttggcgccgacggcgacttcagcgaggcgcggttccaggccacggtgaacgcaggcctggccaacgacctgggcaacctgctgaagcgcacgctgggcatgctgcacgccaacgttggggacagactgccgtgcggcgcaggcgaggcaggggtgcgggacgnnnnnnnnnntgccaacgccggggataaactgccgcgcggcgcaggcgaggcaggggtgcgggacgccacgcgcctgccgggcgttgccgaggccgcggcgccgcgtgccgcggcggcctatgcggccctgcagccccacgccgcctgcgaggcggcgctggccgtcagcggcgacgccaacctcctcctgtcagagctgcagccctggaccaccctcaaaaaggcagggctttggctttgtggattgtgtgtgcggaaggggggaaagggggccggcggcggcccatggtggatttgagatgggcgacctccagatcggacggcatggacactgaatgaatcgcgggcatggtggagcacatctttatcaaagggtggcctgtggcaagaacaggtgttctgctcgaattcccaccccgccataccacacgggtccccctccgtgaacaccaccccctcattgacaggggacggaggaggaaaaggctgccgccatcacggtgctggtggctgtgctggaggcggtacgcatcgtggccgtactgctgagccccgtcacgcccagcctctcacatgccatcctgcgccagctggggcaggaggcggctgctgcggggcagccagcctggagcgacgccgcctggggaaagttgcaggccggcacgagccttccgccgccggagctggtcttcgcgcgcatcgcccgggagtttgtcacagagccggcggcgggcgcggccgcggcgccgaccaagggcgccaagcgcaaggcccagaaggtggcgtcctgactctgagtatctgcgatgagtggcccttacgttgctggacatcttggattaaaaaaacatgccaagacttgccagcatgtgatcccccgnnnnnnnnnnttctgcgatgtgtggcccttacgttgctggacgacatctcggattaaaaaaacgtgccaagacttgccagcatgtgatcccccgccgcctggacctcgcagctgcatggcagcatgtttgcttgtctaattgcctgctcctttcggatcccagcacatcagaagcgagttcagcatccaaggaccatcactcactggccccttatgctacagactgccgcaggcgggagcagtttaggtgtgcgccagggcctgaaggtggaagtataatactgttgcaacaaatggtacagggccatggcttctcagccagcagggaacgggggcttggttggtcagttcgacgcacatttggcagtgcgctcgagggggaaaaggcacgaactcgcaccaaaggtgcgctcagcgctggtgggcgagtccgcggcacgnnnnnnnnnnggggggcttggttggtcagtttgacgcacatttggcagtgcgctcgtgggggagaaggcacgaactcgcaccaaaggtgccctcagcgctggtgggcgagtccgcggcacgcccacagggcgagcgcggagcccaccgccgcgccagcggctgccgtgccgaagacggcagggaggatgcccggcaggagggcgcccggcaggagggcagtcagggnnnnnnnnnnggcggctgccgtgccaaagacggcagggagggcgcccggcaggagggcagtcaggggcgcggggaggggatgtgaggcgccggcagcgccgtcgagcccagcccccgccatgcccccgagctccctccggccgccggcctcgcgcaggaggcgcagctgcaaggcgacttcctccagctgcctgcccagcagcagttggctgtccagcagcgaagccagccgcgcctccaggtgcgacgagctcggcccctcgcccccggccttgctgggtgcgggcgccccctgcgacccggctgtcccctgcccggcggcctcctcgccgccgcgccgcggcnnnnnnnnnnctgctgggggcggatgcccccggcggcccggccgtcccctggccggcggcctcctcgccgccgcgccgcggcgccccctcctcgcctgcggcccggtggcgcccgttggcggccggcgccgggcgtgcccggatcgcgatgcccccgccccgtccgccctcgccctcgctctggctcccgaccccgctgctggaggaggcggtgtcctccacctcccgcccgccgcgcttggagccgtgcgccgacccagccgcgcccatgtgctgactcagcaggccctcgggccgggaccccacccgctcctggcccacgctgccgggcgacatgtgcaggcggctggcggccacgggggctgcgggacgggcgtggagggggcaccgtcgggcgtgccggagacggtgggcgggcactgcatgcagcgcaccctcccgcccacggcctgacgacctcccacatggccccaggcccccgccagtcctcctgcatgcccctccccagcacaccacccctcggcgcacccgaggtgctgaagggcgtggtgccgctgccgcccccgcaccccgacagctcgaaccccagggtgcggcggaaggagccggaggccagcgggctgctgccgtgggagaagctgctgcccagcaggcccgggccgtccaggggctccccggaaaccttgaaccggcgcttcaggtcctcggtcacggtctggaaggaggttgtcaggttctcgatctgcaccagctcgatgtaggagtgcgggatgtaggtgccctccaggcccagcgccgcgccgaggcgcgtcgtcgcctccctctccttgctttgtacctgcgcagcgggggggatgggtgcgtgcctgggcttggagaggggagtgggagggaaaagagggcggtgttgccggcgcatggccgcaaggaggcgccgcgacgaggtggnnnnnnnnnncacctgcgcagcgggggggatggggtgcgtgcctggggttggagaggggagagggagggaaaagggggcggtgttgccggcgcgtggccgcaaggaggcgccgcgacgaggtgggactgggggagcgacagagtttcgcccaggcaccgccggcaacattgccacgggtggcacgctgcgcagtcgtggaaacaagcatcgaggtatccgtccgcagtggtcaccaaaaatttccccccctctccaccacccgctcacctgcacaaagctgcggtccatgccctcgatggcatccagcttgatggtcaccctgcggcacgaggacgccgggagtgcggtgcttgagcggcgtctcacactggcgacgcccgtgacagggctgttccggggcgcctctcatgtcgagagcgtcccacnnnnnnnnnnagggtggcacgctgcgcagtcagggaaacaagcatcaaggtatccgtccgcagtggtcaccgaatatctccccccctctccaccacccgctcacctgcnnnnnnnnnncgagcggcgtctcacactggcgatgcccgtgacagggctgtactggggcgcctctcatgtcgagagcgtcccacggggggcctgcctggaggtttcactattcagggatggcagcccagggcccacccacaggcccaggtaccgcttgtgcccaagtcctcccggtgcccccaaagccccttccagccttccacccccccttccacacccacacctgtcgttggagaaggtgcnnnnnnnnnnatgcccccaagcccccctccagccttccacacccccctttcacacccacacctgtcgttggagaaggtgcggctggttcggcgcatgatagtgccgacatcgtaccccaacgccatgaggccgcccaggatgcggacgggcacctcgaacgtgaccctgggagagatgatgacgctgccgtccaccacccactcctcaaacatgagggagtagcgcccgtcgcggtaccgcatgcgcagccagctggcgcacgactccgcgtcctcgttgggcgggaggaggtagatgtcgtagctctccgtcgtgtcctgcttccccgcagccgcgccgtcgccgccctgtgcagccggtcggtgtgggagggtggaccgggttgggagggggcggccgggggatgcagggagcggggattggagcacagggaggggtcccaagcactcatgcccacggtcaggtgcccgccaaagcgcacgcaggtcacattccccatgcacccacacgccaaacacacacacaaagccgcaacacccgcccatccaaccctggtgacaccgcgggctgctgctcacctcggccagcacggccagcacctgctcctcggtcactgcgctggccgacttgaggatgtaggtaggactcatgaacccggagaaggggttgaagcggttgtggatgcgcaggtgggcggcttgcaggtcgggctctatgaaggccttgtacatggggtacaccgtctcggagacctgctggatgatgtcctccgccgcctgccccgagcggttgatgtcgcgcaggacgcgcttgaccaggtcgaagtgcacgccgccggtgatggagacgcggaggtccagcatggggcgcaggcgctggctcagcgcgtagatgccctccaggatgaccacgcgggaggaggtgacctccacgcgccgcgttcccacgcgccggctctccttgaagtcgtagatggggacctccgctgcgcggccggcacgcaggtcggtgatgttctggatcagggtgtcgaagtcggtgatgcgggggtctgcaggggtggggggggtgttagggggggggggcaatgaaaaggggagggcggacgcacggcgcaggggtgcaggaggcctgaggggcgcggtgaaatgccaggattgcannnnnnnnnntgtgtgtgtgtgttagggaggggggcaatgaagaggggagggcggacgcatgacacaggggtggaggaggcatgaggggcgcggtgaaatgccaggattgcaaggtcccagatcataaaaccagagccagctgcccgctctatgacacacatggcctgtgcacacagggaaggggacatagatgtacgaggctcccaaccttgccctctcaaccatcccaaccgacacacccaccatcaaagttgccgtcgatgaccttgctcccgnnnnnnnnnngaggggacatagatgtaccaggctaccgacctcgccctctcatccatcccaaccgacacacccaccgtcaaagttgccgtcgatgaccttgctcccgtcgttgtacatgtccatgctcagcaccacgctgtccggtatgaaggactggatcttggctgagaaggcggtcttgccggacccggaggggcccgcaaggcccaccaggatggtgtctcggttctgggagcagagcagctggatggcccgcaccaccatgaaggaccccttttcgaagctcagcaggccctcgcgcggcttgatggtgtaccgggaacgtccatccccggacttgtacttcaccagctccagctggtctttcagcaaggcctgggggatcaggggcgcaggagcggcgtgggacggcgcccttcaaggcaatgcgggctggtgtggaactggacggcacagcgctcagcagcagctcctctgcgctgcattcttgcatattatcacctttttctcgcgagacatgggcgtacgcgcctcccctgctcgggacccgttccgcacgatgtccatggctggttcaaatagcaagtacgagatagcgagcgaggaatggagaacccatgcagggtgccgggtggggcaggaggcttgccacactgcaacgaggtttgggcgaggtgggtgtcaaaacggctcgagcagctgtcgaacacctgggcccggatcgaaacgcttggaatcctgctcgctgcatggttcccaaccttgaccgatacctcacacccagccaaaagtcaccggagcccacccatgtttatgcaagtactgtaatcccgaagtatcgcttgatcgggctgtgaaccccctcgttctacccggcccgtagtcgcccgttcgcgaggcctggtcatggcccttagagagttgggcaggcacggtatttcagctccaaggcgtgcccagataaggagcagaggtggtaatgcttcagcagctctcccagggtactcgttggtcctaaaatcttagcactgtgtttctgcnnnnnnnnnnctaatgcatcagcagctctcccagggtactcgtcggtcctaaaatcttagcactgtgtttctgcacactctagcctttcacagccgagagggccagtccgactgaatgagtgcttggcaccattggatgagctcatgcatatcaaactgaacagctggtggcaggagaggtcgtcannnnnnnnnnggggccagtccgaccaatgggtgcttggcaccattggatgagctcttgcgcagcagtctgaacagctggtggcaggagaggtcgtcatccgtgcaagagcaacgatacgcgtccgcgctacagtcgtggggaggtagtctgttcctatcattgcatggcttccttaccctgcccagaggcatcacattctcaatttccatgccatatgaaggtaatgcgcgtgccagcgccgtgccaggcgggggttagttgcagtatcgtggggtttggctagtccgcgtaatatgaaatgatttggttggtccaaggtagacttaccacatccaagtcccaaactccagtgtgggcgttgggtttcgtggtctgagacgcgtggcgtgggttcgacgcagtgcacgggtccatgtgcgaaccggcatctgaaatttcatgcacaggcatccctcctggtcgaaatatgcctgcgatactaccatgacaccgtagggagcactctgatggctgttggaagtactctaatccggcctggcatggaagaggactttcacaagcttgtctgaacctgtcacgagagcaacgggtgcactgggaggcgtgtggtggacgaacacatgtcatccaagccgtgttgtccttgtcataccactcttcacacccaccaatacaaatgggtgcagcgtggagtgctgaagtggggcctgttacgggaagaagtggtgtacaaacagggactgcaaagtctctgtcatggatcgcgaccgtcaatggggcgggcaacgtactgatgttgccgttctcttctttccccaacggtccgcccattgtggcaaccatcacgcatgcgtgctaccctcggaaggtgcaaagcagccggacagcccagcagggatcagggcagtttgttttacatgttacatgatgctccatctcacgtgaggttagtcttgcaagctcctggaacaaaaaggccataaagatggatgttagcacagtaagggtgtatcggtgctcagggatagcgtcacattcaatgcgcatgaggatttagatgctatttggaacccctaagctattgtcgtggtttggtctccaatgggtgtggaccctccccagccaacaaggcttccccggcagtacctctgatccagggttacagagagcaccttacaagcgcagatggcgtggcacaacagaacatcctctcattgtcatggattgcacagagaattccctagcaagctcaggctgccccacgacaccaagggcggccaaaggattgcagtggctgcacctcactccttgatcagtgcgagccgcaggcacgtgacaccgatgagactacgaattccagctacaaaacaggcccacagcatcaggcctccttcttgatgtcnnnnnnnnnnaatgatactacaaattccagctacaaaacagccccacagcatcaggcctccttcttgatgtcgaagaagaagtctgcggtgcgcaggcggtcgatgagggtggcgcccagtccgctggcgggggtgaggaggccaccgcgctgcagctgtgggtcggcgtccagggcatccgactgcagcgcgaggcagagcgcggcctccaggaccaggcgggagccgccctgtgggttttgcgcaatgatggattccgtgaggcacgctgagttgtggcagcgctgatgcattaccacgcaagccgttttgctaatgcagcaccagagcgataccctgacatgagcaccctgatatcctgacgtccatccctcattcatcctgctgcagcaccgccctccaccactccaaggtcaatctcaagctcacccagtatcccgggtctccgtggttccagccgacctctgcccgaatggttgtgggggctgtgccatcctcctcctgttggattgaatgagcagagacaaggtggcattctggatatcagccactcaactgcactctgctggctaccagaccggccccaggcaagtcaaaatatgagctccctgcctcacctgtccagcatcacaccccatgcccagggtccaccctccatgaacaaaacctcagccctgcagcaacatacctgggtcttggccaggacgatgtgcttgaagtgcccgcccagcatggcctccctggtggggccctggcccggggttgggaggaaacggaggagcaggccgtgcagccaagcctggctgagcgccaggccaaagccgagcaccccggcgcggatggcctgcgcacccaaccagctcttggcgggcacggtctcctcgtaccggaagtcgtctccgtacgacagaaagtagttggagcggtgcaccacgcggttgttgctggggaggaaagtggggtgggcaagaggggagggctgctgatgccggggccatcagggtgcccggccttcatggcgtttcaaggtgagtcctgaaacccccaacgccacctggactcaccaaacctgcatgaagaagcccgtgaggtacttgtggacgtcctcgttccacttgacgccccagaactctgcatccctgccccaggcagagcgcggggtcagcgcatagacattgcgtccatcgtctgtcttgacgctctgagaggcaatctccatgcctgggcgcgagggtgcggggatgctaagtttggtggggagctaagaaaagtatgccctgcggccctcgtgttggtgctgcttcatcatacgggtcgtgccagggcggcatcttgcacactgtgcaaaccccctacaagcccgtagaacaaattccaagcaccccaacctcgcacccgaagcgatggtgcctccagacacaccgcccnnnnnnnnnnaggaacgctaagcttggtggggagctagaaaaagtatgccctgcggccctcatattggtgctggttcatcatacgggtcgtgccagggcggcaccttgcacactgtgcaatccccctacaagcccgtagaacaaactccaagcaccccaacctcgcacctgaagcgatggtgcctccagacacaccgcccttgccctctgcaacaacagtggtgatactcgccagcttcttgcccagcttctcctgggcgtgctttgccaccagcagggcgcccaggtcgctgggcaccgaatcgtacctgatggaggcagacggcgtgcgtgagggggtggaagctgtgcactactgctcatgaccggctcccaccaggctttctgttgatgctctagcagacatcaatccaccttttcacaaggaaggacagcgccaacactcacgcgcagcatggaatgaggcggatgcccttctccctggcggattcgtggtacttgtccaccagggttgtaacccaaggaatctcccctgccaaaatttgaatacaaagagggtgactgacctgggacagacgcggggtccccaccacacgatgctcgcatgacaagcagggcgtacacaactcaaggtcccagccgcacaactttgtattccccgcagcaagaaaccagaacatgtctgcatcatcccatcttctacctgtgatgtcaacataatgcgtcccagcgtgcacggcagcgtcaacaacgggggtgccgagcctcaggtagggtccggcggtggagatgacgaccttggcctgcgagaaggcggcatgcagcgactggggatcctccaggtctccaagcaggatggggacgtcctgtcaatagaacagagggttggggaggttggcatggaggaccaccaatgcctcagcagatcacatcgatgagcccgtgaagcacaccccctgcacaacctttccccctcacacttgccccttgcattgcactaggcttggcacctagccatcaccgttgatagagccctttgtgcacacctccttgtcgaagccatactgggtgctcaaggaaagccgcaggctctcgaggcggtccctgcttcggccagcgatcgcccacttgactttgccctgtggccaagggtgagaacaaggggcttacaggagacaatccaaaagcgcagagtttctcagggaagagataagatgcaggttgcaacaaccatcaagacaagaagtaacccaagtacctggtaggactgtgcaaggtgctctgccaccaatcgacctgcaggaggaagaaggtcacctcacgtaccacacggcatccgcatggccagaaattaatcaatgccggcatgtctggttcaatactcatggtacaaaatcatctgagtattccatatctcacctgtgaaaccagtggcgccccagaggacaaggtggaaggggcgcgccgtggtcgccatggctggtttctgggtggccaagttggtaaaagctcttcgaggtgccaaacttgcgatccttgcagtgaatgaacttatactgatcaaccctgagatacttaatcagctgagcgagggggtcgacactgacgcgtgcctaaatgctttaaccattggtaagcaagccaagtacatcgcaggttctgctcgcgcgcgcgaagtctcgacacactttcgcccagccaacccactgagtgacggcaacgtattaacactacataggaatgtaatgagccaaacttatagcagatagtagtcacatcttgctgtggcgatgaagagcgtgctcatgcccccccatcggtgtgttnnnnnnnnnntatgcttaaagcattggtaagcaagccaaatacatcgcaggttctgctcgcgcgcgcgaannnnnnnnnnactgaggcgacttcagctgggaagcattggcgtgccgggtcgtcttggagcttgtcctcgccatttccaggccgacagcttggcnnnnnnnnnntctgaggcgacttcagctcagaagcattggcgtgccgggccgtctcggagcttctcctcgccatttccaggccgacagcttggcnnnnnnnnnngaagtgacgacagcgtattaacactacatagtaatgtaatgaggccaaccttttagtagagagcagtcacatcttgctgtggcgatgaaaagcgtgctcatgcccccccatcggtgtgttttgcatatcaccatgcatcatccctccaacccttgctgagagttcattggagaccctgcctcaccatgcccgagcccgatgtagctcaccgagtaccnnnnnnnnnnnnnnnnnnnnnnnnnnnnnnnnnnnnnatgggaggtggacgaggagccagcaggcaccccctggaccttgccagctccgacccccggcctcggcgcctcctctggccatgcatcgagcacaccagctgcatcagccagcgatgtacatggtccaggccagctggaccagggctccctcccaggaccctttcaaggggcaggtgtcctgcatggcagcggcgacgcccctccagcccccggccccgtccccaccgtgtttgtgggcaccctttacctgccctccacgcctggcagcgcggcccccttcagccgcttcagcggcaggacgccctccggcggggcacccccggccctgatgcacgaagtggtcaggactgacgcacgctgggcccgcttcctggccgcgaccaccccctttgtggcctacaacctgctgctgggatccagggtgggcagggacacggtggtgctcacctgccgggacgccgccgagcgcctcagcgccggcctggtgagcagagaggggttgggtggccgggaccccagcgaggcggctttgttctcgggctggtgcctgcgtttgcaaccttggcgtcacctcaccgtagccaccatgttgtcgcgtatctcccttctcactccctgacacccccttccaccacaggtcaagctggtgcggcctggagaggaggatccctcccctgcagcccccgtgcccccgcccaccgatgacgagcnnnnnnnnnntgccgtagccagcctgttgtcacgtatctcccttctcactccctgacaccccgttccaccacaggtcaagctggtgcggcctgnnnnnnnnnngcagcagtgctgttcctggctggactagagcggaaggacggggcggtggagcctgtcacgatcttgtacaccgggtcctgcctcacctgtggctctgctccctccaccccatcgcgccgcagtcatggagagggacnnnnnnnnnnagggtcctgcctcacctgcggctctgctccctccccccccatcgcgccgcagtcatggagagggacagcggaccgtcggccgccgcccagcctccgctcccgccagggggggggacctggggctgctgcacaccccccgcctcggcggcggcgctgcccgacggcagcgtgctggaggaggtgcccacgcacgtcgccgaggacgcaccctccccgcagtctgcggtgatggccatccccgtccgctgggcgctactggccatggccgagctgggccgtcggggcccggacaacggcgagggcggtggcggagggccggtggcgaggcggcacgccggcgcggctcgcggcggggcggggggcctggcggtgctcgccgactgcggagccgagaccacgcagggcgacga

SEQ ID NO: 43991 - DNA, 1322 bp, Chlorella protothecoides
  modified_base (105)..(114): a, c, t, g, unknown or other
  modified_base (453)..(462): a, c, t, g, unknown or other
  modified_base (691)..(850): a, c, t, g, unknown or other
  modified_base (1024)..(1123): a, c, t, g, unknown or other
agcccgggtgcggcgtgcggcagcacgccgcctgcgtggcgccgcatgccggaccgcgcccggcccccgccctgcaggccgccttccgctgcgagcgctgccgcnnnnnnnnnngctgcgtggcgccgcacgccggaccgcgcccggccccagcccttcaggccgccttccgctgcgagcgctgccgcgccgcgctggccgaccccttctggacgctggcggagccggacctgctgccgcccgcgctgctcaagcccatgccggggcgcgcaccggtgctgaccacgcagggcatgcagggggtgcagggcacggagcgcatcttctacctttccagccagcagatcgagctggtcacgcggcaccacgacgaccaccgcatccaggtgggtcgcctgtcgttgttgttggggggggcgtccgggcaggaccccgctgcgatacgtcctgcannnnnnnnnnttgtcgttggtgttgggtggggcgtgggggcaggaccccgctgcgatacgtcctgcaggtcctaacactcacaccaccctcccgccccttcccctccccccctccttcccactcccttcccacccatgcctccccccccccctgcaagcagctgggctgcatctgcctggcggacgaggtgccgtgccgcttccactggccgcgcaacatggagctgcgctgcaacggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgtgcgcgggcgcaacagcctggtgctggtggccgccgacgccggcgggtgggcgtgcgtgctgcagcacacgcggcgctcccccgccgccgccgtcgccacgctggccctgcccgcggagggcgccgcggaggccgtgcaccgtgtcgcgcgcctcgtggcggggggcgccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggtgggtctgcgctgccccatgtccggcgtgcgcatggcgaggcccgcgcgcttcgccgacgcctccggcctgcaggccttcgacatgcacgccttcctgtcgctggcggcgcgcaaccgcaagtggcaggaccccatcaccctccgcaactccaccatcaagcagctgcaggtgttttggggggggggggtgcaccg

SEQ ID NO: 43992 - DNA, 61 bp, Chlorella protothecoides
cgccaatgccataggcgacgcagacagaggggaagagccagatggcgttgctgagctggat

SEQ ID NO: 43993 - DNA, 64 bp, Chlorella protothecoides
tctgggaggggttgcgcagcgtctgcctgcggatgatcggccaggggcagggggtggggcccag

SEQ ID NO: 43994 - DNA, 61 bp, Chlorella protothecoides
caaggtgctgaagaccacgcagagcggctaatccggcttcctgcatgacaagttcaccacg

SEQ ID NO: 43995 - DNA, 61 bp, Chlorella protothecoides
atggggtccaaggcggcagtcggggcggggggcatgatcggcgaggacgtggtgctgggcg

SEQ ID NO: 43996 - DNA, 61 bp, Chlorella protothecoides
cgccagggatcgtgtcgtggggacaaacaccgcgtgccccccctcagtggtgtgcgcaata

SEQ ID NO: 43997 - DNA, 97 bp, Chlorella protothecoides
cagccgccgctcggcgcgcagcacctccaccgcagcctgcttgaagatgccgcccccctcggggccggcaggcgggcggccggggccggcgggggcg

SEQ ID NO: 43998 - DNA, 61 bp, Chlorella protothecoides
gcgctggggggccacgtggccacgctgcgcctgctgtgcgacgagggcacgcgctgggcgc

SEQ ID NO: 43999 - DNA, 2844 bp, Chlorella protothecoides
  modified_base (157)..(224): a, c, t, g, unknown or other
  modified_base (294)..(303): a, c, t, g, unknown or other
  modified_base (672)..(681): a, c, t, g, unknown or other
  modified_base (1673)..(1682): a, c, t, g, unknown or other
  modified_base (1800)..(1809): a, c, t, g, unknown or other
  modified_base (1895)..(1904): a, c, t, g, unknown or other
  modified_base (2642)..(2651): a, c, t, g, unknown or other
gggtcagcgtgccgccccccgccaggccgggcgccgtccagcccgcctccgcgtcgtcggcgggcgggccctcctgcgccgccagcaccaggcgcagcgcgcgcagcacgcccatgcgcagcagccacgcgcgccgcgcctcgtctgacgccagcgnnnnnnnnnnnnnnnnnnnnnnnnnnnnnnnnnnnnnnnnnnnnnnnnnnnnnnnnnnnnnnnnnnnncggacgggagaggcgccccacacaaaacgaccaccagcaccccgctctcccatatgattgttcccccgcnnnnnnnnnntggacaggagagccgccccacacaaaacgaccaccagcgccccgctctcccatatgattgttcccccgccgcaccgcgatggtctgcgccacggcggcggcactggggccggcgtcggcgccctcgccgcccggcgcccccgcacgcgccaccgccagcgaggacagcgcgtcctcgctggcgtccaggggcaggtcccaggtcgaccccggcagcagctcccccgccaccgcacgcacaaaggcgggccccaccggtgcggcgtggatgtacagcgccagatcggagtcgttggggccccccggcggggctgtgggagcggggccggagggaggagtggcgtccgtgccgagcgcaggagcgggcctnnnnnnnnnncgggggcggggccggagggaggaccggcgtccgtgccgagcgcaggagcgggcctgtccgctgcagggtcgagagcgccaggggcagcgtccagcgtgccttccgccggcgagctctcaccgccaccccacggccgccaggcccaccatgaggaggccgacccctcggcgtcgtggggcggccctcgcgtagaccccggcgccagccccgcccccggcgccccagcctcgacggcgagcgcctgcccgccggcccaggcaggcagccacccgccgagccacgcgccggtcctggaccccgcctgcaaagctgcctggtcacccttcacagcagccagggcctcttcgccgtagggctgcacgacgaaggaaagggccaccaccatctcggccagccaggcgtagagcccggccctgcaccccgcctccaccaggcctgcgggcgattgtgtggagggttgatgcgcaggggcggtgcctgggccagcttgcttgagacagctgggctgctgcgccaccgccagaccaaccctgagcagccacatcacgaacaaagcccggctgcggtgccgggcgagcgcaccacaaggcaactcttaggcccccgaccggccgcatgcggcagccctccttctctcctccctccatgacaacgcgtcccatcgtcgtcacgactcactctccagcgccagcgtgaagggctggcaggcccgcgcgctccgccgcagcgtggcagcgtcggcctctcccgacggctcgcccgcggcgtgccgcgcccagcccagcacggtctcggcccaggcgtcgcgggcggcggggtccagggcccctgtcatggccagcgccctcaccaccgtggcgacagggcgacgcgggccctcatttcctccagcggagatgcggtgcaggagcgggagcacggtgcccttaagcagcgccggctgcaatggggccaggggacgtgttgtgtaacgggggggaggtacagggggnnnnnnnnnngccacaaggcaactctcaggcccccgaccaggtgcatgcagcagccctccttctctcctccccccatgacgacgcgccccatcgtcatcacgactcactctccagcgccagcgtgaannnnnnnnnncaccaagccatcgccccctttccagcaccatgcatgggaacgccgcccaaaactcgtacatctccccccactccggcctcatccannnnnnnnnngagcagcgccggctgcaacggggtcaggggacttgttgtgtaacgggggggaggtacaggggggcagcaggattgcagtgttgcgacggggcacagactctgcaggcggcactgatgtgtgcagtacacgtggagcttttgcccttgagctggcacggcaagttcccctgcttgcttgcataaccagttatcgcccccttccagcaccatgcatgggagcgccgcccaaaacttgtacatctccccccactccggcctcatccaaaatcccaatgtccctcaccggcacaccgtcccccgggccccgcctcctcacgcatgccgcaaaggcggtgagcgatgcgtgcaggagtgcaccctcccccgccgccgccgcgtcggccgccgtgcagagctgcgggtgcagccacccggcggcctcaaggggcacgctgggcgggcagccgcgcgccaggtccttcatcaggccgcacagctcctggcgctccggctggccggcggcgagggcaaggaagcgcggcagcacggggccggcgccggcgcgtgccagcgtcgcgcagttcaccaccgaggcctgtgcccagccacgcagacagcgcagcgccagcagcgtggacgcggaggatgcggcggggtcgtgctgcagggagctgcctgcccggctgcgtgccgccagcaaaggggccccggccacgcccagaccgtgtgattcgaccccggtccccgggtcctcctccnnnnnnnnnntgatgcggcggggtcgtgctggagggagctgcctgcccggctccgtgccgccagcgaagggtccccagccacgcccagaccgcgcgattcgaccccggtccccgggtcctcctccagccaggcgagcacggcgcggacgtcggcggggggggcggcctccgcaaggcggccgggggagagcgcggcgcccagg

SEQ ID NO: 44000 - DNA, 61 bp, Chlorella protothecoides
gacagtgtgtttatcaagattcgaggcgggggcacacttgtacatgataccgtgaatatat

SEQ ID NO: 44001 - DNA, 61 bp, Chlorella protothecoides
catgctcccccacatcatcctgcaggctggggtcggtcctggatcgtgtgcagggcggggt

SEQ ID NO: 44002 - DNA, 3647 bp, Chlorella protothecoides
  modified_base (95)..(104): a, c, t, g, unknown or other
  modified_base (659)..(668): a, c, t, g, unknown or other
  modified_base (1132)..(1174): a, c, t, g, unknown or other
  modified_base (1341)..(1350): a, c, t, g, unknown or other
cgcatgccccgccggacccagggcgcccgggtcgtggtgctgcggccgcgcagtccctgcaccagcgggaccgggcgcgggggcgtggcttggcnnnnnnnnnnatcatggtgctgcggccgcgtagcccctacacctgcgggaccgggcgcgggggcgtggcttggcgcgggcgcgggcgcgggcgccaggccgccctccgtctcgcccgacaccagcgcgtagaggttctcgtcgcgctgcagaaagtgccccgccgccagcacaaagttgacgctggccatgtcgcaggcgtcggccatgtactgcagcaccttttccagcgaggcgcccttgctcacgcccacgggccgcacctcgatgctgcgcccgccctgtggggtgacgtgtgtggaaggggggggggatggaccttgagagtcgggatccagagggcgattcatgagtggagttgtggatttctggtggccgatgccagcgctgtcctcccaggctcgagtcactcccgtcgccccctcaaaggcatcaccaaacgcgtcgccctcagtttcctccgcccctcattcccaggcgctccccctccctcccttcacaaaagatcctcaccctcacgacatccacgggcgcggaggagatgggccccgagatgaggtgctggnnnnnnnnnnacatcaccaaacgcgtcgccctcagcttcctccgccctcattcccaggcgctcccctccctcccttcgcaaaagatccttaccctcacgacatccacgggcgcagaggagatgggccccgagatgaggtgctggagcaggtctcgggcctgcaggcgcccaaactcgacgtcggcggcacggtagttccacacgatgctgtgctcccgctgctccacgaagctgcgcggagtgcgctcgcaaaagtactcgaacaccagactgacgctgtccatccactcgcccgagggcggctcgatgacgggcacccactcggtggcgccgggggggcgcagcagcatgccgttctccgccgccagccagatgcgcgtgccggcaaacacctcctccagcacctccttctcgctcccgctgaacaccaccacctgcgttgtcgtgagtgggggggggggggggggggggggnnnnnnnnnnnnnnnnnnnnnnnnnnnnnnnnnnnnnnnnnnnttctggggctggtgtccgaacatccgcctgccagacctggcgggcagcgtggagtaggaggctcggtgcggtggactgctcgatacctcgcgcccgttcccatctgcaggcccgctgtatgggcatgcacagcctcccccagatctgctcctgggtgggagacattnnnnnnnnnnccggtgggctgctcgatacctcgcgcccgtgcttcatctgcaggcccgctgtatgggcatgcatgcacagcctaccccagatctgctcctgggtgggagacattcacgacgcctcttttctcgcccctccaccaggtcgttactcccccaaaacacccccctctgtcccccgcttccccacaaacacatgtgaaccccccttcctctcacgtggacagtggggtcggcggcgagggcggccagcgcggcgacggcgtccgggtcgacgcgggcgcgggcgcggcccgggccaaagggccccgccgcgtgccctacgcccggacggtgcgtcctcccccccggcccctcctctcccggcgtcagcgtggcgttgtagcccaggaccaggaggcgccccgccgcgctaccgaacgcagcggccacgtccggcacggggagcggcggcggcacgccccgcgtgcgcagctccgcctccaccgccgtgtcgtccagctcggagatgaaggtgtcggcccaggtctgcgcagtgtgcacggtgacgtgcgcgtagttgtggcggtggcgctcgcgccgctcgcgctccggcatgcgcagcgcgtagccgatggccgcggccaggtcggacacgttccaggggttgaccaggagggcgcccgcgcccaggctctgcgccgcgccggcaaactcggagagcaccagcacgcccgcgttgtcgcgctggcaggccacgtactcgtaggacaccaggttcatgccgtcgcgcagggaggtcaccagcgcgacgtcggtgatggcgtacagcgccaccagctcgtggaaggacagctggcggtccaggtggtagatgggcacgtgggtgagcgtgccataccggccgttgatgcggcccacaacttcgtgcaccatgctgcgcaggcgctggtactccgggacgtcggtcctgctgggcaccgcgatctggaccaggagcacgcggtcgcaccactccgggtgctcctccaggaacttctcaaaggccagcagcttctgggggatgcccttgatcatgtccagccggtccacgcccagcatgaccttgcgccccgcgtaccggttcagcagctgggccacgttggcgcgcacctcgggcgcgcccagcgccgcggtgaagcggtcggggtcgatgccgatggggaaggcggcgacgtgggtcagcgacccgtcgtcctccacgccctccggcgtggcctccaggcccaggatgcgggtgcaggcggacacaaagtggcgcgcgtagtcgtaggtgtggaagccgatgaggtcggcgcgcaggacggagcgcagcagctcctcgcgcacgggcagcgtgcggtagatctcggaggaggggaagggcgtgtgcaggaagaagcccacctgggggtgggcagcgttccgtgcgtgggaaggtgggtcgagaggcgcaggagggcagaggtgccttgagctgggtcgggcgagctccttggtgtttgcagaccagggtgggagcggggcacaggcggcagagcatggagggttgtggcccgtggcccaccccccccccgggcctccctcctaatagcaggcgatcagcccacaacacaccgaccttcatgttggggcggcgctccttgagcaccgcgggaaggagcatgaggtggtagtcctgcacccagatgatgtcgccctcctggtagtgctgcatcaccgcgtcgccgaagatgcggttgaccatctggtgagcggcccactggaactgcagcgtccgcgtctctgacagcttgctgtcgatgttcagcggcacgtagtggaacagctgccacagcacggagttgcagaagccgttgtagtgcaggtccaccatcttctggtccaggtacaccggcgcgtagccctcgccgtgcagcgcagaggtcagcgcgtcgcgctccggtcccgcctcgacgtacaccccgggccagccgatccacttggtctggaagtgggccacgcccatgagcgccgacaccaggccccccgcgctgacctgcagctgccacttgccctccgggtcgcggtacgccgacaccggcaggcggttggccaccacgatcaggcgctgggaggcgcggccgtcggcgagtgcggggtggggcgccgcggcgcagaaatcggggggggcgccggcgccgccggcgcgggggtgcaccccgggggactcggcgccgggcacgccgggctggtcgccaaacagtactgtggtgctctggctcttcctcatgcgctggagcaggaggcggtctggggagggggggagg

SEQ ID NO: 44003 - DNA, 61 bp, Chlorella protothecoides
tggcgcgcgccgaggaggggtgtggcagggggcacttcctttggtcgagctcgtcaatctt

SEQ ID NO: 44004 - DNA, 6299 bp, Chlorella protothecoides
  modified_base (203)..(426): a, c, t, g, unknown or other
  modified_base (529)..(538): a, c, t, g, unknown or other
  modified_base (601)..(610): a, c, t, g, unknown or other
  modified_base (800)..(809): a, c, t, g, unknown or other
  modified_base (1233)..(1242): a, c, t, g, unknown or other
  modified_base (2120)..(2186): a, c, t, g, unknown or other
  modified_base (2412)..(2496): a, c, t, g, unknown or other
  modified_base (2775)..(2784): a, c, t, g, unknown or other
  modified_base (3132)..(3141): a, c, t, g, unknown or other
  modified_base (4258)..(4267): a, c, t, g, unknown or other
  modified_base (4601)..(4610): a, c, t, g, unknown or other
  modified_base (5381)..(5390): a, c, t, g, unknown or other
  modified_base (5871)..(5880): a, c, t, g, unknown or other
tgcttgccagcgtgtacatggtcatggggcggtacgtcagacgaaggagcggcgggaaagggaggggcatgcggggatgcgtgcgccgggcgtcaggaaggggcatcgctgcggcgacgcgcgaggccggcagaccgctgcgtgggccgccgtctctgcgttgcacgcgcaggtggaaagggagtgcaggggcgcgaggaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcccccgacgcgcacggctccggctccggcgccgccctgctccccgccggccggcagcgcgtcgcgcagtcgcgccatgaccgtccgcgccaccgcctggaannnnnnnnnngacctcatcctcccccctctccacttgaaaccgacctgtcctcgggagtagggtaccgcgcgnnnnnnnnnncacctcgtccacgttggcgttgctcttggcggaggtctcgaagaagggcagcttgtattcgtcggccagcgcctgtgtttgaggtggcacgcgatggggccggtggcggcggcacttgcgcaccgacacgtcgacggtcgataccatgggctgcagggaggtgggatgcccggcgggcacacgagaggtnnnnnnnnnnagtgtttcccttttttctttagatcccttgtgggggcctcgccacgccccccttcccccgccgctgcagtttcttcagccccctcagaactagttcgtgggcagcaccccgtgcctcttctttcattcctagtatgagcattcagtagcttattttggccccgcgcacggccttgccccctcaccctcgcgcgcaccccttgtctgactgaatcccctccccccccaccccaaccacgactggaggtcaaacttgcttccccggtgaaccccacggaatttagtccgacgtgttcccctacactcagcgctgtagatagtcaggctgacccttctgccgctcaaaataggaaaagaattccacaagggatcagcgagagctcccaaccagcctcccggagcagtggggggacgggatggcgagnnnnnnnnnncagtgggaaaagaattccacaagagatcagcgagagctcccgaccagccacccggagcagtggggggacgggatggcgaggcgccaggattacgactacctcatcaagctgctcctcatcggggacagcggtgcgtgagggtgatctgagtcgggtgtacaagtgcattcggggcccgggtgggagccggcacgggaccacctgtcgacccgtgccctccagacccctcccccgggtggttgttgcaggggtggggaagagctgcctcctgctccgattcgccgaggactccttcacctccagtttcatcaccaccatcgggtgagggggtgtggacaggggcgggccacgaagggggtggcccccttggaccggtggcagttgaggtgcagccctgtgtgcatcgtcccacactccagcccccccacccacccactcccagcatcgacttcaagatcaaaaaggtgctcatagatggcaagtgggtgaagctccagatctgggacacggccggtcaagaacgcttccgcaccatcaccagcggtgcgttgtgggcacctcctcgtttgtttctcttctctttttgggaccgctcctcatacctgtgtgtgcaggcaaacttgcgatcccctgcatcaccaattgcatgcaggccaacccatgattgggcgtgactagttccctgtgctttcctgctttggcctcacatcacccaggcacccccttcagccccccgagcacacagcccctgcatcccccattctccaatcccctgcgcccctcgcacagcctactaccgcggcgccatggggatcctgctggtgtatgacgtcaccgacgagtcctccttcagcaacatccggaactggatgcggaannnnnnnnnnnnnnnnnnnnnnnnnnnnnnnnnnnnnnnnnnnnnnnnnnnnnnnnnnnnnnnnnnngtggggaacaagagcgacatggatgagtcgcggcgcgcggtaccctactcccgaggacaggtcagtttcaaggggaggggggaggatggggttgagagcggtggcgacctctcgtgtgcccgccgggcatcccacccccctgcagcccatggtatcgaccgtcgacatgtcggtgggcgactgccgccgccacctgccccatcgcgtgccacctcaaacacaggcnnnnnnnnnnnnnnnnnnnnnnnnnnnnnnnnnnnnnnnnnnnnnnnnnnnnnnnnnnnnnnnnnnnnnnnnnnnnnnnnnnnnnaggctgcgcgactccctgccggctggcggggagcagggcggcgccggagccggcgccgtgcgcgtcggggggccaccgggcggcgcccctgggcggtactccgcggcgaagcccagcaagccggcctccagcggctgctgctgagtgcggcgcgcgtgccctcggcatcctgtcgcaggcgccctccaggcatccccctggcgccgggtctcgagtcccagcgtctaccctgggccccgccccgcgaccgggggcagcttcctcgcgcccctgcactcnnnnnnnnnnatggcgccgggtcacgagtcccagcgtctatcctgggccccgtcccgcgatcgggggcagcttcctcgcgcccctgcactccctttccacttgcgcgtgcaatgcagagacggcggcccatgcagccgtttgccggcctcgcgcgtcgccgcagcgatgccccttcctggcgcccggcgcacgcatccctgcatgcccctccctttcctgccgctcgttcgtctgacgtaccgccccatgaccatgtacacgctggcaagcacggcaggggggggtggttcgcatacacaccagcttcagtagtggtggtatcggcggcgcagggcgcgacggagcggctctttcggnnnnnnnnnntggcaggggggtggggtcgcatacacaccagcttcaggagtggtggtatcggttgcgcagggcgcgacggagcggctctttcgggggctccccgccagggatggaatacacgagccccagggctccgcgcgcgctgcgtgcagccccgcccaaaccccgaaagaggcagacccgcctcaggccccgccctctgcgccgccctccgccagcgcgtgcacgcgcgccaggaagcgctgcaggagcgcggcgcagcgggcctccacgtcctgcacactgcgcctgccgtagcccaggccccgcaggttctccaccagggcggccagggcggcggggcctggcttgccgtgcgacgccaggcagccgtgcaagagtaggcggtcctcgtcggcgtgccagctgccgcctgccggcggcggccccggccccggccctggccgggccaggtccggcagcagccgctgacgtggcagggggggcgggggcacgcccagcgcggcgtagccgccctgcacgcccgccagcgcggcggccagctgctgccgcaggctgccggcgtccagctccggcggcggcggggggggtgcggcgcaggggctgggccccaagccgtacccgcgcaggagcggggcctcgggcggcgagggcggtcgcaggtggcgaccccatcccggcccgctcatgggaggctcccaggggggcgcatcgtcgtggctgtcgctgctgactgggatgggcaggagcacggaccgggggcctctacccgtggagggcgaggggggcgatctcgacccagggtcgcaggacgccgcgccgccgggcttgtgcgcggtgaagaaggcctcccgcagcagggcctggcgccgtttctgggccagggcgcggcggcgagcggccttgtcgggcctgatcagcgaggcgccgccggtgtgcttgctccacagccgcgccagcacctgcagtgggtgcgggtgtgtatgtggcaattgttgctggggaatcatggatcggtcccgcccctcacaggggcgagctctggctctgcatcgatagagatgacatacgtctcggggaatgcgagatccccccaaaattacaccttgggctgccgagcgggcannnnnnnnnnggagatgttatacgtctccgggaatgcgtgatcccccaaaaattacaccttgggctgccgagcgggcaggtactccttgcatatgagctcccagcgattcttggcatcgcccacccacgcgacggcttccgccagcagcgcaatctcggggggggtcaggggcccactgatggtggccaccgcttcctgaggcattgattcacgcgattggaaagggggatcatgagcaatggagtggagtgggtcggggccaggggatggaccgactgcaagggcaaactccagacgccgcatgcctccttcccctgctccaagttacaaaagccaccagccnnnnnnnnnngtcctgagggattgattcacgcgattggaaagggagatcatgagcagttgagtggagtgggtcggggctaggggatggaccggctgcaagggcaaactccaaacgccgcatgcctcctttccctgctccaagttacaaaaaccaccagcctaatttcaacccggtcacccctccggccaacaaccttgatggagtttgggcgggcagagcttgtcgtctggttcttcttccggtgaaacagctgggatggcgtcttgttgggcaggagctccgccacgatgcgttcccagtcatacccaaatctgcaatgcgagggtgcacatgcccttgtcagtgattccctgcgtgctcctctgagggccgggaggaggaggaggaggtacgagcgcagacagactactgccatggcatgaggcatctgttccatggaggaccagaggggtccaaggcagggcatacttcgaagaacccaaaggaaatggtgcagtgcagcatggaccgactcacaacctgcagtacctgaggatgcccagggccagcagctcatcctcggcgggactgaagatcatctggctggtcaccatgtagtctggtggctgcagaggggaagggtgtgtgctgttggagatcaaggagctgtcagagcggtggttaccggagtgcggagccgctcgaggattggccctcacatggccacgcctgatgaccgactccaccctccctgacaacacgtcgcaccatgggcagcaggtctgggtcggcacactcctnnnnnnnnnngggggggaagggtgagtgctgcgtgagatcaaggagctgtcagagcggtggtcaccggagtgcggagccgctcaagggttgaccctcaaagggccatgcctgatgaccgactccaccctccctgccaacacgtcgcaccctgggcagcaggtctgggtcggcacactcctcctggatgggtgcccaggcagccgccacatcctccggcagcctgctccactggggatgcaccaggggccgtttcctccgcttcggaggctgcctggaaggtgttgggaggtgggggttgggtgggaggggggtatcttggggatgagtgttggagcagaccacgtgctcaaagccacaccttcccggacacaccccacacgaatgcccgcctcttccgccccccccatcacgggcggcaatggtgccacgaatacgaccgaaaccagcatgtccccttttctttcgccaaagaaagggcctcaccagccgnnnnnnnnnnacagaccatgtgctcaaagccacacctcccggaacacaccccacacgagtgcccgccacttcctcccccccccctcacgggcggcaatggtgccacgaagacgaccgaaaccagcattccccctttcctttcgccaaagaaagggcctcaccagccggagggcgcgtccgcggccctcttccgcgctgccgcccccccagggcccatcgggcccaccgccaccgccccctccccttcctccgagtcggagccgaggtcgtccacctcccagcgtatccgttccccaggcgcgtcgggcgcggcctgcggcctgtcgggggccacggcgcggcgcaggtccggccagcgccgcagcgccgccacgtcggcgatggtgtgggcggggacgggcatgcgcggcgcccaggagccccgcgacg

SEQ ID NO: 44005 - DNA, 70 bp, Chlorella protothecoides
gtagacgtgcgcgcccgcgaaccagggtctaccggccggtggccccccggccgcgtcgtcgccgtccagc

SEQ ID NO: 44006 - DNA, 67 bp, Chlorella protothecoides
atccccgctcacacgccgatctcgtggaccagccggtccagccagccccggcctgcacagtcccccg

SEQ ID NO: 44007 - DNA, 453 bp, Chlorella protothecoides
  modified_base (98)..(337): a, c, t, g, unknown or other
cgtggagcgcgtgctcgcgctccaccccccggacctggagtttggccacttcactgccgtgcacggaccccgcgcccagagcctgctgacgtggtggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcgtggtgtgctggaccggggtgcaggcgggggccgaggccccgctgcttcctggcacgagggctggacctggccggtatccaggcgctcggcgccctgctgagggccacggccc

SEQ ID NO: 44008 - DNA, 61 bp, Chlorella protothecoides
agcagccttggggaagtgcagggggggggggttcagggttctgtcaggaatttgtccctga

SEQ ID NO: 44009 - DNA, 61 bp, Chlorella protothecoides
gattcgcagtccggggtgctggagcaccgccctcccactccgcatgccgtttagggcactc

SEQ ID NO: 44010 - DNA, 61 bp, Chlorella protothecoides
tctttacaaccaccgttccccttcacatcctcccctcccccacttcaccctccttcaaaca

SEQ ID NO: 44011 - DNA, 17393 bp, Chlorella protothecoides
  modified_base (837)..(846): a, c, t, g, unknown or other
  modified_base (1068)..(1077): a, c, t, g, unknown or other
  modified_base (3305)..(3314): a, c, t, g, unknown or other
  modified_base (3587)..(3596): a, c, t, g, unknown or other
  modified_base (3820)..(3829): a, c, t, g, unknown or other
  modified_base (4223)..(4232): a, c, t, g, unknown or other
  modified_base (4649)..(4658): a, c, t, g, unknown or other
  modified_base (4825)..(4834): a, c, t, g, unknown or other
  modified_base (5834)..(5843): a, c, t, g, unknown or other
  modified_base (7089)..(7098): a, c, t, g, unknown or other
  modified_base (8401)..(8410): a, c, t, g, unknown or other
  modified_base (9084)..(9093): a, c, t, g, unknown or other
  modified_base (9416)..(9425): a, c, t, g, unknown or other
  modified_base (9896)..(9905): a, c, t, g, unknown or other
  modified_base (10045)..(10209): a, c, t, g, unknown or other
  modified_base (10351)..(10360): a, c, t, g, unknown or other
  modified_base (10425)..(10453): a, c, t, g, unknown or other
  modified_base (12167)..(12176): a, c, t, g, unknown or other
  modified_base (12285)..(12294): a, c, t, g, unknown or other
  modified_base (13295)..(13304): a, c, t, g, unknown or other
  modified_base (13951)..(13960): a, c, t, g, unknown or other
  modified_base (15250)..(15259): a, c, t, g, unknown or other
  modified_base (15569)..(15578): a, c, t, g, unknown or other
  modified_base (16510)..(16519): a, c, t, g, unknown or other
  modified_base (16656)..(16665): a, c, t, g, unknown or other
  modified_base (16849)..(16858): a, c, t, g, unknown or other
ggttggcgccgtgcaggccggaggaggccacctcgcccgcggcccagagccccggcagcgccgtctcgccgcccagcccggcgcgcacgccgccgcacatgtagtgctgggcgggggccacgggcagcggcgcggcggccatgtccaggcccatcgccgcgcagcgcgcggcgatggtcgggaagtgggcctcgatggccggccggcccaggtgccgcacgtccagtagcacgtggtcggcccccgccgcggccatctcggcatggatggcgcgggccacgacgtcgcgcggcgccagctccatgcgcgccgcgtcgtaccgcgccatgaagcgctcgcccgcggcgttcagcaggcgcccgccctcgccgcgcacggcctccgagatgaggaaggcgcggccgtcggcggcggcgggctcccccgccacgagcgcagtggggtggaactggacgaactccaggccctccagcggcgcgcccgcacgcgcggccatggccatgccgtcgcccgtggccacgcccgggttggtggtcaccgggtacagctggccggcgccgcccgtggccagcatggtggacagggccaggaagcgcgtgcgccgcccggtcagcgcgtccagcgtgtcggcgcccaggcaggcgcggccgccgccgggcagctcgcccagcaccaggtccgcgcccacgcggtgctcgtggaaggtgatggccgggtgcgcgcgcgcgcgcgccagcagcgcgcgctcgatctccgcgcccgtcgcgtcggccgcgtgcaccacgcgccgcgcgctgtgcccgccctcccgcgtcaggtgcaggggcgggatggggnnnnnnnnnnccgacgcggcgcgggcaccgcccggaccgccgccccttccacgccctgccggcacggcggcgcgggtgaactctgcgcccaggcgcgccaggcccagcaccagggccgggccctcggcgcagacagcggccacggcctcggggcagttgagccaggcccccgccaccatggtgtcgtgcacgtgggcggcgacggagtcgcgcgggtccagcaccgcgcagnnnnnnnnnnagcagactgcggccacggcctccgggcagttcagccaggcccccgccaccatggtgtcgtgcgcgtgggcggcaacggagtcgcgcgggtccagcaccgcgcagatgccgccctgcgcgtagcgcgtgcagccgtcgtcggccgccgccttggtcaccaccgccaccgacccatgctcggccaccgccagcgcgtagctcagccccgcgatgccggagcccagcaccaggaagtcggtggtctccacgctgcaccgcggcgaggagggcggcgagccggcgggggagacgggcaggccgtcggtggggccgcccacggacaggccggcgcggcagggcacgcgcagggggcgcaggggcggggtccccaccacggcggggcgggcgtcggggccgcgggtggggtggtctgccgagcgggcgatcgcgccgcgcccaatgaccagggaggacgggccgctccccctggtgcgccgggagcgctggggagcgcgtgtggcgtgggaggcgcccaggctcgcacagagcatcatcatgacgcccggggaggagcagggataggcaacaccagacaggtgtatgagtgcaagaggagggggtctaaacggccgcactgcgagcccaaaaggatactactgttcaaggcagcgtgagctgggcgccgtacttcttattccacacctgggggaggggagggcagggtcgagatgagggggtcgccggatctggggttgcgctgcagctacctgcgctgggggcagccgccgaaatccggcacacgccccgtgcgaggcgggcgtagagcactttaaacaaaacgcaaggggggtaatagcctgatccacttacccacgaaatggtgcgtcgagtcgccttgccctgtggggtgggatgacgtgtgtggggtaggttaggccggcccgtgctcgcaaaacatatgccggcattgtgcacgagcagaggcccaccccaagcggaccttggtgttcatcagatacaagtgagcataaaggggtccggggcagcggggggggaggagcgtgtcctaagcctaaccaccgtcagcgtcggcacaggaggtcggctgcagagggggcgtgggggctacagcgaccagtgtctcactggagtggactggtagagtggagaatgaacaacggcgtgtccttgcagtgtcgtgagcatgtcgtgggggatcaccatgcggaacagtaaccttgctggcattggtggcgctgccgacgcggacaatttctggcgggactgggtagagagctgatgaggagtcgcagatcgtcatgggggagatgttgcagccgtgtgctcatgctggatgctgtcacctgggatcaatccttctgcatcccggtttgagcttcctcctcttgcgtgagcacattaatcatgcacaggtaacatagatcttggtccaagtcaagctggtcaaccatgtatgtgatcctcctgctgtagttggacatcagccctcgcatactgatattagtataatgatgatgaggaaatggggttggaactggcgatgagctggccagcctgggcccgtcttggcgcactgtcggggttgaaagctacatgtcgacaccctggactccgaagcactccagcagacatattcccctgtttgtgcttgccaccgatccgaaccgcgcagcatcgcttctgatgacgactgtttgtccatattagagttgttgtataaacctgtaggcaccgagactcatgtagcgaaccgtgctgtggcattctggagatggagtccccatggcacccgacattccggcccatgccgatggcggcacacgaccgatgacaatgaatgcatcataagattcaaataatacgcgtgccgtctcctgtcgtctgatcagcggcggcgatgtccctgtacacgagctactacacccggcagctggccctgcgcccggaggccatctccaccccggaggttgtggatgggaagaaggtgcagcaggctgccgtcccccggcgcacggtggacgcgaccgggccctacgtccagtggctccaggtgcgggctgagttgagtgctgggaatggtgcgtggcgggggggggagggtgctgcacattgtggcacacgcctgacagggagcgccgtgctctccctcactcctccccagcgcgtttgccccacagacacgtgccctgcgtggccaagacgcgcgcagctggcccgacctcctgccannnnnnnnnnaccgtgctctccctcactcctttccgacgtgtttgccccacagacccgcgccctgcgtggccaggacgcgcgcagctggcccgacctcctgccaggccccgtgggcgcgctgggcatgctcccccccgcagccatgctgcaccagcccgtgagtggcgccgccaccaagtttgcgggacaggcgcccagcaaggtgagcctgtgtagctgctgtgggtggcgaggctgggaggtaggcgggctttgtgtccctgtgggtgatctggcgtgctnnnnnnnnnnttcggtggtgagactgggaggtaggcgggttttgtgtccctgtgggtgatctggcgtgctggagaggggcgctggcccctgtgcttgcatccccgctggctgcctgagtacggctgctgttcatgtggcccaatgcacctcctttcaccacctacgggtgtctgttacacgccacaccctgcccaaagaaggacatcctttcccacatgctgtgtccgttcccnnnnnnnnnnagagacgggcggcgctggcccctgtgctcgcatccccgctggctgcctgagtacggctgctgttcatgtagcccaatgcacctcctttcaccacctcctggtgtctgttacacgccataccctgcccaaagaagggcatcctttcccacatgctgtgtccgttcccttgctcaccaaaccccgccccgcccccccatgcatgcgatgcaacgcaccatccagacgcggagcagcgtgaatgtggtgtgctggacccccgacggcaggcgatgcctgtccggcacccaggccggggaattcacgatgtgggacggcgcctccttccagttcgaatccatcctgcaggctcatgaggggccggtacgcgccatgacctacacccgcagcggcaccnnnnnnnnnngtctatcctgcaggcacacgaaggacccgtccgcgccatgacctacacccgcagcggcaccttcctggtctcgggcgacgacggcggcgtggtccgcttctggaagaccaacctggagctggtcaagtcggtgcaggcgcacggcgagtcgctgcgcggcctggccttcgcgccctccgacctcaagttcgccaccgcctccgacgacggcacggtgcgggtctgggactttgcgcgggtggccgccgagcaggtgctagcggggcacggcggcgacgtgcgctgcgtggactggaacccgcgctcctcccagctcgtgtcgggtgggtttagaggggggggtgggggcgtgaggtgagtaagggggaagagggggaagcggaggagggagggggcacggcgggaagtgaccgcgcnnnnnnnnnntgatgaggtgagtaagggggacgagggggaagcggaagggggagggggcacggcgggaagtgaccgcgccgcattcctgtcactgcacttcctggaggtgccgggcgtcgcactgatcacacaggcatcaaggagtgggggtgcaaacgcgtctgcttgtcatgcannnnnnnnnntctgtcgctgcacttcctggaggtgccgggcgaggcactgatcacacaggcatcaaggaggggggggtgcaaacgcgtctgcttgtcatgcacatgctccctgtgggtgcgcagccgtgacgtacagcatggcggagctgtgtgcggcaggagggcccctcaatggcctgctctgggcctgccgcccaacctcctcctggcacccaccccaccccctccaaccgcgatccctccccctgcacacacccaccacgcgacagggagcaaggacgggctgctcaagctgtggtgtcctcgggcggggcggtgcattgccactctgcacggccaccgcgcgacggtgatgcaggccgcctggaacgccaacgggcactgggtgctgtccgccagccgcgacgcctcctgcgccgtgcacgacatgcgcatgcgccgcgcgctggcctccttccgcgggccctccaaggacgtggtctgcgccgcctggcaccccatccacgaggacctgtttgtggcgggcgggaacaacggctccctcctctactggctggcctcacggcccgaggcgccggtgggcgctgtgcccgctgcgcacgagggcacggtttggagcctgggctggcacccggtggggcacctgctggccagtggcggcggcgactttgccaccaagttctggtgcaggtggaggggctggtgtgtcctggttggcggtggtgctgggcggtagagtggagggagggaagggggtgaggcaggtatgggatggaggcattgcggccaggtctgcatgcacgcctttgggggggattgagagggaggtgtgtgctattgtttcaagaagaggaggtgatgctgggagccacctgcatgcagcagaagtaccctgcagctgcatggaggtcatccgagcaagacctcctcggggccgccgtctcatcacaaacccctatccaggtccagccagaccggctccgccatggatcttcacttggactaccannnnnnnnnnggcatgcacgcctttgtgggggattgagagggaggtgtgtgcttctgttttaacaagaggaggtgatggtgggagccacctgcatgcagcagaagtaccctgaagctgcatgaaggtcatccgagcaagacctccttggggccgccgtctcaccacacacccctatccaggtccagccagaccgactccgccatggatcttcacttggactaccactcccacatcccgtgcaggagacgacccggcgaccctttcttcgagcgccaggcggcggcccaggcagaggcggccgccgcggcggaggccgacggggccatggactcgctgccgccagggggagcggcggccggtcgcgcgccgcccgtgagcgccccgatcgctgccgcccccctgctgggccggcgccagggcggcgccgccatccccggcctggggggcgccccgccggggtcaagtgccgcctctcaggcgccgcgctccgcgcacgcagcgcccccagctggagcctttgacgcccacggcgccatcccggggttgggcatgctggcaaccatccccatgagcctgaccgcggcagcgccgccggccaccagagagccacgtggcggcacggtgagcagagcccccccggctgaggaggacctggacgtcgcgatcgaggcggccgtggtcgaggcccgggccgcagaggcgcccgacttccaaagacccagcaagcggccgaggggaccgggtgaaggagagacagacgctgggacggcagggacggggacggaatcaagcgaccaggccccgggtacggcggcctgggacgggcaggccatcgtgctgccagcgcactcgggaccccgccgcacacgaggctcggaccgcaggcagcagcctgaccccgcgccccaggcttgaagtgctagcttgcttgccacggttgcgtgtctgaaaattttacaaattctgcagagggcccctgggagcaggcatagcaggaaggggggatttcatagaggtggaggggaggcctttgtcggctatcagtttggagcttgcgatccccttgatccggggcagcacgcaggggcacgccgggtgtgtcctgcaacatccctggggaatggcagctgcctaaaaaagacacactgcccgacgagacgcacgctgtcggcgccagtgtgcgactcgacacacgcaggaggccccgtcgccggcccgcccgcaatcatgtcctggcgcggtagtcgtgccgcgnnnnnnnnnntgccgggtgtgtcctgcaacatccctgggaatggcagctgcctaaaaatgacacactgcccaacgagacgcacgctgtcgacgccagtgtgcgactcgacacacgcaggacgccccgtcgccggcccgcccgccatcatgtcctggcgcggtagtcgtgccgcgcgatggtgaagttctgcgtgaacttgtcgcgattcttgggctccagagaccgcgtcacgcccgccatcacccgctccaagcacgccgccaggtggctctgccgctcggggggctggctggccgccacgcgcttggtcacatgctcgtaaacctgtgtggggaggattgatggttgggtggggagtatattggtgagtaggttgatgctggagctggttgatgccatcagcgaggagtccagctcaagcaggggtgacaggtttggggccgatcgaaccaggcactccgcccgacacttgagcaggcgcctttacgacgccctcggcggacgtgaccaaacgcagcgtccctgcgagtcccagccgccacagcgcacggaaccctgagagccttcgacgccccataccaccaaccctctcccccatttgttatcttcccaaatccccttgcccccgaccccccaactccaccccaccccttctcagcacctgttcgctgacgaggatgaggctgagcatgggccgtgacagggaccacatgttggagcagtcctcgaacatgacgatctcgaacagggtggtgagcagctgggggaagaggtcggggcgctgccgcacgtgctccgagatggcccgcgccgcggcattggggctgtgcccgccgggcatgtgcaggaagtagtagccggccaggttgtcgatggccgcggcgcactggctggatacggccacgtccaggctcttcagccccgcgtccaggctggacagcaggaagacaaaggtgggcgtgtcgcgtgctgccagcagcggcacgtggctcgcgcacagcatgtccaccagcgcaaagtaggccttgcacacctggtggttgggggaggggggacggcatggggaggtgaaggtgtgtgtggaggctgggtggggcaggactgggtggagcaacgttgtgaggctctgacgggcagccatgtgaacagctgcgtgtgatcctatgctgtctcacggctgggcagggcctcagtaacgccaagcaagccgagacccctgggttccctggtttagagtaccgttcgaccggagctggaccctgcctcagaggccccagctcggcacatcccctggcccgtcagaccctgcagnnnnnnnnnntgagacccttgggttcccaggtttagagtaccgttcgaccggggctggaccctgcctcagaggccccagctcagcacatcccctggcccgtcagaccctgcagctacagggggacttgctacaccgacccaaatgcctctttctccccaccaccaccctcaaccccccacaccttgcggtaggccaggatgtcggccagcgggatgttcagcgccaggcgcaccgccatgtccagcgcatcgttgagcgcggggtcgccatacagctcaaacacgccaaagttgacgtagctgccgcccagcgcgcggctgaggattgacaggcagatccaggagcccttgtacagcccgccgtacacgtctgcaggccgcggcgccgacagcacctggttgccatatgtcaccaggacctgggttggtggggagaatgggaattccgtatgaaggtctggcattatggaggcattaatgcggagttgcatctgctgggcaatcggacttgttgtacaaggctcgagggagcaaggttatgggcgtcaccacccgacacacacgctccctttaaaagatccatccgcccctccccaccccccctcatccgcgcggcctccccttccccgaccttggagacctcgcggaagagcaggatgccgttgggggaggaggagtcgaagnnnnnnnnnnaactcatccgcccctccccacccccccttatccgcacggcctcccctcccccgaccttggagacctcgcggaagaggaggatgccgttgggggaggaggagtcgaagatgaggcgctgcgacttgttgagcacaaactcgttcacgaacttgaggaggggggtggtgaccaccgggtcgccggaccaggcctccaggcaggccaggatgacggggaagttggcagggtagagccagtcaaagagcatgcctgcgcggttggaaaggaggcgaaaatggggggggggggtaggtattggagaaggcttggcgtggggtgccagnnnnnnnnnnttgggaaggaggcaaaaatggaggggggggttattggagaaggcttggcgtggggtgccagctttacatcatgcgctagcacctgccgcaccagcatccctcggaggtactcggatgctgggccagaaccctgctgcgcaggccccagcctggccccagcatccacccggagctcttgcaccaccgccttgaattccccggcttcaagtgcgccacaacacccgcagcgccacagccgggcagcattcgaccttcatcccaacagccttcctaccgtaggtccggcgcgtgctcgtggcggcggccaccccccgcaggtccctgaagagaccggccacggtctcgttagaaaccgaggcgcgcagcgcggcggggctgcccgcgctgcggctcgccgtcgccagggagtcaaacacctggggacgggggtgggttgggttggggccagggtggggaggcgcgcctttggtnnnnnnnnnngtccctcggaggtcctcggatgctgggccagaaccctgctgcacaggccccagcctggccccagcatccactcggagctcttgcaccgccgccttgaattccccggctgcaagtgcgccacaacacccgcagcgccacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagggggagggattttcctccgtgtgggcgtccatgtcgaccaccctgatgcatcgtcgagctcgaggaccccaacccaagtcatcacaccctcccgtaaccacccctctcaagccctccacacctgctgcatgggcgccannnnnnnnnncgtcaaacacctagggatgggggtgggatgggtcggggccagggtggggaggcgcgcctttggtnnnnnnnnnnnnnnnnnnnnnnnnnnnnnaatcgtcgagctcgagcaccccaacccaactcatcacaccctcccgtaaacccccctctaaagccctccacacctgctgcatgggcgccacaaaggccttgaagcgatccggtgtgtcatccatgaacaggagccgcgcgagtgtcgagtaaaaggtggtccgcgcccgcaggtttgcctgccccgccaggaaaggaaagtactctgggggattggggtgggaggaagggggagcgtcagtggctgtccggggagagcccgactccccgagcctggtaccttgtgggtggcatcgaatgcacacaggcttgaatgcccattcggcatcccagccaccgcgcgtacaccctccgcctgccgctctggcatctgcaagcaaccatgctacccctcccaccaataacctcacctgcggtgtggtgtgtgagcaggtagctgatggcctccagcttgatgagcagcttgccgctcatgtaccccgatgccaggtcctgtgtggagggtggcggcgcgtcaggacccaagcatggggttggttgttgtggcacttggcctgtagtttcacttcgcaggtattcctcccaggacacacggaggggcgcggccaagacaccgtcccaccacccaatatggcactgccatgccatccatccgacaacacacccagcacatgcattcgcccccagaaatcccccacatacaactcctcccacacacaccttgaagagctccagggtggcggagatgacctcctctgcgccgcagtagaccttgaggtttgaggccatcttggccaggatgacgttcatgaccgcggcgtggtctgccaggcccacgctctcgcccaggcggacgtacaccttgctgctgtgcatcaccgcctcgccaatgtacaccttgcggaaggactggaggaaggagagcagggccagctccagccgacggcgcgaggccgcgcccgcgcgcgccgtgtgcccggggccctccgccgcgcgcaggacgccgaagacgcgtgctgcgaggtcgccgtccaccgcctcctgcgcgtcggcgccggaggcggaggcccggccacgcagcaccgcgcccaccatgtacacgatccaggtgagctggccctccagcaccgccgcgtcgcgcgggggggaggaggaggaggcggcgccgccggcgacggcgccgcccgcgccgcgggacgcgtaggccgcgatcagcgggtctgccgctctcgtcagcgcctcggccatcttctcgtactggaagcggaagaggtacggcagcgagtccagctggtcctggaggggtgtggaggggagggacgcacagaggtgaagggggggagagtgagggaggcatgtgaaggcaagagggctgcattcaatgtccgtgaagagatcgaccagagcaccccgcccccgccgcccaggcgcccagcccaccacccacaccacctgcagctgctcctcggagtcaagggggtcgtccgtcagcccgtcttgcacgacagtcctcaccgactccagcctgcacgggcaaggacagggggccaggaggtggtaggaatgggtgtgtgtgtgtgagaatggatacaagcgcagctacttgtgagacaccaaaccaggacgcttggcgacctgatctgctaggccccagccatgttctctttattccaaggccgctaccccgcacaattccccctcctcttctctccccnnnnnnnnnngtcggcatggaaacattgtcgcgtcactgatgcacatgtcctcccagcccagcccgtgtatagataaggcagtcggtacccgccagcacccatccagccatggccggcnnnnnnnnnntctgatctgctaggtcgcagccatgttctccttattccaaggccgccccaccgcacaattccccctcctcttctctccccaccgcgctaacgctccgcacctggaggtgaggaaggccctggatatctttgggacataaagatctaggagggacggcgcctcgcccttgaggtatggcatgctgctcaccagccgcgacctgggaggaagtgtgagggaatgggagggatgatcggcatggaaacatcgttgcgtcactgatgcacatgtcctcccatcccagcacgtgtatggataaggcagtcagtgcccgccagcacccatccagccatggccggcttgttgcgccctgacccaggtctacagggatctcgccatgcaattcagtgaaagggcccctcacgagaacctggctccaggccctgtcttccctcctcgcgcccccctctccttccccattctgacttatcccccccctcccacctcctgtcctccgctcaccagagcccgaggaggtagaacaccgaccccgaggcccactgccaggaggtgaggctgttgatggtgaagtcggccaccagtccaatccactcggggtagggcgccagggccaccagctcgcccagctggtagttggtcttcagccgccccagcaggcggcagaactcgtggtagttggcatggtggtgcagcccgcgccggtcccgcagcacgtcgcgcgagccctccaccaggcgcgcgaggaaagcggagcgcaccgcgtcgctggagaacagggagcgccgcaccgaggccaggcgcaccttgggggggttatgttgggtgaggcaggggtgaaggaggcaagatctgaataagccaaggaggatctacgggtaattgtgggcgacgcggccccgggggaagaggttgctgcctgtaaagcatggtctgggggcgttctctcccccaaatcccccctccccgttgtcccccatgccgccgctcaccaggctctccannnnnnnnnnggctgcctgtaaagcatggtccaggggcgttctctcccctaaattccccctccccgttgccccccatgccgccgctcaccaggctctccagcgccaggctgctcagtggcggctcgttgcccgcgtagtagccccagagcagctgcagcgtgcccgcgtcctcgatggccgggcgccaggcggtggggatctggatggtgcccaggtcctccgccgactcatccaggcaggtgcccacaaagtcgaaggacagcgtggccaccagcagtcgcagcgcctgctccagcagcgcgttgtcggcacgcatgccgggcagccgttgcagcgcgcccagcgccagctgcaggatctgttgcagggaagaggggcgaaggggagggggggtgcaaccaggggcatggatggtggaaagggtcggccccctggctcgttatcttggaagatagtccaccaacaacaggcgcgacctggaagggctgctgggcgcggtgcatgcgtggccggatcgatcgtgccggcacccgcttgccaaagagatgcctgcaacctgtgcacagggactggcacgccgacttcaatccctcaccaccaacccctcgttcgcatcgcctgccgtagcctcaccttgtacagcgcggcgtcccggnnnnnnnnnnccaccctggcacgttgtcttggaagatagtccaccaacaatgggcgcgacctggaagggctgctaggcgcggtgcatgcgatgccggatcaatcatgtcgccacccgcttgccagcgagatgcctgcaacctgtgcacagggactggcacaccgacttcaatcccttaccaccaccccctcgttcgcatcgcctgccgaagcctcaccttgtacagcgcggcgtcccggaagccgactgccacctttcggtgctgagtcagcgtgcggtggggcgtggggctgttggcctccagcaccatggcgttgagcaggcgcaggcccagcatgtagtgggcgagtgagccgtcctgcgtgaggaagcagggtgcaggtggtgaatgggtgtgggggcatggagcgacagcatcatgggagccgggaatgggaagccaggaggtagagctggcttcactccccgcatgccagcgtagagctcagggtcagtgcagggactgcttctggcaccccttttgccccaccacaagaactgccagtcccaatgacgaccccctcctgcacaacccccggcttacattggagcgcggctccaggaaggcgccggcgtcctccacgatgctgcggtacgcgctgtcctcgaaccagcccagctttgtcatgcggcaaatgagctggaccaggaccgccaccacatagggctccagggtcgggccccgcccgttcaggtactgcaggaaataggtccgcatgtccagcttcacctgactcctgcgaggtgtgggggcgggagccggcaggcggtgcgtgggagggtgggcggagcgctgcccttttcgtggcatgcacgcggggcaggggtgcacggcaaaatgcaccagccgcacatttcgtggtttgaggaagcaggctgcccatgcagggtcccgaccctcccccgcctcgccccgcagcaccggcacccagactcacgagagcgtgaattcagtgacgaccttgagcaggctgctcgctgccagcagttgggcatatggggagctggagacgtccaggatggtctgtcgcatcggggtgggaggatgagtcgagttcactcgcgtgcatgcctgggccgaggctggctcgctatgcaggtgaacaggtgtgcagcgtaggtccctgcaatattgcatgcatgcgacaaggtctacgttcaagccatgtacgcttcccaccgccctcaacccttcgtcaggctctacaggaaaccaaggcatgttctgcacatctacacaggcaggactcgccttgcagtnnnnnnnnnngatattgcatgcatgcgacaaggtctacgtccaagccatgcacgcttcccaccgccctcaaacccttcgtcaggctctaatggaaaccaaggcatgttctgcccatctacacaggcaggactcgccttgcagtggggaacatagtctgtagaggtggtgaagacgcggagcgattgctcagcgtgcaatcggtcctgagggttctgcgatgtgagggaaagtggtgatggccgatgggcaggtgagcagcactcccctcaggcccttgccctgcaggaaccaccgacctcatcgagcaattacctgtgcnnnnnnnnnntccctcgggcccttcccctgcaggacccaccgacctcatcgagcaattacctgtgctgtgtaaagttgcaagcaaagcgcctccagctgaggcagttgttgcacgatgtccatccccatggcagcccgctccaggcgcggcgggcttcgatcacttgaccgccggcccagcacaggcgacctcagtcacagcgatcatacatatttcgtgtgcagggaagatcccccacatgcacgacgctctccagggattgcgagagtccgatgatgtcgcgatacagaagcgtagtagcccggtttgcgctcacgacgatgcgcgccaccttctttctagctgatgaatgcccatgcaagggaagccctcagaaatcccacagaactggcgtcggccgggctgctgcactgggcatcccacggtgctttccaaacttgctcctgactatgtctcaatggatcagcactctgtcagaaggcactacctcttcaataatccgaaaacacacaagctcaggagtaatcaccaaagggggatgagcctggacaccacatgacagcgcatcagactctgggttgcgacattgtatcactgcaaacatgatggcatgaagctcagcaaggacaacccctgcaggggttgccagtattgaagatgacccgccacggctttggagcctgttttatggttaataattgccaacacatccaagttgacttcccaccgtcttgccgggtcatcatgctctttctgagggtggattaccgtaagggtatgcacggcaagctcatcagccgccattatgcaaccgcagtgctcctcatttccaccctttcaccaccaatgctgcatctgaggatgcagcattggtgcacgtgatgtctgatggtaccttggactcagatgcaggccgctgtagaaggttcaacaagacgaannnnnnnnnncatgcaaccgcagtgcacctcatttccaccctttcaccaccaatgttgcatcctcagatgcagcactggtgcacgtgatgtttgatggtaccttggacgcagatagaggccgctgtagaaggttcaacaagacgaannnnnnnnnntgtggtgcgtggtaagctgacaacacaaggctgaatgccgggtcttgggatccattccgccccatctacagttcaatttccccctccagccaggccagctcccgcacgtgttctggactgtggcgccaaccgtccagctggatcaaggagcaattcgcttgctttgaactgcccttccctgatnnnnnnnnnnagcggtgcgtggtaagctgacaacacaaggctgcatgtcgggtcttggatccattccgcctcatctacagttcaattcccccctccagccaggccagctcccgcatgtgttctggactgtggcgcccaccgtccagctggatcacggagcacttcgcttgctttgaactgcccttccctgattattgagatcagcaaggtatctctacatcacaatcgccagaaaattggcggcaaacgcttcacatcgtaggaccacacgttcgagctttgggttcttggtgggcgctcaccgggtgccaggcaccaggcactgggggccatcaggcagcttcatgggcagcttcaagtgtttggggtcggggggcccccaggatcattgcgatatccccgcgcggccgcagctctaccaagtccagacgcagccaggcgcagggggcaggcagagcgggagggtgtacagggccagtggggggcgtgtgcgcaagcaggcttaagtttgatgtgagttgggttcagtggattccgccggtgga

SEQ ID NO: 44012 - DNA, 61 bp, Chlorella protothecoides
ctctgtccaacacggtgcatgcggcggggggcctggacgatggcatgctggcttcacagga

SEQ ID NO: 44013 - DNA, 131 bp, Chlorella protothecoides
aggccggggtggagtgcggggctgtggaggcggtgctgtcggatgggtccaagtgtgcccactcccatgcagtggccgtgtgggttccccaccctgtgtggactgtgatgctgaggcagcgtgcgccagat

SEQ ID NO: 44014 - DNA, 86 bp, Chlorella protothecoides
gggcggtggcggattcttagatgggggcgggggcgacttctcggcgggggggggcaacttcttagttgagggcggtggcgacttct

SEQ ID NO: 44015 - DNA, 77 bp, Chlorella protothecoides
agacggcgcagggcgccacgccgccggcgcgtgcgccggcgacggcactgcccggcctggagggggcgccgagctgg

SEQ ID NO: 44016 - DNA, 61 bp, Chlorella protothecoides
accgatgatgagccaatgacacattggctggggtactgacgccccccccccctcatacttc

SEQ ID NO: 44017 - DNA, 74 bp, Chlorella protothecoides
gcagatgcctgtcgcgccactgcccccccccctcatcctccccactcaaacacacacaatcttcccaggtccag

SEQ ID NO: 44018 - DNA, 377 bp, Chlorella protothecoides
  modified_base (108)..(307): a, c, t, g, unknown or other
gtgggttcggcctcgcccggcgcggcactcgtcccccgctccacgaaggaagcggagcgcgctcgcgcgtgctgcaccgtgccccgcaccaggccggccccggccacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctcgggcgtggcgtccacgcgcgcgccgcgccccgacggccccgcctcgccttcgaggtcgacggccgc

SEQ ID NO: 44019 - DNA, 118 bp, Chlorella protothecoides
ccccccccccccccccgtctgaccgaagaaagcacagcaacctcagcaccctccactcccacccccagaccccacccaccctgcgggtcggcggccagcttgttgagctgcgcgctgt

SEQ ID NO: 44020 - DNA, 61 bp, Chlorella protothecoides
agccgtccgtccccaggcgaaggaagggcggcgcagtgacacaagctggcgtccagatcaa

SEQ ID NO: 44021 - DNA, 40782 bp, Chlorella protothecoides
  modified_base (112)..(121): a, c, t, g, unknown or other
  modified_base (273)..(282): a, c, t, g, unknown or other
  modified_base (781)..(790): a, c, t, g, unknown or other
  modified_base (963)..(978): a, c, t, g, unknown or other
  modified_base (3946)..(3955): a, c, t, g, unknown or other
  modified_base (5332)..(5341): a, c, t, g, unknown or other
  modified_base (5798)..(5807): a, c, t, g, unknown or other
  modified_base (6139)..(6148): a, c, t, g, unknown or other
  modified_base (6652)..(6661): a, c, t, g, unknown or other
  modified_base (8141)..(8150): a, c, t, g, unknown or other
  modified_base (8461)..(8582): a, c, t, g, unknown or other
  modified_base (9325)..(9334): a, c, t, g, unknown or other
  modified_base (9620)..(9629): a, c, t, g, unknown or other
  modified_base (13028)..(13037): a, c, t, g, unknown or other
  modified_base (13228)..(13237): a, c, t, g, unknown or other
  modified_base (13407)..(13416): a, c, t, g, unknown or other
  modified_base (13517)..(13526): a, c, t, g, unknown or other
  modified_base (13647)..(13656): a, c, t, g, unknown or other
  modified_base (14254)..(14263): a, c, t, g, unknown or other
  modified_base (15923)..(15932): a, c, t, g, unknown or other
  modified_base (16014)..(16023): a, c, t, g, unknown or other
  modified_base (16858)..(16867): a, c, t, g, unknown or other
  modified_base (18846)..(18855): a, c, t, g, unknown or other
  modified_base (19593)..(19602): a, c, t, g, unknown or other
  modified_base (20581)..(20590): a, c, t, g, unknown or other
  modified_base (21114)..(21123): a, c, t, g, unknown or other
  modified_base (21487)..(21496): a, c, t, g, unknown or other
  modified_base (23227)..(23236): a, c, t, g, unknown or other
  modified_base (23890)..(23899): a, c, t, g, unknown or other
  modified_base (24100)..(24109): a, c, t, g, unknown or other
  modified_base (24550)..(24559): a, c, t, g, unknown or other
  modified_base (24805)..(24814): a, c, t, g, unknown or other
  modified_base (25245)..(25254): a, c, t, g, unknown or other
  modified_base (25536)..(25545): a, c, t, g, unknown or other
  modified_base (26152)..(26161): a, c, t, g, unknown or other
  modified_base (26723)..(26768): a, c, t, g, unknown or other
  modified_base (27059)..(27068): a, c, t, g, unknown or other
  modified_base (28182)..(28191): a, c, t, g, unknown or other
  modified_base (29885)..(29894): a, c, t, g, unknown or other
  modified_base (32414)..(32423): a, c, t, g, unknown or other
  modified_base (32498)..(32507): a, c, t, g, unknown or other
  modified_base (32577)..(32586): a, c, t, g, unknown or other
  modified_base (32860)..(32869): a, c, t, g, unknown or other
  modified_base (33207)..(33216): a, c, t, g, unknown or other
  modified_base (34689)..(34698): a, c, t, g, unknown or other
  modified_base (36000)..(36009): a, c, t, g, unknown or other
  modified_base (36227)..(36236): a, c, t, g, unknown or other
  modified_base (36648)..(36657): a, c, t, g, unknown or other
  modified_base (37044)..(37053): a, c, t, g, unknown or other
  modified_base (37182)..(37191): a, c, t, g, unknown or other
  modified_base (37276)..(37285): a, c, t, g, unknown or other
  modified_base (38309)..(38420): a, c, t, g, unknown or other
  modified_base (38476)..(38485): a, c, t, g, unknown or other
  modified_base (39280)..(39289): a, c, t, g, unknown or other
  modified_base (39526)..(39535): a, c, t, g, unknown or other
  modified_base (39949)..(39958): a, c, t, g, unknown or other
gccgcccagtcctccgcctccaagcccgccaccatctccacccccacctagcccgccaccctctccacccccacccagcccgccgcccagtcctccgcctccaagcccgccnnnnnnnnnnctccaagcccgccgcccaaccctccgcctccaagcccgctgcccagccgtctacctccaagcctgccgcccatctcatcacccagcccaccgccggcttctcttccccagctcgatcctcttccacctcccagccagtctctgccaactcannnnnnnnnngcccagccgtccacctccaagcctgccgcccatttcatcacccagcccaccgccggcttctcctccccagctcgatcctcgtccacctcccagccagtctctgccaactcaaacttcgtcccccccatcattcaacccatcttttagtccttctcgtgaagatcctccagccagcgctcctgtctcctccattccagctcccattcctcaggagatgagtattctgatcccatcagcttcagtcgtttctcctagtgagtctccacccagttttctgtccagtccaattccctccctggcgtcacctggtggtgaaccaatatcaatcgcccccttggatatgtcgctgctcaactcgccacttgcctcacaactttccagccaacctcctccaggtcggccaagctcactctcaccaccatcaacacctaattttcagaacctctcaccaccaaccgaaacatccctgccactgaccgtgctgccaccactgccgctnnnnnnnnnnacgcccccttggatatgtcgctgctcgactcgccacttgccgcacaactttccagccaaccccctccaggtcggccaagctcactctcaccaccaccagcacctaattttcagaacctctcacccccaaccgaaacatccccgccactgaccgtgctgccaccactgccgctnnnnnnnnnnnnnnnntgccaccctcgccatcaccacctctccaatcgccaccgctgccaccctccccatcaccacatctccaatcgccaccgccgccaccgtcgccaccctccccatcaccacctctccaatcgccaccgccgccaccgccgccaccgtcgccatcctccccatcaccaccgctccaatcgccaccgccgccaccaccgccaccctcgccatcaccacctcggcaatcgccaccaccgccaccctcgccaccctcgccatcaccacctcggcaatcgccaccaccaccacctcaagagtcaccaccgccatctgcgccgccctcaaaccccccgccagtgcctgccagtgatgctgcctccaacggcacggacacatctggcggaacgagcttccccttgagaatcataagctcagacgtctgtgaaggggccatgactgtcagcgccgaaggccgatggacctacagcaatgccgcaggcggtgtatcggatgtcagattcagcacccccaggcgttactcccagggagaaaggcaggagtttctttgcggagacttctacaataaaccttgcactcgtgggtcttggacgctgtcccccccatacagagtggctggctgtgccacggtccacatcaatttctcatcgggttcctgcaattccaagcacagggagttctgcttctgattgaacacccttgatctccatggacatgtatgcatgtttgtggctctatgctctttcgatccctctacaagctcgaccagtgcttggtgatgcattggtcagaccctcgacgtaaaattgtggttgttcacaccttcaccccgtagctatccgtgcccaagccgagtggatgtaagaatgccctcgaaggccgagctggtggtgtgttttgtgccgggcgttccctctacaaaccgatattgctacacattgtcatcatcctgtaaattgatacaatattcaatgtcgcaatctaatacactcacacacaggaaacaaatgggctgagagaggtttaccagattctgtcctattacatcatgaaggataaaatgaccagcaagtaggcaatgccgccggagcaggatgtgcacaagtgaatgattctagctatcatgtggagaacctatgcgttcatgggcttgtatgaagccaaaccccgggtgaccgctccaacagcccaaaagacggctcttaaagtatttagaacttggatgtaaacgaaatctggcccactggagctcatcgatactacgaggtaataacttccatgcggattctcgaacaactttttactttccttatactgtggaggctatggatcacagggaggtagccactcattatgagtcgcagtcgacgcattcagactggcagcatccgattaggcggaatgtagttcatactagaggggcgggcttggtgattccagccaacccatacatctagtacaaggttggcatggattttacgcgtggcaatggacatggacacgcggttgacatctcgactgctgaccccttcggcaaattgtcacgcagcctcgatcgagacgatcatttgcgtaattcctctctgttgatcgaaatcgggactgggaggcatcatgaggtcctcgagcctacgatggatcctgagcctggccctcctgtcgatcaccctgccagacgcgcatgggcggtccttactgcagggcgggcctgtgtgcgactcgaaagctgtttggaacatatccagctgcgccgcagccagtgcgtgggatccgaaagatcggactagacgtctgcatgacatttccgagatgccgggatccgcgcacacgggggttgtcatgaagaggcacaggggggtgcaagacccacgtgctcaggggtcgttcaccggttctgtgcagaattcagtcttgcctcacccccacaatccgcttcctgcccttgccgtgagcctcactctcgccccctcaccctgcagctggtgagtacgggacccgcctccctcaaggccaactccagcctgtgggaaccagcctgacgactggcgtggcgaatgccggcatcgcaggccccaccttctccaccttgcctaaggcaaggtccatgttggcattgggattattttccttcacaaacctccctccccctccgtcccctctctgtgtatgatgctgatctgatggtgcaggcggccttctggggaggcggagactggccgtcgcctcttccctgccctctcgctgggcgactgcacgtgcacctgacacagaatccagcctcaaaggtaacccttttgctgatgtacggctcgttcgcaccgctcagggaggcgccgtgagcgggggctccatcggctacaccacaggtaaggctggctggcaggtctatgtgagagtatgagtgggcatttgatggggtgtggggatgggaaggaggagaaaatgcgaggaagtagttcggagcgagaggcatccggagttttatgagaggatctcgtagcttacaactcaatgcattctcgccaattgctccactcagagaggagccgaactccagcagggtgcctgctgcacacccctgcctcgcatttcctctccatccagcaatcccggccctaaccctcaagccacaggcgcccttctcctccacagggggcgcccaggatgtcgccaacttccgcgccaacctgaacgcttcgtacctgcctttgccatccgacgtgaccttcaatggcatcatcaaggactactactttgacacgtgaggggttttggtgttagcttcaggattcccattaaggcacaaggttgcggctcctccccgtgccacacccatcatggactcaactgtcctgccggaggcgagctctgcccttgggtgctccattccatgatgcatgtcttgagtctgaagcacgcatcctacccctccgcgccaggaccggcgagacgtcccagctctgcaccgagctcnnnnnnnnnncgtcttgagtctgaagcacgtatcctacctgtccgcgccaggactggcgagacgtcccagctctgcaccgagctcttctgcccgatctactccattggcacttcgccccagccggccctcgtccaggcggcagatgggccggactcccgaacaaacgccagcgatctgtatatggcaggggagctggggtgggtgatgtttgagagttcttgtcattcagggatctttggagtcagttggtcgctgcaagatgtcgaactggaaaactgtgcggaggtcctaaggagtccacatgcatgagaccatcctctccttcatgcagttggcctggattccgggatccaggccgatcaattttcgcgcaagaagctgaacctggtgctcctgctcgacgtctcaggcagcatggacagcccctttaataactattactacgatcaggtgcagggaagggtcaagcgtgtgaactatgggaacttgagcattcaccatgtgcactcagtcgtggtacgcatgataaggtttatcatggcaacccccttgaatacgctcacggctgcaccactctactccctctaccatgcgcagtttggagtgcagcagaacctgacggatgaaggtacggctgttttgcgcctgcatcctccaggcagcaatcctgcgtgggactttgattcattcaagccaggaagcctgagaatgccacatgagggtgaaattgagggctctgccaaatgtgcgtagagtttgactgaacaggcccggcaacacataaaccctctttgctgacctgcagagcagcgcaagaccaagatccaggtggcacaggaagtgctgaccggcattctggacctcctcggaccggaggatcgggtctcaatcgtcctgttctccactgacgcctgtcagccgctgccgctgggcaaggttgggtgcctggacgtgaaggccctcaaggcagacattgaggtggggtgtgttttgaaggagtgctggtgcatatgctggggcacttgaagcacatgcattgcgacattggaggagcttgtggctgctctggatatgtatatgaaccttgggagtcgcgtacaattctatgcacgaatgtgtgcattcttgaaggtggggcacatatttgtaaggcttcctttcaattcccccactcaacagagggatgtcaaggcgaccgactcgaccaacactggggctggcatgaagctggccatcaagacattggaggagtgtgaggcctgtttgtctgcagaccctaatgagtgggagaaccggatcgtcctaatgactggtgagttttgttcacacatggggaggcaggggagatgggacagacggggctgaaaaggtgtatgaatttggagnnnnnnnnnncatgactggtgagttttgttgacacttggggaggcaggggagatgggacaaacggggctgaaaaggtgtatgaatttggagcgactggtaagctcagcctctgcgaaaccccttgtgcgcgggaggcccctctcaccaaacacaagagtacttgcccacaagcataccagcaaacatcctgcagatgcgcaaaccaacgaaggcgccgtggaagattcggagctgaagagcattctggaggatgccgctgccaagggcatctacttcacgatcgtcggcatcggccttgagtgaggaggtccagcctgaggggcggcggtgcctcgcctgttcgatgcgcaggatgcaaaccagggagcatgcgcactgttgcaccttccacacctcacaccctactttttgcagcttccagaccaccctggtggtgctcatcacccaagtcagcggcgccaactannnnnnnnnncatgcgcaggatgcaaactagggagcatgcgcactgtttcaccttccatacctcacacccttctttttgcagcttccagaccaccctggtggagctcatcacccaagtcagcggcgccaactacttctccgtgcactctcctggtgaggggttgcgaacatgggcgagcttacggtcatgggctgcactgcttcctcacccctcattcgcgcctccattcctgcaccccaagcccatcatcccaccccagtctctgaaccttcttttccccctactatcctgtccctactcatctccaggggagttccagaagcgcctggtgtcccaatttnnnnnnnnnncggcgaacatgggcgagcttgcggtcatgtgctgcactgcttcctcacctctcattcgcgcctccattcctgcatcccaagcccatcatcccaccccagtctctgaaccttctttccccaccactatcctgtccctactcgtctccaggagagttccagaagcgcctggtgtcccaatttaactacagcgtcaccccgctcgtctttgatttgaccctggagatccagagccccctgggcctggcctcagaggacggctggcgcatcctgcaggcgtacggctcgcccaacaacgactcgacccttactccagatggaaagattctcagcgtaggtggcaggggggtcgtttggggtgttagtttggggtggtaaaggcggggttggtaaatctgggggttgacgaggcacgtggatgacagtgcacagtgtttccggcgcagagtgaacggggcgcactcatggatggtccgcagcgcgcaggcagaactccttcctggtgannnnnnnnnncaaaggcggggttggtaaatctggggggtgacgaggcacgtggatgacagcgaacagtgtttccggcgcagagtgaacggggagcactcatggattgtccacagcgcgcaggcagaactccttcctggtgacttcctggaagcattgtaacagacaccactctggcagcctcctcccccaccgggctcctggcgccaagacaggtccaccacgccctcattgcaggtcaagacgctgtttcccagccccaaggaggatgcagccatcaagggcggcgtggtgctggtccgcatgctgcgccccgcggccgccaacacccctctccagctcgtggccagttaccgagaccgcaccgcctttgtgaggaagcggccggcctccaacacgaccaggaccgtccctgctggggatttaggcgccacgggaccaggggccagctaccagtccagcggcgtcaggaaggccattctgttggcgcgctacaccgacctcctgcgtggctggtgagggcgtttgtggatgtgtgtgaacgagagaggggtccaggatggcgaatggatctcgtgctgaatcttctccgtgctttgagaagtgtccattcccaccaacattccagttctggagcacacccatgcatctcctcgcctcgcccccctcgtccctgcccagtgtttgcctgccatgtgagactcaagacaaccacctgctccttccatcatccacccctgcaggctggtggaccagtggcaggtggccagcaacgccaccggccccttgcccatcccgccgaccctgtgccccggcttccccaccctgttctgcccggggccccagctggagcccctgtccttcctgtccagcttgagcgggcaggtgagggactgcgggctggagcgctgggtcgcgccccgggcctgcatcatccccgtccccgatgtggtcatcgcgccgcagctgggggagtgggagcgccagagctccccgctcaagatctctgcggacgctcgtcgggcgttccaggagttcctgccctacttccaggccgaggccgccgcgctggctgacgcctcgctggaccaggaggtcgccgtcctcgagcagctcatcgcgctgcccgtgtcctaggcggagcaggggggttgggggcctggattgcacaccgccctgatctgaccgaagatgaccactgtgacgactttttctctgcaccgcatcttccaggctgctgaaaaatgttccatccgtactggagcacgtcaagcatcgtgcgtcttgctcctcaagattaagctcctccatccagcctgcaaattttgtctcagggagctcgagctgctcccagcaagtaaccccaccttgtgcatgctgaccggcatctgtattccatctggccaattttcaggcccagagctcgaccactgttatgagagtttgtattttttgcgacaatgtttcggaatgtgctgtgtgaaggggtaannnnnnnnnncctggccaatttttaggcccagagctcgaccaatgttatgagagtttgtatttttgcgacactgtttcggaatgtgctgtgtgaaggggtaacttacgtgacatgggggtacacatgctccctctgcatgcaaggcgcacatgcatgagatcgaagttccatcctgctccccacagacgagaagactcgactcccccccatgccaatgcagccttgaacatctgccacacacatgtcgcatgtgaaatccatttgtcgactcgagcaacatatatatgcgtggagtgcatgtcgtgaagtgggagcgcttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagggcgtcgaagttatccgaaggccttcaacttctgagagcaaacctcagttgccccattcgacgagccatgcggacgctcagctgatcatcgtgttttcgggacacactgctctccccaatcgatgccatgcagtcggtggcgggcctgcgatgcaccgcccttcgccccttcattgcatcctcgaggcagcaagccctgctgctggcatgcgtctcccgggcttggggccgggaaagggctggcctgcacagggcaacccccaccatcgccgccctgaagcccagctccgagttcccggccgactaccacatcggccagaccagcagtgtgcccctgacccccctctgccccctgctggccgggacgggccaggtcatggcggcccaggccaactacctgcgcgtgcggcttgaggagctggaggatgccgcaggggaggtggcgtggagggcggggcaggcgccccaggaccccggcatgccactgcccggcccaggggaggacacgctgctctgcaccgccaggggcctgctcaagaagatgcagacccgggtcatggtcggcgacagggtccacctctcgggcatcgactggaccagcctgcgaggtggggatctgggtgtgaggaggcattcgactggcagggcggtgccttgtgggcggtgtgtgtcgtgcgctccatggaggcatcaatgggggggactgtccaggtgtgagagcgggtgcgatggcttgaacnnnnnnnnnntggtatgtgtcgtgcgctccatggaggcagcaatggggggactgtcgaggtgtgagagcgggtgcgatggcttgaacatggggagcctgccctctgtgagcctgtccgaggcgcagggaggcgacgcatggggtgtgagccggaaacccgacggcgttgccccatgcaaggctgcatgcccagcctctcatcgcagtccccgaccgccttgtgactatcattcacgagaaggaaaccccctccaacaaaacaaaccatcctacagggtctgtggatggcgtgcacnnnnnnnnnntctgccctgtgtaagcctgcccgaggcgctgggaggcgaggcttggggtgtgagccggaatcccgacggcgttgccccatgcaaggccgcatgcccagcctctcatcgcagtcccccagccgccttgtgactatcattcacgagaacggcaccccctccaacaaaacaaaacatcctacagggtctgtggatggcgtgcacccgcgatcctcggtcctgcatgagccacgggtggccaacgtctcgcgcctgctcctggtcttctccctggcggccccgccctttgaccccgggccggccacgcggtacctggtggccggcgaggcggcgggcctggacctgtcggtggtgctgaacaaggccgacctggtggaggctgcggaggcgcaggcgctggtggatgaggtgatcagggtcgtgatgaggggacagaagtgggggccaggtgtgtgtgggatcgagggggggcgcctcgttgggggtcacaggtggtgggtggggtggggggggagcatcggatctcctccgccgtccctggaccagtgtcctcctctgcacggctgtcaaatgcataagtaataatcaacagaataccagacacggcatccaagagtttccccccccttgccctttactcccccccctttcccctccccccaggtcacctcctggggctacaacgtcatcctggccagcacggagacgggcgtggggctggcagaaatggctgacgccatggcggggcacacggcggtgctggccggcccctccggggggggcaagtcctcgctgatcaacgctctggcccggcgtgcgacctcggcggcgggggtggaccccacgcccgtggagcaggcggtgggggaggtgagcccgcgcatcgggcgcgggcggcacaccacgcgcaacgtgacgctgctgcccctgggggccggcgcggtggtggacacgcccgggttcaaccagccggggctggagggcgtcccccccgaccgcctggcctccttcttccccgagatccgggcgcgcggcgagcgggcctgcgcctttgccaactgccgccacctgggtgagccgggatgccgcgtggcgcagccgccctgggcgcggtaccagcactacgtggcgctgctggaggagcgcgtggcggcggagcgggaggaggcggcgcgagccgtggggaagaaggcgcggcagggcacgacgcgggtgaaggctcgggcagggggccggcgtgtgctggaggccaagctggagagcaagacgcaccgccgcacctcacgccgctcgcggcaccagcagctcgcggagctcgccgaggagggcatggaggaggtctgaggcgtccccccgggggaaagggggttgtgaagggcaggagggctgcccttgcaagccctcgccatgcgcgcctgccctgctcatggtttccctccaggtttcttgaaggaggaccttccatattcctgtcaagttctgtgtacatcaattaacaatcatagggggcacagcacagtcagtcgtcatccacgaagtcgcgcccgtctgtccaccggggtctcctgaacgcagcaatctcctcctgagtgtatgagcccgtggccgggagtttgtatgcagggcgaggcaaggacgaccatgccgggagaaacccaaggtgacgaagtgacattgtgctcgatcactccatgcactgcctcactcgcccatgtaccttggtcatgtactccccagtctgcatcttggtgttcctgttcagctcgcggagctcctccaggcgctgctcgtcgcggcggtcccgcgagatgtaaaaggcagggacacccacccccagggccactcccagtagagccccccctacagcaaccagggtgtccggatcgctaaagtcgatgttgatcgcgcggcacggtggcattatcgggcgtggatggccccatgatcggtgcaacgaaggcgccctcatggcaggtccgcatggtcgtccattgcaggggatacccgctcgcactttcgttgacaataacatcctcgtatagttggagaaaggatttgtgatctgtctctggaggcccttaaagtcctgcccctcctctgctggaacctgacctctcatccccctgcgccacgcccccggatctgatatggctctgatatgggtggctcgtacctcttggctaggcgacccccctaagcacgcgtgcgaaccagggcacaacattatattttgccctctccttcgtcaacgctcatttttttggaatactaacgtttaaaagctctcgatggtcctgtgcgctggtagtttgagctgcagggcgccgccttcaggcggtgctaggttggagcgggggtcccccttcgtgcgcctgggccaccatgcccgcccacaagctcgcagacggatgtcagacctcgtaataaggtccatcgcagcccctgctccgcccccgctgcgacctgcatctcagcctcaagccccacctgcatcagagaccttcacggtgagtcatgatcgaggtcggcccctgcggcgctcgtgccccggaaacgacccgctactcaatccctgaaccatgaatacttcaggggggccgcgaactggccaaccgccctcccttctccctccaagacatccgcaacgccatcccggcggagtgctggaagaaggacaccttcaagtccttcgcctacctggcgctagatgtaggaatcgttgctgccctggccgtgacagcacatgccgtcaactcgccatggctctggcccttctactggctggcgcaggggaccatgttctgggccctgtttgtcgtcggccacgactggtgcggttggagggggtaatctggcgaccctgcagggcatgcagtggggacaagagcatcgccaggcttcgccttgcctgctgatcccagcccgacttggctggacaatagatgctgtcggggacatgccgcagtgcatgccacaatgggccccttcaacaactgaccaccactatgacccatattccctgcagcggccaccagagcttcagcacaaacaagcagctgaacgacgtggtcggcctgatagtgcactcctccatcggcgtcccctaccatggctggcgcatctcgcaccggacccaccacaacaaccatggccatgtggagaacgacgagtcgtggtaccctccctcgtgagtcattgtggttggtcgagtcacggcatgagtaggctggtctgcgtcctgggggtccaagatacatgctatgatatcaactcggctggtgtcggacccgcgtcgggtaggatgtatcttgaaggcaatcaatagggcgagtattgggttgcagagcacaagtatgaccttggaggctcaattcatgcgccttactcacatgctgatccccnnnnnnnnnngcgagtatcaggttgcagagcacaaatatgaccttggaggctcacttcatgcgccttactcacatgctgatcccctcctcacctcctcctgcagggagacggtgttcgactccctgagcttcacagggaagctgggccgatttgtgttccccatctccctgctggcgtaccccttttacctcctcgcccgnnnnnnnnnncccgagaccgaccttttcacccctcgtgaagccccaatggtgagttgtgtcgcaggtgtggaggtctctgtaccgagacgagtggcgcgattggtggtgtgcaatctctgtgaggacagagtaagacctctgcagctgactatgctgagaaggttctggcgtatgctcannnnnnnnnnataccgagacgagtggtgcgattggttgtgtgcaatctctgtgaggacagagtgagaccactgcagctggctatgctgagaaggttctggcgtatgctcannnnnnnnnncctttgacagacctgattgccattgcactcctttcatattctgagataagaccctccatgtatgcgctgctcaataaatagtgccatggatacgcattttccctttctcccccagattcgnnnnnnnnnnggctcaattgtgcagacagccatatgtgccttgctagagagatagcacagtagtactttcacagacctgattgccattgcacttctttcatattctgatataagaccctccatgtatgcgctgctcattaaataatgccatgagtacgcattttccctttctcccccagattcgcacctctaatgcggtccagctggcgtttgtcggcgtgctgggcgcctgcacctgggcactgggcctgcccgccatgatcaagctctacttcctgccctacattgtctccgtcatgtggctggacctcgtgacttacctccaccaccacggtccctcaaaccccgaggaggagatgccctggtaccgtggcgaggtgagtcatgggcctgggattgggggtagatgggggcctgcggttgagtgtgacttggaagaaaggtggactggtgtggtggctgattgctttgcagatgctggagacagactgcctttcttttttttgtacacattacaccctctaggccccacctcaatcgcttggtgttggagcgcaccagcccacttattgaccctcaccctcaaccccccctcctccacaggagtnnnnnnnnnncttcttttatgtgtacacattatcccccctaagccccacctcaatcgcttggtgttatagcccaccagcccacttattgacccccaccctcaaccccccctcctccacaggagtggagctacatgcgcggcggcctgtccaccatcgaccgcgactacggcatcttcaacaagatccaccatgacattgggacgcacgttgtgcaccacctcttcccccagatcccgcactacaacctggtcaaggccaccgaggcggtgaagccggttctggggcagtactaccgcaaggtggagccctcccccggcccgctgccggtgcacctgctggagccgctgctgcgctccatgagcaaggaccactacgtcgacgacagcggcgacatcgtcttctacaagacctccgaggagctgcagcacccgctgcgcacgctgtggcgcaagctgacgggcggccgccgctccgtcgcctgagggttcctgatgcctgtcggcggcctcatgcggagcgcctggaaggctgtggcatgggcacccgagcgtcaaccatgggtcgctgccgccgtggcccttgggatcgcgctggggcaagccccgtggggcacccaaggcagggagaaggcccatactcacccccccctttacgcctgcaactgtacacttgaatctgggcgtcttgcactgcaccttgagactcagactgcaatccccttggtccctgggcgcgcctggcatgtgctccctgcccaggcccccttgcattccctgctgggtgtcttctagctcaataagccccccataaaacagcaagctcccgcttggggatgctagcgtgcatgtccttgtacaatcacgattcccagcggggcagacctggtgcgcgatggtggtccgagtggagggggccagcgcagaccctggagatgagggtttcgaggcatgcactgtgtggtggcgaggactcggatacgcaggctcgctcatcgatgcaggtcctcagcgttccggccttcgcctccccggcatgcgtcgccatcacgcaagcaggtccctgaccgccgccacgagggcgtcggggtcgtagtgcgccgcgccggcctcggcgctccactctgcgctcacgctgcgcacgacgcgcacgcccagcgcggccagcgcgtcggcgtccacctccacgccgccgccgcgcggcgccagcaccgcagtgcagtacgccgagggcgggtggtccaggccggggtcccgccgcccgccccgccgattcagcgcgtcggtcagggccaggagcacgtccgaggcggccatggcgcccggccgccgcaggcactgccccgtctcccggtccaccgcgccgttgagcatcaggatctggtgggttgggggttggggagggtggggacggggtgtgtggtttgggtgggcatgggatgtggctcggcaggccatcgcgcatgccacccggcggccatgagctttggtgcggggcagcacctgtccgctccagtgaagcccagtgcccagcgcacaggctgccggggtctcactggcatcgagctcggcacgggctacccttccgcgccacccctcttgggcccgacatccccccttcgaccctgaagcacgagaaacaacaaaccttggggcagcgggcggcggcgatnnnnnnnnnnaaggatctggtgggttggggggtggggagggtggggacagggtgtgtggactgggtgggcatgggatgtggctcggcaggcnnnnnnnnnnggtctcacccaccccgcgcagcaccaggtggggcaccagggaggtgtagagggagcccatgccgtagatcacggcctgcgcccggcctagcgcagccagcgtgcgcgggttggcgtcgggcgccacctcgtgctccgcgccgtcgccgtcgctggacaggtagaaggcgcggcggatggcggcgggcagcggcgccgcgcaggccttgtccaccgacagcgcctcggcccccgcggcggccgggtgggagatggctgattggccgatgacccaggagccgtcagccagctcggcgccgaggcgcagcgcgccctcgctgggcagcgccggcagggtctcggtgccctcagggatgcgcgcgacgcgggagaagaggaagatggcggcctccagggagcggaagaagatgcgcgcgccggcgaagaagaagttgcccaccgagccggactggaagttgaaacggcgggaggcgtggcgcaggatgttggcctggaagtgcaccaggaaggcgcggatggtgtgcttgtacggctcagtcaggtcctggggggtgggggtggggaggatttgtgaattgtgtttgtgtgaatttgtaagagcacagaggatgcaggacgagatgcagcggagggtgaggaagttggagatggggctggaacagtcaaggcaggaacattggacgccgatgttgcaggaccctggcatgcctcagcccatcctagatcagcctcgtgctgtccgacgccatgctgaggaaaccaagcaggcacttctcttgcccgcgtcgtgaccatgcctcaatatctcatacctgccagagggggtgctccccctnnnnnnnnnnacaagcaggcacttctcttgcccgggtcatgaccatgcctcaaaccctcatacctgccagagggggtgctccccctccacgatgcggtaccactcctggcgcgcggcctctggatcggtagaggacaggcggtgtcccagcagctgccggacagcctccgactggggcagcaaggtgtggccgagtggggagtgggtggcagcgagagaccggtcatgcactgtccagtccacttttcttctgccagactcggttgccagcatatggcagcgcccgatggacaagacacgcctgagctgcatcgtcatgccactacgcacagccagcatacacgagtcgaagaccgcagggcgcgaggccacccttcttctccctgcagcacccacctcggcatcgccctcctctgccaggcgcaggcagcgtgagcggatatcacccacggcagggccgcccagcactcgcaccacctcagccgtgctgccgccgtcgtctgtgacaggcagcacatgcgtcacgttgtgcgtaagctgcttaaagtggcctgtgggtggggccgggggtgcgatattgtaagctgcgtttgagtgtcagccacgaaggcatcctggttacagaggcccccaccagggggaggcccgtgccaaagccccatgcccgcaatgcaccaaccacgccgcacccgcgacgctgttgaaggctgtgcccccactgaacacgacaatgtgtggcatggcggggagggagctgggctcggcggccacgctgtccacgctgggctcagacgctatggctggcaggctgcgagcaggtgcctgccgattgggcatgccgcggccagcctgcggccgcagaggccctgtgatgggagattgggaacatgcgtgatggcaaaatccaggtgtaggtgataaattggagggaggaagacctgggccagggatcagggctcgcaatggcaggaaagcatacttgcctggacagggggtctggcaatggagtctcggtgcgccgggcaaactttgacactgtatcgtcaagctgtctttaagagcactgcgtgcacaagtgagaggttgcagcatgctcggatccctgtttactccaccattaatggtgaagtgacctccagtgtgaagcgggggtttacggagcgtttagagcttgtagcgcgatcaggggaggagccgtctgtcattaggcgtatggatgtaatgtaagaacgtagagatcgtagcttgcgttcgcgatacgatggtgcacctccggagcattgccggcactcgacactgctggggttcgaacacgtcggacctcgatctcccccatccccgacactgcatcacgcgccttctcacccgagctcgagagcctgccgggtggaggccagtatccacataccatatcttgttaccttgattttgactcgagaacgggcctgggatctgcctctctccaccctgcacgccccacccggggtgctgcgccttgccacagggattccaccccgtgtactttgtcactccttgatcggccggcgtctcggcacgccaaccccataagtttgaaagagcacatactagcgaaaccatgtccaaagagagggtttcgccttgggggaggctaacggggtcgggaagcaagaggtcttcgtcgccacccaaccccttggaggccacgatcgagtcgctcaagcaggagaatcagcgcctgaaggagctggtgcgtgagctggggaccttgatggctgacaaggcattggggcgtgcgtgtgtcgagggtggcgatggtcgtgggtctcgtccatttcgggggagtgactccctgctcatcacttcagctccaccatttaatatgcattctactggccgtccagggattaaacttgatcattcaggagtggattatgcccaaatttgcacaagcatcagttcacaaacatgtagctgaacatcccaccgtagccctccccccccccctcnnnnnnnnnntgtagactatgccccaatttgcacaagcatcagtccacaaacatgtagctgaacatcccaccgtggccctcctccccccccccttcaccacccataaacagatctcggagcggacctcccagggcgcgactcagtctgggtacctgaacaagtaccgcccgcacgccaccgcctcgctctgggcacacacctgggagcctcgcttcgtggtcgttcgcacgggacacctgtcctactaccgcaacgaagagggcgtgcagtttcacccgcgcggccagctggacctggagggcacgagcgtggtggcggaggggctgaagcgccgcgccttccacaccttccagatcgtggacagcgcaggggcgacgctgctgcgcctgagcagcgactcgccatccgaggcgcgcgcctggatggacgcgctggaacgcgccgggtgccggcgccgcagcggcggcgaggagggcgagctggcgcgccgcgacagctcctccaccgtgaacacggtgggcggggaggacagcgaggccgagtccagcggcggcgcgggggctgccgccgtgtccggcaagcacatcggctacacctccgacacgtcggacgtgcagagccggccccctcgccggccgcccagtggcaacggcggcggcggcgggcatggcgggcaccaccaaggctccgcgcgcgagggctccggcgagggccaacccaagcgcaagcgcgaggccatgaagccgnnnnnnnnnncgggcacagcgggcaccaccaaggctccgcgcgtgagggctccggcgagggccagcccaagcgcaagcgcgaggccatgaagccgtccgccccgctgcacaccgccaccaagtactccatcatgtcctcggagcgcgtgttgtccagcaaccagaacggcatggtgaacctgacgctgctggtgctggcggcggccaacttccggctcatcctggagaacttgctcaagtacggcctgcgcttcaaccccgtcacctttgcgcgccgcgcactgaccccccagaacaaccccctcctcttcctctgctggcccacgctgctcgccctctgcctcgccgccctgggcatcgagcgcctggccctggccgcactgcgccgagagcaggcccgcgacgccgcggcggccaagaagggggaggggcgcagcgccggcggcggcggcaagggcgccgtgggcgccggcgccgcagagtggctgatcctggcgctcaacgtagccaacaccagcgccatgctggcggtgcccagcgccgtcatccactacaccgactcggaggtgctgccgggcttcgcgctcaccgccgtggccatcgtgctgtggatgaaggccgtgtcctacgcgcactgcaactgggacctgcgctgcgcgcgccgcgcgcatgagctgcgcgacggcgagcgcggctccggcctgctgcccgcgcacggcgacccgccgctgcgctacccggagaatctgacgctgggcaacctggcctacttcctggccgtgcccacgctgtgctaccagctcacctacccgcgttccacccgcttccgcatcagatggctgctcaggcacggcggcataaaggggggggggtgtcatgaaggggagagggggggctcggtggggcatggttctcatgaaggggagaggggggggcccgggggcgcatgcatgccctactccctgggcaggctgagtgggggctgagtnnnnnnnnnngagggggggccccgagggcgcatgcatgcccttctccctgggcaggctgagtgggggctgagtgccatgagtcgtccacttggtgtgcgaatccacacacactcacctggcacccttgccctgctgttgtggtgtgcccttgggaaccaatagtgccccgaggtctgttgagggcaaccgacttgcacatcgacggcctcaccaccaccatcaacaccaatccaatcgcaggcgggtggcgaccatgctggtgacgctgacaaccatgctcttcatcatcgagcagtacatcgagcccaccatccataacagcatccagcccatgatgaccatggtgagatgggatgtgtggggggcgcagaggaagggatggaccttgctgtgggttatgcacgggcaggtgcggctgcatgccgctctgagcaggatggtgggatcgcggtgaacaacccccggtgtgcaggacgcaccgcaccactcacccatcacgcctgggctgccgaaggactggccgcgcatggtgnnnnnnnnnnttgcaggggcaggtgcggctgcatgccgctctgagcgggatggtggggtcgcggtgaacaacccccggcgtgcaggaggcacggcaccgctcacccatctcgcccgggctgccgaaggactggccgcgcatggtggagcgcctgctcaagctgtccctgcccaatctctacctctggctgctcatgttctacacgctcttcgatctctggctcaacatcgtggcggagctcaccgggttcggcgaccgcgagttttataaggcgcgctggggttgggtgggggtcctgtgggagtggaaggtaggggaggctatgtcatgttgcatcgcaggatgagtcatgcatgcccagctgtggccgagannnnnnnnnncaaggcgcgccggggttgggtgggggtccctgtgggagtggaaggtaggggaggctgtgtcatgttgcatcgcagggtgagtcatgcatgcccagctgtggccgagatcgcaagcatgctgccagccccttgcctcacgtgccgccccgccaccgcacaggagtggtggaatgccacgaccgtgggcgagtactggcgcctctggaacatgccggtgcactcctggatgctgcgccacgtctacttcccctgcgtccggcacaagattccaaagttcacggctggtgcgcgacgcggcagggtggctctcaggttgccgggcggggttccttgctccgggcagcgcgatgccgtcatcaagcttcttggccgggggtgatcatcctgcctgcacgctgccgccgaccctgaaaggcaccatgctcttgggtctggggtgtgagtgggcgccctcctcaggccagcccactcatcgggctcccattgtgagtgagtcgagcattccgaaccccacacctcacccactccccacgctcaggcctgattgttttctttgtgtctgcggtcttccacgagatcctggtggccctgcctctgcacatggtcaagggctgggcgttctatggcctgatggcgcaggtgggctgagggcgagctggaccgcggcttgcagcgcctgtgtggtgcaagggccttggtgggagtgcagccggaacgggcagctcccttcactcccacacttcccttgccccggacctccaggtacctctcatgctgatcaccgagaagctgaagcagcgctttgagagcgaccgcattggcaacgctattttctggatgagcttctgcatcctgggccagcccctgtccatcatgctgtactaccacgactggaggaaggagcatggcgcatagggcggtcgcgccgccgcttgaggactgagtagcgcttgtccatccccatgttttgtttgagatgcagcacactgcgtgctacagtcgaggactggagtcctcgactgtgaaatatcgcgttggcagataacgatgctgcaaaattttcatgtccatcaatgtaggagagcgcgcgggactgcgagggttatttgcagccccgagattcaaagtcagtgccagaggcaggcgcattgcgatgccgagctggggatcccgcatacacatcgacgtcgctttaagatttgggcaggcgaaattccgtgtggcgcccttccatatcgcatcagatcgtgtccgaattgggcgctttgatattccagggctgggtgcacggacctcttagggcctgtgcagtagcggtgcgacctcgctttctatcatgggaactacggtgccttggcactctcacggcgccatgccggcttcttaggctcctcgcctcagagccagcggccccatcacagccccaccatggcaagcaccctacgcctgctccgctcccgcgccctggtgccacgcctggcgggtcctgggcccgaagctagtgctgaggtgcccctgcggcgctgcctcactgtctgggacctcaccttcctgggcatcgggtccatggtgggggctggcatctttgtcatcacgggcgtcgcagcggcgacagtggcaggcacggtctggggtgtgggagaggaatgcgagcgattgatgcccacgcactagaccttcctaggtagcactgtgtgggctggtggccaatgcatggctgtgttgagcttnnnnnnnnnngtgcccacgtactagaccttcctaggcagcactatgtgggttggtggccaatgcatggctgtgttgagcttctagtcctatggcatctcctctccaaccgcgacgtgcacaggcccagccatcatcctgtcctacgtgctcgccgcactggccgctggtctctcggcgctcaactatgccgagttggctgccagcatgccaggtagaaggggttgggggtgtaagttgcgatgcacaactcgcactgctatgtttttggggttatgcaaggtttcgcaaagtattcagtactgtgcaccaggcaaaaggctgaccaagaaactcatgacatgctgagggtgccccgaaactactatcatgcaatgtgcaggcagcccccctcaattttttcaacattccaaaaccaccgtgcagtggctggcagcgcctttgactacacgtacgtcgtgttcggggagggccccgcctggtcagtgggctggagcatggtactggagactgtgctttcctcggcggccgtggcacggggcctgtccggatacgccgccaccctggcgggggccgacaccagggcgctgctgatcagcatccccgcactcggcctggagctggaccccctggctgccgggctggtgctcgcgctctccggcctgnnnnnnnnnnacccgccctcggcctggagctggaccccctggccgccgggctggtgctcgcgctctccggcctgctcatctggagcgtgaagcaggggatgcttttcaaccgaggtgggtagggaggggggtggggaaggggggagcaatactctgcagagcagcggcgccacttgccgagccatcgatgatgcgcagtcactccacagcnnnnnnnnnncatgcttttcaaccgaggtgggtatggaggggggtgggaaaggggggggcaatactctgcagagcagcggcaccgcttgccgcgccatcgatgatgcgcagtcactccacagccggcagcaaatgcctgccacttgacgtccgccaaccccccaattcctccctttcctgaccccgccgcacgcagtggtgtctatcgccaagctcgccgccatcgcgctggtgctgggcatgggcctgccccgcgcctcgctcgccaaccttacgccctttgccccggagggcgtgcgcggcgtcttctccggggccagcctggtctttttctcctacgtcggcttcgagatggtggccaacgccgccgaggaggtggggcgaggctcggtcctgtgctgcggagcgatgcacgggcaccaacaccacagccgcagctgggcagggcgtnnnnnnnnnnaggcggggcgaggctcggtcctgtgctgcggggcgatgcacgggcagcaacaccacagccgcagctgggcagggcgtgtcgtcacctgcatcagcccacctcctcatcatactttccgtgcacccctgaagatcaccctttcttccccatccaagaattgcaccccccccagcatttcaaacccatcgccccctgctcccctcccccaccaggcgctggagccctcccgggacctgcccctggccnnnnnnnnnncgcatcagcccatctcctcatcatacttgccgtgcacccttgaagagcaccccctctcccccatccaagaattgcatcccccagcattttaaagcccatcgccccctgttaccctctcccaccaggctctggagccctcccgggacctgcccctggccatcctggggtccctgggtctaacaaccgcgctgtatgtggccgccagcgcctgcatcgtggcgctggtgccgcgcggcaagatcgacacccacgccgccttctccgtcgccttcacgtccgccggactggagtgggtggcgcgtgccgtctccgcgggcgcactggcaggtgaggggtgcaatctacgcgaggatgtgtatgtgcgggcggacaaagctgctgaggagtagggacgaggagctcatcagtgccttgcgtgcttgccgtgcagnnnnnnnnnntaatctacccaaggatgtgtatgtgcgggcggacgaagctgctgaggagtagggacgaggaggtcatcagtgccttgcgtgcttgccgtgcaggccttgggaacacccccgggcacaggcaggcaaatggccctgtaagagagctccttggatgcccctctcgcgaccccgcacctgcgctccttgctctgatgcgttggaccaccacaccctcccccacagaatttcgacctccaaactccctccaccccaccccaggcatcatcacctcctgcctctgcnnnnnnnnnngcacctgcgttccttgctctgacgccttggaccgccacaccctcccccccagaatttcgacctccaaactccctccgccctaccccaggcatcatcacctcctgcctctgcggcctgctggcgggcgccagggtgctggtgaccctgggtcgcgctttcctgctgccccacgcgctggcgcgtgtgcacccaggccgacagacccccatggccgccagcctggcggccgccgcgctggcgggcacgctgagcctgctcatggacatcggcatcctggcggaggtggtatcggccggcacgctgcatgtcttcctcctggtctgcatggcggtgctgcaccgccgctaccgcgccagcggccacggccgcgctgcgctgcgcgtcgtgggaggcctgtgcttgttgtccctgggtgagcagatgttggttgaagggaagcggtcgggacatggggacctctgcttgttattgtccttgcctcaagtgggaccgggagtgaggtctcatgcgaggtgcagtggggcagccgacttctacccgccctcaaaaccccaccacgtcctcgcccatctccaaaggcgcgagcctggccttccgcttcggcgcnnnnnnnnnngtgttggttgaagggaagcgatcggggcatggggacctctgcttgttgttgtccttgcctcaaatgtgaccgggagcgaggtcgcatgcgaggtgcagtggggcagccgacttctacccgccctcaggactccaccacgtcctcgcccatctccacaggcgcgagcctggccttccgcttcggcgcgcccctcgccgtcctggtcgtcctggccgcgctgtgggcgctgggcgcggcctcgctctgcttcatcccgcgtgcgcagcaggtgaccaccttccagaagagtttctccgtgcccctgttccccatcacgcccgccctgggcctgctggtgaacatccacctcttctgcagcctgggcgtggccacccaggcctgctttggggcttggacagcgctcggcgcgctcatctactgcctgtacggcgtgcatgcggccgcggcggccgaggaggcgggcgaggcccccttgacgaggtaggagattgtggtgcaactgcaaatagacgtcaggagccttgggacgctgagggtgaaaggcagacagggttatcccccnnnnnnnnnnnnnnnnnnnnnnnnnnnnnnnnnnnnnnnnnnnnnnctctgaattacagtcaggctaacaagacccttccctcgttctcaaagcaggcatgagtcagactttggagaccgactggtcccaatggcgcgcctggatggcagctctgaggtcgtcaaaggacaggcgagtcgcctgccccagtagctggatgtcaatgtccatgctaacaatgtggctaacaatggcaatgtgaaccctgccgagcttgacgggtatcagcaggtagctgacaactcatttttgacaaagtttacatgttgaagactcgatggagtcaagggcatcggnnnnnnnnnncggcaatgtgaaccctgtcgagcttgacgggcatcagcaggttgctggcaactcgtttttgacaaaatttacattttgaagactcgatggagtcaagggcatcggaaagatcgctcacaattggaaattcatgtgttgcttgctgttggcgaccggggctgccacaacttcgacccaggctcgaggggcttcatgtgcattcgaaaattctcccatgccaggctgagcgagcgcctcaaataaagcatttcatgcctcatgccccaagaaatgactctttcatgacgcattgacttgctgtatggcctcctgagagcatcgctactcgagtatcataccccacctagtgcttgatatcacactccgtactcgacccgcgatggcaccgcaggcaatggctgtgcaacaagcacagatttcagcccaggagtcgctccaactggtgaggatagtcggtcggtattattcagagcagcagtgatgatcggaactgtatgacaaggaggatgttccttcatgaaacttagttcggctgcttcacgacccgagcattaccctccacccactacctctgcgcaggtgcaatgcctcttgaaagtggtgaggtgatgttgtcatgattttcccttgtaatgatccgaagtggtatcgctaggtgtcccgatccctggacatataccagtcgattctgtatactcccctcccaacgcagtccatctaccacgtgtcctacctccgtggcttgctgccggaccacgtcttccagggcgtggacctgcagcacctcgacggtgagggtgatcttatttggctgctggtctgctcagggcgctacactccacaccatcagcgagccagacagcacttccccctctataacgccacattggatgcccaattgttcacagggatgaatttgaagatgctccttccacctccggaagatccttcccaagcaatgaagcctgggagcgaggtatctccgacgcaagaggcccagcgtctggctgcctgggtcgaaaacggtgcgtgggagtgtcccgagggttccagggtcgggcatgcaagggcattgtagactggttggctcgcatatttcactcgtcactgtacnnnnnnnnnnaagggttccagggccgggcatgccagggcattgtagactgtttggctcgcatatttcactcgtcactgtactacaccgcacaggcatggcagatgcactggagaagggctaccttcacaagtgcctgtttggatttgctgctgatgtcgacgcgcagcagctgctggagcaggtgacgctgtgcagctcggctcttggatgaatctgacattgtgcttgagattccgctggagccctgcacacctctcccactcttgtaaatgtgttggttccaaacgcaccgatcccactccaccattcacactcacctgcagtatgtgttcaccttctcgtatgacccagacggctgcatccacatgtctctggccggaaaaggaaagaaatttgccagccggcacggtgcagctggcgtcgagagcgtgaagaagcagtgagtttgagactggtgcgagctggctacgaatctgacatcatgccgaactgcacctcatggtgtgccaggtgcctgctgttcgaattgctgagctgggtgacaagactgcaaggtgacatggtagttactagtgcattggcaccccaccacaaccttcagggtctgtcggctgatgcgcatgctggtggaggtttgccacacgctggagcccgtgccggacgaggtaaggcattctcttgctgcataggcatgtccatagccgagagctgggcgccactgccatcggagatgggttgggatccagcatcctcatttggatgccctacagcctgcacacagaaccttatcaacccccttctggcactcaatactgcagcggtacctcttcatcaagctcacttacgtggagggcacccctgccgactatgagcctcccatgtttgaacctgcagcgcacagggcaaccggctgcttcccccgcaaacccttcaacatgtgcgcgcgagctagtactttagatctcgctgagcgtcagctgaggaggggcagactgctgcccagggtgtgccatttacctgtgggcagtcttgacagccgctgcacctcctgccatgcatcgcatgtccttcctgacaccccaaccctcctgaccctttccatcccttgtccccacccaccagatgcgtgggtgctgtggacagcaactaccatgcagtcacgctccaggtcaagtccgtcctagactccctggccgatggggtcagcgaggggaacgcggtggccgacgaccaaagcgtccaagcgtccgaagccatgaccggcaaaccgaaggagggacgcacagatgcggtgcgtgagatggcatccagcttgcaattgagtttcgaagggtgtgggggatccttggcctgcatgggagcagacagcgagggaggcccctgaaaggcgtctcaattcttctttgtgggagttggaatcgcgcatgcagcaccagctggaagctttcgcaacagtctgcaggagtaaaatcctgcagaagcttaccaggataattctttctgtgtgcagggagggcgagtgggaggaagtgacagcaactgcccgagccaggctggcggcgagggtgagcagccttccagctgggtatattaccatcttcgctgcatacctctcgtgaggttgcgttgcactgtggggaagtgctcaggatgccctctgaaaaggcaacggccaacaatcccttgtaaacccacagatctgnnnnnnnnnngcctctcgtgaggttgcgttgcactgcgggaaaatgctcaggatgccctctgaaaaggcaacgcccaacaatcccttgtaaacccacagatctggagcgtctgcgcatctgggtgaagagtcggaagaaggtgggtggtggggtcacctgaaggggtccttaattggcaccttcctgggtggctgcaagtgctctctgagcggctgctcctgacgcgttgggtcatccaccacactgcaaaggacctcttatgcaaggcagactcctcacattcagtctcttcatccaaaacagttctctgtggcagaagttgtgccgcacttcctggacctgccatctcagcagctcgtcaacaactgtcaacagcttgtggaaggtctgggattctctggtcggatgcccggccatctgtcacctatacatggctgagccaggacccacacacaaccctccaatcccaattatacgagcatttcctccaacccccccttacagagggtttgttggctgctgcagggaggcaggcttttgctgtgaaaagctctgggcagggcgccgccctcgatgacgcccacctgctgctggatgggatcggggctctgagcgtggagcctgcaggtatggaagccatgacctgtgtgcaagggggattatgagcagatttcgtaagatgaagttttaaatactgtgctgcccttggtatgtaccctcaggcgagctggggcaatcctgcaagcgtgccgccgaggactcctgtgcgggcgggatccactcccctccaggttccctgcagacccaggtgaagctgagaacaatgaaagtgaggagcttgcgatggatcaatgtcatgatcaccaagtccgcgtgactcaatacggctaccattgcaacccctccatgcacacagtccctgacgatcatgcccaaagggagccgagttctggctgacgccggcaccggcatggacccaccgccgccgacctactggcctgagagccaggtgtctgacgggcgcggagggcagggcgggggcaagaaggtgagcatcgtgcacgatcccatccgtcagaccaagcgacgcagggtggcgccggcggccggtgcggcatgcgccgatgagggcaggatgcccgcaccgctgcccccacgtggtccagctggagggatgaggacacgtggcacacgtgtaaagccatcctatggcaagctgggcctggtagcgcccgtgtgatggggcacaggcgaggcaggaatgaatctggagtggactgtgaactgtcccaggaggtggccgcaccctgtgccatacgtcaccctgacaggaaggaatgtctgacacaggaacacttgaatgtgaatactgccaatgcaaccgccagaatgccccccatgtaatgtaagtgcgtaagccatgtccaaacctaagttggcgccctcaacaccccatgcgagtgaccacgatctccatcgcacaaaaattcacgagccaggggcatgcatccatttgcagggctccgcagaattaacaagaaagtatacagataaagcattggaatgagctgacaacgctgcgcacaacccgctgctgctggcagtgcgagccagctggcgtactcgcggtcgccttgcctgacacatctggcaggtcgaacacagctgtccgatgacggtggattatgccgatacccccattgcggaatggaagcgcaaggagctgcgagcacacaggcggaaggtgtggaggggcatgcaccagcagggcgggctcctcatgtttgcatggatgtgccccagccgttgacccctcgaacaccccccgacaccacgtcaaggtcttctgcgttggatggaatgaggacggcaggaggctggccacgggctcccatgacgagaccatgcgcgtgtggagctgcgacgaggctggcatcgtgagctggggtccgtgccatgcggctgagcggcgccaggggtgtgaagcatgcccttgctgccggcccggtgtggagtgtgaacacacgctgcacacaggttcctgtccagggccgcatggctgcacacccaccgctccgctgcccctcccccacccatccacagttcaagcaggagatggagatgagggggcaccaggacgccgtctcccgcctggcctggcaccccacacacccagacaagctcgcgtccctgggccagctcactgagcagtcggtcaggtgtgctgggctgtgcgttgccaggattacaatgagagagcggaaacgcgggctgcccttgcgtgcctggctgcaggcttggtccctgtctgcgtggaggtgatttaccctcctccgaccctcgactgcctcctggctccaaccaactctggctccctcgagcgcgcaggttttgggacacgaggagcggcaagaacacggccaccctgcccacgcccgggatcaacctgtccctcatctggtcgccggatgcccagtacatggctgtggtgcgaaggggtagagcactggatgtgtggggctcgaaagnnnnnnnnnnaacccttgactgcctcctggctccaaccaaccctggctccctcaagcgcgcaggttttgggacacgaggagcggnnnnnnnnnncactgagtgagactgaaatacagacaggagaggggtgtctgcggggatgagcgaccttattgcatggggnnnnnnnnnntcctgagtaagacttaaatacagacaggagaggggcgtttgcggggatgagcgaccttattgcatgggggcccgggatggggcaccatccagttacctccccttgcatcatgccacgctgcaccaacagaacaatctagacgatgtggtcagcatcctggatgtcagacggatgaaggtggtcagcaagcacaacttcaagcagcaggcaagcatgaagtcgttgggcatagaatgtgtgtgtgggtttgcaactgcggtgttgttttgagtgnnnnnnnnnntatgaagtcgttgggcatagattgtttgtgggggtttgcaactgcggtgttgttttgagtgcatggatgggtgtgtgcaaggagtgcagggtgcgatgggcttcattgggaccttgcagccccagcgtggcggggatcagcatgatgtagcagcggctggtcccctacaccctcccccagtgcagggcatgatcaaccccagaccctccccacgcagatattcgagattgccttcagcaaggactccaagcacttttacctcgcgaccgacgctggggaggtcgaggtgagagcggctgcggtttggctgcacctgggcgcaccgccctgcctgtgcnnnnnnnnnntgcgaccgacgcgggggaggtcgaggtgagggctgctgcggtttgactgcacctgggcgcaccgccctgcctgtgcttgggatgtggtggctgtggtgaagtgggcttttgctgtgacaaggctgggctgtggtgcttgctgcgcctgcgtgcggcattccttcgtgcctgtccactggagctgcaacctgatcccccaacccgcatgcaggtgctgagcttcccagacttcaagccggagaggactatgaagggccacgtctcccgggtctcctgcatgggctttgaccctgggcacacgcgcatggccagcgggggaatggacacggtcaccagcctctgggatctggaggagggcatctgcacacagacgttctacgacttggaccaagccatacgtggcgttgggtgggttgtgatgggtgggaagaggtggtctcggttctcactcctctgaatggactcgaatctgcgctagcatcgatgctgctgtgagcgggctgctatcatgaggtgctgatcgactgtcaagtgctgcaggcagacattttccggaaacccagctgctgttgcttcacactctggaatgcatctgaatctttcatggtgctttggattgcacatactctggactctgatcacctcctctcacgctggccctttccgcacaggttcagtcacgatggccagtacctggccattgtgagcgaggagcctgctttggaggtggtgaacctgaggacaggggccaacctggggaggcaggtgctgcgtacctgccccgtggacgttgcctggaatccgaggaggcacatccttgctttcccgggggcctcggagcgggacgggagtggcgcggagcatgggctggtggagctgagatacttgccggagcagggtcaatcctgatcgatctgtacaacactcaatcgcacacgacgtcattccaagggaaatgagcttgaacagggctcccagtctccgtgcgcacgttcaggccgtcgaatgccatcatgtggagcagcgggcacggagtactcgcgcgagccccaggttctgcctgggtcttgcgagccgccgatctctggccagcgcaacttccctgccgctgggccgacaaacgagggtattcatctcctcgcggaccagatccacacttcgtccaatcacaatgtcgcgattcagctccagaagcaccgcacaagatgttgtgcgcggcgtagacctcaccggcaaggtcgcggtcgtgacggggggtaacgccggtataggcgttgaaaccgtgcgtgcgttggcaggagccggcgcagatgtcgtattcacgtcaaggaatgtggaggcgggcaataaagttgtcgatcggctgcaggcggaaggagtgaaggtggggagtggtcgtattgatcgctgattgttgccgacattgtaggggtgaccttgctacagtaatctccagcccctgttcctgccccnnnnnnnnnnggtattgatcgctgattgttgccgacattgttgggatgaccttgccacagtaatctccagcccctgttcctgccccaatctgcaaaccatctcaagtctcctgccagggtaagctcacggtaaagcagctagacctggcctccctgaatgacatccagtcgagggtggaggccatccaagccgcagcacctgtcattgactacctgatcctcaacgctggggtgctgagcggccccgcaaagacaaaggaagggtttgaaatgtccattggcactaatcatattgggcactttcacttcaccaagtgtctcctcccaaaattgaagaagcaggtgggctcgggtgaaagttggtctggtgggggcctccgttggcggcggaatttctggagcgttgggggcatacgccaccaggcagtgggcaagggtcaagcaccttgcttccttgccgcggctggccacaaatcatgcgccctgatttatccatgcacaaccattccagggtcgcccagcacgtgtggtggtgctttcttcccgtgctcactttggtgcccgtgatctgccgatggatgacctgaactgggagcgccgcagatatagcgcctggcctgcctacaacgcctccaagctctgcaacctgctgtttgccaaggagctggcgcgcaggactagagaggcgggcgatgacatcgaggtctttgcattgcacccaggtgtcatcggcacgagcctcttcagtggggagtcattgtccaactttgcggtgcgcattgccaaggccatccccttctttccgctgctgaagtcccccgagcaggtgagaggaaggttgtccaggcggagtgggaatgagcatagtgtgatttatattgtcaagggaaccactgcgctgcatgtctcagggctggcccttgagggtgtcgctgtcctcgcccttgcgggaccgctctggcttgcctccaagccatccagactgacgtgcaatcttcaatccccaccagggagctgcaacaagtgtctatgctgccacatcccctgagctcaacggccagagcggagcctacctgtccgattgcaaggtgacagggacgagtgcgctaggccaggatgccaacctggcaaagcagctgtgggagaagacagaagaaatgattgctggcgccctccgttcctgatttgggcatcctatttatatgagtatcggacaacctcgggccatgtttggacctagtgaatgtaatcacttgcagatccctcaagggtgcaagggggggtggtgacaaactatcaagccgctcgtttnnnnnnnnnncgcagatccctaaagggtgacagggggtggtggtgacaaactatcaagccgctcgtttgtcccggagattcgccgatttgaaacctaggaaatcgagacgctcagagcacaacagcctggcccggagatgttgatcttgcagatgtagagtcgacattgcaattttctcgttgaaatcgcaggatttacgcagtagttcctcagtcgcaggcggcagnnnnnnnnnntgacattgcaatattctcgttgaaatctcaggattaacgcagtagttcctcagtcgcaggcggcagaggtggcgccatgtcttcccagttccagttccttgcgggcagtcccacaaagcagggttggcagcctccgagcgatgccctcacccccgcatctgatctcatccaggcatggggcaccaaagaaagtcgaggcgccgactctatcctctccactcccggcgagcaagtgctcagcgccaaggtatcggcatgtcgggtggcgatgggcttgaagtgttgcacgtgtctctgctgggcatgggtgtggcaaaggaattgtgctcttctccaaagcttcgctcccattcaatctaagcccagctcctccctgttccctccagacactgttctcttctcctcagcccannnnnnnnnngggaattgtgctcttctccaaagtttcgctcccattcaacctaagcccagctcctccctgttccgtccagacactgttctcttctcctcagcccactccgagcggatgtgaccgcgaggaagctctgaggtctgtggaggccaagttggaggccaagctggctgctgaaacccaggaacatgcatcaggtatgctcatgggcacatggaaggccttctgctgttgtttgcatacattgaaatatgctctgtttctaggacaaagtgggataggtaggatggcgtatgaatggcacatgtgcattgcacattgctgtcgcagcaactccccatactactctactctgtgcagtgtcgagcaagctgcagtctggtggtgcagatcagnnnnnnnnnncctaagtgggataggtaggatggcgtacgaatggcacatgtgcactgcacattgctgttgcagcaccttcccatactactctgccccgtgcagtgtcaagcaagctgcagtctggtggtgcagatcagnnnnnnnnnnatcctggggagcatgtgcaaaggaggtatcaattcgctgccaccctgcatgatacgcccagctacccttcacgacgccctgcccnnnnnnnnnngtgaccttgggatgtcatgcgaggctctttgtggcaacagcgcgggcatgcaggctcttggggagtctgggcaagggaggtctcaattcgcagccaccctgcatgacacgcccagctacccttcacggtgccctgcccacctgccacgaccaccgtgcagtcgtcggcactacaagcagaggtggagaagcgtgcccagcgcatggcgctgctgcaggccaagctgcaccggacccgcttcaccctgacggaactgcaggcctcccagcagcgcctccgcaactccaccgagaaggtggagagcctgaatgcgcagctcaacaaggatgagcgctccaaggtgtggattttgcggccctgggagggcggccgcggtctggcaggttgcttgtatgaatttgggagggtgttgtgcaggacggtgcagcaatgtgtgcttcgcggcatcttgatatgcctctctgttggggacgggatcagactggtggcaattgctgccatcttgtgctgtacgagtggtgctatcgcggctgcaaggcattgaggccaaccgccccctaaaaacattcctgcccagcaccgttcagccccactctcccacccaccaggcgaggcgcgcatcgctgggcgccctgcgcggcgagctgaacgaagcgctgtcagtgatgaatgccgcctcgcggcgcgtggaacagatggaggccatcaccgacatgctggtcagccagctggccgagagggaggcccagctaggcgaggtgcaggaggccgcacgctgcgctgagtcgcagcacgcccaggaggtggggagagtggccttgggtgaggcggaatgaggggggagttttgcagggcgccccgtccttcctgtggggcatgggatgagcggcagcacgcaacaagattgctgccgcggcctctcccgcccagcatccagttctcatcaacatttaaatgccctgctaacccctccgcgcccccacgcaggtggcagccctgaccggcgagcgtgaggggctgatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgctttgggtggcagtcaacatccaggggatgcaaacactgggtggccagcaaccnnnnnnnnnncattgctgccgcggcctctcccgcccaacatctagttctcatcaacatttaaatgccctgccaacccctccgcgcccccgcgcaggtggcggccctgaccggcgagcgtgaggggctgatcgaccaggtggcctcctcccaggagcgcctggccgacctcgaggcccgggacgcagagctggggtgggtggttgtcttgtcttactggaggatgggacatggttgtgtttgggtctggcggagccatgcacggcaagtgtggggatgcttgcgtgcttggggtggcagtcgacatccgggggatgcaaacactgggtggccagcaaccatcaactccattcctcctttccacacaggctaaaactggacgaggcggcacgccgcgcggccacactgggcgcggcgttgcggggcgccgaggctgagcgcgacgccgcggtggcgcgcgagcgggaggccctacgcggcgccatggccgaggcacagcaggcgcaacacgacctcgtgctgcagctgcaggccaaggaggaggcactggcggcggcgctggagcaggccaaggtgggtggtggggcagggtcgggtttgagcgatggtgctggctcaggggagatcagacagagggcgatcaggcctgcatggaaggccaggcagagggcagtcagacctggctggctgcctgtggggtgttgtcatgcctgtcggtgaggctgccaccgaatgaggcctgcctttcctgcactcgtggactatcatgccatcattcacgcgcagatgggcacgcccgtgggtgannnnnnnnnntcattcctgcactcgtggactagcatgccatcaatcacgcgcagatgggcacgcccgtgggtgagggcgccaaaaaggtgctgcccatggccttccagcgcatcaagtgcgttcatttggagagcagggcgcccgagcgccctggcggcctggccaatgtactgttgtgaggttgcctgcctgtgtattgaaacctctgtgcagcaacagtgaagcgatgtcgccactgggtacatnnnnnnnnnnaccctggcggcctggccagtgtactgttgtgaggttgcctgcctgtgcattgaaacctctgttccgcgacagtgaagcgatgtcgccactgggtacatctccgcactatggttcccatcacaacgccgcccccaagtcatgcccatccgtcacccgacctgtgcagggccacccagcagcagctggcggaggagaaggcgcagcgcgagggcgccgagacggctgcccagcaggcgcagcgcgagcgcgacgaagccatcaacgccctggagagcaaggtgggtgcgcgcctgactggcgccaatcctgctgaattgctttggcatgaagggaggggtgaatgcagcggttgaaacttgtgtggctcgggttccctactgagggcatcagccctggccatcacggcgtcgcctnnnnnnnnnntgaagccatcaataccctggagaataaggtgggtgcgcgcctgactggcgccattcctgctggattgctttggcatgaggggtggggtgaatgcagcggttagaaacttttgtggctcgggttccctcctgagagcatcagccctggccatcacggcgtcgcctggcttcatcctaatacgccaccccccttgatcatgtcattccctgtcatcccctccagatctccgtcatggacgccgaaaggcagcgccaggtggcagagaagcacgcctccctggagagcatggtgcgcgccgcagccgccgccaccacggaggcggccatgaaggccgaggccctcaagaagctggtgggtggaacggaggggttgtgctgaaggcgctcgtcatggagtcatgaccttgaggatgagggggccggcgtgtgtcgggatgcaagcgagagtccacagtcctgaggacccgtcgttgtgcattgatgtctgttgggctgccccgccctcaccccgtcgacctgccgacccataattccattcccaattccccccctccctcccctcccccagaggatcgagcaggaggccctggaggctcgcctggccgccagcgagggacatggcacggaggtcgccgcccgactcgcggcgcgcgatgctgaggtgggaaccctgtcacgccaggtggcggacctggaggcgctgtccgcccaggccgaggccggcctgcgcggcctgggcgccgagctggcggccgcgcagggccgggcggaggcgggcgccgtcgcggtcgacgcgctgtccacacgcctggccgcggccgaggc

SEQ ID NO: 44022 - DNA, 61 bp, Chlorella protothecoides
agaagtacaaggtgtgtgcgagatggcaggggggggacttggggcacaaacctcatttatg

SEQ ID NO: 44023 - DNA, 101 bp, Chlorella protothecoides
gagagggacaggtatcaataattaaatgcatggggggggggaaggggggggggccgcggcagcggccccctcccctgctcacgccgtggcctcgaccgagg

SEQ ID NO: 44024 - DNA, 61 bp, Chlorella protothecoides
gaggggtgaagccggggcaaaggtgtgaggatcctggggagcgctgagggagggatccaca

SEQ ID NO: 44025 - DNA, 70 bp, Chlorella protothecoides
cctgcactgggctgttcagccccctctggaggcccgaccaaatacaccattgcatgcatcactgcccccc

SEQ ID NO: 44026 - DNA, 61 bp, Chlorella protothecoides
tctgtgtaacggggtcggcctgggggcgggggaggtagcgatttcttggggcactctgtgt

SEQ ID NO: 44027 - DNA, 61 bp, Chlorella protothecoides
ctccctcatccccggccagatcaacttcacactgatccaggccgtcacctccagagtgacc

SEQ ID NO: 44028 - DNA, 61 bp, Chlorella protothecoides
gcaatctcgccattgaatgggtgccggcgggcggtgctctcattatcgagcagcggcgcct

SEQ ID NO: 44029 - DNA, 61 bp, Chlorella protothecoides
catcgacgagatcgacgcgatcgggcgcgcacgcgggcgcggcggctttgccggcggcaac

SEQ ID NO: 44030 - DNA, 61 bp, Chlorella protothecoides
catccccacacgttctccccacttctgttcgcccgcccgcccatacctgtacagacacaca

SEQ ID NO: 44031 - DNA, 492 bp, Chlorella protothecoides
  modified_base (93)..(102): a, c, t, g, unknown or other
  modified_base (185)..(332): a, c, t, g, unknown or other
ggcgtccccgcgcggcgcgctggccggccgcgcgcgcaccaccgccaccgcggccgagggctcggggtgcaccgaggggccaaaggcggggcnnnnnnnnnncaggcagcgcaggggccccggcgcggggctggccgaactgcgctcggcgacgcagcccccctccaggctgctggccgtgctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgcaggcgcaccagcggcgcgtcgccgcgcaggcccgccagcgcccggtccagccccgtgccgaggtcggcagggtggggcctggcgaaggtggtcgacggcgtgcgggggccggcgcccgaggtcgcgccgcgcgccgttgcggcgtgcagcggactgg

SEQ ID NO: 44032 - DNA, 61 bp, Chlorella protothecoides
gctggcgggcgaaggaggtttcatcgcgggggtagcttccgtcatgttcggcattaccctt

SEQ ID NO: 44033 - DNA, 92 bp, Chlorella protothecoides
tcatcccgcgcccacccacccgcccacacagtatgccatgtctgtgatcgtgggacgcgccctgcccgacgtgcgcgacggcctcaagccgg

SEQ ID NO: 44034 - DNA, 61 bp, Chlorella protothecoides
caagggcatgacggagtccgaggcgcacaagcgctactttgcgccggcggtggcgcggcgc

SEQ ID NO: 44035 - DNA, 440 bp, Chlorella protothecoides
  modified_base (124)..(349): a, c, t, g, unknown or other
ccgccatgcgcaaggtggcgtggggggagggactctgtgtgaatacggaggacgaggtaccccagggctgagccgtcccagcagcttgggggaacagatgtttggtgccttggctgggtacatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagcggatctgtttaacggtagaaaatcccatctgcctcctctccttccatgtcacaggcggtggaggaggtgctgggtctgttgctggcc

SEQ ID NO: 44036 - DNA, 61 bp, Chlorella protothecoides
cagcaccaccggctgcaccgcgtccaggatctggttgtccagctgcgccttgcggatggag

SEQ ID NO: 44037 - DNA, 61 bp, Chlorella protothecoides
ggcgacgaccagcagcgcgcggaaggcctgcgcgtgcttcaggcgcagcgcccccgggctg

SEQ ID NO: 44038 - DNA, 61 bp, Chlorella protothecoides
cgccgcctggttccacagacccaagcacgcacgccgcagggccgcggaccgccgtttcgag

SEQ ID NO: 44039 - DNA, 457 bp, Chlorella protothecoides
  modified_base (98)..(337): a, c, t, g, unknown or other
gctgggccgtggcggcccaggcgccgggcccgccgtgccggcctcgccgcgctcaccggggtcggggcccggcggggcgggggcctccctggtccgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcctgcgcgcccttgccaccgcggccgccgcctcggagcgcagcgcgctgcgcgccgcgctgctcccgctcccggtctcctcctcgctggcgcgcgcgctgcgctccggggacgaggggg

SEQ ID NO: 44040 - DNA, 61 bp, Chlorella protothecoides
gttatttgaccagctcggcgaatcggtgggggccgggatgggcatggcgtgtcgaggggtg

SEQ ID NO: 44041 - DNA, 423 bp, Chlorella protothecoides
  modified_base (156)..(267): a, c, t, g, unknown or other
gcgcgccgccgcgccggggccgggcggcgcgggcaagcggcgccgggcgcggcccagccgcctgctggaccacgaagacctgcagggcatgcaggacgtgtttggcgacgacgacgagctcaaaggtgctgggcgtttttgtttgatttttggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcacatacgccctctcaatcggctgctcacatttcaccgtcctcatcacgaaacacatgctccaccgcagccctgcgcaacgtgagcgcgcagcggcggggcgaggagggcgcccggcgcgggcggcgcccactcgcgccggcggcgtccgcccc

SEQ ID NO: 44042 - DNA, 96 bp, Chlorella protothecoides
atactcagtcgtcccgcaccagctgggaccttagtgtcgtatcgggaatgtctgtctgatccaaagtaccaatccttgtgcagtggccggcgcggg

SEQ ID NO: 44043 - DNA, 61 bp, Chlorella protothecoides
ctcgcggtgctgcaccagcaggcccgccagtgcggcgtcgcacaggcgcgccagcgtcccc

SEQ ID NO: 44044 - DNA, 16007 bp, Chlorella protothecoides
  modified_base (695)..(704): a, c, t, g, unknown or other
  modified_base (920)..(929): a, c, t, g, unknown or other
  modified_base (1207)..(1216): a, c, t, g, unknown or other
  modified_base (1274)..(1283): a, c, t, g, unknown or other
  modified_base (2277)..(2286): a, c, t, g, unknown or other
  modified_base (3029)..(3038): a, c, t, g, unknown or other
  modified_base (3295)..(3304): a, c, t, g, unknown or other
  modified_base (3454)..(3463): a, c, t, g, unknown or other
  modified_base (3681)..(3690): a, c, t, g, unknown or other
  modified_base (4960)..(4969): a, c, t, g, unknown or other
  modified_base (5999)..(6008): a, c, t, g, unknown or other
  modified_base (6994)..(7003): a, c, t, g, unknown or other
  modified_base (7388)..(7397): a, c, t, g, unknown or other
  modified_base (8461)..(8470): a, c, t, g, unknown or other
  modified_base (8996)..(9005): a, c, t, g, unknown or other
  modified_base (9735)..(9744): a, c, t, g, unknown or other
  modified_base (9824)..(9833): a, c, t, g, unknown or other
  modified_base (11152)..(11161): a, c, t, g, unknown or other
  modified_base (11354)..(11363): a, c, t, g, unknown or other
  modified_base (11743)..(11752): a, c, t, g, unknown or other
  modified_base (12395)..(12404): a, c, t, g, unknown or other
  modified_base (12591)..(12600): a, c, t, g, unknown or other
  modified_base (12867)..(12876): a, c, t, g, unknown or other
  modified_base (13085)..(13094): a, c, t, g, unknown or other
  modified_base (13564)..(13573): a, c, t, g, unknown or other
  modified_base (13730)..(13776): a, c, t, g, unknown or other
  modified_base (13944)..(13953): a, c, t, g, unknown or other
  modified_base (14010)..(14019): a, c, t, g, unknown or other
  modified_base (14076)..(14090): a, c, t, g, unknown or other
  modified_base (14283)..(14292): a, c, t, g, unknown or other
  modified_base (14754)..(14763): a, c, t, g, unknown or other
  modified_base (15451)..(15460): a, c, t, g, unknown or other
gccgctgccgtgcgcgcgcgacagctcccaggagggcgaggcctggtgagccaccggagcgtggggcgacccgtcgctgctgcgtcgcgcggggccggggcgcgactcggggccccggcccagcgtccccacctgcacctctgggttcttgaagggagagggcatggggttgcgcgcagggtcgctggacccctgcatcgacaggatgcgctggaagcctcgaacgggctggggctcggaccctgggcccgaccccacccgctgctgctgctgtggcggccgctgctggtaggaggggcagggccaggagcggtgagggccgcggccgccaatctcccccgccgccaggtgctgggaggtgccggagggcgtggagccctcgcgcgccgcgccccagctgcgctcccgccgcagccgccggaccagctgatccagcgaggacaggggcctatgcagggcctggctggggccgggcgaggacgcgcgggggggcgcctctgcgggccgcggggcgccgccgggcccgacgtccacccctgctgctgcggcgagcagcgccaccaccgtctgcggggagggtgatggaggcagccgagtgtcagggtgccgcgcaggggttcttgcagggcggcataggactcggactggatggttccccccaccaccaccgaccaacttccacccaacaaatctcnnnnnnnnnncgggtgatggaggcagtcgagtgtcagggtgccgcacaggggttcttgcagggcggcacaggtctcggactggatggttcccaccaccgccaccgaccaacttccaccccacaaatctcacctgagagtcgaggtagggcaccgctgttggatggctgccgtgaccctccgaggcctccacgccatgcgcagccagctccgccgccgccacctccnnnnnnnnnngggatggctgccgcgaccctccgacacctccacgccgtgcgcagccagctccgccgccgccacctcctttgcatgcgtggatccgtgctcggcggccatctgggccaggcgagagatggccgacaggtacagctcgtccttgggaacctcctgccgagcgctctgccagggctggaagggcgccgggtccggcacctgtggagggtggaggagcaaatgagtggggtagggggggtggggcggggtgccagagcccattcttgaggtgcagaggtttnnnnnnnnnngttgactgatggcaggggggagagctgcctcgcaacacgcctgccatccccagcctcnnnnnnnnnngtgccgagggctctgccagggctggaagggtgccgggtccggcacctgtggattgtcgaggaacaaatgagtgggggaggggggcggggcggggtaccagagcccattcttgaggtgcagaggtttgccacctctggaggcacgcgcaatggcctgtaagatgatacacgtgcatggcattgcccgatggcgggggggggagagctacctcgcaacacgcctgccatccccagcctcccacatcccctcaaaacacgcccgcattaccaaatcatgcagggcaggacagcgaccccccagctcccccacctcagcaggagcctcctgtcccgccgtggtcagctggatgtgcagtggcctggagatgataaggggcggtacggtgtcgctggcctcccgcgcggcggccgtcgccatcctcacctccacggcgtccccctcgtccctgacggcgccctctgcgctgagtggaggccggcggtccggggacccgccagagctgggcgctgtgagggcagagtaggtgatgcgctgggacttgggcagccgatagtcgggatcagggttagcgtgcggaagctggttggcgcggcggcggcgtgcggcgtgcttgtccagccgcgcccggcaagtccgcatgaggccctcgaaggcggccagctcctggaacctgccgcactgcagtgatggcgcaaggggggtggggatcgacggttgaacatctgggcaagatgggccagcctcgcgaggaacagggcaatgggggaggtgcttccgtgtgagagagcggctttcactatccaatgtgggcaggcaggtgcaaggttgagagcctgagcaggcagtggcaggttgactaccattcaaatcacaccctcgcacaggctcttctgcttggactgtggccatgtctgctaagcctttgggtggctggaatccatgctctctagatatccccacaacaccgcagggaccccagcaaggtcacctgctnnnnnnnnnngtccatgctccccagatatccccacaagaccgcagggaccccagcaaggtcacctgctggcagaagcgcatgctcactccattcctatcgatggtttcagcggtagcacaaggcacgcagatcctgtacctctaccaaattcagcgaggaagcatgggattggggggtaagacggagccgcccggatggggcatcgcggtgcgttgcgtagaaaccaagggcacggcaaccaggactacccgcgaaacaggaacaccccccaaacccggtgcaaacctggtagtaagaccttaagttcccgagtgcgcatccgcagacctacgcaataggggcgtgggctcgaaatggggactagacccctggtaggaaggctgtcggtcgcctcccttccctgccgctgctcctaccgtcgcataagtctcacctgacaccccggagcatccctccgacgacgccctccagtgtggatatgtggtttatctgcatcatgggtatccctgggcgagtgaggggcccctttgatgctcccttcaggttccgctggggcctccgacggggttaggagggaagtcctcccatcgacggcatcctctgagtccgggacttcttcaggagacatggttccaaattctcaagtattcactccatttacggggcatgctttggctagtgctcgacacacaacggcattcgcagtgccatcccagcctcttgaggatgcagaagctatccgcgggacggannnnnnnnnncgacatcttcaggagacatggttccaaattctcatgtattcactccatttacgggtctgctttggctagtactcgacacataacggcattcgcagtgccatcccagcctcctgaggatgcagaagctatccgcgggacggagccagcctctggccggaacacggaggttgcgtaatttttaagctgcagtactaccctttgttttcgcagctggtagctggactgcacatctccgtgcatttgcagcatgcacagcnnnnnnnnnncttttaagctgcagtactacactttgttttcgcagctggtagctagattgtacatctccgtgcatttgcagcatgcacagcccaattacgagatcaatggagggggtaaggagcatggcggcgaagtacttgggcccgcgtacgcggtannnnnnnnnngatggagatgggtaaggagcatggtgggcgaagtacttgggcccgcgtacgcggtattaaacacagaaactcaagcctggtgtcgtaccttaatgagcctggtagtgtagcttcttaaattagatcgtatacttacaaggctggatcgtcatcatgcctggcaggactgcaggactcgatgcgcaacaatggtacgccaccagacagataacctggtnnnnnnnnnntcctagttggactgcaggactcgatgcgcaataatggtacgccaccagacagataacctggtgggaatcccggagctcctgcactcactagcgctgaccttgaatggaaatacagtcccgcgttgcaaagatccttcccgaacatatgcgccggtaatatgtgttgaatcccccatcagatgctataggctgcccctagctgtgcaacctcgccctctatccgggcagcaatttgcgtgctgatgccaagcatgttcctgcaaagtgagcatgctcttgggttgagcttcagaatagccttctccatgggatgaaaggccacctgccatgctcctgccaacgaaaaccggaacaccaggcgtttagtcacatcattcgctcgcatcgtctgcccatctgcaccccagttgccagttcacctgagttgcagcagggtcgcatagtctgagggatcctcagtgtgcagtaggtgaagccgatacagtgcctccagctgccaacaggaaaggcagggaaagcgacgagatacatgagcaaagtattcagtgagtccttgggtataccttcaaagaatcctgttgccgctgggggaatgaaccctgatcaatacacccacagagatccaggaacaaactcaaccacaaccatctacctctggagccccgcaggaggggctgctaacaggccggcggcagcagcggttttcatgcagagcccttcgaagctccgccagtgctctgtgcacaacagaaatggagagagtctgtatcgtcagccggaaggtagcagcagatgccaatcctggcattgagcatcatggaaatggcacttttggccgatgcctcatcacacccacagtatctccacccaccttgccggttctccatccgactgaaaggcagatgctttctctatgtgagccgtctgacgagtctgggccagggcggcgacatagtcctgctgcggctcgtactgatacactccatgctcagccgcggtgtaggacgccaacgacgagcggtgttgtggcagctcctccccccggcttggctgtcggagggccttcaagaagtacacgccaccggcagctgcaattcccaggcagaagggaatcagcgtgcgtgccctaaggggaggaaaggactggactgactgtgatgccctcctttcaggggtactcataccctgcatgccatccatggtctgaccccatgcctcacagtggggttgaaggctgcgccggggtgtggtacgtgctcgggacggatcnnnnnnnnnngtgccatccatggtgtgaccctttgcctcacagtggggttgaaggctgcaccggggtgtggtacgtgctcgggacggatctatgcgctgcctggcacctcacacactggcgatgacgaccgctcggacccggcgtgggggagggcaggaacgccctaccctgatgcagggctggcgccggcgtgcaattcagcagtgcgtgtaccatatcgaatcgctgttgttacaacaatgtttccgagatgttcagagatgtctcgaaactatagtccgcgcagaagggtgtttaggggagctcccggatcggcgcgcagcaggttccccagcatgacgtattcaattggccggggccgtgcgccagagggcgccagacggaacacggcatggcgatcgcggcaccgcagcggactcctcacatgtgatagggcatgcgtgatcctctgaaccatggcgcaaggactgattgatcagtgaggctcgactgagtgctcctcgctggtccctgccatgccgtcttacaccttgaggtgcgcgtgccattggcagggcgcctggccatgctcctgcactgataccttgcagcattccatatcaatcattcacatcgcagtggagtggaggtgaccttccctcacacagcctatccatgccagctcacctacatgactaaggtcatccaggccctgcaagcggtgcgcatgtgggggccctcaggggacgtgggctttggcgacaggcatggctgcttgaggatacatgcgatcacccaccaggcagtcatcgcacgagcctgcagggggagaatgcgctgctggagagccccacgggcacgggcaagacgctgtgcctgctctgtgcgaccttggcctggcgggcccactttgtcaaggaggtgggtcgcctgtaagttttgtgggggttctcaagcaagcagggttcccggtgcctgctgcagcctgccattgtgcctggaagagcccacccccacccggtctcgctctcttcccaggcggccgagcacgcttccaggnnnnnnnnnntagcccaaccccacctggtcccgctttcttcccaggcggccgagcacgcttccagggtcgctgcccagcctcacgccagccaactggttcagggactcagggtgcgtcattgtaactggggagcgagcgagaggagatggttgagtcttgcacgggccagcccacgggaaggtcctgccatggctgtgtcgggtgtactgcctgactggagcatcagggacccccctcttcctactttccttcacacaacataggaggcgtgggcggagcacaagctggagcaggcggagagtggaaagggcgagctgcccactgtcgtgtacgcctcccgcacccactcgcagctggcgcaggtcatgcgtgagctgcgcacctctggctacaggtgtggaggagggagggccctgggtgtgatgccatgcactccccgcatgcctgtgcagagctgttgtggaggacgtgagtgcacgcgcggccctgggagtcctgctgatctgcgcagcccgggaatcccccctccctccctccacgatcacattctcacagggtgcgctccgccgttctttcttcgcgcgcccacacgtgcctgcacccggtggtctccacgctgcacggtcaggcggcgaaccgcgcctgccgctccctcatcagccgccgcggctgcaagtggtggggtggcggtcgggcgggcagggcaccctcggccagcactctctgaccttttcccgggatctgccgatcactcccccctttccccccaggcagcacgacgtggagcgctttgccaagggcaacccggacgccagcctggaggtgctggacatcgaggacctagtgcgactgggcacccagcgccagctctgccccttcctcctcagcaagtagggcggagggagggtggggggaagggggtggggagatttgaagagagggggagggaggggggtggggaaagatggactctgcacgggtcccctctgctgtannnnnnnnnnagagggtgggggaaagggggtggggaggtgtgaggagagggggagggagggtgtttgggaaacatggactctgcacgggtcccctctgctgtacgattcgctcctggccgagtcgaccccacgcccctcggcccccacaatctgcagggagtttgcgactacggccgacattcttttcgtgccgtacaactacctcatcgacccccagcgccgcaagagcctcaacatctcctggaagaacgccgtgctcattttcgatgaagcccacaacgtggaggtgtgttgagcggtgggatcagagtgagcctggggggaacgcccactctcaagcgctgcacagccgccgaggcatgtgttgctgacctccctgcccaacccccacccnnnnnnnnnngacgcccaccctcaagcgctgcacagacccagaggcatgcgttgctgacctccctgcccaacccccacccaatgcctggcaccgcagagcgtgtgctccgacgccgcctccttcgacctcaccgccggcgtcctggcggggtccatcgaggaacttgggaccgcggcagagctggccgtcaccaagggtgatggcgggagcaacatctacaacgagcatggcaagcaaggtgggtttggggaagtcagggagacctgtgggtgccagggaagcagctggttcagactgtcggcactgcggccgggctgacgtgttcacaccacccacatgtgcgtgcaccacctgcagaaaaggggacaaactacctccagctggccaccgagctgcggcaagcgcaggcaagggggcggcggtggtttgtccctgtgtgaggctggagggactcatgcgtagtggggcctggctggcaggcggaccttgctgcgccctccgtgttcctcatccaacgtgatgaccatgtgcacccctcgccacgtgcagataatcctgaagaagctggagcagagcatcgccgccacggccgtgccctcctccaccgggttcaccgcccctggggcgttcctcttcgagctgtttggcaggtgcgctgggaatgattttggtctgtagtgcctcggtggactgggcttgcggtgggaggcggcgctggatcagggcccagaccctgagacgcagccaccactcctcgagcctgcagcatgccatcagatgtcatcatctggtgctttcccaacctggcccagggtgaacctgacgctggagacctggcccgtcctggctgcctgcctggaggccggcgtggacctgctggcgggcgacgcggccgagagcgggcgcaggtggggatgtcgggcgccgctcctctcctcggatcttgggggctgtgcggtgggggatgcagccggcagcgtgcattcttggacccacactgtcgacttacacatatgggaaacctttcctctcacccatcccgcccccaccgccctacaggagcggggcgcggnnnnnnnnnntgactcacgcatatgggatacctttcctctcatccatcccgccccccaccgccctacaggagcggggcgcggtctacatcctaccgcctgcacaatctgcaggaggcgctgtccctggcgttcgaggcggccgcgcccgccgcgccgggccagccgcccgcccacctcgggtaccgagtccacatccaccgcgaggaggccaaggtgtgcaccaactgcggcagactggaaaagaggggctgaaatactgcatgccgggcaccagacaccaagaccaaggccagctttggggaactggcatgccaaactctgtgcccaatcccaccttcccgcagaacaagatgctggtgcccacgctttccttctggtgcttttctcccggccaggccatgctccagctcaaggagctgcaggcaaggggcccggtggggcgtggcttgatctgggccgagggtggtgcctgactgaatgccttgctttccccttgttcaaatttctcacatcagagacacggccctgactcacnnnnnnnnnncgcctggctttccccttgttcaaaatctctcacatcagagacacggccctgactcaccgctcaagcctggtggaagcgccagtcaaacgttccatgcagcccacatgctttgcctgtcttctcacatgcaggtcaaggccatcatgctaacgtctgggaccctgtcccccctggcatcatttgcagcagagttgtccattgtctttccccaccgcctggagaacccgcacgtcatcgacccgtcccaggcgagccgtgccagttgcagctgggcgctgaagtgatcgggtgcctccatggaggcccgctctcctgggggccctggggtactggaatgggcgcggggctcaggctcatgctatattctgcatctctggatctacaacccccccacccccctccccctgaatgtgtgccgagctcccctggctcgttttcctctaagtctgacccgttctctctcgcctgccacaccatcctgcgcacaggtctgggttgggtgcgttccggtgggtccatccgggcaccccctcaactcctccttccagacccgcggcgatctgcggtacaggtgcggtacagcatcgtgccatgcagagtgggggagagaatgagtgttttgggcgaggcgtacaggaattggtctgaggagtggacgtggccaccatcccccgacgcctaaaggacaactccgtttatgacagggaggacctcggcaactccatagtcnnnnnnnnnncggtcgagcgcggggctcaggctcatgctatactctgcatcactgcatctacaacccccccccccccccccccccccccnnnnnnnnnncatgagtgttttgggcgaggcgtacaggaatcggtctgaggagtggacgtagccgccatcccccgacccctaaagcacaactccgtttacgacagggaggacctcggcaactccatagtcaactttgcccggattgtccctgacggcctgctcgtctttttcccttcctatggcctcctggacagctgtgtggagggctggaagctacccagctcgggcgggagcaccatctgggagaggatctgccggtgaggagctggatgctgggtggagtgggaggcggggaggcatatgcaacaggagccggtaaatgccacttcaccagagctgcccgcccagggttgatttccctgccatgcccggcaagagcgccatcccctgcttgcctctgaccctgcaggcacaaggcgccggtggtggagcctcgcgactctgcccagtttgtgctggcggtccaggatttccaggccaaactggatggcccagggacaggcggggctgtcctctttgccgtctgccggtggggcgaggtggtggtgaggagcagggttttggggtgctccagaggctccccagctgcagatggggatcctgggtggcgtgcagtgcatgctgtgcacatgcagacccctccaccaaccccggtcttggcatgcaggggcaaggccagcgagggaatcgatttctcggatcgcgcgggacgggccgtcatcatcaccggcatcccatacgccaacaaggcagatgccaaggtgtttgtttcaccctggaggaagcagggtgctggggcaggccaggcagacgcacgggcgggaggggctagggggggttgcctgaacaggattttgcatgagtcgaagccccgtgtcgtgggatttctgatgagatcagggcatgggaactcctggcagcgccctcttcccctccttgacatcctcccttgagatctgtgctcactcagcacccatcaaccttccaggtccgcctcaagcaagaggtgctgaacgagagcctgcgcggtagggtgggcgcggccaagcgccccatcggcatgccgggagaagcctttcggggccctgggcggcctgacgcgctgtccggggatcagtggtacgttcagcaggcggtgcgggcggtcaaccaggccatgggacgcgtcattcgacacaaggatgactacggcgccgtcatcctctgcgacgagagattcaagacgccggtgcggggggaaatttctgaaaagagaggcgccttggcttgtatgcatgcggctagacagggggaatcggcgcccggggggggggggggggggggggggnnnnnnnnnncgattcaagacgccggtgcgggggggggaatcctggaacgagaggcgccttggcttgtaagcatgcggctagacaggggaatcggcgcatgagggggcttggatgtgtcccttggatgtgccacctctgacaggactccttggcctgcccaccctcgcctcgctcagaacatgcgaaatcagctgtccaagtnnnnnnnnnncccttggatgtgccacctctaacaggactccttggcctgcccaccctcaactccctcagaacatgcgaaatcagctgtccaagtggctgagggagcagacagcggtcttccccgactacggcaaggcagcggggtctctgacgaccttcttccgtgccaacgccggccgcgcgagagagcctgctgcccaggcaagcgtggaaatggggtgtcggcccgtgccctcagcccccacacatgcgcaccaccatacttgacagcacgcgccaggtagtagcctcgtgagtcggggacacagcactctgaaccccgcccagctttcctacaatgcgctccgatgcatgcagaaccagcgggagcctgccgccgcacagcccttnnnnnnnnnntctcagcccccacacatgcgtaccaccatacttgacagcacacgccaggtagtagcctcgtgagtcgggggcacagcactctgaaccccacccagctttcctacaatgcgccccgatgcatgcagacccagcgggagcctgccgccgcacagccctttgcgagcgcagtcaccggcggcgcaccccggcccggagaggtggccgtgcagcaagcaaagccagggcccttgctggccagcctgccgaccgccatggacctggccggcatcaccgcctccctgctgggcggcgcgagtgggggcggggcggtgccggcgcggcggccgggggatgccagcggcccgggcctcctccaggcgctggaccgtgggactggcgcgccgacagagcagccggccgccgctcgtcgcacggctgagcggtcggtgcgggacgagctgcctgggtcaggccacgtggtagaggggctgccggatggcggcccgtcgagaccggggacatcacaggccttgccccccatgcggcagcgcactgacgatgggccggccgccaagccctggcaaaggtacggcgtgatcgtacccgatcggcagtccccccttccccgctcagcgcatgtgcatgttgtctaagcaccgctggnnnnnnnnnntggcgtgtttgttcccgatcggcagtcccccccttccccactgaccgcatgtgcatgttgtctaagcaccgctggctggcgtctgcacctctcatccccttcctccaccccccgcaccccggcagagcgagcaccgcgcgccccaccgcggctcgagtggaaagcggggcgcccgacgaggcagaannnnnnnnnncccccccacaccccggcagagcgagcaccgcccgccccaccgcggctcgtgtggaaagcggggcgcccgacgaggcagaaccttcccaggcgggtgacacaggcgctgtggtcggcacaacggggctttctgatggcaggagtggcgcagatgggtcgagcagccagcaaccacactccgccgcccagtcgtctggaccagggcccccttcagatcccaccaggccggcgcacaatgggacctccgccacgctcccctcccgggaannnnnnnnnntcagccagcaaccacactccgccgcccagccgtcgggaccagggccccctccagatcccaccaggccggcgccccacgggacctccgccacgctcccctcccgggaactgacagtcaaggagtacatggcccagctcaaggccggccttggccccgtgagtgcttgagattgcgaagaaatgctgggggggggatgttcactcgggaannnnnnnnnngggccggccttgcccccgtgagtgcttgagattgcgaaggaatgctggggggggggatgttcactcgggaatgcattggacacactcgcacccaccacatggatctggcccccgaaatgcgtcgccagccacacatccagctcacccccttttccccaccacaggagctcttccggcgcatcaacgccgcgctgcaggcctaccaggccagccgggacagggaggccctggtggccagcgtgatcgctacgctcgacaggcccgagcaattcgccctgctggcggggttctccctcttcctacccaaggccgagcgggccggctttaggaaccgcatcgggtgagcagtggctcgtggcgggtcctgccctgccctctgcagcgaaccgggagcgcgagctcccaccctggggcaagactgctcctggaaagccagcatttcacccctcctcacatcgccatccctcgcnnnnnnnnnntcgggagcacgagctcccaccctggggcaacactgctcctggaaagccagccattcacccctcctcacatcgccatccctcgcaggccggcccccagcgcagactcggcctgggcggtgccgggcgatggagaacgccttcccctgcatgacgggcnnnnnnnnnnnnnnnnnnnnnnnnnnnnnnnnnnnnnnnnnnnnnnnctaggaagaccagcccagccgtccagtcgccgcggcggcggcgacgcccagggtgcgtcgcttccccctcaggtggagaggctgcagccggggccggggcgcgcgacgccactcacacaacagcccacgccgcgcaagcccgggcccgatggtcgtgcgacggttggnnnnnnnnnncgtcaccgcttgggtcatcggtcgctccggcacgccagacggtagggaagaccgtgnnnnnnnnnntgtcgccgcttgggtcattggtcgccccggcacgccagacggtagggaagaccgtgnnnnnnnnnnnnnnngtcacacaacagcccgcgccgctcatgcccgggcccgatggtcgtgcgacggttggtgccccaacaacagggcctcgctcctcggccaggcctcgggtggccctggccaacgcgaccaacgcggccagaccgggactgggaagtggcactgccgccgggtgtaaggtgccggcgtggtctggcggggcggagnnnnnnnnnngcctcggccaggcctgaggcggccctggccaacgtgaccaacgcggccagaccgggactgggaaatggcactgccgccgggtgcaaggtgccggcgtggtctggcggggcggggcctgcacccggccgagcagcccccgctcgacgccctgttggcgcaggcgcgcccgcgccaactcccccttgctctatttgcggcaaggtccccatgagctcggcctacgaggcctcctgcggccacctggcctgctatgcctgctggctaggggccctggccaagttcaagtgccccacgtgcggcaagggggtgcgcaagtcgcacctgctcccgaaacactttgtctgacgcgcggcgaagaaaaggaggttgtggctggctcaaagcaggccgctgcgcctccttcccagcatctcacgacatacgccacctggcactgcagcgtctgtatgtacaacaacaatnnnnnnnnnntccagcatctcacgacatacgccacctgacactgcagcgtctgtatgtacaacaacaatcaaatgcaaaacacgggatcgacttctacagtcacagcccctcaaaggaggcagggtctgtgacgggacttggcacatgtcagggctagggactgaaaggtacagagagccggcggtgctcaccccatggggggtggccaaggcaaagggccaatctatggaacagcaaagtgtgtggtggttgccagtcagctcggcacggggcctcgcaactgcagctgctgcggggccatcaagtatgcagtgcaagaatgtattctacagcgaaccagcaccacggggagaggtctcgcttgctggtacacgttgctacgcgccatgcacagccctggcggcgcttgcaaacggtcgcggggtcccttcatcggcaggacccccatccagccgttagtgctgcggctggtgctggccctgcccctcccccgccaggagcagcgaggacggcggccaggagagcgcgaccggctggactgggtccctcgcgtagcggcctgcagggattttgtttttggggggagaccgggccgggagagttctaagggggtagacagagcgtcagggcgtttaatccgccacccccaaccaactcctcactccccaacatcacacacactcaccgcctatgggcnnnnnnnnnntgggaagactgggccaggagacttataagggagtagacagagcgtcagggcatttaatccgccacccccaacaaactcctcactcctcaacatcacacacactcaccgcctatgggcttggggtgggtgatgatgcgcagcggcgggtgccccagcgcgctgagcagctcctcatgcggccctgggaacaggctggcggaggcggccggagagggcgacgccccggacaccggctcctggctggaggcggactggcccgggcctctgcccgcgaggcgggggggcgaggggtgcggcggggggtagccggcccgggccggggagcgcaggccttgcgggtgcggcgggtattgcggcgggtactgcggcgggtactgcggtcgatcgtggggttcctgcgccgccgccgcccagccggcgccggcctgcaggcgcccgaaggctgggtgggcgcgcggctcggcccccgtgtcggcgaagcgcggggaggtgaccgagacgccgccgtcggcgtcccgcgtctccactgcgcgcgtggccaggcccc

SEQ ID NO: 44045 - DNA, 79 bp, Chlorella protothecoides
aaacctgtctcatacacgtccaggaccacaaacaattgcgcacccctccgccatccacttcccctcccctccatcgccc

SEQ ID NO: 44046 - DNA, 61 bp, Chlorella protothecoides
ggccgcgtggaccgccgcctcgctctccgcgtccagggccgaggtggcctcgtccaggatc

SEQ ID NO: 44047 - DNA, 111 bp, Chlorella protothecoides
gcgctgccccccaccgggtcccgggtggctgcggccgtggcgccggccacgctttccctcgcccccgcgcattgaggcgcggcgccctccgcagcgcggcccgcggcgcgc

SEQ ID NO: 44048 - DNA, 61 bp, Chlorella protothecoides
cgaagcagctgaatcctgcaccatagatggcgaaagtccagtcgtcaaaaattcaaattta

SEQ ID NO: 44049 - DNA, 61 bp, Chlorella protothecoides
caagttaggtcaggtaattccagcggcggggcagcaagtcacaccattagcaagccagtaa

SEQ ID NO: 44050 - DNA, 61 bp, Chlorella protothecoides
ctgaggagtcgccctctcccagccccgaggggtcaccctctccaagccctgaggagtctcc

SEQ ID NO: 44051 - DNA, 70 bp, Chlorella protothecoides
gggcgtgtacggctgggtggcgctcaactacgaggagcaacgcctggcgcacagcgccacgctgcccacg

SEQ ID NO: 44052 - DNA, 61 bp, Chlorella protothecoides
ctgtcccggatgccggcttctcggacagggggtggtgcaccgggttgtagtcctgggcgat

SEQ ID NO: 44053 - DNA, 18680 bp, Chlorella protothecoides
  modified_base (237)..(290): a, c, t, g, unknown or other
  modified_base (1842)..(1851): a, c, t, g, unknown or other
  modified_base (1922)..(1931): a, c, t, g, unknown or other
  modified_base (2001)..(2010): a, c, t, g, unknown or other
  modified_base (2250)..(2259): a, c, t, g, unknown or other
  modified_base (3096)..(3105): a, c, t, g, unknown or other
  modified_base (4016)..(4025): a, c, t, g, unknown or other
  modified_base (4434)..(4443): a, c, t, g, unknown or other
  modified_base (4544)..(4553): a, c, t, g, unknown or other
  modified_base (6142)..(6151): a, c, t, g, unknown or other
  modified_base (6552)..(6561): a, c, t, g, unknown or other
  modified_base (7194)..(7203): a, c, t, g, unknown or other
  modified_base (7666)..(7675): a, c, t, g, unknown or other
  modified_base (7929)..(7938): a, c, t, g, unknown or other
  modified_base (8027)..(8036): a, c, t, g, unknown or other
  modified_base (8184)..(8243): a, c, t, g, unknown or other
  modified_base (8449)..(8458): a, c, t, g, unknown or other
  modified_base (8547)..(8556): a, c, t, g, unknown or other
  modified_base (13011)..(13020): a, c, t, g, unknown or other
  modified_base (13248)..(13257): a, c, t, g, unknown or other
  modified_base (13320)..(13465): a, c, t, g, unknown or other
  modified_base (14002)..(14011): a, c, t, g, unknown or other
  modified_base (14365)..(14374): a, c, t, g, unknown or other
  modified_base (15852)..(15861): a, c, t, g, unknown or other
  modified_base (16469)..(16478): a, c, t, g, unknown or other
  modified_base (16811)..(16820): a, c, t, g, unknown or other
  modified_base (17539)..(17548): a, c, t, g, unknown or other
  modified_base (17970)..(17979): a, c, t, g, unknown or other
  modified_base (18154)..(18163): a, c, t, g, unknown or other
  modified_base (18435)..(18444): a, c, t, g, unknown or other
cagcaggcgagcggccagcgcggcggcggccagctccacgtgcgccgcggcggcgcgcagcgcctccacgcccgaggcggcggcgacggaggcgcgtgaagcctcgtgcgccgtcctttgccccgccagccaggcggccagcgcggggcacaagtcgtcgtgcacctcggccgcggcctccagcaggtcgtgctggcgggccagcaggcgcagcgtggaggcggggcaggcgggggnnnnnnnnnnnnnnnnnnnnnnnnnnnnnnnnnnnnnnnnnnnnnnnnnnnnnncagcgcgcccagcgcaaacagcgtcgcgcgcaggccgcccagcgcgccggccaggcgggtgcgggaggatgtgtcgtccacggcgtcgctgagcgcccgggccgccgcggccgcatcaccacgcagcgagcgggccagggccctccccgcgccgagtagggcatccaggagccggggattggcggccagcatcgcgcccagcacggcgcgggagccaggcagggcgccgaggagggccgccgcctccaggacgaaaccgaggccgagcaggggcttgacagccctggacctcagggccggggagggggcgtcgttgctgtgacgccttgtagcgaatctgtggggtgtagggtggtgggacgcaatcgtgcatgacctctggacacacatgcattcattacgccatggcccccctcctcccaagtgcaaacttggcaaatcccaggaccagtcaatgaaacccgctcttcagaacaaccaagtactcacagcgatgaaaggacttttagcgtcagcgaggccagggtctcgtcataccccggctcgtaggggcgtgggaggtacaccagcagggactgcagcaggcgaacaagggaggcgtcctccactgccgtccgccagacatctgacgagctggcttgtgacaatgacttcaagtcagatgcaatgtaggacctggtgtcctcatagtcctgatcccccggcccagaagccgggagaaaaggcaggaaggacatcgccccctgtcagacgctggcttgcgtcacctcatgcttgtgggtggatgcattacacaatgcgaggtatcaagggtgcaaggggatcccatggaaccagcctttgcccaccatgtggcttcctggtcggtgcattgccttcgcatgtgcttgacactgccccgcccagactcggatggaaagagtggctgcgcttcaaaatcaggccctcctccacctcctgccactgcaagctgccactcgctgcaaggcactcatgccagtccagacccatcccattgctatgtgctgctagatagagatcggcatggagggctcggctggggcgaggcagggcacaatagctgccctctggactcgaccgccttcgaaacgggcatcgtcaccttctactgaccagaaggtggcaaagccgaccggtgatacctcacttgacgccattaggattgtcgatctatcggaagaggcatgccgggagccacccgttgacgatgagactggctcccgtgctccagatgctgccatatgcgtgggacccgacatcaccccagtggcggagcgaggggtgagtaagggggtcgataatcagctggcatctgcgtgacctgaagtctctctggatgcagtctcatgtggcagagaggtcgaaggggagacctgcagtcctgcaggcccagctgtcattctgaagccccttctccccttacctcaggacccaacctccagcaaacgacggagtgtcggcccgtcagactccaccccgctcaacaagcgtgcacgtgtgaccaccaaaggcgagcatgcagccttggatnnnnnnnnnngagggggtcgataatcagctggcatctatgtgacctgaaatctctctggatgcagtctcatgtggcagagnnnnnnnnnngtgcagcagaccaccgcagaggcctccgcgagtgccccagcgccagttgacaccgatgccaaagtccagnnnnnnnnnnttgcagcagaccaccacagaggcctccgcgagcgccccggcgccagttgacaccgatgccaaagtccaggaagaccctgcagaccttgggcaggccatgtctcaattaggaaaggagggactgctggagcacctgagcaatcgcagggcaggcctcatgggcacagggatgcctgctcccctgcagactttgcctgaggaaggcagtgcgagcaccacccgcatcccgtactcggatgcnnnnnnnnnnaattttgcctgaggaaggcaccgagagcaccacccgcatcccgtactcggatgcccaggtgagcaggggaattgagggatggcagattgaacagcatgaggcatcgattccccaatctcctcgctcagcaaacgccccaccttccacatcctttgcccgcagctggcgtcccgcattgcatggcagcccctcccccttgcccgcctggtggaggccctgctgcccctcttcagcgccccagggtcaaacggcgctcgcatgggacatgacgtgctgatgagtcggatctgcctcctggccgccaggaagagctttgcttccaagaagagtgagcctgccggattgctggggggttggttggagacagagtatgggacgtgcatgccagtccagggctgcacgcctcacggagaagggaggtacagcatgatggacgtggtagctgccatctccccaagttgacacatctcacagtcatgtcagacttctcaacctgctaccacactgccaggcttggaccctctgctgaatgccttggaggacaccagctccgattgcctgtggcggtgggacctccgagaatcgcgctcgctgccgcatggcctcagggcacgaggggcggctgccaagaaggaggcaaagctggtgagaggggacggggggtaggcacacgcattgctttctgcactgggggtgtcgaggcacagctggttggggtgacattgagtttgatgtttcatgtgtttggcccagtttttggtgacaacagctcctggtgcatgatagcatgatccccttcctctccaataacatcaacgacaggtccaggacagtctnnnnnnnnnnttttttggtgacaacagctcctgatgcatgatagcatggtccccttcctctccgataacatcaacgacaggtccaggacagtctgacagcactcgatgcacttaccgaggtgctgaagactcaggccgagggcgacccaccaaccgccaagctgcacaaagtctgggatgcctggaggaaggtggggagctgcgggcggccgctttcctatgattcgaggcggatcgtggaatctgccgccacttctgtactgcgagtggtcgaactcctcaccctcagtcttactgctccctgtgcagactcaggtccacacgccaacgtcacaggcggctgctgtagccgcatcgccggcacctgcagagaagcttcccgcacccagcgttgctgcggccgctgccgcccttgctccccccgtcgaggacaaggctcgactgcaggcagagaaagacgctgtgcgtgcagcggagaagaaggctcgggaggatgccaaggccgccgccctgcaagccaaggtggacctgaaggctgccagggaggcagaacgagccacggccgccgccgcggcagcggaggcccggacccaggcgcgcgccgagcgcgaggctgagcgcgagaggcagcgagcggagcaagaagcagagaaggagcggcagcgtgccgagcgcgaagccgaacgggagcgccagagggaggagcaggaggtgagggcgaagtgggagtggggagtggggacgtctggtgttcagattggtctggatgatcaagctgccagggccctaccctcctacaaatccctgcatccccttgttcttaatttcttcctggatgcatggtccccttgcgcttgagtgccagggctcaggcctgtgcctccccttgcccacttcttgcagttggccaagctgtcccgnnnnnnnnnnatgtggttcccttgcgtttgagtgccggggctcaggcctgtgcctccgcttgtccacttcttgcagttggccaagctgtcccgcaagaccggcttcaaggacggccaggagctaggcaaggcccgcgacatgttcaaggtgcttgtcggacaaaggcggctgaaattgggggaatttggatgccaacgccctcacagccacgacgccctgggaccagtgtggcatctgggaccaagtcaccccgaccccaatcccgtgcagagcttctttgggggaaagagccccggccccgccagcacccctcccggcagcggcaggggcgccacggtggacctgacgacccccgcagccgccggctccacccccgcccacgccagggcgaccctggtgggccggcgcctgagcatgnnnnnnnnnngaaggcccgcgacatgttcaaggtgcttgtcagacaaaggccgctgaaagtgggggagtttggatgccatcgccctcacagccacgacgccctgggaccannnnnnnnnnccaggggcgccacagtggacctgacgaccccggcagccgccggcgccacccccgcccacgccagtgcgaccctggtgggccggcgcctgagcatggctggcacccccggcgctgccgggccccgagggctcacccccaatactggcggccagccggccgccagggagagggggtacgcggagctgttcctgaagccggagggcgagcctggggctgttccgccaccggcgcggggcgacagcatggacgccgagctggcaaggggcctgggcgaggccgagtcagagcgagcctttggcgagtggctggtgcgggcgcgcgcccagcgccgggcggcaaccttggagccccgcctgggcctgccgccctcctgggcgaggcggcgcggcgcggcggaggccgcgcgcgagcggtaccaccgcctgcgggacgacggcgttgacccggcgcaggttcgcacctggcgccgcaagctgctctggttccccgccgactcggcgaggcccgccttccacggctcctgctccggcgcgccgaggggcggcgtggggccccgcaggccctgggcccgtgaccctgtcttggactacgaggtcatgtccgacctggactgggaggaggagccggagggtgagtgagaacatgggggggcaggggtggaggggggtgggtgattgccacttttgaaccacggggcactttgtttggggggggtcatgggttcagcggcgcagcgtacgttcgaaatgcactgcccgtgcgcgcgaatggcatgcacctcccatacctgccgagttcgagcatggacgctgcgttccgacctctggaaaccctaaacacactcaggcacctccctgtctggagacgacgagtccgacaccggagggtgcggggaggaaagcgacgcggagggcggctccttcatggtggcagatgggtacctgtcggaggacgagggcatccagtggggcgacgagttcggggtggaggacgcggcgcaggaggtcgcctcctcaggtgcacgggagggagctcggccaggcctcagcgatgcaggtgagaggagtggcggagtcctcacggtgttacatcaggaggcctcatgccggtatggcaggctgcaccaggaggaggtgtgccgcacaggcgttccaggcctggacggaggtgctcgagggcgcgccaaccggtcacccagccccctccccgaccctcccacacgcccagacatggcacggctgcgcaaggcgctgcagctgggtgccctgctggagagagccaagcgggcggggcagcccctgatcatcagcaggctgccacgctgcgagcagctcgaccaggcgggtgccgcggagtctgcggccgagaccgccgcgaccagcggcggccacctgagcgccgacgtgtcgctgctggacgcctttgcctttgtgcacggcccctgtgctgcgggggtcagggtgagggcgccagggaccggagtgggtgccggcggggccggcctgacctgggaggccgcggaccccaaccagggggccggcggggccggcagctcggcccccgccgacgcagatgcgggtgctggccgnnnnnnnnnncgacctgggaggccgcggaccctaaccagggggccagcggggccggcagctcaggccccgccgacgcagatgcgggtgctggccggattgcagagcccgcggccaagggctcaaagccgcggtcgggggcaaagcagtgggaccggcctgaggagctcatgccagagctacttcgtctggtcctgcttcagccgggccagaccaagaaggaggtgcgtcgctgtgtggacactcaaggatgggggggttcaagggagggtgtcctgttgcatttttaggggcgctgtgtggacgcggcgggatctttcacggtacgagcggtcgtcgacgcagttggaaaacagtctcccctccctgcaccccccatcaaagtacgtggacgccttcattgcggcccaccnnnnnnnnnngcgctgtgtggacaatcaaggatgtgggggtccaagggagggtgtcctcttgggtttttagaggcgctgtgtggacgcggcgggatctttcacggtaagagcggtcgtcgatgcagttggaaaacagtttcccctccctgcactccccatcacagtacgtggacgccttcattgcggcccaccccgacctccacatctcccgcgcctgggtgctgggcaggctcggcgccctggtggagttcaagggccgcaccgcaaccctgacgcccctggccatggaccctgtgaaccatttactcgctgagttcaacatcgacaggggcaccggctccgtgactgggccttcatgcgcccaaacgatcgccagcagcacccccgccccggagcccaagccggcgaggcagcagcgcaccctgcctgcagtgctgcgccagcgtgcggaggcggcgacggcaacgcggccccccgtgcgcgactgggcgcaggcactctcgctcgtggagtctgggaccgggtccgcgctggcggccctgcccacgcagctggccgccctggttagtccccgtgaggatgaagcggaggagcgggggcctggcgctcccggtcccattcccgccttcctctctgcggccnnnnnnnnnnctcagtccccgtgaggatgatgcggaggagcgggggcctggcgctcctggtcccattcccgccttcctctctgcggccgtggtcgagcgcctggcggccgacggccctgcccgcgagccagagactgtggagcccctcgccgcaacgctgcacctcctcctgggctgcatcgcggagggagccggcgcctgcactcaagaggatgccagcgcctcgcagatggcgtgggccgcgccgcgagccggtcccctgcccgccaccctggagaccttcgcctgcgaggcccgcctggcgccggcactgcgagccgcgctgcgggcaggcggcgccgcggcggccagcgctgaggggtgcctgggcctgctcaggcggcatcgggggatcatggagcgggcgctgcagggggccgaaggcttgaacccgctcctgcggcttctggagggggactctcctccctgaggcnnnnnnnnnngtcgtggagcgggcgctgcagggggctgaaggcttgaacccgctcctgcgccttctggagggggactctcctccctgaggctggccgcaggcgtgccgcagatcggccaaagccgtgtgcacgcccctgcgcggttggttcagacacctcctcctgagagttgccaggactgaaggggaggccgtgtaccccaggactcaacgacatgtacccggttgacagcgtctgctgcctgcaccgaaacgcagcattcnnnnnnnnnnatgccagtgccctctgcgcgatgccggcccaaaaggcggcaaaactccatcctcgcaaatcccctacgccgcgagccgaactcgcttgnnnnnnnnnntgtgtacccaaggactcaacgacatgtaccccggttgacagtgtctgctgcctgcaccgaaacgcagcattccaaatctgatgccagggtttacacaaagagtgagagggagtggaaaatgtgtggaaggcaagcgcaagcttgcggnnnnnnnnnnnnnnnnnnnnnnnnnnnnnnnnnnnnnnnnnnnnnnnnnnnnnnnnnnnnccctccaggacgaactggcggctgccctgcagcttccggagcagcaccgccgcgatttcttcctcgccgggcatggcatcgtgcgcgtgtcccttggcctgcaagcgcacggccacgtgggagaccacgtggcgcccgactctcttcagcgaggcgccgctgggtttggcaccgcgcaggaactcctgcgtcaccgccttccaccnnnnnnnnnngtgccagtgccctctgcgccatgcccccccgaaaggcggcgaaattccatcctcgcagatcccctacgccgcgagccgaactcgcttgnnnnnnnnnnccccttggcctgcaagcgcacggctacgtgggagaccacgtgtcgcccgactctcttcagcgaagcgccgctgggtttggcaccgagcaggaactcctgcgtcaccgccttccacctcaccagcgcctcccagggcctcgcctccgtgcttggacccgccgcctgtgtttgacacgccgcatccgcgtgacacccagccccgctggtctgggcgccatcctcgcccgcctcgtcaaactggaccttggtcccggtccatgccacaccgccgaccttgacggcccgctgggcctggcccagacccacgcggccctgggtcttgctggcgtgcgctgccatgtagacgccctcctgtgcttgggggcggggggggggccggtcgtgaggagccggcgccagggggtcaggactcaggccaagccatcggcacacctgagaggggcgcacgtcagaggccggcccgcgccgcacgctgccgctggcatgaaagagggaatgttgtacggagcaggcaggtgtgccagcccataccccgaaaaggccccccctccacctggtcgtcctcggtgaagccgcgcttggcgtcctcctgcgctttcctcatcccctccagcacgcccgctggggagaacatgccccgaccccaccagccctccaactccgtgggcctccagagcgctgcggcggccgccgccgcagcgctggcctcggccgaatgcacctccacgacaatgcgaggcgcggcaggttcctgcgatgccggcctggcatccgcatcgctccgtgctttcttgctcttggaggtcctgccatctggcacggcggtgccgagggctgccgccgccgccgccgcctctcgcgcctcctgcgctctgatcctcgacatcttgccctccctgccgccaaagcggccggcggccagccgggaaccaccctgggtcagtgcatccagcagcgccagttcgtgagcggacgccgagctggcagtcccatcgcgattgcggcgagacacgcaagtggtggcgtcatcctcgctttcgctgctgctgctgctgctgctgctgtcttcatccttcttctgcgaggcaggggcatggttaaggaactcacaagcaggcatggtagcaatgcgatatccttccgacaggagctggatatatattttgaagaatactcttacaggacgttgtacaactttcccactagagccacatgccctgctcacaaacctgcaaccctcaccacggcatcaatggcggcagaggactcgctgtacgccctctcccaccagttgtcgtcccacttccagctggctcggccgcccacctggaagaaacagggacacagggtcggtcagtattatcgctacacacctgcccaaattgaggcacggcagctcccatgcccagctcccatgcccagcatctccaatcccccttcttcactcactcccacgctgtcctccttctttttcacttggatggcctccttgatgccctcccctgtgcgtcccaagccctggcctttgtcccagcccatggtcttcagcatgcgctcgccataccctccgtagccagtgggtttgaccacgcccactccagctacatggccggggggcagcttcatccttgcgtctacacagtagtgtcagagagtaggaagcgtactgactccaagaggaaggcacggccttgcggtacgccgtcggggcgcgaggttcgaagttcgaagtcgatgtcccacgtacagattaagagtctcacataacaaccataatgcaatactgaagcctaaacgtcttggtagagttcgagggttgtcacatttcgttccaacctgcatgtctagggcgcgacaagcggtcgcgcgccacaggttgaaggcgctctctcgtccaggtattacaagggcgaggaccgtctcatgattgtcgactgcaatacaggcttcagtccaatagaaaacgcattctgtatttatcctaaaattcgagacttgcttcgattactcctgaacctcagggaggctcttgaggccgcccgctgaggtcgtcccccgggcgcaatgcttcgccagatcgggcgatgtggagggaagggcgttgcagcggctgatttggccgtaaaccagtttgctgcatgtgcaggggtgcagacctgcagggtgttctgcgcccaaacctccacagtgagtcatgggactggatgctagtggttgcagccgcgcctggctcaccctgtgcgcagcagccacctagatccagtgactcatcatgtcaacaaatcccatgtcatgtaggagctcctttaccagacgcctgtggactctctccaatttcagaggcaggccctgctggacccactggtgacatcctccccactgcggcgcgccgcgctgcggctcttcggctactacagccgcgaaagccgccacatgcgcgccggccaggctctcctggaggcgatacaggagcaggcggacgcgccaagcttctcacgggccttgcaggtgccagacagcttccagcaccaacacgcagtcttagtcttgcatgtctggctggtgctgcagcggctgcggtcagaaggaaaggacggcaagcacctggggcaggccatgtacgacggctttcaggatgacgtggagaagagagcgagggccaccggggccaaggtgtgtttctgatcgagggatcggtggagaattgtggcccggcccctgaaggagttttcattaccatgcggtgtttctgagtctattcagacaacttgaagactttctgggcctcaaggttcttccccctttaccatttgaattcaggtgcgctttagtaagtttctgaaggagtatgaggagcagttttacggatcaagccgatcctatgaccgtgcaatggagggacagaccgacctcgcagccgccttggcgaggaacgtgtacatgatggacccagagaagcatgaggctgccaatctgatggcaagatacgttcgacggtacgtgcaagtccaaacgaggatggaaagggcttgtatgttttggaacaccaactcgccttgatcagacaggacttcgtttgttggaagctccatatcctcccatgtccccccttcgtgcagagagattgcatgcctggctcttacccccaccgaggccgtgatggaggggaacatcaagttctccacgggtttctattcgcacatgcctgctgaggcagcttcaaggaggacagaagatcttgcaacagcaacaacagcaggagcagcagcagcagccttgtagaaccacttggatgaatccagtctagtgtgcttgtgtgctctgtccctgtataaacaggatagatacaacagcaaccatcagttcagcattgaggatttgggtttggtaaaggaggtgccctggataacaaggcaaccccctcaccccacgtgcctcgactcgaaattcatcgcgcctgcagaatattttgtgtccatgccaggcatgcacctcgcacatgcagccctcggaggcttcagattaatctttcaactggcatgacaaacggagcgttcctgctggaatgagcacgagcgtgtcgaaacggtgggaaagagagctcccacggtggggttgccagctcacatgctctcgccatgctcgcgactcacgccgtctcgccatgctgcaggtccaagggcaagcaaaccagtgataatcggatagccatcctcttgggagccgtagccgtcgctctgggggcatgggtgtggcggagctacaggaccaggaatggccctggtgatgacaaggcacctggtgccagccccttcaagttccccaagtccgccaaggtgacgcacatcaggtgcttgagaaactagaatcctgcctacattatgccctcacatcaagcaacccttctttcacaggcaagtgcccagagcagcggcaacaacaagaagaacaaggccaggaagagggaggagcgggagcgcagggcagagaagcgggaacagaggtggggcgggggtgcaagatagggtgcaaggggattgggtggttccctgagtcgctagcttagagatttccttgcccaacacctctgactacacccacccctggcaggccggccgccgcggcgacagccaagggccctgacggcagcgcccagcctgccggtgccccaggatcaggcacctccgtcatgaactacacctactttgacagcgcgcggagggacacggtgcttagcgcggcgccgcgcagggcggcgctcaccgccgccgacgtggctgccctggacgagaagcggggagaggccggttccaagccccgatgatgggttccttgcttgcgggcatgcttggcatgctgtaggctcctatcaactactgagcggcctggagggacagaacacaggactgtcgggagatttcctagacacagaagtgatcgaggctacagctcttnnnnnnnnnngccgcctcctcggctcgcagcgcggcccttatcctctcagcctcctccgccgtcaggtctccctgtgcgtccaggatcctggcactggctgcctcctcctgcgtgcgggcagcgggaaggagggaggggggtgagctcgctgctgtcctgtatggattcgatacatgatcctcccacatggtccaaaccggcaggtcgggggggtcttcatgttcccccatgccgccnnnnnnnnnnaagacggtctagccagatctcacggcacgtcggcagacacaccactatgcccacatcagcgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctggatggattcgatacatgatcctcccacgtggtccaaaccggcaggtggggggggtcttcatgttcccccatgccgccccaccttccccctccccctaaagcgcaccaagatacgcaaaagcctacctccggcgtggcctcccagccctcgatgtgcaggacgttgttggtgctggcgccgtcgagcatcgtggggtgggcgggcgacagcgtccactgcccctccacgacaaacttgtaggggtaggcgcccgggggcagctcgcgccgcagctcccagccccgcccccgccgagtcagccccacgcggttgccccagcccacgtccagccccgcggcctgcacacggcggcaagtggcgggggcggccaggcacaggaccgtgcgccgcgccttcctgccctgtagcacgtccagcgcggccgctcgcacggcgcccagcttggggctgcaggggcgcagggctgtgaggtgcgcgtgggcatgggggagcggcaccccggacacccaccacatgtaagccagggccaccgnnnnnnnnnnggttgcgggggcggccaggcgcaggaccgcgcgccgcgccttcctgccctgcagcacgtccagcgcggccgctcgcacggcgcccagcttggggctgcaggggcgcagggctgtgaggtgtgcgtgtgcatgggggagtgtcactccgcacacccaccacatgtaagccagggccaccgcgggagcacggcccaggcctggactgaggaatgggggggagggcggttgctttgcctgagaaagtccatccgagatctgctccgagcgcctggcagcctaggtcatgcgccatgcggagacagggaagcagtgggtccacgcagagcttgccaccctagggcagacctgggggcnnnnnnnnnngggcggggcagcagtgggtccacgcacagcttgccaccctagggcagacctgggggccgactgggcctcgctccccgatccccacaacctgacaagcgaccccccctcccccaagatgtgcccacacatcatcgcgcctgccgtgcagtggatgtaggcggtgccaccctggcgctgcatggacccctgcagcgcggccaccgcggccggcaggcccatgcgcaggctgtgtgcgtcaaagtcgcgcagcgggcgacgcacgtggtcgatccggccggagcatgcggccaggatgggcgccaggtccaacccgaagtaggccatgtccgagtcctcctgcagggacaggatggtgcccacctcctcctgcgacaccagtctgcgattgaggaggggagtttggggggggtcatgatggaatccatggactgaggttcatggtggtccgagcaaaggatatggggagagggctgacatcgatgcgggccccaatatgaaatgcagtgcctggagcgtcaggcttctcttcatatactggcccaaggcagcgccgtctgacttcaaactcgattgaaaccagcccctgtcgccccctcgcggcagcccacctctcgatgtcctcggctgtctgcgggcaggatcccacgatcaggttgtcgaggatgcgggtgtagttcatgccgtcctcgtggcaatacacaagagaggcgctgcccatgcgtgcctgcatggtctcggtgtactcctccgacagggccccgctggcactggcagccgtgctggcctggcttgagttctgattgggtgggcttggcacggccccttcttgtgcagatcgagtagattctgcaagcgagggaagcgatggagagggttgctgaggcaacccctgaagtgcagtgtgaacggaaggtacaaggcctacccttgccgaccaataatgcagtgcaggggcccttctgtgcatcccaaacatccttttctcttcctggagggagcggtgcacctggttgggctctgcacatgacgcaaggggcgactggcgatcgactacgatgcaaagatgcccctccatcagctgctcttggtcccctggatggtttccagcggctaggggtgcagggtgcggcggggttgctcatggtcatgcctcgcatagcgcctcgcacccacggcgtgtgaccaaggagtcctatgccagacagagaactgaaagtacaaaggtctgcaggggaacaaataatatatcggacagatcacacggtttgcctgtgcatcgctaagattcagtgcaaacaatccgtgtcaggatccacgacgatgatatggccccgctagggtttgccaaaactggagggcccctggattccaaacattttgagtgccacattctcaaatgatactcagggacatcaatgcattagtcctgaatgttcattctcatgtatctccaggcagtccagttacagtgtgaacannnnnnnnnntggtgcaaacaatccgtgtcgggatccacgtcgatgatatggccccactagggtttgccaaacctggagggcccctggagcccaaacattatgagtgctacattctcaaatggtactcagggacatcaatgcattcttcctgaaacttcattctcatgtgtctccaggcagtccagttacagtgtgaacagcagccaatggatgaatatgagcaggaaacctcaagcaaaaccacaaacacggacaagttcactttcggaccctcttccatgcggtgcacagaagaggagctgatggtcgatttagaagcttcagctgagtcactacccagctggcaggctcgagttctgaaaggcaagaaatgatggcatcagtctcctccacaccccctgggtgacctgtgtagcacatgaccgacagcaagcctcccggctgcaggatgtcaaaggcgtggctgagagccgccaggctactgccagctcgtgttgcctctgtcttatcactgcccggtagatagctgtgtggtgaaggagacaaggaggcaagtgtgtgtgagagaacagcccttatgcagcaaaagcgtgaaggttcctgaacacgggcgtctnnnnnnnnnngtcgctgcctggtagatagctgtgtggtgaaggggacaaggaggcaagtgtgagtgagagaacagcccttctgcagcggaagcgtgaaggttcctgaacacgggcgtctgttctcaatcaggacggcagaaatcgtgcctttatagagcgttgcacaccacatggacaacatgtcaacatgcctgatgctggtcaggactcatgctcagagagcgtaccccatgtccaacattgaatcttgccttcgttcacccggctgctccccttcgtcctgcatgtccccaacgcccccatgacagcttaccccagattgaagcagatcagctttgcagnnnnnnnnnnctgaatcttaccccgttcacccggctgctccccttcgtcctgtatgtacccacgcccccatgacagctcaccccagattgaagcagatcagctttgcagagtcgtgtcccaggtgctcgggcatggtctcatgccctgcgtggacgagcttcaattccggcattgcctccggtgccagctcctcctccagccgccgccgggtggcctgtagcgcggctgccgagatgtcaaagcccactacccgtcccccgcctcccacacaccgtgacagggtgagggtgtcatggccgttgccgcatgtggcgtcaattgccgtgtcgcctggctgcaggatggaggggcccagcatgcccagcacatctgtcagccgagcattctccagccatcgagctgcatgggaggcctgggtccgcacggccatagagcgggacgcatggttgcagagaatcgtgtgattgaagattgtcgaccggtgagtgccagccacgcccaggcgagtcatcatgacgcccgcacttgctatggcgaccgtgcttcacgactgcgcatggcgttgcaaccggcaggtaggcagtcggcctcgaccaccgtcctctatagtagataaggaatggaatagataatcaaagatggatgtgcgatgggttaggtgcgccactctctcgcctgggccgatgtgatcgtttacggtaacctctgtgctgacctcaccctgggannnnnnnnnnaataagtaagggaagagatgatcaaagatggatgtgcggtgggttaggtgcgccactctttcgcctgggccgatgtgatcgttgagttgtagggtaacctctgtgctgacctcaccctgggattttcctcagcggtcttgcacagaagcctgatctctgctgtgtctcttatggactcgaactggcctaagctgagattaaatcttcatatcatcatcatggtacatgaggaggagcgtcttgagggtgggaacgggaaaggaaaatccagagaatgtcatatcatgtgcgtgcacaaaggtgtgacaaggggcctgaggtgcagctgtatcagaggttagggtcaaggtctggctgctttgggggtatattagtgcggtgaagctatctataggcttgtaaggttgggcatgctcggggcnnnnnnnnnngggtgcagctgtatcagaggccagggtcaaggtctgactgctttgggggtatattagtgcggtaaagctatatgtaggcttgtaaggttgggcatgctcggggccaagggcgcactgcccttgccctgatgagattttctcaggtcggcaggaatgttgccggaatcaacaaaannnnnnnnnnagctttgggtgaaatggtcaagcttgctgcgatcgatcagtcgagcgtggccgactcgcgcccacagaggagcgtgcgccagctgctgcgcttgggccgcccgccatccttgcgatcggctggggtgtcttgggggcagtcggcctcgtcaaaggcaaaagcctgcacaggggatgtggtggtgccattgtcaggtggctcaggggcatgccaacggggtatgcacgtcgtcgcctgcaaaagcgcttcaggggtccccgatgcagcgaaannnnnnnnnnagggcatgcacgtcgttgcctgcaacagcgcttcaggggtccccgatgcagcgaaaccccaatccataaaccctcccagcaaacacccgctgctcaccttgatggcaatactggccgtcctcttggccgagatcaggaaaggggactggatgcgatcctcaaactccctcctcgcagcggctgcctccgccttgctggcctccgccgcctccctcgccttgtcggcctcggacctg

SEQ ID NO: 44054 - DNA, 875 bp, Chlorella protothecoides
  modified_base (149)..(255): a, c, t, g, unknown or other
  modified_base (445)..(622): a, c, t, g, unknown or other
ggcgggcggcacccccgcgacgcccggcgaggtggagcgtgtggcgctggacgcacgccaccgcgtcacggccgggttcgtagtcgcctgccccggcgcggccgtggacctgctggtcgacctggacctggccgcacacctgcaccacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacccggcccaggtcgacgccggcgcggggcggtgcccgcatgcggccctctgccgcgcggtgttggacgccgcgcgggcccggctgcaggcctgcgaggggtacgcggaggcggtcgcggaggcgtgccgcctggggtggtgcgaccccgccgccccccccccgccgctggtcgaggcgcagggggcggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgacagggacgtccagcgacgagtcggaggagtcggaggactcgaccgactcggaggcgaccagctcctccgacgaactgaagtcgtacgcttcgtccagcgagtcggaggcagagtcgagcgctcttgaggacgcggcggcgaagtcgagcgttcttgaggacgcggcggcggagatgagcgctcttgaggacgcggtggtgaatttgagtgctcttgaggacgcggcggcgagcctcgggacccgcggagg

SEQ ID NO: 44055 - DNA, 77 bp, Chlorella protothecoides
gggtgagcggcgcgccctgctggtggccaggcgcccccccccctccagccctcgagagggaggcctcaacccggcgc

SEQ ID NO: 44056 - DNA, 80 bp, Chlorella protothecoides
tggttgctggggcctccgttcatcctcgcgccctgcatctcgctatgcctctcctcaaaccccccccccccccccccccc

SEQ ID NO: 44057 - DNA, 64 bp, Chlorella protothecoides
cttgtgcgcctcgtaccacaccgccgcgctttctttcgtgaaccgcgccctggagaagcggatg

SEQ ID NO: 44058 - DNA, 61 bp, Chlorella protothecoides
cgtggaatgggtatgcagtgacggcggagggggcgcaggtcttcagggagtctcccttggc

SEQ ID NO: 44059 - DNA, 61 bp, Chlorella protothecoides
atccgacatgaagggcaggagaggggcagggggcgcggtggcgacctgaaccgaatcagtc

SEQ ID NO: 44060 - DNA, 1042 bp, Chlorella protothecoides
  modified_base (130)..(320): a, c, t, g, unknown or other
gccgcacgcgcgggccagcgccgcgcgctgcgccgcgtcgccgcggtccagcgccagcgccgggtgcgtgcagaccttgcgcagcgcgagcagggaggaaagggaggaggaggagcgcgacggcgccgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggatgggtgtcaacgggtttgggggaggttgcggggtgatgcaggggccggtgcgtgcaaggggaagggcaccgtgtgtgtgtgtgtgtgtgtgtgtgtgtggaggcgtgcagcagaggtcctgccaggtggccaccggcatgcatggagtcggagccgccggcacggactggaaccatggggtgtgtgtctcaatctgcacacgtggaccccagcaccccctcccttcagcaccccctccacttcagcaccccctcccccgtcctccggcccccccatccagctcaccgtcatcccccctccagagcgcagcgcctcgcacagctcgagctggaggggcgtcggcgtgcagcgcacgtcctgcaggaccttgggcggcaggtcggtcagcacctgacccttggtccggcgcaggacaaagggcgtgatggcgcggtgcaggccctccagcgccagcaccccggcctccgaggaagacagcgcgccgccgcggctccgcgcctggcgcgaggccacctggcaatccggggtgggggagggatcagggtctctgctgagcgacgggtcgtgccggcgcaggcgagaggacatcgtcacggatcatcccaacatcagccaacattgcaatcccaccctgccggccagcctcggccttgcctgccagccagacaagccctgccagcgcacacgctccgcacccccccccctccctccccaccac

SEQ ID NO: 44061 - DNA, 61 bp, Chlorella protothecoides
gcctatgaggagggtgggagggctggcaggggcacacagcttcataatgtcggcaggacgt

SEQ ID NO: 44062 - DNA, 413 bp, Chlorella protothecoides
  modified_base (117)..(346): a, c, t, g, unknown or other
gtcgcgcgcggcgcgccgcggccgcgccacgggctgcaccaccgagcgcagcggggtggccgggtccagcatcgcaaccaggctgggcgccgcgcccagccgccgcgccaggtccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctcaccgcgcaaacgtgcacagagacacacacccctcataaaacctccccccccccccccccccac

SEQ ID NO: 44063 - DNA, 64 bp, Chlorella protothecoides
tcaaaaagaaaagaatcaatccgtcaaagtctaaaaccttttcacaacgtttcactaactttgt

SEQ ID NO: 44064 - DNA, 61 bp, Chlorella protothecoides
ggcacggaaagccgccggaatggctgctggggcaataatcggcggggggggcgcctcgaca

SEQ ID NO: 44065 - DNA, 61 bp, Chlorella protothecoides
aggatgtcctggacctcgcgctggctcgcgcccagccattcgcggagctgggtctcggtct

SEQ ID NO: 44066 - DNA, 61 bp, Chlorella protothecoides
gatcatcaacttttgtcgggtgctggctgggctcgcagtcccaggcacgccggccacacag

SEQ ID NO: 44067 - DNA, 98 bp, Chlorella protothecoides
gctccgccgccggggacgcgtctggggagcatgtgtgggaggtaaggaaggggggccggtgcagcaactgttgaggcatgggtgactgtgcacatggc

SEQ ID NO: 44068 - DNA, 103 bp, Chlorella protothecoides
tgcactggaagcctggggatgaaggccttgaaatgagacctccaaagcgagcaagggcctctgacaggacccaaactgcgtcgaggctgggatgaggacccgg

SEQ ID NO: 44069 - DNA, 61 bp, Chlorella protothecoides
ttcccagccaacgcaacgtacttgcagacgcgcgtcgagccacagggggtcaaagggcgcc

SEQ ID NO: 44070 - DNA, 2473 bp, Chlorella protothecoides
  modified_base (150)..(232): a, c, t, g, unknown or other
  modified_base (479)..(488): a, c, t, g, unknown or other
  modified_base (1042)..(1051): a, c, t, g, unknown or other
ggccgccgctccagtccagggcgtggatgtcgtgcgcgccgtgcgcggcggcgaccacgtacgcggcgccgccggcgcggcagtcccagccgcgcaggctgcggtcgtcgcccacggaggccagcagcgcatcggagccggggagccagnnnnnnnnnnnnnnnnnnnnnnnnnnnnnnnnnnnnnnnnnnnnnnnnnnnnnnnnnnnnnnnnnnnnnnnnnnnnnnnnnnnacggtgtcggtggagcccagcaggcggagcgttggggccagcgcgggcggggcacttgaggctgcgccggggtccgcgccggggccccccgcgccgcgcaggcaggccgcgccgcccaggtcccagaccagcacctgggcgtcctttccccccgacgccaggcgaggcgcggcggagctggcggccaacgcaaagggcgcgtccgccgcgtggcctgacagcgtgaggtcggggagggagggcgggnnnnnnnnnngcgcaaagggcgcgtccgccgcgtggcccgacagcgtgaggtcggggagggagggcggggggggggcggctcccgccggctccgcgctgctgcgccggggctgggaggccacgtcccacaggaacacgaggggggagtcggtgtgggtggccaccaggtgggggtgggacggcagctcacgcagcctgttcacctccccggggtggtagatcacggccgaggggggtgaaatgtgggggctcttggcgtgctcggtccagccggtgatgtgctcggcagcggccacacgggggcgcgccacctccgccgtcacgaccagcagcttgttgggcacggagccgtccgtctgctcggacaggtacagctgctggcggcgggacagggggctctcgtccagaacagggccccacctgaggggggtggggggggtttgaatggggatggggggagggtgctctggcaaacatctgagtcatgcgaggcagtcatgtgggagcacaggggcactgcagctctagatgacccccccccgcgtcggtgcatggagtgcgcannnnnnnnnnactggcaaacatctgagtcatgggaggcagtcatgtgggagcacagggcactgcagctcgagatggaccccccccgcgtcggtgcatggagtgcgcaggggccgcacagggcagaatttgtgcgggggccaagagtcctggtgatcgaggcccaaccccacccgggtcgcctgcacacacgaggcgtaccggcacgacagggatggccatgtcaggttgtggttggcgaaccaatcatagaggtagggaatgagctttttccaggccagatactgctccttgttgacgccatggtgctccatcgcggtgtggcgatgccggggttccctggcactggcttaccgacacatcaaacaatcctggaggagcacgatgcccggcttacaaccccagcgttgcgctcattcaagtagaatgacagctgctgctcgatatttgccgggtgacagggtagcggcatggaatgccggggtccccttttcatgcacaccgtgcaaaagggctccggtggctggggcgccatgattcgaccctggcagcgattcagggggacacggcaatgggataagtatccacggagctctggccgaaaggagaaccagaccgtgcattacgcgcaccgtaggtacctctcaactagtgacagaggcgttccaaagcttgaccgagtgcttgccgcacgagacagaccaaaaccccatctgagggggttgcgcagggcttttcgctgtatggccgccccatgcttctccgggcgatgtttgccgcagcccacactggccgcggcaccgggcaggggcttccccgccttcaagctccctaggagcgcccgcagcagctcccgcagcgcagcaggcgagtgttcggaggggccgctgggctcagctctttcggtggtgcaccggccgcacgtgatcgaggcatgatcgctcgacgctcgcgtgcgctgctcctgctcgcctgctttcggagtcgaatgaccagcgttaccgaagtgaagcgggtccagcgtccctgcctgcgccccgtcgtcggttgcccacttgctcagctcgccaccaaccccctcctgttgcagctcgcacggtgtcgcgtcgggctttcctcggcaatggcggcttcttagagcccgaggacctattttggaaggataccttggagtcccagctgcaggtgggggtggtcttcacaacattggcaatctgtggtcgggatgtgggttggttggaggatggacgtcttggcatccactctgtggcgaggggctcctcgagctggcttcgagcgtcagcagttctcacagggatttttggacgccacgttggcgacagatgctgtctgcagaccttccctgagcgtggggatacccaggtctgatgtttgtgacccttacctccccccccccaggagctggacgggggc

SEQ ID NO: 44071 - DNA, 41443 bp, Chlorella protothecoides
  modified_base (106)..(115): a, c, t, g, unknown or other
  modified_base (783)..(792): a, c, t, g, unknown or other
  modified_base (1230)..(1239): a, c, t, g, unknown or other
  modified_base (1320)..(1329): a, c, t, g, unknown or other
  modified_base (1386)..(1395): a, c, t, g, unknown or other
  modified_base (1804)..(1813): a, c, t, g, unknown or other
  modified_base (2833)..(2842): a, c, t, g, unknown or other
  modified_base (3252)..(3261): a, c, t, g, unknown or other
  modified_base (5037)..(5046): a, c, t, g, unknown or other
  modified_base (5124)..(5133): a, c, t, g, unknown or other
  modified_base (5795)..(5804): a, c, t, g, unknown or other
  modified_base (6702)..(6711): a, c, t, g, unknown or other
  modified_base (7778)..(7787): a, c, t, g, unknown or other
  modified_base (8049)..(8058): a, c, t, g, unknown or other
  modified_base (8676)..(8685): a, c, t, g, unknown or other
  modified_base (8879)..(8888): a, c, t, g, unknown or other
  modified_base (9030)..(9039): a, c, t, g, unknown or other
  modified_base (9186)..(9247): a, c, t, g, unknown or other
  modified_base (10101)..(10110): a, c, t, g, unknown or other
  modified_base (10795)..(10804): a, c, t, g, unknown or other
  modified_base (11390)..(11399): a, c, t, g, unknown or other
  modified_base (12807)..(12816): a, c, t, g, unknown or other
  modified_base (13669)..(13678): a, c, t, g, unknown or other
  modified_base (14472)..(14481): a, c, t, g, unknown or other
  modified_base (15127)..(15136): a, c, t, g, unknown or other
  modified_base (15200)..(15209): a, c, t, g, unknown or other
  modified_base (15835)..(15844): a, c, t, g, unknown or other
  modified_base (15952)..(15961): a, c, t, g, unknown or other
  modified_base (16030)..(16039): a, c, t, g, unknown or other
  modified_base (16590)..(16599): a, c, t, g, unknown or other
  modified_base (17313)..(17322): a, c, t, g, unknown or other
  modified_base (17697)..(17706): a, c, t, g, unknown or other
  modified_base (17938)..(17947): a, c, t, g, unknown or other
  modified_base (19660)..(19669): a, c, t, g, unknown or other
  modified_base (19949)..(19958): a, c, t, g, unknown or other
  modified_base (20923)..(20932): a, c, t, g, unknown or other
  modified_base (21456)..(21465): a, c, t, g, unknown or other
  modified_base (22311)..(22320): a, c, t, g, unknown or other
  modified_base (22950)..(22959): a, c, t, g, unknown or other
  modified_base (24961)..(24970): a, c, t, g, unknown or other
  modified_base (25286)..(25295): a, c, t, g, unknown or other
  modified_base (25795)..(25804): a, c, t, g, unknown or other
  modified_base (26680)..(26689): a, c, t, g, unknown or other
  modified_base (27209)..(27218): a, c, t, g, unknown or other
  modified_base (27304)..(27313): a, c, t, g, unknown or other
  modified_base (27545)..(27554): a, c, t, g, unknown or other
  modified_base (27772)..(27781): a, c, t, g, unknown or other
  modified_base (28340)..(28349): a, c, t, g, unknown or other
  modified_base (28601)..(28610): a, c, t, g, unknown or other
  modified_base (28863)..(28872): a, c, t, g, unknown or other
  modified_base (28932)..(28941): a, c, t, g, unknown or other
  modified_base (29155)..(29164): a, c, t, g, unknown or other
  modified_base (29593)..(29804): a, c, t, g, unknown or other
  modified_base (30058)..(30071): a, c, t, g, unknown or other
  modified_base (30337)..(30346): a, c, t, g, unknown or other
  modified_base (30611)..(30620): a, c, t, g, unknown or other
  modified_base (31233)..(31242): a, c, t, g, unknown or other
  modified_base (31350)..(31364): a, c, t, g, unknown or other
  modified_base (31493)..(31502): a, c, t, g, unknown or other
  modified_base (34324)..(34333): a, c, t, g, unknown or other
  modified_base (34974)..(34983): a, c, t, g, unknown or other
  modified_base (35703)..(35712): a, c, t, g, unknown or other
  modified_base (36048)..(36057): a, c, t, g, unknown or other
  modified_base (36494)..(36503): a, c, t, g, unknown or other
  modified_base (36681)..(36690): a, c, t, g, unknown or other
  modified_base (38927)..(38936): a, c, t, g, unknown or other
  modified_base (39463)..(39472): a, c, t, g, unknown or other
  modified_base (40108)..(40117): a, c, t, g, unknown or other
  modified_base (40619)..(40628): a, c, t, g, unknown or other
  modified_base (41336)..(41345): a, c, t, g, unknown or other
ctgaggctcgccgtgacggcggaagcgggccaggacggcgcggcagccgcgcaggacggcgtcaagcccgagccggggcgggaggctggggcgcacgctctgccgnnnnnnnnnnggcggggccaaggcgcgcgcccccctggacgactgggacgtggtggaggaggagcgggagcacctctccctgctccaggcccgggccgcggagctgaggctcgccgtgacggcggaagcgggcgaggacggcgcggcagccgcgcgggacggcgtcgagcccgagcctgggcgggaggctggggcgcacgctctgccgaaggaggagccccggggcgaggcggagctgggggaagcaggcgagcccggggccgctccacaggacgcacaggccgaggatggccccgcggagggcagcgaggcggagaggcgcgcggctgagacccaggaggcgatcgagcggctgcagctgatcatcgacggccccagcacgccgccacgcctgctggaggacggcaaggagcaggtgtggagggggggggtgtctttcaaagcggcagggtgtttgggggtggggagacgctggcgatggtgtcggggtgtgcaatgcagaggctcgggacaggaggacgggtgtgtggaggtatcccaggcccatgacgtgccgtgatgacgtggccgagggcgacgaccgccctgggggactgtcgtcgacgctccgcgctcaccctgccccgcccgccccaacgcaggcctccctggccagcgcgctggacgtggccgagttcnnnnnnnnnntcgccctgggggactgtcgtcgatgctccgcgctcaccctgccccgcccgccccgacgcaggcctcgctggccagcgcgctggacgtggccgagttcctgcagctctttggcggcgcctgcgaggctcccaccctggacctgccagcggtgatgagcagcgtgcggtggcccttggacggcgagggcctgggcggcctgtacaaccagctggtcctggtgaggggcgtggcgggtcccggatttgtggctgagatcatggtgtgccgaaggatgacgtccagtgaaggcatccaacgccgtaggcgcaatgggtctgcagcgttcggcaggcgctcgtcaggcagagccctgggggctgcgtgccatgccatgcaaggcccagtgccgtgggcccttccttccctccgccacctcatgaacacctggcgtgtggtccnnnnnnnnnnttgagatcatggtgtgccagaggatggcgtccagtgaaggcatccagcgtcgtaggcgcaatgggtctgcagcgttcggcnnnnnnnnnnctacacccctccccctcccccctgtaccttacagtgctgcttgatcgagcagtacannnnnnnnnnttacacccctccccctcccgcctttcccttacagtgctgcttgatcgagcagtacaaccacgacccgcccgccaaggcgcgcagccaccggtggagcagggtgctcaccgcctccacctggcccgagatcctgcggaggtacctgctgaccacgcgggccgaccaggggccccccgccgaggacgcctgccccctgtccctggacaacgaccaggtggccctgctggcagcgcgcaagctggaaaccacggcctggcaccagcttgaacgtccgtcgctggggaagatggggagggggagggggagtgtactcagcgagagccttgagcaagtgttgtgcgcccgcccatgcctccctcatgtgccacacgggcacgggacttgacctccctgtattcatgcaaacgcnnnnnnnnnnaccatgcatccctcatgtgccacacgggcatgtgacttgacctccctgtattcatgcaaacgcccaacaaacccaccccgcagccgagctgcacctgcgcctgctgtgcacgctgtgctacgacatctcccagggctacgcgctacgcaacgacatcaacgtgcggctgcaggacgccatccgcatccagaccgagctcttcaaagagcaggtgaggggtgggaagggtggtgattggtgccggtggcgagcgtgcgcctctcccaagtgacacagctggcgcgggggcggcgaatggaatgggaaaccgcagggcgtgccccggcctcacgctcctctgccccctgtctaccagatggcatggaggaaagcgcggcggggcgagggggaggcggcggtggccgcgcccacgtctgggaagaagaagaaggcggccaggaagtccaccgcggctgccgacccgaccgaggaggagctgcaggccctggaggaccaggcggcggccgaggccggcgaggacggcgacgacgacggtgaggaggtgtgggagatgcgagtgaatgatgaacatgcggtgactccctttcccggcagcgggcgatcgtcgcacacctgcatcacagccggcctgctccctctgccggcctcgcgacgacatggggccgtgggatgattcctgctttccactcgccgcagccgggactgaggagctggatgaggcgcagcaggcctgggctgcacgggaggccgagtatgagggcaggctggcggagcgatccagcagagcggaccccctgggcactgaccgattccaccggcgctactggtggctcgcatgtatgacctgggggagagagggtggccctggagtgctcgatgcgtgaccgatgtgtgaccaggcgcagacatgcccgagatgtgcgttttgccctgagacgctcgagtaaagtttcctgctggctagcaccatctgaggccactccaaccatgcatcccctcgcccacctctgcagccgcgcnnnnnnnnnngtgagacgatcgagtaactttcctgctggctagcaccatctgaggccgctccaaccaggcatcccctcgcccacctctgcagccgcgccgggcattgtcatggtggacttccccgatgcggccccgcccgcggcgctgaggagcaaggagcagttggacgagctgctggcgcggctgaaccggcgcgggccgcgcgagcgcgtgctgcacggcgcgctgcgcaagcgctacgccgccatcgtggcctgcatggcgcaggcggagggcacggcctacagcctggaggggtatgcacgacccgtcccgcgcgacaagcgcatggcagtcaggacgctgcccgaactggaggagggtgtgggtgagcagaaatgggcagggaagcgggactgggttctctggggagggggggnnnnnnnnnnggaactggaggagggcgtgggtgagcagagatgggcaggggagcgggactgggttctctggggcgggggggattcatcttgatgaagagggaagggagagaggcgggcctgaaggtgacgtcggcaagcgcccgtctgccaggccaggaatcggctcaactttgtgaaggcttggacttgcatgcaaccttttggcacccgcctgtctttctccctcaaattgcgtcccatcccacaaccgcacccatcctccagtccgcaatgccctggccgaggccaaggagcggctggacaactttttgactgaggcggtggaggtgggggtggagctggagtttgacgccaaggccatgcggaagacgctgcgtgcctgcgacacccccgaggacctgcgccgtgccatgctggagctggagaaggtctactgcaccgcgggcgagggccttccgccaggtgcggcatgtgcatttgtggggtggctgggtaagggggagggggggggtgattgaaggttcagttgtgtacgaagggcaggcgtgaggatcagtcagggtgtcgctgcgaggcaatgtgccctaggctgggttgcccaggacgaaatcggctaccaacatggaagggtgctctgcggggtcgcccagtgtgatagcagaaggcggagattctcctgtgaaaccgaaccactatccacaacctccgccacacaggcgccacagaccgggagatccagatcttgatgggcgaggcggcggcagacgagccagaggcaaagcctggggcgacggcaagcgcagggcctacatgcgccgagcccggcgtgggcgtggagcccatgcagggcatggaggggcccgggtctgccggagctgagccggtgccggcagaggcccaggttgccaaggggaccgatgccgcggcgcccgattcggctgggcatgcagccgcggctctccccggcgcaggagtggaggcggccgctccggtcgcggcgcccggcccgtccacgacccccagcccggccacgacgccgcccacgcccgcgcagccgacgccgcaggcgtccggcacgggggccgcgggcgaggcgacgggcacgacgtgcgagggggaggagggggaggagggcgagacggcgggcacgccggcgcccttccgccccgtcacgcgcgacgacgacctggacgactccgacgcggagcacgccttcctgcgcgagaagcgcatgcgccgcccggcgcggctgtggcgctccgcgcgggcgagggcgaggcgccggcgccctccctgcgccccatgatgatccgcacgggcaaggccaagaccgacgacggtgtgcgcgtggtgctgaaggccatggggcgcgaggctttcccctcgggccgcgcggcggcggccatggacgcgctggcgccgccggagctggtggcggagtgcaagtggggctaccagtgctccgtctgcctgttggcgggggacctgctgtgctgcgagcacccctccggctgcaacgtctctgcgcaccgcgagtgctccggctgccacggcgcgctgggcgggccctggatctgcagcaaccacgacgaccgggagctgaagacgcgcatccgacgcagggcggcgggcagcggtggcctggccgaggaaggcagcgcggggttggaggggggcaccgcggactcggaggccaccgtgagtggctggtggttgggggccggtgtgctgtgggggtttagggttgtgggggccaatcgggcgttttcgtgggacggctgcagnnnnnnnnnntcctgccaccggccttccaccaccaacccatcctgtaccaacccccgccctccaggtgagcgagggggggatgagcgnnnnnnnnnntggttggggaccggtgtgctgtgggggggtagggttgttggggacaatcgggcgttttcgtgggacggctgcagggaggggttgagggaaggggcccaagagacggtcatgctcggttttgtgccctggatgccttgttcgcctaccttgcgacggaattgaatccagtggctccagactttggaacccggtatcccccccctgccaccggccttccaccacaaacccatcctgtaccaccccccaccctccaggtgagcgagggggggatgagcgacgactcggaggccacccaggagctcacgagtcggcggggaggaaaacgcgcccgacgctgagcaaggtgggccagcaaccacatgaagcaccccctccccccacgttcactctgtcgacccctcggccctcttttccaatatgacgacgtcgtgactggctggcgcacgcaagtggcgatgccacgatgccctgaccccttgatgtagtgcgtcactctgacagtggagaggaggggtggatgtgccggcaggcagacatggtcgacagcaaaatgactctgggatgcctggctgccttccaagaggattccacaccagtgctttgcaatcagaggtgaaagtccgcgtttcgaaactggcttgcttgccattacctcgtcaagnnnnnnnnnntcttccaagaggattccacccctgtgctttgcaatcagaggtgaaagtccgtgtttcggaactggcttgcttgccattacctcgtcaagggcgctgtgcttctgcatggagacttcgtggcgggggtcagaggcgggatgtcggggcatcaccgcacctgggaccccaccaaccggaaccgtcatggtcaactttttgcaagtcgggcgcagtttagcatgcagagcgagagcagctacgtaagaagaagggcatgtaccgcgtataatacctcattataccggcattattgtggcgttcgtgtagaacagcggccctagattgccgcacgaactgcacgagacaaaacctgcacttctgcacgcagacccctgcagacttgcccgagcttgcaagaccggatcggctgcgacacccaaagcaataactatatccaaatggaggtgggtgggtgttgaactggtgtgtacatcatccacaaggacgccgggggaggttacactggctccggctccgaaacggcactccgacttggttgctgagactcgcctcctcaattggtccctcgcagtatccaggccatccccaggccattggagcgattcatgaagagaagcaagggatcgcgacgcatccggagggactgcagtcccaagcgcgtgatgcttgcatgcagcgacgggtgacgaattcgtccacgatggacagatcagacaatctcgtccggccccacaacggtatggaagacgcgcactcgctggaaagctccatttcactgccacggaagaggccaggtgataggacattgttatgcacatccattggaggcatcaaaggctgctagctcattaaagattcagaccacaacgtggagcccagcaggaaactctgcaaacannnnnnnnnngcggctgcttgatcattaaagattcaggccacagcgtggagcccagcaggaaactctgcaaacatgcgtgctccacatccattccacagcgcgggatcagagacccaggtcgctgggagccgcccccgggctacaaccggcgaagaagtcgcgggcatgtgctgagccgctgcggccccgcacagactggcagaagaaggatcgggacacctggatcaaggcggtgccacaatggtggtgcgagcatcgcatggtacactttgcaagtgagccctgacgttgggcagggtaggaggcggcgcagagtgcgcgccaggctgtgactcagcctcccagctttcatggactgaagcctggctttgctgccatcgaggcagcgcttcaaggtcctacagctcactcccttcccgcctcccatgccatgcgcgattccacacaaccgtgcgcagacaaggtgcatcgagagctgtttggctgccaggggagcgccaccatcctggattccgagggggaagtttttgactgcctgatctccatggagctccgaaatgacaacagggtgcagtacacgctgcaggtacagggtggggggtgattggtggaggattaaaggggagcacgtgtacttcaaccccaaagtcacacaactccctgtcaagcaagcagacgtttcaaaggaggtgaacttgatgccctctttgcattgccaatatccagtagattgcacccattctcctcccctgcagggagacttcctgatgctgtgggacaagtatggtattggggaaggcgatgtcctgaccttcaggaaggacccccttacagctatcgtgagcttcatctgctcccctgtcagcggccctcccaaaggccacccagcgaggactggcttacgagcacagacaatggtgagggggcttactgctatggacatggacactttgccttcgattccactgactcgctcaaaagtgatattgtatcatgcagcctccatagcctgttgagaccaacggatccgacattccctcacagtttgaggaggatgctgacgtgggagagggccnnnnnnnnnntgattccacgggctcgctcaagagtgatattgtatcatgcagcctcgatagcctgttgagaccaacatactcgacattccctcacaggttgaggaggatgctgacgtgggagagggccgcagcgcatttgtgagttggtgtatgatgagattccatgctttcctggagagtactgcggggatgggtgcctgatgccctgatagaattatcaatgctgcccgtcagtcatcgagtacgctccccagaacgcccccaccgcatnnnnnnnnnntcgtgctttcctggagagtactgcgggcaggggtgtctgatgccctgataattatcaatgctgcccctcagtcatcaagtacgctccccagaacgcccccaccgcatcacttgggtggaacgccccgtctgctcagtctggtgccatcctgctccctccaggccctccgacacactgcgcggcaggcacctgcacaccaggaccgctggagggaagtggggcctgggcaggcactgaagaccgtgtaccgcaccaacctgtcccacttccactgccccatccctggtgaggggtgcagatgctggggtgtctctcatgcccagaacccactgatatgtggagtctgcagctcaagggagggctcccggccctgctcttgcttgtcacgcaagtcccacctccccataatcccgacagagtggctgtacgaatcgctgagtggccaggctcccacgcccaactgcacacttcaagtctttgaccctcacatgggtcaggacctggccctggatgtcgtcttttgtgagaacgccaaggtccactacatcaccgtgagtttgtgaggattgagcgggaaggaggtgcacaggaagaagggagcctcttgcttggaggccnnnnnnnnnnaaccgtgagtttgtgaggattgaccaggaaggaggtgcataggaagaagggagcctcttgcttggaggcccagcgaggagggttgatacatggggtccagggcagaccctgtgccacatgaggagaggcagtaggaccaggcacgccagtgtgtcagcttggttgtctgcattgctcacgcccatccttgggtnnnnnnnnnncaggatcaagcacgccagcgtgtcagcttgggtgtctgcattgctcacgcccatccttgggtctacagaggcgtgtcgccgagtccaaccgaagctccccatccccacatgccaacacagggtcctgcgtacaagcggtggnnnnnnnnnnatgtcgccaagtccaaccgaagctccccatccccacataccaacacagggtcctgcctacaagcggtggctgctggattccagcctggccgtgggcgaccagatcctggtgcatcgccgccgtgacgtcatccactggcagcgggtnnnnnnnnnnnnnnnnnnnnnnnnnnnnnnnnnnnnnnnnnnnnnnnnnnnnnnnnnnnnnnggaaggtgatgtgcccctgcactgtgcctcaggtcgtaccacaggcctcccctcggtccccacacatgtgcaggaggccgacgcgggctgctatgcctcgggctgcatagcacatgggcgctccgcctcccgccagggcagcgacgaggacgccggctttgaaaggttcgaggtgctggcggcggtggccgaggacgtgggcatccacggcaccccggcgctgctggggggcggggcgctggggccgatcctgggccaggaaggggttgcgaagccggagccggggtccggagggactctggcgggtttgaagatcgacgaagccaaacccccggtcaaggagtccgccggtggcgagccaagaaacgagcacccccatcgcgccgcgctggccctgctggagccgcagcagggttggggaggggtcgccgccgctcggcaccccctgcccaccctgttcaaaccccggggggcgctggcctgcgctgcaagccagtttccttcggacccatgccccccgccctcgtccggcgaggcgctggcctcggcatggaccagcctgccacccctggtcacccagtgcccgcccagaccggcggcggcccaggtggcccaggacaccatggcgctgtactttctcatggagcagatcctggcgtgccacacgtggaccagcgaggagattggcatctggaccggcctgaaggccaagctaggtgagtgaaggggggagggagtccaaggggaaatggaatggggagtgactaccccaggtagcctgccgaagaatgagcagcgaggctcgcaacccttacccggcctgctagacgctgcagcaacatgccccgcctgcnnnnnnnnnncggcatctggaccggcctgaaggccaagctgggtgagtgaagtggggagggagtccaaggggaaatgggatgggaagtgactaccccaggtaccctgccgaagaacgtgcagcgaggcgcgcaaccctcacccggcctcctagacgctgcagcaacatgccccgcctgctcgcccgcatcttgcttgttaactgcacatgccagtgcaggcatggcccgcaccctttcctggccagtcgccatcaagacccccatacccacctacccctgtcacgcccaagcagcctgcctcgacgacaacgggcggcgcatctgctgcctcaacctgtccaccgcagcgacggaccggggccggttgctggactttgccctcagcatcctcacgctggcacccaccacgccgccaaagcagtgcgcacgcagccccgccctacgcaccgacccatgaacatagggtcctcaacaaaaaggggcttgggggggttgtgcctggctggccatcagcaggtgccctctactccctctgcctgctgtgaatggtcccacatcgatgcacactgtacatcagaaaggagcgagcaggaactgctggatcctttcttttagcagcagcgggctccagcctggcctgcacctattcaggccatgacaactaggggtctcccaatgtcgcgtgcccctgcannnnnnnnnntctttctttaagcagtaacgggctccagcctggcttgcacctattcaggccatgacaaccaggggtctcccaatgtcgcgtgcccctgcagggattcccccaggtcgcatgcatagccggaacggtcgcgctcggcgcacaccccagtcacacaccaacgccggctcagttggcggccacggcgggggccgaagcgccgggcgctggcgccagcacgatgccctccagctccgtcacgatatcctgcagcttctggatgtgggagacaaggaaggcggagcccgaagcccccgccgcccgcgactcctgcaccaccaccatctcctgcccgtcctccccccgctccagcgcaaagtccaggtcgcccgcgggctggggcgtccccgccagcgcgtcgccgccgttccatgtcaccacctgggtgctggcatgcatcagcgccagctgcgcgcgcaggctggcctcgtccagttcagccaggctcgccagcttggacagcgtgatgctctgtgtgtgtgagagggaggtgctgtaaggtgcagttggggtgggggttgggtgagattggcagagggaagatgagaannnnnnnnnntttaggtgcagtttgggtgggggtgggtgagattggcagagggaagatgagaacgcagccaggcctcgtcgcagtcctccagtgcatccatggctgcagctccaggatgggccgggcccaagggcctccttttccccttccaaattggcaaggacagatgcaagcaaatctttccttgcacacgtcaatgctcccttcctgggtgccactcgcccatgtcgcaagcttctccttgcttcatccctttcccccaaccccagcctgacgcacggtgtacaaccgcagaaactgcttgagcgcgggcagatggcgctgggcctccaccactgacaggaactggttgagctgcggcttgtacgcctccatgttggcattgccctgtgggaagcaggaagaagagggcgcatggagggaaaagaaggggatcaggttgaagggcagttgagctgctgacattcttgtgttagccctggtcaccaacttccaaagcaaaaggccagcactgccatgagaagaaactccagttgcaagaggacaagcaaggcacttgtacatgcgaaagtgattacaggtggcacccctcacagcccactgaatgtactcacaacctctcacaccatcttacctgaggattggctgggtcgacgaagcgccgggaaacaaacttggggcaggcgtaggcaaagagctcctcgtaagcgtctggctgaccactgttcatcagcctgaccttctctccatacctggtgtgggaacgcgaggatgggcactgcggcagggcacatgtgacatgcacaggacgtgaacatgtacagttgccatgccccacccaaatccacgggcaggcggggggtgacgttcatcgctccaaggccaggatccccagggtgttcacgcgaacattccatcagtgactcataaattactcacttctcgcgcaggaggacttggacgttctcgtccaccagccgtgacacggcggggcagagcgccgctgtaagtaaggatggcgatgggactattcaatgagatggcaggtgccattgtcagaagctggaaaccacacgttcagcgggcgttcttcgtggctacaaacccagaccaccactttagagggtgcaatgcccgcacagggcccttcaatgagacaagcgctgatcccccagtgtgcaccagccatgactcacaggagatggccagcaaggcatacagctgctcgttcttcttcaggatctggtcgtaccctgggcctctctgatggtgcgccattaccctgaggaaaggaagggatggggacatgggagaccaatgtgagcggtgaggaccctttcgctaactctcaatacatttcccaagccatgcggcaacgacggccgcaggcaaggacatgaggaacgagccaggggcnnnnnnnnnntttaccctgaggaaaggaaggcacggggacatgggagaccaatgtgaggggtgagaactctttcgctaactctcaatacacttcccaagccatgcggcaacgacggccgaaggcaaggacatgaggaacgagccaggggcagtggacttccacaagcaaccgccaagcctgtcacatacttggaaatgtagcccaagatgaagttgaggcacttggcggcgtccagatacctttgcagcatcaaatacgcaaaggctgtgaagtgtcgggagggggaaggggggggcgaagtgtgctttgattgatggctttggacttgtcaatctgcaagtgttgatgctacaacacaattttgtaaccagtgcagtcatgcatacggcagcaacaaaatggcactgctgccctgatgccaggcacccttctgactataaaggcaccactacttcaaggggcctcaccagagtagtagaaaagggtgatgttggacatggcaatctttgtcgtgaacaggtgccggcggttgaaggggttgaggggcgccagtgcctgccgaggggttgggcggcattgatggaggttctctgctaccaaacaaggcaatactaggagggctgccatggcacgagcgccttgtatgatacagggcccaaaccgcagtgttcaccctgccacctacctgcaggccggctacatagtcgccaagcacgctgtgcaccctcagcaggccgaccagactgaaataacccagcatggtctgcacgttggactgcaggtcatacccctcgcccacatacagcgcctcggcgccacctggaacatgccgtggttgagagagactctagtgggaaacacnnnnnnnnnngtacccctcgcccacgtacagcgcctcagcgccacctggaacatgcggtggttgagagagactctagtgggaaacacaaggggcttcagtgcatacatgcaggctcctcggtctcctacagaatggttcatgacaccctgactcaattgcacaggagcccttccctacacccaacccaccaggctttgacaggattccgcggatgtcggactgggagaccaggtcgttgaggatctgaagcaccgtctgtagaggtcaaagagggattacaggcacaggttgactgttcagatcccctggcagcacttggtccctccaaatacgtgctgcgcatccgcccctttgtcaataaaaccctttccccctcccacacctattcttctgtgcccagccacaatatcccttcaaccaccagtattcagctcacctgggagtcccagaccttggggctggcggccagcacatcaagctcctcaatggacttgccagacaggttgccgcgatactgcgcaaaagcctggtactgatacacgaactcgtccaccatgtcccagagccactggttgggaagctggacgttgaggtggctggacaggatgaccgagaagaactcgcggtagttctcccaggaggcgatgcggtgcgccagcgtgggcttggccgcggcgtgcaggtggcggaagcacatttcctgggccagggtgcgatgcgtgaggggtggccgtttgagggtgcaccgaatagcatgagagtgaatccgcaccgaggggcgcactatgtcaactggcaatcgnnnnnnnnnntccgtttgagggggcgccgaatagcatgagagtgaatccgcatcgaggggcgcactatgtcaactggcaatcgaagggtgagcccagaccattgtaactcttcccacagtccccggccttgcggccccaccttgtacagcatgcagaagacgtggtcattgtccacgaggtggctcacagcctccaccgggggccaggccacgcccttgaaaaagcgctccgacaggtgggggaaggtgtgggagtacatgacgaagatctcgcggatgttgcgctccctgttgagggaggtcgggtgaggggtctggctgatcagactactacagtggtggacgtaggtgtcatgcaaggtagtccaaatggagcagctcggatcacatatcatgcaacgctgttcaagggattcgctggtgtgtatatggatcacatctggcaccaggcgttggctacagacctgatgtgacggtagaagtagacgacaaagtcttgcaccatcttgggcacgggtgccgtgcgcgacagagcctgcgcttgcgagagaccacctcagaggcgaactagggatatttatggcccaagagccacatgttagcaattaccatcgacaggcacccgcaccctgtatctcacatcgaatccgtccgcnnnnnnnnnntctgctcccttccactcttgttctaagggccagttcagccgtccaatgcgcattggccactcannnnnnnnnnggcaattaccatcaacaggcacccccaccctgtatctcacatcgaatccgtccgccatggtgtggcttcctggcctacgcttcgagcccttgcgaagtccaagactttatgctcccttcctctcttgttctaagggccaattcagccgtccaatgcgcattggccactcactgcagcattgcccgctgaggcctcctcgcgctcaagatccacagcaggggcggcaggtcgtggtaccaaactcccggtaccgatccagccgtggagcgagggggtgtggcagtgtaagatcgctgcgtcccatccatccatacagcatgcaattgatcttcattggcttgtgaatgccatgcctgagaggcaataggggctggggaggccggagcctcacccatgcgctgtgctctcgcagggcttcacagtgcatgcggtgcgacagtcagccggtcaaggcacccgacgagagaaaattcataccactcaaaacctcatgatataggcatcagcacccgccttcctaccagggggaggtgggcacccctctgccgagcagaaccgggactgggtgcccgaggggcagcagatgatgacgaggccgggttgcggagcgcgatcgaggcggtcannnnnnnnnncaccagggggaggtgggcacccctccgccgagcagaaccgggactgggtgcccgagcggcagcagatgacgacgagaccgggttgcggagcgcgatcgaggcggtcannnnnnnnnnaatcttcattggcctgtgaatgtcatgcctgagaggcgataggggctggggaggccggagcctcacccnnnnnnnnnnaggctgcccagtccgcgggctccacagccacccaccctctcgccgatacagaggtatcccatgtgctgggcagggagaggcagggtgggctcctgcaccatgtcgtcccaccttccatggatccccttcctcgcccactttcctccagaggatcgtggcgacggcgatgatggcggccatcaccgccgtcatctacaccctggccagcgtggctcgcctggactcctatgcctcctacttcctgcccctgcccaccattctggtggcactgcgccacggccacaccgccgcgctgagggccgtcctggtcagcgtcctgctgctgctgggtgcgcgcgtgcggggttcggtggggccctgccagtcggtgtcctggagcgagagcaccacccagcatgcccgggatggggcatcgtgctgcctgtcgctcgtgtcacgctgcacgccgcggaccacccactacaatcgtctccacctttcctcacctcaccaacccatccccccccaccacgcaccccttccctctcagtgctgacgggcccgctgcgtgnnnnnnnnnnttgtcacgctgcacgccgcggaccacccactgcaatcgtctccacctcacctcacctcaccaatccatccccccccaccacacacccctcccctctcagtgctgacgggcccgctgcgtgccgccaccttcctgtgcatgcacggcgccatggccgtggccctgggcgtggcctgggccgcgcgcctgccctgggcgctgagcatcccgctggccgccgccgcgcgctgcaccgggtacgcggcctacgtggcgctgtcctcctgggccacgggcgaggacctggtggcgctgctcctggccaacgttcgggcgctgctcggccaggccgccgtgctcctgcgcgcacacggcgcgccctctgacgccgctgtggccgccgccatcctgggcctgctggccgtcaacgccgcggtctacgtcgccctgctgcacctcctctacgccgtcatgctgggggccatgggccagccgcccccgggcagggtgcccgcctgggccggcaggctggcacagcgggtggcctgaccaagcatcagggggccggctggatgagacagttgggagccagagtgctgctggactcccccagccatgcacgccatgtcctccatacgcatttagaccgtctgttggactcaacccctgctgattgagctcatcgtcagtaaaattcctcctcatcctaggcctccattcctgcatgcggtgttgnnnnnnnnnntgccatgtcctccatacgcatttagactgtctgttgggctcaacccctgctgatcgagctcatcgtcagtaaaattcctccacaccctaggcctccattcctgcatgcggtgttgcacggtcgcatatacaggaaggcagacaagtagacattcaagggcgccaatggtgaccctccaaagcgcatgcttggaagtcatagacacaggggcacccggacaagcacgctcagcggccgcgcatggccttgacctcggccaagcactcggccttgcgagcggcgttgggctcaaacacatacctgcaggccgggagggtggatgaagggacaggtcagctttagtcgaatgacaaacaatgtgggatattcctttgnnnnnnnnnntgcgttgggctcaaacacatacctgcaggcggggagggtggatgaagggacaggtcaaccttagttgaatgacaaacaatgtgggatattcctttgtcatacaaacaatcgctcaacaagctttcctccttcctcccaaaaagctgaatcaataaactgtcgagcgctgtggtttctgcgccccccggcacccacttgataagcgactccttgatgggcaggatctcagggnnnnnnnnnntacacaagctttccttcttcctcccgaaaagctgaaccaataaactgtcgagtgctgtggtttctgcgccccccagcacgcacttgatgagcgactccttgatgggcaggatctcagggaactcgctctcgatgcgggcggtgtccaagaggttgttagagcggggggccacaatgaccttggcctgctcctccacggtgaagttggaccaggtgaagtcggggtcgatgtactgcttgtacagctccaggatctcattgtggctgatcgcgcccgggttggtgtagttcatcacgccagtcagcccacgcctagccatctccagcgagtaaggcagcagctccggcagcacggtcatggagttggggatgtcgatgatctgaggacaggggcaggggttgatcatttggggaagaggaaagtgggcagggcgcaaggaggtggatgcaaatggcgtaggtgttgcaagaggtggacagcaatgctggtgtgtagtccttggagtgggggggcggggatgccacagtgcaaagtaacatcaccatgatagacagctcagaagttgcaaggagtggtcacagtgtacatgctaagccagccatgggtccaacatagcttgccacgctaccccctagaggcatggctccaaagccatgccctcagccaccaccctaccacgaaggctgccgcctaccttgtcgtatttgatgatcttggtgatgaagttgcgcgggtagaccagcgactccacaatgggcatgcgcacacgcagcaccaggacattctcgtactgcttcagcaggccctcgacgattgccttgcagtaggagtagtaggagccagtgaagttgggggtgtcagactccttgaaccccttgccggatccttgggggaacttttcgtcatagtggaagatgcagccagtgccgtagtaggtcatgtggatgccgcgctcccgggtcacgtctgccaggttgaggcagccgatgatgttggcgcggatcgtctccaccttgtggtcctcgcaccagtccacattggggcggcccgtgacacccgcagcattcaggacatgggtgggcttcacctgcagtggcggggggggttggggaacccgtaacaacggccgcgtccaggcatgttgcggatatgcagggcaccacgagtgccattgccgatttcattctcctgaagtatgaataagcatcagatgggggctcgcgcgagcgaggaaggaccatccacccccgcgccaccgcaccctctcgaggtcggcgatgacagcctcgcgattctccaggcgagcagtgccgtactcaaattcagcgccctgcttcttgaggagctcgccaacaagccccccgatccatccattcttcccgtagatcagaaacttgggctgcggggggtgtgagatcttgaagagatcgagtgctggtacagaggagaagggggatgaggagggagagtatgctcaggttactcatggcatgcaatatcagagtgctttctggtgccacccaccgcgctgtcgccattcttggtctggaacacagtcatgttggagggatgcctcaacgacagctgcaccgccaagccgacagataatatactgaggagcagtaggctacttgaccttggattcacgaggagtgagtcttatgctacttcgtgcagcacagcatgccgcttgtattgttagcagcactccgnnnnnnnnnngaagtagactatttcttcttaggatcacgaggagtgagtcttatgctactttgtgcagcacaacatgccgcttgtattgttagcagcactccgacgcccccttcaccgaccccccgcggggctttccattgggtggcgggaatatacattttgggggtcttgctcatgactatgtaccgtgtgggccgcgcatgccgtttgcagtcttgatcttatgtaccatttgtttaactgatatgtccaattcacagtcattggggcacagccccagtcagtgggnnnnnnnnnntttatgtaccatttgttaaattgatatgtccagttcaaagtcattggggcacagccccagtcagtggggtgagtgccaggtaagaaggtgtgtacgcatgggtaagtagtgctctcacctcaggacaagatgtagaacaggctggtgctcactgcgctcagaagcagctctgattgaggatggcctcgatgtctataatgctggcgcagcagaggccgccagcttcttgcgcagacgccccggcagcgctttcttccgcttcatgacggcagcctcgactgggacctcggcgtcgcccggcgccgcgcctcccaccggccgtcgggaggtggcgggcgggccagaagacctcttgccttgcaccggggccgccgctgtgtccaggtggtatcccagtcccgaagcccggttgccaaacacatacccctgcctggcgcccttgaaggccttggccgggatgtaagcaggagcaggggcggcgggctcgactggcccctgcccggcaacggcctcgccgccgtgcgcctcctgcccagcctggccgcccgcaacctcgtcagcctcacgccgccctttcttcttgcgggccttcagccccagctcccccagcacgtcctcgctgcgcggccgctctgcctcgcccagcttctccttgaccaccgcgtacgccttggccaccagcagcaggttggggtccaggtcggcgtcgtgcgcctccagcagctcgatgagcggggccgccagcggcgccagctcccgcgtgaagaaggagaaggcgtggccgtcggtcgccagccgccctgttcttcccaccctggacgatgagcaaggagaggggcacagttggagtcttggcgcagaaagtgcgagggctccagaaatctgcgcgcgcgcagctaagattgcctggaaggccatacaaaagggtgggagcagagatagtatgtggaccggctgcccctggnnnnnnnnnngaagtgcgagggctcgagaaatctgtgcgcgcgcagctaagattgcctggaagaccatacaaaagggtgggaagagagatagtatgtggaccggctgcccctggggcctggtgggggcggttggcgtcccccggcaggccccggcgtcccaccagtcgcccttgcgggttcctgtgacgcactgagccgggacagccggtcctgagggtgcactatccgcaaacaccttgccaggaaaagcccagggtatatgtaacgggcagcctggtggttgtgtggcggctcaaacaggagagttagggggtgggggaggccagcactctggattgtattgttcttggtgccacgatccacccccatagatgttgacaaagagagagtgcttcctgctttcccccgtcgagcatcacatcgtgacgccataattgccagctccctgtcactctcccatcccaggaaaaaaagcacggcccctcacccctccaaccaattaaaaacaccatccttccccccgtcttgccacnnnnnnnnnncctctcccatcccaggaaaaaaagcacgacccctcacccctccaaccaatcaaaacaccatccttccccccgtcttgccacctgtggatgtactgctccaggttccccgggaagtcgtagttgacgacgtagggcaggttgcggatgtgcagcccccgcgccgcgacatctgaggccaccaggatctgggccttgcccgcgcggaagtcggccagcgccgcgtcgcgctccgcctggctgcggtcgccgtgcagcatggcgacgcgccgcccctgccccgccagcaggtcgtgcaggaagcgcacggtgcgcaggcggttggcgaagatcaggacgcgcgggcgattgcgcggcccgggccccgcggcggcatcgatggccgccaggtggcgcgccagcttggcgggcttgcgcgcctccgcgcacacctgcaccacctgggtcacgctgtgcgagatggaggcggcggaggggccggcggagacgcacagcgggtcgcgcagccaagaggcggccacgccggccacgccctctggcagcgtggccgtgaagagcgagacctggggcggggcggcggcgggcaggcagccgcgcaggcggtccagctgcggcgcaaagcccatgcccagcatgcggtcggcctcgtccagcaccaggtaccgcacgctgcctgcgcggaggagggggggcaggtgggatcgggggatttggtggtggggtatggtggggaccgtcgggggtgaggtgtgagaaaacaggtgaggaactccttggcctgaaaagatttgaaagcaaaccatccaaggaaatgctcggcaggatgaatggggtgggagggaggaactnnnnnnnnnnaccttggcctgaaaggatttgaaagcaaaccatctaaggaaatgctcagcaggatgaatggggtgggagggaggaactgcataggtgtgaaagatccaaacttgcaggcaaacacagcacagcgcgacggctgctactcaaaggacatcggtggcctcagcttcgggaaaagtgtttgcttgcagtggggagggctccgtggagcctccccctaaacatccgtaacttgagtaaacagggttctcttcaccggccgacgatgcaggggcgcaaaggtggggatagggacccaaaggaaagaaagtgtgtgaggcgagctttgtcatggaggagcaagtgaaaggcgaggacctcagacacagctgatctcagcatggcaatgctcagaaactgtgaaagcaaacgtgtgatgaaatcatcaccggtccagagcatgacgaccaggttgaggatgcctgagcaggcttcaaagtaattgtgggaggcaaagagtccgggcaatgagggactgctggaatctcaaagtacatggaaaagtcatggcaggaggctctgtcatctaagtcaacacagatatccccccccaccaaagcctgtttggccctcctgttctcactcaggctcagtgcnnnnnnnnnngcagataatcccccccccaaaccccgctcggccctcctgttctcactcaggctcagtgccccgctgtccacgaggtctaacaagcgtcctggcgtggcgatgaccacctggggcttggccttgatggcggctacctgcgcagaatccaggagcagggaaggtgtgtgggcgggctgatagttagcacattacctcgtcaatgtccgacgtcccaacaagtacaggggacgatcgtggcatcagacatttcaaccaagcgaggagtatcggcatgggcaaccccccggtggggtggctgtccctgagaagcgcggataaacatcagactcatcccttgccacgggagtgtgcatcaccaggagttctttgagaaggggtggggtgctggccggcgtggggagtgcggtgatgggaggggactctgggccggcggaggcaaagggcctccaccactgcccccccaaccccccccgcaccaacccacacctgacctcatcttcctccgtctccgaaagtgcacccagcacaaagaccacccctccaaggccctccccacgcacatgctcttgcttaggtacgccgccatggatgacggcggcttgagcccctgtcagacgcgccaggtccttccagaccaggcccacctgctgggccagctcacgcgtcggctccaggaccagcaccgtcgccgtcgcagcagggaccttggcagcccccttctccagcagcgccgcggcaggcagcagaaacgtcagcgtcttcccagcgccgggctcggccacggcctgcacatcgcggcctgccagcagcggcgcccatgtctggtcctgcaccggggtgggctccgcgaaccctttcgaggccatatagcgctggaagagggggggcagctgcgccagcgctgcgctgggcggcgtgggggcgccctgggcggcttgcggcagcggccgctccgcctcgctgtgctccacacgcatgggcagggccacactggtggacatcttccggcgcttgggggccgcctggcgcggtgtctcgacccggggcgcggcaggaaccggctcggacgtcagctgggtggctatccggctctccagcgactcatgcttgggagggggggcggaagcggagggagccagtggcccggtttcctcttcttccaggtcggcggcctggaggaccggctcctggaagcagactcctgcagaaggggggtaatggatgaggggtgtcaatttgcatgcggaactcccgctccctgggagcatcggcgaccatgggagggctcgatgacggggcacgccgtcacttacctcgacataatcgcctggggcccgtcctcgagcgggagcggggcaccttgccctccttccctgccctcttgcgatccttcttcgcggatttccgcgcgaggtagtcgacacccatgcctgcctcagaccgatgagtgtgctcgggctcaaccttgcatgtcaagcacagactatatcgatgaagtgtatctgtaaagtgagcagaatactaacttatgaaaacgtaaacaatcaaccccaatgcggagaggtaaaggctcaaccatctggctcaggcggcatgcatatgtcaacacatgcaacccccaaagccggctctgtagaaaaggcgggaagggctcatgtcccacatggtcagagcaacggagcctgagtgaatcgaaacacccgttaacagtcaaatggatatatgaagcggaaggcgttggttgttgttgacaaaagattggtcaactttctctgtatgtagactcgctgatgctccttgttcaatacgaaatctctgtcgttatcactgttgcatctgggggtccatcgcaaattcgcactgacacgaattaatgtaattacatcgataatgattgtgcaacctgctgcttacgttatactccagacattataatcatgcaggtcaaggttctgcaccccttcctgacaccgcgcgcgcgccctgggggtcttccaatatnnnnnnnnnntacgttatactccagacattatgatcatgcaggtcaaggtttctgcaccccttcctgaccgcgcgcgcgcgccctgggggtcttccaatatcataccgagattttctcttctctacgacatggcttaccactgcccaacaggccctggatatattgcacaggttgcatggctcccattgctcatccggcgcccagagcaacgtcgtcgaccgggcaagcaatatatcgagcacccaattccgacggagttccgcatcctcgactgaatcacccgaagaggtgcaaatcccggcatgcccaaatcatttccgctgannnnnnnnnngttccgtcggagttccgcatcctagactgaatcacccgaagaggtgcacatcccggcatgcccaaatcatttccgctgaacgtgaagccatgggagaccttggaatccgagttgaaagcaaaggtgggtgtgggtttgtactccggctcgcgcggtcagagcccggagcccagacgctatcgttccacatgctgccctatgcgattaccaaacaggtaacgagctgggcagagagcgaccgtgctgctctgctcgcagcactggaagccaggaatgctgctgagcaggaccgggcggttgctcgggatgagctgaaaacggccttgctgcagactgcagaggctaaatcacaagccctggcagcagagcatgctcttgcaagcattgtgcttgagaggtgggtggctggtgttattgtcgccgggcccagacgattttgcctgtgcaagatcctttcccacaatgcaatccttctgcatgcggctgtccacaaagacaannnnnnnnnngttttacctgtgcaagatccttttccacaatgcaacccttctgcatgcggctgtccacaaagacaactctgagtcttcatgctgacggcaatgtgtgtgcagtaagcctccacttccatgtccatatgcagggatagtctggcacacagtttggatgcaagtcagcaggcacagctgtacgcgagcaaggagctggaggagtgtcagagttccctcaaaacgcacaaggagcagctggcagtggcagacggtagggtgacttgcagaagaacttccttgcatgcataggagaagggacatgaaaatagatcagtgaaggtgctttgtagtcggcatgctgggactgtcaacgtctcgcagagctgcacccgtttgactcaggagtgtctgtgtgtggcacaccgtctgagcagtgctcttggtccttccatccagtcgcccaaccccacccctacagccgtcaacctggcacgcggcagcgacctgcaggccaagcagcgagagcttgaaaaggcgctccagcagctggaagccctgcatgccaggaacacaggtgcgcagggtcctcagcttgctgttattatggcaggttattggcttgtggcatcatgctctcctgtcgagcattcgccatcctcccattccgtgagaccctagcccctgtgcgtcgcacagatctggaggagcagctggcaggcagtcagagtgcccaacgtgcagcggagcaggccgctcggtctgccgaggcacgggcctccggcgttgcgcaccaggccgcttcagccgccggcgaggcggctgagcgggagagggagtggcaggcgcagctgagtgtgtcggagggtcggaggcgccaggctgagctgggtgagagannnnnnnnnntgcctccggcgttgcgcaccaggccgcttcggccgccggcgaggcggctgagagggagagggagtggcaggcgcagctaagtgtgtcggagggccggaggcgccaggctgagctgggtgagagaggacgagttgaacaaaggaatcgtcataggatcaggactcccatgctggggctgcggcctcggaaacaccccaccaatgcagtggccagggggccctgtgcctagcccagaacgggggagctcctccacagcatgaggaggctaccatcatgcaggttgtgcaaccccacccaccattcccctgcccaggactggatgcggccgtgaaggacctggcctccttcctcgaggagacggacacgctgcgtggcgagctggagactgccaaggctgccgccgccgctgccgagaaggtcagtgactttggtcttttggtgagcctgcccactcctcactctatacctggctgtagctctgtctcgagcagccaagacacaacctttccaagctgctcannnnnnnnnncttggtgagcatgcccacacctcactctatacctggctgtagctctgccttgaatagccaagacacaacctttccaagctgctcannnnnnnnnntgagcaaggcggggcaagggccgaggagcatgctagatcatgctggttgcatgttgcgtattcagtacggtgctgatgaagcgcctccaactcatgacaaagtccatccatgatgaccaacagtatgtgcacagccctgcagccagctgaactcagcagtcttccagcttctcacattccgtcaggcaagcagcaactgcagagattgcttccctcgcctcccagctggagnnnnnnnnnngcgctctctccccgacatacttgcaggcccagagcgagctgtcgcggaggatggaggaacagcagcgagtcagcgctcaggcggctgccaagcagaggcgagcaaggcggggcaagggccggggagcatgctagaccatgctggttgcgtgttgggtattcagtaacggtgctgaagaagcgcctctaactcatgacaaagtccatccatgatgaccnnnnnnnnnncgcttatcacattccgccaggcaagcagcaactgcggagattgcttccctcgcctcccagctggaggtgctgagggcagagtgtggggcagcaatagccaaggccgccgagcagggatctcaggtggagtggctcgagtcggcgctgaaagaggcccagatcgccgccaaggtcagcacgtcgctgcattctggggtctcattcttggtccttggggcggaggaggtggtggcgttggtgctgcactttgcaacgatgttcttgcggaggactggagttcgacgaacatcttctcatcgggcaccccccgcgacaggatgcccgcgctgcctggcggagcgccgagggagcgctgcacagcgcggtacgctcccgtaccgctgcccagggccgacggctggccctgctggaggcgtgggtgcacgagcggggcatgcggctgcatgcccaggaggtatggtggggcagggaagtatgatgattgttcttgaaactattggatcgaaggttggccgggttctaggcagttggaactgcaccctggcagcagcagcagccnnnnnnnnnncactcaacgtagagcaccggattcaagttgtgaccggattcgagcgtggacggtgtgatagatgcggaatcatattaccgcagattactaaacatcactaatttcatcacatcacccacccttgaaccccaaccaggctgctattcccgtggcccaaaggagtggggagaatcagccaacaaataagaagtatgttcacatcaagtcaaatcacgcggcgcatcaccccagggcccccgtctggcgtcacannnnnnnnnnagaggtatggtggggcagggaagtatgatgtttgtttttgaagctattggatccaaggttggttgggttctgggcagctggaactgcaccctggcagcagcagcagcctggctgccatgaccagcatgagcaaggggcacaccgcgtttggcacacagctctcaggtgcacattcttgcctattgcaggacattgggcgtgcgggggagcatggtgacggcatgtacgcatccagcaaggtgagggccgtctnnnnnnnnnnggggcgagcgggtgagcatggtgacggcgtgtacgcatccagcaaggtgagggccgtctnnnnnnnnnnccatattctgcgcgcccaaccagcatatcgcagattactaaaacatcactagggcttacgtcatgaactcgctccagatgaagatttcgaatatgggcctgaatccatattttacggaattacaaataaatttcaccttctcacatcgcatccttgaacccaaccaagtactgtgctgctattccgtggcccaaaggagtggggagaatcagcnnnnnnnnnngaagtttggagtttagacctgtcacaaagagcacaccgcctctcatacaaatgatggccacaggaccctggtgcgagtcgcacccatgctgtgcagcttcacgcaagcatgtcgtacttcttcatgccctccaccctttcttgccctgcactgcaggatgtggccctggagagccagtctctccagcaaattctggatgccgtgcgcgagctccggcaggagggcgggtgggattcggaggtgaggctgccgggccaggactactgcaccccatccccttcgcccatcaagacaccaggacgttcttgatgcctgtgtgtggattctgcgtctttgctgcacaaccctgtgatgccagacgggggccctggggtgatttgatgtgaagatacttcttgatttgttggctgattctccccactcctttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtcacaacttgaatccggtgctccacgttaagttttgcaaatcgtagcatatcttccttggaggaagaggcgggcctgacgtggggtatcccacgcacccacttcagctacccagtcccttcccgatgaaggcagcggtgctccccatattccgatcccagtggctctggcatgcatggagtgtggaatcagcacaacccctggtgaaggcccctcactggcgaaccggtcggaatctggaggagaggatccnnnnnnnnnnnnnngggaatcagcacaagtcctggtgaaggctcctcactggagaaccggtcggaatctggaggagaggatccaactcctcagtgagacactgaaggtcaaggcgagttgcaggatgtgcaacgtctcgagcagcccagccaatgtttcgaaagctcgatccctggatgctgttgggtgtaagtgggtgtgaaaaactcctaccaaaattcactggactgattcagaaggctgtctccatgtcgcagttccaggagaagctcatgggagnnnnnnnnnncgctcgatccctggatgctgttgggtataagtgggtgtgaaaaattcctaccgaaatctactggactgactcagaaggctgtttccctgtcgcagttccaggagaagctcatgggagagtggacaaagctggagcaggccaaggaagggacccttcgcaaccgtggctacaagtgagtgcgcgtaggactggtccacagcgaagcaccatgggaactggtgtgcatcaatgcaagatcttcagctttcagccccatcttgtctgnnnnnnnnnntgcaccatgggcactggtgttgcctccgtgcaggatcttcagctttcagccccatcttgtctgtaggctggcgcaggctgtgctgtcgcgtgaggaccccatggagactttcctgaagtcagtccctgatcctccagccccactagaggtcatagctccggtgagacccccatctgtctcgcaaggccagcagggaccttctgacggaaccttccgggtgccctgttggattgtgcagattgccatgccacacatgcttgcccaggagacggtcagccaatgctcagccagccgaggcgctgcttgtcataccatgcatgccctgcatcgctcatcaaccctaccaggcagctgtgtgatgtactgcctgatctcatgacacctcctcgcaggacgtgtttgaggagcggtacgtccgccgccgcctcaggatgctggcagcttctagccagcgccggcatcgcagccgcatgggcctctggctgctggcgctgctcccgcaagtccccatcctggtatgcagaggccctgagatggcatcctcgccgcgatgggcagtgtaccctgctcagaatcacacgggtgccaatgtggtccctgaactcgagaggannnnnnnnnnccttgtcataccatgcacgccctgcatcgcctcatcaaccctgccaggcagcagtgtgatgtactgcccgatctcacgacacctcctcgcaggacgtgtttgaggagnnnnnnnnnnnnnnncatgtattgattttggctgatgttctggtgtgggtcgacaggcagtcccaagctcctctgacccaaatggatgccgattcatgaactggccttcatccaaccgagttgcctcttgcatccacccacccnnnnnnnnnnggctaggcatgtccacacaagcaccctgcccactccctctcgtcgccgcagctgacaccgctgcccgccataaccatctactacaccgcatatcgattctactctcactatcgggccctcaaggtgagcctatcgattccgtatgtcttggttttggctgatgcaccggtgtggaccgacagacagtcccaagctcctctaacccaaatggatgccgattcatgagctggccttcatcgaaccgagttgcctcttgcatccacccaccctccacagggcggacaagcgctgcagaggaggttcctggacctggatgcgcagcagattgcccggctgagggctcagctgctggacatgcaggcgggccaggggggcctggaggtcaagccagggacatgggtgtccgacctcctccagccaaagcacatgtgagtgggaggtgtggaggtgccaggagcgatccattcaaaatccaaaaggacaggtttggggctgggccgatgcgcaggtgcggggtccatgtttgcagcccggtgtgagcccacgttcatagaagcatgctcatgatcgtccgacacaggcttctcgctttcttcaagccaaagtgcgcttgattttaactctgcaccagcatcgacctgtcagtcccagctccatggcctgcctccctcgccaggtacctggacctcttccagaggctggaagagacgcagcggagggaggcgctggagagacagcgtgtggacaaccccgaccccagtgaaccaggaagcaatcaagaaaagaacatgctgatcttcactgcaagcaaggagctcacgagcatcctacagccagccaagaggtgatggacatgctaggggaggttacttatgtgctcagaaaggacactggcatattcgcactgccgaaacctcttgctactaatgctcattacccatccctgcccatcactgcaggttgacacatcccctcgatgatcaggctgctgtcgcggcagcagaatacctaggtgcacccaatctgctgcagggggtggcgagggcccggaaacgggcagtcggtgcaatgttcccgatgcagctgaagtctccagagggagtctgacgcgttcctgggtgtgcatcgtccgaatggaatgtcctgtaagtcaatgaatccagacactctatttgatagtggacaggtttgccggatcaacaggtctcccagacgacgcaggtatagctcgtgagtcttgatttgataccatgcttactataagatagtgtgctgctgttagatcgagacttgaatgcacgtataagtcgcggccttccgtcctgctagcctcgcccaattgggcgccatgacgagcgggagggcggaccgcggtagacccgggatccctccactttactgcgaatgccccagtgagcggcggcttctgcctctttccggcgatagaatagccgagtagcagcctggtcggcccaagtagctggtcaggatggtgagctggaggtcgcagctggtggggggacccctgtgagaggccggcacgacccatggcggtgcgagtccaggcctgtcagtgcggtgcgagataatcccctctcacttcctttacactctcacgctgttgtaggtgcgcatcagcgttctcggcgatgctctcgtgagtgtgacgagggggacactcccgggctgtgaggagggcggggtggggtgtatccgtccctagatccaccacgcgcgtcacgccgcccaactacatcgcaacccacagaaatccatgtacaatgctgagaagaaggggaagaagcaggtgctgatccgcccttcctccaaggtggtcatcaagtttctgcaggtcatgcagaagcacggtgagtactcgagccgggtccgctcgcgacgcctgtcctggacgcattgatgatgggtagagtgtgagattccgcaatcgctgcggagggctggcgcaggctaaaggcactccatcctgacaggcccagcccagcccagcaggccacacctggccactttcctccagggcacattaccaatcatcccctgccactcctctgacaggctacattggcgagttcgagtttgtggacaaccaccgctccggcaagatcgtggtggagctgaacgggcgcctgaacaagtgcggcgtgatctccccccggtatgactttgcagccggcgacatcgagcactgggtggggcgcctgctcccctcccgccagttcgggttctttgtggtgaccacctcccagggcatcttcgaccacgaggaggccaggcgaaagaaggtgggcggcaagctgctcggattcttctactgagcgtcatgccggccccccggccccatggtgggcaggcggcgtgttccatcctgtaacgcgtcgcgacaaccgtgagcccatacaacaagcgacagggaggggcccgatgaggtgggaagagtatcttgcctgggatgaacagcaccgcaggcacggcacgaggtgcagcgtttccttggcaagcgcgtacagcatcgcaggaatatcatggagtgaaacgtttccttggccaggggtgaacagcaccgcaagcacagcacgctcacagccgcagtttcttggcggaggggccggaccctgagtccaccgctggtgctcgtttcccgctgtcctgagcactctggatgccagcaaacacggccttggactttgtgaagtggccacgggccaaaggcttgtctgctgggggcgcgccacgcttgttctgcgggagggttggttgtgggggaggagaggggctgcagtcaatgtgggaggagacacaaggcnnnnnnnnnnggttttgggtgtggggggaggagagggcctgcagtcaatgtgggaggagacacaaggcgcaggtcatcttaccgtaagcaagtggtcagcgctcgacgatggacatgaggcggggggtgttgaatgtggaacaaaacccctgccaccaactatgcctggaatcgctccccatggtgaaaccaagccaaggccagaacacctcctgcccacattgggctcccctcacctttttcgcggcggcagcggcggcagcggcggcagcctgctcggacttccggccggcgatggggcccagcccgcccagactctgctccctggccgcgcgctccgcgtccttggcggccctgtgcttcttggcgccacgcttcttctgggcgcgccgccgctttcggtcctcccgctccagctccgtctcggcgggggcaaccccgcccttttccagaggcgcatggacctcctcgggggcccgttggctcgccacagacacaaactgtgtgtggggatgggaggggggttgccacgaagaaggcgggaatgagcagccagagggtgccgacctgggagccgccaataacagagaggtaccctcagaatacgcgagtccagcttcattgagctggcacatggcctcaaactccccnnnnnnnnnnttgccgacctgggagccgccaataacagagatgtaccctcagaatactcgagtccagctttattgagctggcacatggcctcaaactccccccctgccggacgcacctgtggcgcgacctcctccatgaggatggcgggagcatccggccggggcccggcctcctcgaccacgggggccggcctgagtgaggaggggtggagcgtctggagcgagcgcgggccatgccatgcatgcagggcatagccagggcaggcccctgatgcagggcaggcaacacatgctgctggacaccttgaatgtaacccctttcaccagcacctggaccaacctgaagtgcaggtgcgacagcgtgtccagcttggcacacagcgatgcgaacagcgctcgggcgttggcacggatcggctcatcctgtgaggcacatgcggggcggagttgcatgccgagattcatcggcagcaggaccttttggcggctgagtccttcgcacctttcgctctcctgattcgcgaccacccttgtcagcgttcagcaggtctgctgcacgacccatgccctacggggtcccctcctctcgccacaccacctcctcgccacatcacctcctcgccacacctccccacaccagccacaccgatccccttcaaccccaccttgtcctcggtcacccctgtgacagtcttgacgtagtcctcctcgtacagctccgccaggcccnnnnnnnnnntactcttgccctgcggggccccctcctctcgccacatcacctcctcgccacacctccccacaccagccatgcccatccccttcaaccccaccttgtcctcggtaacccctgtgacggtcttgacatagtcctcctcgtacagctccgccaggcccttggcggagcgcttgtcgtccagctccggacccttgttccccctgttcttcccctcctcgggcggcggcgcggtgcgcaccgcgctgtcgaagcgcccctcccggattcgtgcccggatgcggtcctccaggctggccgtgctttcctcggtgggcgcaggggcgggggccacggtggtgnnnnnnnnnntaggctggccgtgctttcctccgtgggcgcaggggcgggggccacggtggtgtcgtagtccatgtccacctccagcgcggagttgagcgggcgatgcatggcccccacctccccgcgcaggaaccagtccttggccgccatggcctcggcctccaacgacctgatccgggttgccatctggggttttgggggggggggggtgaagggatgagcggggagtgaggtgtgggtgcggggtggtgcgcagggcagtgtcagcggcctgtggccgtcgagagggcgacgcgtgccggcacacgattgccaggcagcccatgcaattcatgcacacttgtgactcccaaggtggccccttccctctccctgccgtccttgaagacctgcgccctgccagagcaggtacccccaagacaaaacccagtaccttggccatctgnnnnnnnnnncgtgactccccaggtgtccccctccctgacgtccctgaagacctgcgccctgcccgagcaggtacccgcaagacaaaacccagtaccttggccatctggcgctcgtgggtggacagccgctgctgcgcgccggccgcatctccgggctccagggtctttgcggcagcggcggcgcggnnnnnnnnnncacgaagccgacgtcctcctcgtcgctgctcaaggggccggcgccctcgggcccgctttctttctcctcctcggacccctcctcctcctcctcgtcgcccgactgggagccctctccactcgcgtcgctctcctcctcctcttcctcctcttcctcagaagccagcatctcgtccaggccatcgtcctcctcggagtcatgggacgcgtctgaggcatctgcaccattgcattcaggtgttcgtggtggtgtggggcagcgtggatgcccgggtacgactggacgtgggcagggcttgagccttgaacttccagcgatgtggctgctacaaccaatgcatgccccgccaggctttgagagactcgcgaggtgcacagagtgcccctgtgccgtgcgggagagcggcctgcaagaaaattaaaccgtggtgccccccccccaatcacgcctcacctcccgccagctccttctcctccagggcggcctgcagcgcggctgccgacttgctctgccgctctgcagtgcgaccgggctggggccctccggccttgcgagggccaaagaagtcctcatacatggcctcggcgccttcctccagcgccgcgccgtcctcgtcagcatcgatgtcgtcgtcgccaaagaccaggccagggactgcggcgacggtggaggttctaggaagttggcttgcatggcacatatagcaacgacaatcgctactgttcaggatggtgatgggtgcgcctctggaccatgtcggcttccctgatgacccacacaaacacatccagggcacaagacagcccctggcacgcacacttggccctgcgctgcttcttcttgtgcttcctcgcctccgcctcgtccagcgcagcctcgagtcccgcctcctcctcctctgagccctcggcccctgcagagagcatggcgtgcatggtcacattgctgatgtgttcaaggcagaaggcatatgaggctgcagatgcatccttcaggacacaccactctgctgcactgaagttctctgggcctaatgctgggtgagtgtcccataccgctgcaacctccctcggataatcctgtccaggcattgttgtcgcttccccactctcatcaacacacacacgcacacgcacgcatgcctccacgctcaccatcttcctcggctgctgcgcgctctgcatcctggaggaaggcctccatctcgtcgagtttcaggtactcgtcctccacggcagccagcgcatggctcgtcgacttccctcccttgggccgggcgtcctccccctcgccggctttccttgtctggccaggctggtcacccgccagcatggcgccgtagtccagctcagccaggtccagctggtcactcgggtgaggcccagcgccctcactgccatcctcatcactggcctcatcctctccatccgatgggccggcagtcagccccagcagctctgcaaggccggtggaggtggaacggaaaggctgatgcgaaaggctttgcacgcaagagcgacagcactcattgcccgcaactccgccatgcacatcccacacctgttcggggttcagcctgcatgccacaccccggtccatggccaaccccttccaaaccactcccccaactcaccgtccaaggcctctgcgctgtccggggtgagcaggtcaaagtcctccctggtcttcttcagcagccgccgcacccgcttcagggccggggcgcccagcatgtccagctggagccagatctgctcagggtcaaagccatcgacgtacagctccggcagcgcgccggcgggcgcctgcaccgaggtggataccgcgaccgcgtacaacgcgcgagccgccaggcgcgccagctcggccagctcgccggaggcctgcaggaaggcggttggcgtagcggccacgcgcagggcccgcaggggcgccgcctgctccggagtaaaaatatctagcgcccggtcctcgctgccctccgactcctccccctcgctcccgaggtcctctgagtctccggcagactcggaatccgcctcgtcatcttcctcggcatcgacagcccctccgccattcgcctcagccgctcctgcctcgtcctcgctggcatcatctgaggcagaatcaccgctgcctgctgcgtcctgctcctcatccaatgagtctggggagctgggctcgactgcctcatctcccttcgctctgccctctggcccgtcatcgatgacagagtnnnnnnnnnncctcctcatccaatgaggctggggagctgggctcggctgcctcatctccctttgctgtgccctctggcccgtcatcgatgacagagtagctgaactttggaaggttgatcttcctctcctccccattctctaattccagacggcaactgcggcccgtcgcgctgcaatgcagaaccttggctgggataggaccctggaatgaagttcgtgggtttgcgggtatgagagtccgccctttgatgcctcttgccgacaccagccagaccacactgacagcacgatgttctccattcaaacctcacctggccgtcctcgaggtccaccaggatattggttccgacttccaacattgaatttgcttatcgcgccgaggtccaggacagagaggatgttctagcctcggaactcgacccccggctgctgcatggcggagcgaagagtacccttcttatatcagctcagttccctaagccgcttgatttggggtcgacctcaagcatgactgttatgcgcgtgcatgcatgacnnnnnnnnnntttggttccgacttccaacattggatttgcttatcgcgccgaggtccaggacaaagaggaagttctagcctcggaactcgacccccggctactgcatggcggagcgaagagtacgcttttaatctcagctcagttccccaagtcgcttgatttggggtcgacctcacgcatgactgttatgcgcgtgcatgcatgaccccacctgcctcccaagcccaatttcctcgctccagaggtgccgttcgtcgcagcccaaagcacgcactgcttgggcgcgcgagggcgccagggcgaatccaggccccactcccgtcaaggcaagccgaataattctgtaacactaccggtacaccagccatcactgcaacgctgcagcaccttgatgtagtacatgatgcaattgatggatcgacctcctttcgtcaaatcgatgtggtaagcttctgcactgctgctaacgagggcgcttgcgcttgcgggtcttatgcgcatgggcgtttaggcttccctggctgtttgcaagcgaccctcctttcatatccgatgcgcgtgatcagatttggacagaaagctgagcgaatggctggagcttggcttcccggaggagacattctcaccagcttgtagccccagggnnnnnnnnnncgacagaaagctgagcggatggctggagcctggcttcccggagaagacattctcaccagcttgtagccccagggttaaccggggccatggcagggggatcgggcccacgcacatccagcctgggtgccctcgtacccaccacagccacgagcttgctccttctggcggcctttataaaccaaggagtgatcggtgagtctcgaggtggagacatatgggtggagatcagtgccctgagttcgatacgaggaagcggcagacagatcctggggagatcccaaaccgcttctctccataccatgcaggacttgcaatcctgatatttgccgaggtatggagcatcttgctggcccctctggcctcccgcgctcgcgcgattggcacaagcaaacagctttggcgcggcctgacaggcgagtgccggcgtgtggggcgtccctgggtgttgggtactggatctaaaatgtgcacctgtgcctcctgacactcccaagacaccagnnnnnnnnnnaagccggcgtctggggcgtcattgggtattgggtgctggagctaatgtgtgcatctgtgcctcctgacactcccaagacaccaggtgcagtggtgtccattcccataccctagcacatccctgctgcaccgctggatccccacccttgcagggctcacatgggtcatagccctcctgaccctggcttcacagctggcatacaccaccaacgtgcccgccctggagacagtacttcgcctgctcggcctcacgcgcgtgactggagcccggggcctcttccaggtgccattatgttggatgtgttggtgcatgcaacacgtgttcctgcaggctagtagggctgtttgtaggtatggttcaagtgtttggtcgcttgtgatgtcctgtcgaggaaaccccaaagtcctttggcgtcacgtgcatgccgctctttcctcgcaccgcaggccacagcacccattgtgctgacccttacggcctcctggctccagctgaagtcgctcaacgccctgcagtcctcgatggtgggcgcgggggtgaacccgaccaggcaccttgtcagtgcatgactacgtatattctcacacctggataggggcaaggcagaagcttacctcacgagagtgtccctgattcggggctcctcagatgccctggtagcgctcattcttctcaatcccgcatgattccctgtgtgcatccccgctnnnnnnnnnngtacctcacgagagtgtccctgtttcggggctcctcagatgcccctggtagcgctcattcttctcaaccccgcatgattccctgtgtgcatccccgct

SEQ ID NO: 44072 - DNA, 61 bp, Chlorella protothecoides
tcggcagccccgccgccgtcggcacccgaagcctgcgagtcgccctcgcctgcagcaccag

SEQ ID NO: 44073 - DNA, 61 bp, Chlorella protothecoides
aggcttgagcggtcttgggtcacggcaggggaaggaacagggcagaattttggaggtgatg

SEQ ID NO: 44074 - DNA, 61 bp, Chlorella protothecoides
tggtcatggaagtcgaaatccgctaaggagagtgtaacaactcacctgccgaatcaattag

SEQ ID NO: 44075 - DNA, 2049 bp, Chlorella protothecoides
gccctccaccatcgcccccaccatcccccacaccgcccagccctccaccatcgcccccaccatccccatcaccgccggctccacctcccagccctccaccatcacccccgccaacacccccgccgccatctccacctcccagccctccaccatcacccccgccaacacccccgccgccatctccacctcccagccctccacctttccccccgccaacacccccaccgccgtctccacctcccagccctccaccatcccccccgccaacaaccccaccgccgtctccacctcccagccctcccaccatcccctccaccatcgcctccgccgctggctcctcctcccagccctccactagccctcccaccatttcctccacctcgccccccaccgctgccttcaacccccagccctccaacaatctcacctgttcaatgttggactgcgccagtagtaaacttactggaatgcaacatgggccactatccgcacatctgcacacgagatggtgtccccaccgccgtctgcatcgcaaaacaacttccaataaacgtctcgccgtgctggggttcatatatagacacgatcgccggtacatgcatatactctagttatcccaccctggtcatttgcattggggaggagcatccgaccaagtactgggctgtgtgccagcaaaaccccggatcatggcctccaccgtttccctcgccgccatctcctcctcccaggcctccaccataccctccaccgcaccctccacctcaccaccccttgccgccaccatctcccagccctccaccccccccaaccgttgaatgttcgggggcgcctgtggcggacgtagggctatgcaatggggatcgttatccgcacatctgcacacgagagggtgtccccaccgccgtctgcaccgcaaaggcccccagaagtgtctcggagtgcatagggctttatgtagcaccgtccaacggcacatgcgctgattccaactacccctccctgcttatttgcattgtagaggagcaatcggagattatatattgggctgtgtgccactcaacctccacctcattccttcccagccctccaccatttcccccaccgctctctccacctcccagccctcctcatcccagccccccacgatctccatctgatatttgcttgaatgcacctgtggtgaccacatacagctgtggtgcgggtctttacccacacatctgcatacgagatggtgttcccaccgccctctgcctggcgagagttccaaaggatgtcccggcgtgcacagggttgtacacagaaacgactaatggcacatgcatgggttacacttatcccaccctgcttatttgcatcgaggtgtacgaagcgaccaccacgttcttggctgtgtgtcaggacccaaaccagacaccttgactctggtgcttcatatgggagaactgcggcgcaatcggcccagactgcgcagcgccgggagtgacgggcgccgttggctacagctgaagtggccaaccacatgtaaccttcctgtgcgacttgttgacgacacgcgaccttatggagctaacactggcatctacagaagctccttgctgtggggcacccctgcccttgccagttccctccatccctaacgactccttgacactgcgccctcgagccacaatgccctataacatccggctctgaaaggagatgttgaactgaaattagatactcataaggaagcactcctctgctgtacattgataaaggcatgtagcctgcgccacaacactgggaattctctgcaggtgggatttgggattccagggtcgatgctgtgggctcctttgtgccttttcgcaagctggccagcaccacaaacaggagtgcaagagtccatgctcacctacacgtcaggttttgatggacagtgcagtcttcttctctttgatgtgcacaccgtcctcatgactgagaattggtttggcatcctctgcaagtgagcctgccgcctgagaacgccctgaagtcagtatcccatgacaagtctgccac

SEQ ID NO: 44076 - DNA, 61 bp, Chlorella protothecoides
atctgtccagtgggggaaggggggtcggaggggagttggggcgtgggaggtgcaggcaggc

SEQ ID NO: 44077 - DNA, 61 bp, Chlorella protothecoides
cctaaccctaaccctaaccctaaccctaacgctaaccctaaccctaaccctaaccctaacc

SEQ ID NO: 44078 - DNA, 71 bp, Chlorella protothecoides
tccaacgccccacctcacccctgcctgccgcgtcgagctctgcgaaaatgcgcagcgcggtcgagccgtcc

SEQ ID NO: 44079 - DNA, 61 bp, Chlorella protothecoides
gggcgggatgctcgattggttgaccgaggggggggcgactggggggtggagccagttgcct

SEQ ID NO: 44080 - DNA, 61 bp, Chlorella protothecoides
atcatagtgggagccctcagccggcagaggggaggcaaaatcgaggactgaggggttacgg

SEQ ID NO: 44081 - DNA, 411 bp, Chlorella protothecoides
  modified_base (121)..(343): a, c, t, g, unknown or other
gcgggcgtggccagtgcggccaggcgcgggtcgcgctgcgagacgcgggggccccgggcctgcgtcgcggtcaggtgcacggtgctcggcggcagggccgcgcccacctgctccgcgcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgaggcggacaagccggcgtcccgggcgccgggcgcgggccaggcagcgatgcgctgcggcgccccgg

SEQ ID NO: 44082 - DNA, 75 bp, Chlorella protothecoides
ccagggggacccgctcgcggcccgggtggcttgctggccatcccgaggcgcgacgggcgcgggggggcttcccag

SEQ ID NO: 44083 - DNA, 61 bp, Chlorella protothecoides
gtagaagcgcttgaagtcgctggcggtgagggccttgagcctctggaacacagactggttc

SEQ ID NO: 44084 - DNA, 105 bp, Chlorella protothecoides
tgctggccccaaccgagccgcctcgcacagccctggcctcgacgagctgccgctcagcggtctccggcgccggccgccgcaccacgctggcggcggccaccgcac

SEQ ID NO: 44085 - DNA, 61 bp, Chlorella protothecoides
ctcgggggcgctgcatggagttggggggggggggggttcctagcgttgagcgacggcgccc

SEQ ID NO: 44086 - DNA, 1653 bp, Chlorella protothecoides
  modified_base (114)..(123): a, c, t, g, unknown or other
  modified_base (731)..(740): a, c, t, g, unknown or other
  modified_base (832)..(841): a, c, t, g, unknown or other
  modified_base (1189)..(1198): a, c, t, g, unknown or other
ccctcctccggcgctgagctccccccattctttgcacccccgacccctggccccaccccaaataagctgtgcctccggtgcatggcgtgtgtatgttacatggggtgtgggggnnnnnnnnnngttgcacccccgacccctggccccatcccaaataagctgtgcctccggtgcacggcgtgtgtatgttacatggggtgtgggggtttaccaaggcacgtgattgctcccttgcagggttaggggcagtgaggggtgaggttcggtccggggagaggcatgcatgggtgtccggctcctgtcaatccaaaggggtccacgtcgggaatgggtgggcaagggcaatgggctgtctagtaagaaaacggggcatccaggggaggggaggggcgggaggacaccaagtgaggagggtggggtccgcctcggccgcgtgggcgtcgacgtgatcaaaaggcaaagcaggggcaccaatgcgcgtccctcagtggcaatcgatcgtatggtgggcgtgaggcggggggcgcgtgccgggccgtccccggcacacctgcgccgcctcggtcaaagaaaaaaacgggtcagaacaagcgctcgtgtgttccgttctggtggggggggctggggcgcggcgcaggggtgggaatcgtgtcccgccctcccgcgcccttcccccgccgtcatcgtgggtttacgttcttgcatcactcaatcgctctcggtggctccgnnnnnnnnnncgaggcggggggcgcgtgccgggtcgtccctggcacacccgcgccgcctcggtcaaagaagaaaacgggtcagaacaagcgctcgtgtgttnnnnnnnnnnaaaggtctcccgccctcccgcgcccctccgccgccgtcatcgtgagtttacgttcctgcatcactcaatcgctctcggtggctccgctccacacgccgaggcctcagtaggccagtcggcggcgggaggccacggcaatgccgtcctgcgccgcggcgccggcgacgctggcgcccacgcgccgtgtgggcgacaccagcatctccatcgcagcggcgccgccgcagaccagcaggccgtgcgtgccggcgcccagggcggcggcggggaggctggtctggcccacggagctcggtgactgtgaggggcggcagtaagaggtcgcgtcggtgagctgacgacacgccnnnnnnnnnncgactgtgaggggcggcggttggaggtcgcgtcggtgagctgacgacacgccgggacgctttacagccagagacatggatgcctgatgaacccgggatcctgcaaaccacagggcctgcactcgaagtcggccgaccggcctcgacctcccctctcccccgcacacacatgcaccttgtcctccagggtgccaaagccgggcacatcgtcctcgggccggatgggagccagggccttcccaaacagcgaccgccggctagggcggggctgaccgctgcagccaccgacggcgcggcgcgcgcggctgggctggccgggctccgccaatccccgtgccgacacggggcgggagggggacggcacgtccagggacgcggcggcggccgccgcctcgcgcagcagcaggctctgcgggtcgacgcgggcgccgcggcccatgcggcacagcgccgcct

SEQ ID NO: 44087 - DNA, 61 bp, Chlorella protothecoides
gccctcgcgccatgacacggcagcgggcggggaagatcttgtcgtccacgcgccactcccc

SEQ ID NO: 44088 - DNA, 61 bp, Chlorella protothecoides
tccccccccacccaatgaacaaccaacagggtcctccacgtcgctctactccgacgcccag

SEQ ID NO: 44089 - DNA, 79 bp, Chlorella protothecoides
cgccatgatcttctccgccaccggcagcgcgaaggccagggtcttgccggaccccgtgcgtgcgcgcgcgatcagatcc

SEQ ID NO: 44090 - DNA, 217 bp, Chlorella protothecoides
gcgtgtaaagccggctgcccgctgcctgtacgtgggatgtgggacatcgctgtgtgggggggtatgttgggaccgaggggagtgcaggtttggcctcgacgaggcgatcggtgtcggacagcgagtgtgctgcttggtctgcttgcaggggcctcgcaagggccaccactgtgcaccttgccaaagcatccatgcacccaccgagggtggtgccggc

SEQ ID NO: 44091 - DNA, 61 bp, Chlorella protothecoides
gctatgacttgggacagggtatcgggggggggacagagcctgcctgtctgcactggcccag

SEQ ID NO: 44092 - DNA, 76 bp, Chlorella protothecoides
tgagtcacccttacctcccacgcactggaggaaatcgcctcctccaccaccacccccaagtccgccaagcccacca

SEQ ID NO: 44093 - DNA, 61 bp, Chlorella protothecoides
atttttttggctcgcaggttggtgaaggggggtttcaagtccaccccatggtaatgcacac

SEQ ID NO: 44094 - DNA, 72 bp, Chlorella protothecoides
ggcactggtgcggtgccgcgtggccaatgcgacccccccccctgtgggtggtctgccagtgcccgaatggcg

SEQ ID NO: 44095 - DNA, 94 bp, Chlorella protothecoides
cgccgcccggcccggccccgcccaggccgctgcggccgccgttgcaggggcccagtggagtgtgatggagatggttgggggcctgtatgtggtg

SEQ ID NO: 44096 - DNA, 61 bp, Chlorella protothecoides
cctggcattcacgttgaatccagtggcagggaagggggggggggagcaaccacttgcaatg

SEQ ID NO: 44097 - DNA, 100 bp, Chlorella protothecoides
ggaagaggaaggggggaaggggggtgggggggggtatggagtttcgacagccaggggtacatgggcatgccctgatggagtaaacagcgcacgcctcgct

SEQ ID NO: 44098 - DNA, 61 bp, Chlorella protothecoides
tacgcgtgtcggcactccaccgaggaagcggggcgagccatagggcccgccaaaagcccga

SEQ ID NO: 44099 - DNA, 128 bp, Chlorella protothecoides
gcacggccgagcgagccggcgggcaggccctcgtctgccggcggggccgcaaacggccctccggcccccagcaggacgcccagggacccggcgccgcccagcgaacccaccgcggcttgctcgggggg

SEQ ID NO: 44100 - DNA, 61 bp, Chlorella protothecoides
ggtggtctcaagaatagagcggctactgcggtgaagcatagcgcacttggtctgcgctctt

SEQ ID NO: 44101 - DNA, 2877 bp, Chlorella protothecoides
  modified_base (167)..(176): a, c, t, g, unknown or other
  modified_base (895)..(904): a, c, t, g, unknown or other
  modified_base (1108)..(1117): a, c, t, g, unknown or other
  modified_base (1435)..(1444): a, c, t, g, unknown or other
  modified_base (1714)..(1723): a, c, t, g, unknown or other
  modified_base (1852)..(1901): a, c, t, g, unknown or other
  modified_base (2309)..(2318): a, c, t, g, unknown or other
  modified_base (2521)..(2530): a, c, t, g, unknown or other
ctcagggggggggtcacatctggtagatgcgagcgtgaggaaggggaggtggcgggaggcacgctggtatgcatgccgattcctgcctcggtcaaggatcgaggacccacaccccctcctccccatcccccccttgctccctcaccagcttcacgaggaagctgaannnnnnnnnnagggggggtcacatcttgtagatgcgagcgtgaggaaggggaggcggcgggaggcgcgctggtatgcattctgattcctgcctcggccagaaattgaggacccacaccccctcctccccatttcccccttcctccctcaccagcttcacgaggaagctgaagcgggtgacggccgagcagggcgcgcagttcgtgtcctacgacccccgcaccggcacctggcgcttcacggtggagcacttttcgcgctacggcctctttgatgatgaggacgacgacgaggacgacgaggaggggcgttcgggcgaccacggcgcaggagtgggccaggagaagccgaccccagtcggcccggcgtcggcgcggcgcggccgccggcgccaggtcgtggactccgacggcgaggggggcagcccaggcgccgccgatccggacagtccccggggactggctggcgcgcggcccccaccctcggcggggctggggctggcctgggaggaggacgacgaggaggagcgggaggacatgcagcagagtgcgtgctgcgtcgtgtgcgggcgccggggggcttggagaggggcttgttcagggtgttctggtggaggggatggagtgcaactgaaacgtcgggggggcatcgatggtttggatttgaggcgttgaggcggaggcgggggcatcggttggaccccccgccgcctggtccccgtgcgatccgnnnnnnnnnncactgaaacgtagggggggcatggatggtttggatgtgaggcgtcgaggcggaggcgggggcatcggtggccccccccgccgcctggtccccgtgcgatccgggacctcggcccatcacatgacatctccacaccccaccttccctctggcacgcaggcgacggcgcgagcgtcagcggggaggcgtcggacgagagcttcggnnnnnnnnnngcgtctccacaccccaccgtccctctgtccccgcaggcgacggcgcgagcggcagcggggaggcgtcggacgagagcttcgggggcgcactggcccgcttcgtccccggcggccgcgcgcaggattttgggggggctcccaccctggtgacatcgctgcctgccagggtgggagcctctgagccggaagacctgcagcgaatcgggtaaggtgccctggatgggctctgatggcagggtttgggtgtgttctggtgggttggtgggagggcaataccttgcgaggcctgtgaggtggaggccgcgacgacggggagannnnnnnnnngaggtgccctgggtgggctctgatggcagggtttgagtgtgttttggtgggttggtgagagggcgataccttgcgaggcttgtgaggtggaggccgcgacgacggggagagtcggccctgatcccgtcggtccacccccgtcccgatctccagagaggggctgtttggcgcgacgcagtcccgcgggagcggcattgcccggccggggcgggcgggtgcgcgccgcggcactgcagccggcaccccggccgggcgccggtcgggcgccgnnnnnnnnnncgcccggccggggcgggcggctgcgcgccgcggcactgcagctggcaccccggccggccgccggtcgggcgccggggcgtactcggggccagcagaggcgtggggccagctggacgcagtggccgccgnnnnnnnnnnnnnnnnnnnnnnnnnnnnnnnnnnnnnnnnnnnnnnnnnnccccgccgaccccgcacccctgcgcaagaacaactgggtgagaacgccccccgcgctgctcccacccccagcgcatcccgccgcgggtgccctgcccagccctgaggagctggccctggcctccccgggcctggcggagatgcccgggccacgcagggtgcccacgggccccgccacggcgcagggccacacccgctgccgcgtcggggctcacccagtcaccccggcggccgatgcggccgaccgggcggaccccgcccgctggctggggcggtcctggcgcgccgggtgggcgccctccggcctcctcgcccacccaggtgcggtttggggggcgcgtgtggacggagacgctctggccttgcatgccgcagtgttcactggctgcccctcgatcgacccgtgcannnnnnnnnnaacggagacgctcctcggcttgcatgccgcagtgctcactggctgcccctcgatcgacccgtgcatgccgccgccgctcgggaccccacgtacgcctcggcgccggccccctcccgaccccagtgcactgccaccctggtcccctcacacgcacacgatccgatcactggcacaggcgggagcgaggccagcgcggcgcaccnnnnnnnnnnggggcccccacgtacgccccggcgccggccccctcccgaccccagtgccccgccaccctggaccccccacaagcacacgatccgatcaccggcgcaggcgggagcgaggccagcgcggcgcacctggtggtggagcgctcgcccgccgcgcgcgccggggtcgcggcgaccgagaaggcgagccacctggaggccctgctgcgcatccacctgcggcacagcgtggcggaggcgccgggggggccgagcgccgagcccacccgctgcccctcctggcgcctggcctgcccgcgcacggcgggcctgcgcgccctcaccgccgacctgctgcgcgcctgcggcgaggc

SEQ ID NO: 44102 - DNA, 61 bp, Chlorella protothecoides
acaaagcccgtggctgccatccttgctggggggtgactccgcccccatagcctccaagact

SEQ ID NO: 44103 - DNA, 97 bp, Chlorella protothecoides
tccggggcttggtgtccgcgccaggatcgtccagcccgagcccgcgcacccccaatctcacctcccctttcctccttcccacccccgccgccaggtg

SEQ ID NO: 44104 - DNA, 75 bp, Chlorella protothecoides
ccagggggacccgctcgcggcccgggtggcctgctggccacccccaggcgcgacgggcgcgggggggcttcccag

SEQ ID NO: 44105 - DNA, 63 bp, Chlorella protothecoides
cccccccccaagccagcctctcatgcgccgtgggtcggcagagacttgctccccaagacaccc

SEQ ID NO: 44106 - DNA, 77 bp, Chlorella protothecoides
tggcgcagtccctcgccgacagccgcgccgcggcctgtgcggccgcggcgggcccgccccgggcgaagaggaagaag

SEQ ID NO: 44107 - DNA, 16035 bp, Chlorella protothecoides
  modified_base (104)..(113): a, c, t, g, unknown or other
  modified_base (619)..(628): a, c, t, g, unknown or other
  modified_base (1130)..(1139): a, c, t, g, unknown or other
  modified_base (3050)..(3059): a, c, t, g, unknown or other
  modified_base (3934)..(3943): a, c, t, g, unknown or other
  modified_base (9639)..(9648): a, c, t, g, unknown or other
  modified_base (9972)..(9981): a, c, t, g, unknown or other
  modified_base (13415)..(13424): a, c, t, g, unknown or other
  modified_base (13988)..(13997): a, c, t, g, unknown or other
  modified_base (14821)..(14830): a, c, t, g, unknown or other
  modified_base (15249)..(15258): a, c, t, g, unknown or other
  modified_base (15805)..(15814): a, c, t, g, unknown or other
cgcgcgggcgcagctcgcggcctctctcttcggcggccggggggcccaggccgacacaggcgccggcggcgcaggggtgggcaggggcgtggggaggagccctnnnnnnnnnntggcggcgggggggcccaggccggcacaggcgccgccggcgccggggtgggcaggggcgtggggaggagccctgcggcggcgcggggggcacgtgctcagccggcccaggctcccgccgcgcctgcgcccgacctgttgggcgatctgctgggagaggaccctgtcgacctgggatcccagcagccatcgggcaacgggcatgccaacgagacagacctcttctttgggggcggggtggtgggtctggagagcgtggcgcaccagccagagcgtgagcagcagcagacccccctcaatgcccccagcgacccctttgccatgctggaggggctgcagacgagcgggcagtccgccccagtgcaggactacgacccgtttggcggagccttcctcggacccacgcccgttgcatctgcggccgacggcgcccgaccgccgccggggctggcctccccatcgccggccacctcgtcgcccaactggaacctggggggcgtgggcatgnnnnnnnnnnacccgaccgctgccggggctggcctccccaccgccggccacctcgtcacccaactggaacctggggggcgtgggcatgcgggcgatggcgggcggtgccatgcagaaagcgcagtcgcccccgcctgccaagaaggctgcagacccctttgccgatctgctggggtagcgcccgcttgcttgctgcctgtgaacgctctcctgagcgcgctgatgcttgggccaaattttcaatagagaagcaggatcccacgagcaggagcggcaggtgcaagagtttgtgaaagggctttgcgagcgcagcactcgaaagttcatacatgagggtcagatcatctggttgggagggttctgagtacccctcggccaactcgcgcccaggggaccagcgcccaacacccgtaatcgaggacaagccaagtaccagaattaaatctcggtaattctcgtttctccacgcatgcattcctgatgtatattatgctcatctgaggggctaggcnnnnnnnnnnacgaggacaagccaagtaccagaataaaatctcggtaattctcgttactccacgcatgaattcctggtgtatattatgctcatctgaggggctaggcgcacaggtgggttccacactgggcgacacccagtctcgtgtccgaggtgtccaagagtcgcggaataggatcgacaagtgacgggggatcccgaaaccctccatgtcggtgcacgagcaagtgggctggctctctctggccgcggcagcgggattcggcgctgcaggctggtggtggctggtgcagcaccggcccccccgggaaatcatcctgctttccctggacggccacgccgtcgcgcaccccattcccactgatggaacccagctccctgtttcctacctcttgacgggccccgcggccctggcgcgggtgcaggcggcccccccagcccaggctccccaggtagctcccaggctggtggaggacccccccgccgccccgcaggcggaggaggagccggaggtaccagaggccttcctggaccccatctccctgggcatagcccatgaccctgtcgtcctggtgggcacaggcgccatctacagccgggagtccctcttccagtggctggccacgggatcccgcgtctgccccaagaccaacatactgctcaaggacatcgaggttgggatgcagaggatgtgtgggggaggtggtgctgaggattgggagggggagcgcttgctgcgtgtgatttgagggatgccactccgaccctgtgaccatggccggcacaggccgaattttgccctccctcagcaatcacattcatcccctatagcgtgctggcatggtccctccaaccccctcaaaacgtcaatccccccccaggtcgtgccgctgacggccctgcgccagaccatccgggagtggtgcgagcggcacggcgtggcccagccgcaggctgcgaacgccgccgcgaatgaggccgcgctcgccccactcggccccgaactgcaggggctgttggcctcgctgcgtggcggggacgtgcgattgcgcggcgtggcggccggcaagatcaacaacatgttcatcgactggcagcgaacgccagccatcctggacatggccgaggcccgcaccgcagccttcaaggtgtggagcctggagcgggctgcatggcgagaagggcttcggcagggcaggcgacgagcaagcatgggggaccgtggatgcggtgttgtgtcgttggcgaggcccatgccagcctccccggcgcatgttgtgctgattcttcaccgcatgccatgcaccagggagatgcatgttgtcagcgtggccaggaggtgaagctgccaccttgctcccccccctctcccacccaacccccccctcaggacatgatgctggacctgctctggctgctgcgccacggcgactactacggcgccggcgtggcggcggcggccctcagccaggccgacgccgccatgcgtgtgggcgaggatgtgcgccacctgctggccacgctgggcgcgctgccggcggcgcgcctgctgcacgccaccgacgtgtatgcgcagcactcggcagcgcgcttcctgtccatcatgcgcggcctgctgggcggcgagctggccgcgcacgtggcgggggcgggcgcgctgagcgcgctgtgccgccagctgcagcccggcttcccctacgtgcgctgctccgcggccgtagccatcgtgggcatcatggagcaccagcccaaccgcaccgagctgaggcgcgtcggcggggtgcaggccctgcgccgcatggtggtcgaggtctatgaagcgggtgagaggggacagggggatgggccagggagtgggtgcacgatcgtgaggggtgcagtcatgtgtgtggttcatatggggaagtaggactgctcagtnnnnnnnnnngaggggaatgggcgagggagtgggtgcactatcatgaggggtgcagtcatgtgtgaggttcatatggggaagtaggactgctcagttgtcagttccagggagtctcacagagcaaggggcatttttacagggcttcgcatgggtgcggggcctcaagagcctcataaaactgtaccccctttgatgccgccccgcaaaattatttcccgccacccctcccgcatcaccctctggcccgcagaggatgcgggccccaccaagcagatgcacgcgcggtacgactgccgcgacgcggcgcacgcgctgatcgccgcgtgtgcgacggacgaggagctggccggccaggttccggacagcttcgtggaccacgagggcgtcctggagctcaccgccgacatgctgcgcgtgtttcgcagctgcggccaggcctggatcgagggccgggtcccccggcccggtcaggggctggatccgcaggaggaggaggagctgacctcctctgacgaggaggcggcagaggcaggggaggaggcggaggaggaggaggcgcacgcgagggcagatgagagcgagtgggaaaccgacgaagagggggcgtgaagcatgcagcttcctgctcgtgatccacctgcagtgctctcctgcgggctcccgcatgctgtgtgccaggagtgtggggttcgccagtgctctgcagtctaacccgtgcattccaaagagcgcattacgcccaaccgaccatgtactattgggaaacactgaatggaatcatcaaaggcttgccgtgcataccaacctgactggggctgtcagccacggggccctgctacctctcgacccgggttggagaaagggcaagcatccccacgctcacnnnnnnnnnngactcgtgcattccaaagaacgtattacgcccaaccgaccatgtactattggaaaacactgaatggaatcatcaagggcttgccgtgcataccaacatggcaggggcaatcagccacggggccctgccacctctcgacccggggtggagaaagggcaagcatccccacgctcaccacatccccccaccctgcggcacgggatgctatttcgtgttggtaatggaatgagctttgcagaccgcacctggcacgcaaggtaggcgatgggagcgaggagcgaggtcgggagaccggtatggggtgcaggcccggctccgacaccaatgatggtacaaggagaggcgcgcgtccctcgcacaagcgtcccggtctatagcattgcacatttcactactttcgcacatcgattccatcccagattcgaagttcgcatcggatctgacactctgattctggggctaaacaccatggacgatgacctcgagttcctcatggacaccgtctccgaggaggaggaatccgatggagtgagcctccccgggcagctgacatgttttagacagtgcatgaaatttcacccatcatctcgaattgcgtgccggatgctgccctcgtgcggcggtactcgggattgtagtcccttccgaaaccctccctctgaccggtccgtggcctgccagtacattggtattggcagttgtcccacaagacctctttcccttcccgcctcccaggagcctgctggccagccagttcagaggacacaagccaaccgcctccccctgcaccagtttctgcgcttgatagcgggcgggcgcatggtcgaccatgggacggcggcgagcaacgatgaccttgtggccgccttgaagcgcggaggggtgatccaaaggtaggcttggacgcacggtgatgtcagagtccccgctgaacaagaggttgtgccaaggctgggagccttgcactgtcagtccccttgtcttgagaaaggttgctcccctgtgtctccatcgccagaactccatcatgtgctccctgcagtgacctggtggcacgagccatgagggcctgcccccgcgacgcctttgtccccgaagagtaccgctacgaggccctggcagactcgcccatacggctggagagcatggagttcaacgtttcggcccctcacatgcacgccacctgcatcgaggccctcgacatcaagcccggccacagggtgtgtttgtgttgtttgggggtttcctacattggggctcagcaggctgtagtggcaggtggagacctacatgccttcagttcacagtgcgattggttcatgagcactgggacatcattctgcggacggccaacccgcgagtgcgctgacactcccctgtgctcgggacccgagcagccatccgccacatcccgacctggtcgaccccgcccccctcaccttaggtcctggatgtcgggtgcgggtgcggcatcctggccgcctgcgccgccttcatggtgggcagggctggctccgtggtgggcatcgacgtccggcgccaagcggtgcgcctgagccgcgacaacgtgcggcggctggcggcggccggcaccgaatacgcggccacggcctgcgaggtcgacttccgagcgcgcgacgtcttcctgccctccgcgcgtctgcgcgcccgcttcgaccgcgtgcacgtcggcgcgtcctgtccgccggagcggctggggcccctgctggccctgttggggccgggggggggccgcatcgtggtgcccgtggcgcccagcgacctgcgtgtcatcacccgcgcgcccgacggcgccgtcacccagcgcgtgttgagccaggtgcgattcagcgagctggaggtgccgggggacgcgcgcatgctgctggccatgctgagggcggatcgcaaggcgcgcaccacgcccgcggccctgcccagcacctacctggccgacctggcgggcatgcagggtgagtgtggaggggggcctgatccatgtgctgtgagggatggggaggcacaggggtgtggatggggaagagtcaacttgcgagggtgtgggggacatcatgtctgatggtgcgtcgagcacgagtaaagcttaggtggctgtcttcaaagcgtcaggcaaccgagcccacggggggccgccgcctcctcctgctgcgtctggagactggagtgggtgtgcatgaaggtcggcttgcactccccgccaccccatccacctggtcccccttccatccaggctcgatggcgcgggccgcaatgagctccaagggtgtgctcgggcagtcgccctgctcgccccaggcaggcaagttggaggtgtaggatgccggtgaggtgcagtgagacatgcgtcgcgagccgtaaagcgaatgcggtgcgctccccaaacaggagcatctgcggcgcatggtcgaaaactcatacgaccaacacctcgcacgcccacccccacgcagtctgggagctgcccacgtcccccttgggatcggagagcagctggccccgccggctgtcgtccttcctgagctcctgcagcgggagcagcagggatgccggacctcaaggtgcgcttgagtgggcagatcatgcttctgcctctatggtatggttcaggggcagagtgattcgtccctgcaggaggcccagaactgatcatgggaagagtgcacccgaacccacccatactgctggtgcccgctacgcacctccccccccttcgaggctgacgtcctgccaccgcccgcagatgaagccacctcgctcaaggacagcgtggaccctgccgtggtgctgcggtgcctgggctccccagacatctccctcgtcgggaagggctatgttctccccgtgcacaggcaagcggccgtgcacaggcttgtcattccgtgcctgcgcagctggagagtgcagagggaagtgatggtcttgacatgaatccaatatgttcttcaccatgtcctcctctcccaccggtcctccttgcagcgaggtgctgcggcagcgttgcgagcacttccgggcgcggtgcgagagcggcatgcgggacgcggcggtggagacgatccccgtgccagaccacttttcgcgccagggtgtggaggccctcatcgagtacatgtaccatgacgtggtggtcaaggacgccgaccccgacgtgcggcgaggctggtgtggggcctgggtggatggggaaggtggggagggtggggggctcagcaccctgccctaggaggtctggtgtctgaagctgcaggtgcctctcgggcgcggtgtggcacacccatctccctaccgggttgacccttctcctgccgggcaaccagtcgccagcctgctgcaggcatgtctgtcccccccccaacacacacacgcacaatgtcaaccaggcatctgctcgttcttgcctcccctgccagatggcgctggccacgctgcatgtggcgcagtactatggcgtcccccgcctcgtccaggagagcgagcggaccctggcgggaatcctgctgcagaagcgagccgcgagcgacacccaggagggtgagagcgcgtgggggccctgctggactctcctgctttagcttggggtaacatgccaggacggaggttgtgttggcctcggcaatcagtgtggagggggccagcagagcctgtgcctgagacatgggcccttttgtgtggtcctcagtccttggcgagacaagttctggctccaccacggcacccacctgtgcctcgtttcactacgactcctgagcctctccatgcgctcacaaatcccacactctccattgcagatctggccgccacggcccccgccctgctgaccctcgccgacgacagtgggctgggtcacctacgctccgtggcacttgattacatcatcacccactacgacgcggtggcgcagcagccggcctttgctgcgctgtccaaagagcaggtcgccatggtggcgcgggaggcctgtgcgctgcatggccgtgtgctgagcgcgctgcgctgcgtgggcagggacgaggtgctcctccccgaccccgtttaccagtgaggtcgagacagggggagtgcggcagtgggtggcggctcccctttgagggccatcagagagggggtttggacgtggccctgcatccagggcatcactgcgtcgcctgttctggtgcacctgctctgctgttgctgcaccgaagccagccaagggcgcagcccgcaccgtgtaccacgcattcttgtacaaaaaggctaggctccagtagcttttcttcgacggcccactgtatctcatcgtatcgccacacatgcacagccattgtcattgtttccccctttgttgtatgtgcgtttcccatggcttttgtacattgacggctggctgctctgtggttgtcaagcacccagggtgtgaggggagctgctgtacggataggtatgcatgcagggagagtcttcatttgtattctggcgacagggttgcctgtgcagtgcatacagtcttatacacacagtatagtgccagccccccagggtctgcagggcaatcagtgcatccttactcgcagacgcacccctcacagctgcaccgtcgccacctggggcgccggtgaccgcttctcggccaccgcgctgttcacgtgcgtggctgcggcctccagtgccgtcctttcctcctggctggccggctgctcaccgcgcagcacatgccacatggtcgcctgcagggccagcagtggggcgccgccgcccgacaccagcccgtgcatggcctcagggacgcggcacaccctggctgcagcccagggtcggtgcatcagggaggaaagcagggcatgacgggcacgcatctcgtccacattcccggggcgcaccgcgccgagcacagccggccactccgaggctggaaaggggttggatggtagtggaggggttcgaatcggtgagaggtgccatgcggtgggcagagaatgttcagagggaggagggtggaagagagcatgctgctctccacaccaggctcagtctgtcgtgaggcacagggccgccctgccaggacctcccctcttcacttctgctttagctgcaggaattcaacgctctggtagccttcctttcgatcgcttgaatgcattccgacaatcacattgcacacaccccaactgccacccgacgggcctgccggtgaccgcacgcccacatcccctatgcttctcaccttgaccttcctcaacaaaggcgtggagcgcagcctcagcgtcggtggggagcagggagtcaagtccagtctgctggcccttctcttccccctctccccctgccagtcccgccaaagccgcttgggcggccccacgaaccgatgcgttgtgtgcctcctcccccagcgccagactcaccaggaccgccccgggcctggcagggtccagcaagaagagggccgcagcagtgcgactgcgactcatagcggtcactgcaatgacacatcatttgagtgggcctttgtcagggtggaaagcatggcagagagagcaatgggcatggagatattggcagccaggcctctgcaccattctactatggaatacactcagccatatcatcaagctcgcagctttgagacgaacctgccatcccctccaacacctgcatgcagggccgcatagggctctggctgcagcagagcggccgcgnnnnnnnnnnagacgaacctgccatcccctctaacacctgcatgcagggccgcgtagggctctggctgcagcagagcggccgcgaccgctgcaatgaatgggcccagccgatcctgctgcgaggcgaggaagacctcgctgtccccgccccttcccaccagcttggctgccgcctgtgggaattgtggcgtccagtgacctgaccaggcccaaactttaccaacggctcgcacagtaagcccttcccagtgccacatcaaaagcagaagggggggccccctgcgatacatgataccgatcctccccttcttccctcccacccatcccagcacannnnnnnnnngcagaaggagcagccccctgcgagacatgataccaatccttcccttcttccctcccacccatcccagcacactcaccacgagcgtagcatcgcggacgagctcctcctcgctgcccaagaactcctgcagcaccccttgcaggctgtccagcagcgcgacggccgccctgcaggctcgccgccccttcccgatctgctgcagcagctccatggaggtcacgctggcgagcacgtctcccctactgccctccagcgctccccgcacggcggggagcaggggcgccgccagatcggcgtcccgatacaccacttccagcgccactgccagagcgcgcaggcgcggcgcggcggtggggaggagcgcgacgcggtgcagctcttcccgcaaccctgctgcgcggcacagcagcgcgccgggcgtggcagcgccgagcagccgccctgcggcgatccccgcgccggcctcccctgcatcctcctcgcccacaatgccgatcagcctcccgcaggcgtccaccttccaggcctccggatagtgcacatcggcgagggcccggtggagctggtcggaggctgtcgtccgcacggccgccaggggcgagtgcagggcaaaaagtgcaaaggggagccactcctccctcctggtcacgcctgaaggtgggacggtgggggttggggggaagagtagcattgggtttaaactgtggaatccagatggctgctcgctcatacggctacaatctagaatgacagttgccacgcactgtgcttcattcacagcagtacaccagccactccttggtgggacaaccgcgaccccccagtgcagaacgattcctaaaggctgtgagccaccctcgccgtctcacaagtgatatcgtgtaccccacaccaagcattacctgcttcggtgttcagcgcggcgccgatgctgccgcagatctcccggacatgctcaggttcaaggtgggtgtctcggagctcgctgcatttgggaagaagggaggcgtggagtgagcacagaccgatacgcgccctcccggatacaccaaacctcatctgatgatgacctccagtgcgtacctgatcgccttctccaatggccaagcgtccaagaaggcattagcagcttcctcactcaattctggtccaagtttcgcaatatgcgctgcggcgcttatatacgcctcgcgggtcatggagccttaccaggaaacgatagaaacctgtttgggttttaatcatcaatgctccagatgcgatgcctgtggccttcacgagtaagccgacgcgctggaattacgtcacgtcgttcgggcggatctacacaagatactacctcttcaacataggaaaacgctcgaaggacatcatgggagtgcacaagggcatgcctaatgtaggtatatccaagcagcctgttcaagcatggaggcgggtgtgaaagcttattggaaaaacgctgtgcattcagaaggagggggctgatgtcaggaaagatcctggaccgcaaattaggcctcatgcaccttctccgacaaaacgaaacctctgatgcatggtgtcgagaccatacatcatacatcttgcaactttccaaccaacatagaacttgacatccaagaaatagattgagtaatagatcttttgcgtgcaatcttcgctgaaagcttccctcgtctgcccatgcattcgatgggaatggcttcccagagcacgatacagtcgctctccagcaatcaactgcgagcaaggacctgcctgacctccactgcgtttggatgtcgcctcccacgaccgcggcgagccgtcccagcccctgctctgggcgacgacttgcgagccgcggcagccagcaccgccagccacatgcgagggctgatagaggagcaggagctccgcgagcgtttgaggacggcaggcaccggtgtcgcgcaaggcgtgaagggtgggctggcgaggacggggcgggccttccagtcgctggactcccggttctccatcaggcagcggctgggggatgtggctgcccaggcccaccgcggcgcagtggccgtggacaggcagctcggcctgcggcagcgtgctggggactggtgggaggatttcctgcgcctctggccggcggtgaggtggtctctggatggtgccatgcctggcttttctcccccgacaagcctcgcgccccacgtgcgtgcccatcggaccccccccccttctcctccttgaactccgcgacagaggagacagcggctgcaggctctcatgcgcacgccactgggaaagggcctggccctcggcctcttcttggtgggctgtcggacaggattagtcatgctggccctcaacctgctgttcgccgccacttggctcaccccgctggccctcatgctgctggcgcggggcgcgagccagacggcgcagcgtgcggcggcgcagcaggcgcagcggcaggcggcccagcagacgcagcagcgcacgatgtttgacgccatgctgcgctccatgcggcggggcgggggcaaggccgcacggcaaccccaggggtcggttgtcgacgtggagtgggacaccgtggatggatagcttgaagtgggctgcctggagtaacgatacagctgctggcccctggaagcattcccacggtctctcccaggagcccctcccgcaacaagcgaaccgcctgcgatcattgcatgccttgccccttgcccaaaccatgctcacccctgccctcttcagctcacagtgtacaagtggcagacaggcccgctcctggccagccggcagcgaggggacacattgtgcgtgcctgggaatacacaatgcaacatgcactatggtacaggagggggttgggagtggcagggcaggggcctgtgctgtcgagcagtggcgcgtcagcatatgacccaggccagggtggtcagtcccagcagcgcagccgatgcccaggccacacgctggggccggtccagggccacggacacgacatgcccgctgcgcttgcacagcactttgtacccagcggcgagcagagcctccagcctccctgccatgcccttgtctctcagcgagggttgccaggcctggtgcgggtgtggtcggccagttgctgagacggtctcctgcatgtgtggaataggaaggaggctggcatgactccctggagcttcatagtatgcacagcactggacactctaagccaaaatgctggtcttggagtgaggtgattggcccccatatcgatcttcattcatgtacttgtgccttttactgacagtcttgtagggatctccggccagcaccattcttggctacccctttttactgagctaaactcgtccataccgacctggcgcatgatgtcaagcttgttgatcagcttctggacggcgccaagggcttgtggccgggcatagtccacaaagtcnnnnnnnnnnaacaatcttgcagggatctccggccagcaccattcttggccacccctttttactgatctaaactcgtccataccgacctggcgcatgatgtcaagctttttgatcagcttctggacggcgccaatggcttgtggccgggcatagtccacaaagtccaccatcatctgcagaaccaggagggcattggggactgacaatcctcctccgtccctgcccgacaccgtgggacgacctcaaacacctgtgtacctggaaaatgcatgagatgcagctgatgatgagctccaaggtcaagacggcgaagatgagggggtcccgtactgtgttgtcattggtgtcgaaagaaccctcctgcgtacgtgggtgacggaaatgtgcgagtggcgaggcatggcttgggattacagctttgaaattcacacaattcccacatgattctactgacgtcgggaagtggggaggaggggggtggagtttggcatgtcggggtctcggcaccctcgtccttgaggagggctggcctctcctccaactcgccgtcctgccccaccatgacatagtcannnnnnnnnntcttgaggagggctggcctctcctccaattcgccgtcctgccccaccatgacatagtcatcggcatccattatcagactcgactcaatacgagctggtgggtccgcggaacggaagatgtcgttctttttcgtggagggatgctcccacatgattccaacacgagcgaacgctcccagtttctgggcgcgagggtgattcggatttggagcacgtgatcgcgtgactcccagcgctttggtgaaacccacgaaaaatggcgctctgtgcacagctgacagcgatacgtgtacagcaaacggcagcatggtcatgacttctgatgccttgtatcaaggtgaataccagcttctggccctctcgaggacggccagccagtccagccagaccccaagcacggcacccatcacttccgccgccgcccgcgctccttaatgctcagctgcagcgtgtcccccggcgcgacgttgtagtgcgccagcgacagctcatcgcgcaggaagcccagcccctccgcgctcaagcgttgcttgttggccgggatggccagggcgggcaccagcaggtccttgaaagccagcaccgtcaggcccaggctcggggcatgcaccggcaccgtctgccccgtcagcgtctcgtggccctccaccgccgcgcacgccaccaggatctggagcacagggggtgaggagggggtgaggcaggagccgaagagggggaggggacgaacagcctaagctccacaagacatggatctctggcgttggtccttgataggcccaggcgaccttccgggaacctcatccccgcgaaatccttggctgnnnnnnnnnntgagagggggtgaggcaggagccgaaagggggagggaacggacagcctgggttccacaagacgtggatctcgggcgtgggtccttgataggcccaggcgaccttccaggaacctcatccccgcgaaatccttggctggggcctcgtgcgtcatgtctctgctcgtatcacatccccatcctcccaccatgatatcttccctcgagtaacaactcctctcccaaggttctccgccccccctcacctcgcactgtcctgggtgggtctccagccactcctcctcaggctccagcatgtcgatcttggcacgcttggccggcggctccccctctggcagcgggggcgggtggctcccctctgccgcgccgtccggcgtcgaccccggcagcgggggcgccagcgtgacggggaggggcgcgnnnnnnnnnnccccctctgccacgccgtccgacgtcgaccccggcagggggggcgccagcgtgacggggaggggcgcggggaaggaggaacccgggagtaccatgcccggcgcgggcgtcggggcaatgccggcgccgggcggcggcaatggcgcgggcgacggccgcgccacgctggctcgtggcggcaccgcgaagatggcggcggccgccgtgcccggggcggcgggcggggccatgccctttgggtacactttgggtgctggcggggagccgggggcggggccctcctccccctcgcccggccctgtcatcgaggcagggcccggcgccggctcggcagccccgtctgcggccgatggcgtggggccaccgctggggtcagcaggcagaggtgcggcagcgtcggcggcgcccgcaggcaaaggcgcggcgacgtccacagtctctagcaccgcttcttgcggcgggagcgccgagggagcgggcacagcagccacgggcacgggcaacgcttgcgggacgggcgggggccgggggaagcccggcggccaggnnnnnnnnnntcgagggagcgggcacagcaggcacgggcacgggtacgggtaccgcttgcgggacgagcgggggccgggggaagcccggcggccaggccgacatgcccctgggcggcggcggcagcgccgcgtcgccgctggagccggcctcgaggcccaggtgtgcaccctgcgggtcgtacgcgtgcgcggctaccccaggcgccggcggctgcagggacggcggggcg

SEQ ID NO: 44108 - DNA, 61 bp, Chlorella protothecoides
gtgtcgcactgtttgatcgggggggcgggggggaggaagtcggcgccctggagctcgaggg

SEQ ID NO: 44109 - DNA, 463 bp, Chlorella protothecoides
  modified_base (180)..(256): a, c, t, g, unknown or other
ggcgcgtccacgccctcgcgccgcgtcccgcgcccgctggcctcgcccggcagcgggcgcggcacgggactgggcggcgcctcgcccatgcccgcctggatggcgctggcggagtcggacctgctgggcgagggcgacctgagcaacctgcccgacctggggtacctcacctcccccggnnnnnnnnnnnnnnnnnnnnnnnnnnnnnnnnnnnnnnnnnnnnnnnnnnnnnnnnnnnnnnnnnnnnnnnnnnnnncttccccccgggccacgtcgcctcgcccgcgcaccccatgccccgcctgcgccggcgcaagttcgctccggagcgcagcccgcccatggtgtcccccatcaagtccctgttcgcgcggcgccagtcgctgggtgcgggcgcgggcggccccgccgccgcgctgctcggcgcctcgggcctcggcgcctttgccgcggcgggggccgg

SEQ ID NO: 44110 - DNA, 76 bp, Chlorella protothecoides
gtgtgaggtggacgcgcggggctcgggcgcagaagggccggggccggcctcggtgctcctgctccgatctgcaggc

SEQ ID NO: 44111 - DNA, 73 bp, Chlorella protothecoides
ctgagactggactgcaactggcatccagaccaccccccctccccccgttgcagctgctctgccgatgccccgc

SEQ ID NO: 44112 - DNA, 75 bp, Chlorella protothecoides
gcggcggcccccgtggcctcacccccccgggtgcgggatgctgccgcccccctcagcgggaaggcagccggcgcc

SEQ ID NO: 44113 - DNA, 762 bp, Chlorella protothecoides
  modified_base (184)..(193): a, c, t, g, unknown or other
  modified_base (282)..(351): a, c, t, g, unknown or other
gggggaaggggggaggctcgagggggatgggaagggggtcacgagggctttgaccgccgaggaggctggcggagcgatgggaggggccccatgcccctgtgcatcgcggtgcccgggggtgtgcccccttgctgactggagacccaacccctccccccccatccctcctcgtggaaaccccttnnnnnnnnnntcctgtgcatcgcggtgcccgggtgtgtgccccttgctgaccggagacgcaaacccctcccccccatccctcctcgtggaaaccccttnnnnnnnnnnnnnnnnnnnnnnnnnnnnnnnnnnnnnnnnnnnnnnnnnnnnnnnnnnnnnnnnnnnnnnccctccacggccctccagatgaggggcgcggggtcttcgcgcccctccttgctcccgcgcgggtggttgtaggccagccaggagaggtggtagcagtgcaggtccacgaagacaaagtcggcggaggcgacgtcgcgcgcggcgtgggaggagttgcgtatggcggcggccagccaggcctccgtggagtactggaagtcggcgggggccagcgcgtcggcgccgtcgatgcccgcgccgggggcggcaaagggccaggtggcggggtcggcgaggtcgcaggcggggcccgacccctcctgcgccagctcccgcgccgcgtccagcacgtagatcttgcacccctccagtcccggggcgggcccctcgtcctccgcggccagcgaggcgaccaccgacgcggcgcggggc

SEQ ID NO: 44114 - DNA, 66 bp, Chlorella protothecoides
tttgagcgcacgaggaggatggggagcgggggtggggggtgcacggctgcccaccctctcgcctgc

SEQ ID NO: 44115 - DNA, 61 bp, Chlorella protothecoides
attgacacaatccgcctttctgtctgcagggggagacccctgagtttgtccagatggtcaa

SEQ ID NO: 44116 - DNA, 72 bp, Chlorella protothecoides
ctggcccgactcttgcgccagaagggcgtgacggtcacgccgcagttggagcaggtgcgggagccctcgctg

SEQ ID NO: 44117 - DNA, 10700 bp, Chlorella protothecoides
  modified_base (101)..(186): a, c, t, g, unknown or other
gccgcccgcctgccgcccgccctccctgcgcccgccgccctggctcccgccctgccggtacccgctgccgccgccgcgcgactgccccccccccccccccnnnnnnnnnnnnnnnnnnnnnnnnnnnnnnnnnnnnnnnnnnnnnnnnnnnnnnnnnnnnnnnnnnnnnnnnnnnnnnnnnnnnnngtatcgtagaacccggcgtctgagtcctcgccggggacgaacgcgccgggcgcgcggtggaagctggtcgccgcgtccgcgccgccctgctggcgcggctcctggtactggctgcgcccctgccgggcctcctgatactccccgccccgagccccgtgccccgcctgctgctggtactcgggaaagccctgggagcgggggggcgcacgccccgccgcgccgtactgcccgttggggaagccgcgggagggcggggcgccggccaccgcgtcggggggcgggccgtacccctgcgtggggtggtagcggttgccgccggcggcggagtcgtactggcccgccgcggcggcggcctccgcctgagcacggcgcaggctggacatgcgcggccccgagccagacatggctgtctcaagggccagtttctgtgtgtgtggggggggtccgagggggggagttggaggggaagtgggtgggtcgggaggtggggtgggatcactgagggccgcgcgtgcggtcgaggaggtcccacgcacggcagggcgggacggagggaagcgtgcacggatgacaagatgcctgccagccaccacgccccacgattcggtcgcaggacacacactggcggcacagcccacgcgacacacacctcaaagccgcccaggagctccgccaacttctccttctgcacggccacctcgctgttgagctccgccttcttctcggcatcctcctcggcctcggcggtctcctctgcctgcctaatcacagcctcctgggccttcttctcgtccagctggctgggactcaggcgcagctgaggaggagagggtgcagggggagtcgatggtttggccccatgggaaagattacgaacggcagagacttttgagagctgctgcttgggccccccagcattcctgccgcgggcacccagctctgtgtgggaccccggctctgcgacgaagacccccggacgctccagcatcccagcctaaaccaaggcagcaagcgtacatgcaatttgtaggtggacttgacctcctccctgagcacctcctcctcggtcttccccacgcggccagcaatcacggcctctcggggttttgcgttgccgaaggggctctgcgcgcgagcagggatgggtcgtgagctccagcagtcaccgtgcaagcgaggtggtggctgcggcctcgatgagccacgacaaagcagtgtgatcgccacacatcttaccttcccaattgaagcctgtctctcagcctccatcctggccacggcctctggatccctcggcttcaggttcagccgcggccgggcgggcactgatggtgcggggggggcagtctcttggtccgtcatggcaggtctttgggggtttgaatggatgagtgggggcaacggtcctgtaacggactgtttcggcggtagttgctgcgacgccgggtgttatgacggggtctcccagcgccctggttgccacgccccccccagccaaagcagccaaaccaccccggcgcgcgcccggggggttgccaccttcacattcgatctgcttggatcgggggtggggggcaccctgtaacctgaaccttcagcagtcccacgacactatcaccattggcaaaagcttgagtggtgccgagcattgccgcctgcactgcaccgtcgtgcgtccctgcgggtgccggagcctgttcaccaggcgtggcctccaggcttcccttgaaggccgacgcaccgcacaatgccaaaacagcacccaaactccattgcggaccggatcttgttggcggtgaatctgctatgttgcgtgggcggcatttacggtgcctacctaacccaaggggttatgcaggagaccctgtccaccaagcggtttggcccggagctgaagcgcttcacgcacctccccgccctcaacggtgtccagagctgggcatgcttcgtgtgggcgtacgtgctcctcaagatctttgagaaggggtgggtgtgttggagagggtgtggaacttgaagggtcgctgctgtacccctggtgccggcccctgtttgcatagatgcacgggcacccctgctgttccacccctgaatttcgtctgtggactcttctgcaccccgcagccattcaaagatgccgcccatcactgcctactggaagcctgcggtgtccaacagcatcgggccggcctgcggaatgcaggccctcaagtacatctcctaccccgcccaagtgcttgccaagtcctccaagatgatccctgtcatgctggtcggcaccgtactgcacggaaagtcctactctgtcgtggagtacacctgctgctccctcatctcaggtgcgcagggatgctgggagggggtgcagacatcgaccctttggaaaggggccgccaggcagtgcggctggggcagtgggtgccaacccccacatccctgcccgaagaccataccgtccatcctctctccttccccctctccacacatgcagccggcatctccctcttcgccctgcgctcatccacaaaggtcaccagcaagctggcgcatcccaacgcccccctgggctacttcctctgctttgtcaacctgaccctggacgggtacaccaacgcagcccaggtggggagcccaggaataagtctgcccacaatcgctaccccgcctcctagcctgggtgtagttgtcagcctcctgagtgggcctaagactgacagcatgccacccgggggcagcagctgcctggcagccaccattcttaccgacaccctggcacaatttcctgcaggatgagatccatcggaagcatgagggcgggtctgcgctgcacatgatgtgctggatgaacttctggtgcggcctcttctatgtccccttcctctttggcctgaccaacacggggcgggagctgctggcattctgcatccagtacccagaggtgggctggcggaaatcatgcaggcaatggcacccaatttccttgatgcaagcctcctttactgttgtgcctgcgctggttgcccgggaggggtgcagatgcatgactgcctctgaagttctgctggatggaccccttgaggggtcggcgctgacaagctcgttgtggtggttggtcgtgcaatggcttgtgctttttgccagagatgcatctgccgtcaagcgatgtgtcaagcacccactccacatctagaatgtcccactccgaagccctcccccatgccaggcgggccgcgacgtcttgctcttctgcctctgcggcgccgtggggcagctcttcatcttccacaccatccggcgattcggtagcctgatcaacaccctcatcaccaccacccgcaagttcttcaacatcctgctgtcggtgctgtggagcggcaacccccttctggggcagcaatgggtggcggtggccatggtgttcggaggcctgctcgcctcctctgtctacaagagcaggcgccacgccatcccaggaaagaccaagcatgcttgagttggcttgtggcgtgagtgccctcaaccgcttggccccgtccaccgcccactgagagaaactcgtgcccccctttccaattagcattcgagtgccaaatccccgctctcaactccgctcgtaaatcctgcccacaggcagcagcggggagatggcttgaagacagatcagatcacttggggtgcacataatatccaccgcaagtcgaccgccgctgtcgtgtcacgggctgcgaaactgcccgcgctcatgacgtgaagcagtggaggagacgtcgcggccctagagctcgccaggcatggtgcagagccggcacgcacggtctgagccggcagtactggatgcacgccgggaggaggtgcgttcggggcccaggaggggggatgcagatcgtgcacgcgaattttccacgacctgcccctgcgcagcgccctgcggtgaacattctcgaaacctctcccgagcaggggtatggcatcgggacgcgtgtatcatgtgaggctacagtagacggcgtgcatcgtgagttggtggggtctagtggcgacgaggttgggggtattgggatgagggtgcacgaggtggtagtccctcgcttgggccccctttctggatgcgccctcgcatcaccggaacccacccctgcaccacagacccggcagagatagtggagcgcaagctggacaaggcaggtggcctccactactatgtccactacacagagtgtgagcggcggggaatggactgttcagattctccctctgccttttgtctagcgtgctctggtgtgtggaggatagccgtgcatgcctgggcactgccctcctttcctcggcttgcacttccccacacctttctcttactcctccccccccccccccagttgacaagcggctggacgagtgggtgcctgcttcccgcatctccggcctgcacagcgtgggcagcggggagggtctgtcccgcgccagcaccgcgccggcgtcggacctgctggcgggcctgacaggggaccagaagatgacgcggcgcctgaagcgccagtttgcggagatgcaccatgtgggccccggggtggaggagctgccccctctggaccagcacgcggagaaggagcaccaggagaagaccaaggttaagaacgtgcagagcatcgagctggggcggtaccagatggacacctggtactacagcccctaccccgagccgcacgcgtcctgcgagcggctgtacatctgcgagtacacgctgaagtacttccgcaagcggcgcacgctgctgcgccacctggccaagacccccctgcgcgcgccgcccggagacgagatctaccgctcgccgccgccgccggcgtcggacccgggccgtgtgggcggcgcgatcgcgtccccccccctctccatgtacgaggtggacgggaagaaggccaaggtgtactgccagaacctgtgcctgctcagcaagctgttcctagaccacaagacgctgtactacgacgtcgaccccttcctcttctacgtgctctgcgagcgcgatgcgcacggcagccacgtcgtaggctacttcagcaaggagaaggactcggcggaggggaacaacctggcgtgcatcctcaccctccccgcgcatcagcgcaaggggtatggccgcttcctcatcgccttctcctacgagctgagcaagaaggagggccggctgggcagcccggagcggccgctctccgacctgggcgccgtgtcataccgctcgtactggatgcgggccatcctggaggcgctgcgagatcaccgctctgccatgagcatcaaggacatcagcgaggccaccgccatccgcaccgacgatgtcgtgaagacgctcgagagcctgagtctgatcaaggtgtgtgagtcgatttttggggggggggttggggagggggggcgggtaacggaaagaatggcggaagtggcacggtgtctggatggaggaacgagggaggccgggaagaaagtggcagagggttgggagaggattctgcacggactcggtcggggagcgggtagagggatggtgcatgtcgccgtgcaaactggcgagcaccagtcctgatgaggctgcatcgtttcaactggctaggtaccacacccccttccaccctgaatcttaatcctcgcagtactggaagggagaccacatcatcagcgtgacccagaaaataatagaggagcacatgcgcaccatcgccaaccagaagacgatagacatcgacgtctccaggctacactggacgccatatggcaaattggacgggaggaggtagcgctccgtggcgcagccacccgcctgccctgccctctgtgcgtgcccgatgcgcatcctcatggcaaacgacgccttgacctgacctgacatgcattgtgaatgaggcctggactgggattgtgggcggctgggtggcttacccgggaggactgccggctctcttcgggtatagacttgcgaaaactcacaaacagattgccgggaagtcctcgagtaccttgttgacattcagataccgtatcttagccggtggacaatgcggaaagtgccccatgctgttcagcctcccgagggctcgttcgccgaggcgacacggttcccaccgaggccacaattcgcggtcgctgcaatggaaccctagtaacgcaggcaaacgtctccacacagcgcgtacacgacttcctctagagcgaaggctgcagcttcaccgcatcctctagacagaacctatttcctccaaacactttgaaatcgaaaaccatcccggatgctccaatcccttccgtccccttccggtgcactcactccaagctctttgctacacacaggactgggtttcgaccgagtactgcgcgtaattcctatgggcaaggcgaacctgaatgggtggagagaggcgacgccagccagcgtgaggggcagaccagcatgtctcgcctttgctttcagaagaccggctgcaagcacaagcccacaatcaagcagcttaggcaggactacaagaaaagcatcgccttttaccatgacatgagccacccagggcatgtcaatgacaccttggactgcccatgctcgtcttggtgggcaacagctcttgtggagagtttgctggataccaactctgcagtttccaatccaaacatctgtggagcggttcaaggagctgcgctgtgtgaagcaggcacacattcgttcgattacacctgtgtggccgacagcaagacgttccttaaagactacccagatctgtacagggactttacgatcaccccccaggacgtcccgtaagctgcttattgtggttgctcaggaccagcgtattgtgctgagcaagcgcaacgagcaacctttgagagccgtgggtggtgatcatatagtcctggtgcagaacagggaagtcccggaggaaggccatgccatcgtccacacaggagtactcggatccatgcctcgttcacttggcgcagctccttggacctctccccacatgtttgcattggggaagggagcgtcgttgtccagcaaactctccatgaaagcttccgcccagagagacgagtggagccactgcaaggtgatatgccatggcctggttcctcaatgccacgagagcaaacgctgctcttcttagaaacccaccttccctgcttgatggcaaagggttccctgcagtcggtcttgtcaaagtggcggtgtgccaggctggtctgctcctcacgctggctggcaacgtctcgtcacccacccaggcatgcccaacccatgggcacccacgcagtaattggcttgcatccagtcatgtgtatgatgtagagcttgggaggtgcgagaggcgaatagaatgggagcggtctcaaagcggggacccctcgagattcattttgagtttggatcttggtggggcgatgagggggccgaagaagaagtgccccgaacgtatggccatcaccttgcaggaagtcatccacgcggtccatggcgacagtgctatgaattgaaagggctcaatggcggcggccctccccgaactcccggcagtcaccaggtcgtccatgctgtaagcggttctgaaaactcgaatagcttcggcacggcgccgcagtggttgcaatctgaggagagattgtgtggtgtagagtatgcaatgtgagaagatcggggactgctccgtgtgttctcgcgagttgttttcacataaatactgtggggcaacttggtcggcatagtgtggagagaacaggtttgcaagccagacacagcatgaggatgctgacctggcatccacctgcgctcgaggccagacgcgaaggtggagcacccccaattggatcaggaatcaggttctgggaggagttataatattgcatttaacaagacctgcctgaagccttgccctgcgagcccaccgcagcgtgtctgctgggtcgaagaaggctcgcctggcgccctccactcaggacacaggacccactactttgcatcagacatctagcatgtcgttccaggacatggcggcggaggccatgggcggcagcctggaaggggatgacatagatgcgcgcatcgacgaggccctgcagtgtccctgtgttggtgaggaggggggggaatggcctggccattccaacctcaagacggatcgccccagcctttactaacagagtgggtcaaattcccgtcactgcaatggatttccattgcaatcactgcagctgatttgagggaaggaccatgtgggaccagtttctcaggtgccttccgctgcttcatcaagagcgagcaccctgacaagggcatggactgcataccccagttcaaggccttccaggcgcgtgcacgaacgaagtggagtgttccttgtgggcggtttcaacgcactccttatcgaaagcctcccgggacgctccattcaaaagaccgaggattcctccacgcaggaatgcctccagaagcatccagagcatgtggagggcatcatggatgatgccgaggcacaggaggatggagagcagacttttgagccccaagaagcaacagcctagaccatgggcagggccatgtgatgccgtgtgcatgtccgcacggcgtgtattctgctgcccacccacccacatcagcttgttcccttgcacaagggatccgggattctatgcagtgtatagtctccctcccttgtcagtagcattgtgtagtccttgactgcttgctttcctccctcctgcttcccactctgcaacacactgtcacagtctggcaaggtcgaacgcgctggcatgcgagcggcccgaccaccagggcgtgccactcgccccattcacaaccagtgcggcctgatctggtatgagttggcgactgccaccaccctgaaccagcgggctgggttgtagtttttctcttgcttcaggatcttcatgtaccggacatccagccccgatgctgggagggatagggtggaaagccagggtgtctcggggtgctttgaaaccagggcatcgctggcgccagcatcgcctcgcggccccaagttggtgtggaaactcggcaaaggctttgcctggcaacagagtctacgccatgcccagcaattgtgttgatttggggtccccctccctcccaccatctccacctcacctgaaggctttcctgggaggacaaactgcacagtgatggggccataatcgcgtttcacagcctccacgctccccgcatccaccgtcaggcgagccttgtgtaggaggaacatggggttatggtgggttgagtgcggcgtgttgtttaagaaccgagaagcggctgacaggggcagtaaatcatcagctgcagccgggcagggcccccctgcgtcttcaccgcgcagtgcatgcccataatgccgtagcctcatcgtccctgacatccacagccgcatgccacatcgccaatcccttccccttacactccagccagcagcaccgcacccaccctcagcgtgtgctcctggctgccacgcaggtgcttcaggttccagacgagcaccctgtcccgctccacccactccgccccctgcgcaaagtgggtcttgctcggtagccccagcgtggcaggccgcgccccgtctggtttgttggaaggggaccgcgcggtgatgtgagtgcatgggcgtgctctgaccatctgaggcgcacatcggagcaatcgcttcctcgcccaacccccgcgcgccccccccgatccccgcgcccagcaccacgctccctcctcccctccccaccaacctcccctcccaaacccgcacccgtctcgacgtgcacacgctggacgctgcgcggcaggggcagcctgagctccacgccagtggccgtcttgctcggcgggaactccgcccgcagccgcacatacagcgtcagcttgtcgggggccaccgcatcgtcctccatgagcgggtagacccggaagggcggccggaagctgcgcgtcgacctggcgcggcagaggtgggtcgcgtgtggggaccgatgctgtgccacggccctctcccagaacccatggaggcccaggtgcacgccagcccccgtgattgccccacactgcacgatcgcctcccccagcccccaccccacacacgcaccggtagttcatggccgcaaagtgcccgttggggggcaccagctccaggacgcggtcggtgtccaggcggcgcgggtccaccgcctggtgcagggagcaggtctccagcaccaccgcgtcggaggaggcgtgggaggcagggccgccctcccgcccgcggatgatcaggtcctcgttcaggcccagctggatgggcgggttgccagacaggtaagacttgatctgcaccgcgccagtgatggagctcgacttctggcgccccgtggcgtcaaaggtagccgtcagccgctccacgatgtccacgaagatctcgtccttgacggggcctgggtgttgttgagggaggggcggtgagtgggtgggggaggggctcgagggggaaaatgggggg

SEQ ID NO: 44118 - DNA, 61 bp, Chlorella protothecoides
gaggagtcgccctctcccagccccgaggagacaccctctccaagccctgaggagtctccca

SEQ ID NO: 44119 - DNA, 61 bp, Chlorella protothecoides
catgaagggacgtgcatgaagcacccacgcctgaatgggcatccacgcatgaatgggcatc

SEQ ID NO: 44120 - DNA, 61 bp, Chlorella protothecoides
gcttggcaataatacattgtgtgtggcagggttagtgaattcaacctctcccatctgttgg

SEQ ID NO: 44121 - DNA, 78 bp, Chlorella protothecoides
cccccagctaccgagtggctgacgtgcttgcctgccactccggccgagcggccgcagccgcctggcaccaccacagcc

SEQ ID NO: 44122 - DNA, 1986 bp, Chlorella protothecoides
  modified_base (250)..(305): a, c, t, g, unknown or other
  modified_base (423)..(535): a, c, t, g, unknown or other
  modified_base (730)..(783): a, c, t, g, unknown or other
  modified_base (1028)..(1058): a, c, t, g, unknown or other
  modified_base (1206)..(1215): a, c, t, g, unknown or other
  modified_base (1420)..(1468): a, c, t, g, unknown or other
  modified_base (1531)..(1540): a, c, t, g, unknown or other
  modified_base (1700)..(1822): a, c, t, g, unknown or other
ctccgcttcctcgctcactgactcgctgcgctcggtcgttcgggtaaagcctggggtgcctaatgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttnnnnnnnnnnnnnnnnnnnnnnnnnnnnnnnnnnnnnnnnnnnnnnnnnnnnnnnngggaagcgtggcgctttctcatagctcacgctgtaggtatctcagttcggtgtaggtcgttcgctccaagctgggctgtgtgcacgaaccccccgttcagcccgaccgctgcgccttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcannnnnnnnnnnnnnnnnnnnnnnnnnnnnnnnnnnnnnnnnnnnnnnnnnnnnnagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttattatttacccaccactttggtaatttcgcctttcacgtaatgcacaaattcttnnnnnnnnnnnnnnnnnnnnnnnnnnnnnnngctgatccgcacggctggccagacgatcttcttcctggcccagatacgcctgacgcgcttccagaatcaccggctgatactgcgccggcagacgttccatggcccaatccgccgccacatctttcggcgcaattttgccggtcaccgnnnnnnnnnntataccaaatacggctcagggtcagcaccacgttgcgttcatcacccgcccaatccggcgggctgttccacagggtcagggtttcgttcagcgcttcaaacaggtcctgttccggcaccggatcaaacagttcttccgctgccggaccaaccagcgccacgctatgttcacgcgctttggtcagcagaatggccagatcgatatnnnnnnnnnnnnnnnnnnnnnnnnnnnnnnnnnnnnnnnnnnnnnnnnnacggtcacggtcaccagcagatcaatatcgctatgcggtttcaggccgccatccaccgcgctnnnnnnnnnnccattcgccaaactgcagctcacgtttcgccggataacgccacggaataatgtcatcatgcaccacgatggtcacttccaccgcacgcagaatttcgctttcacccgggctcgcgctggtttccagcagatcgttaatcagcgcacgacgggtggtttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagatgcacggccagcagggtcggttccagatgacgttcaatcacgcccaccacttcagacagctgggtgctcacttccgcaatcaccgcttcacgcataatgttcagtttggttttcggacggctgccctgctgggtcacatcgttgctgctccacagcatca

SEQ ID NO: 44123 - DNA, 90 bp, Chlorella protothecoides
gagtggtggcgcgcgcgctctgcacccccccccactttagattgtgctcgaaacgtcactaggttcagttcggggtgtttggggatcagg

SEQ ID NO: 44124 - DNA, 12529 bp, Chlorella protothecoides
  modified_base (99)..(108): a, c, t, g, unknown or other
  modified_base (964)..(973): a, c, t, g, unknown or other
  modified_base (1037)..(1046): a, c, t, g, unknown or other
  modified_base (1614)..(1623): a, c, t, g, unknown or other
  modified_base (1914)..(1923): a, c, t, g, unknown or other
  modified_base (3491)..(3500): a, c, t, g, unknown or other
  modified_base (3937)..(3946): a, c, t, g, unknown or other
  modified_base (5006)..(5015): a, c, t, g, unknown or other
  modified_base (7477)..(7486): a, c, t, g, unknown or other
  modified_base (7782)..(7791): a, c, t, g, unknown or other
  modified_base (8024)..(8033): a, c, t, g, unknown or other
  modified_base (8293)..(8370): a, c, t, g, unknown or other
  modified_base (8829)..(8838): a, c, t, g, unknown or other
  modified_base (9010)..(9019): a, c, t, g, unknown or other
  modified_base (10319)..(10328): a, c, t, g, unknown or other
  modified_base (10629)..(10638): a, c, t, g, unknown or other
  modified_base (12333)..(12342): a, c, t, g, unknown or other
cccggcccccctcccgctcggcgcgcgggtcccactccgcgtcctcgcccgccgcgtcccacgccgcacggtgcggccgcgctttcttcctgcggtggnnnnnnnnnntccactcgacgtcctcgccagccgcatcccacgccgcgcggtgcggccgcgctttcttcctgcggtggcctggggccggctgtgccggcgggggcctgctgctgcccggccccagcccggcctccgacctgcatgaaatcagggggtcccagacaaggcagggtggcttttctgggggtgcaaggtggggtgcaaaggcggcaaccatccgaggccagcagcagcccatgccgagctcagcacgtcctccacggcacgcgaatcaccactcccccctcaccttctggccatggccagggtgcgctcggccacgacggccgcggcgtgggggttcaggtgggccggcaggcgcacgagcgccaccgccggggtcaggtggccgcccgcccccggcggcccctccagccggggtgggcgggggtagaggaacaggccgtcccccatctccacgcccagcaccacaaacagcttgcgaacctcagagccctgtggggagcaagtgagggcaaaggggtccggggcgatgatcctcacatttgggagggggaggggagcagggcgaggccgcggcgccgacccatggtaggcaccctctcatgcgcgcggatcccccatgctatttacctggatgtagatgtcccggccgtccttgtaacggtgcacctgcagcacaccattgtacaggtcaccgttcacggagagcacgcagaaggcctgcgccccgaccgcccccagcagctccgacagccagtcgtcttggggaaaggggaaaggaaggaagcaggggagggtttcatgggtgggttgcgacccagcatgcatccatccaaaaggcgactgaaagtgcacgcggcgnnnnnnnnnncatcaacacaggagccgggcaccaagaaagcttagccctaccagggggcctcaggcgggcatgnnnnnnnnnncgaggcaggggagggttttatgggtgggttgcgacccagcatgcatccctccaaaaggcgactgaaagtgcacgcggcgttcagcggggaagggatcggcggcggcagaggcaggcccagcagagcctgcagtcatggccagcatgcctgccttccccatgcctccacccccccatcaacacaggagccgggcaccgagaaagcccagccctaccagggggcctcaggcgggcatggctcgcgtctccggcagtcacggtgacgaacagggagcggaggcggccgcccgcgtcctcccggcaccactgcgcgcgcttggtgtgccaggtggtcaccgccggcggcggcgccggcggctcgtcctcgacgctctcctcagcgctctggggggaggcggagccgggcgaggcgggggccggcgaggcggggatccccggcgcttccgcaccctcgtcgcggagggactccagtgggggacccaggttcaggggcggggggccgctggctgtctcctgtgcgtcagactcacggcgccggggatcccgggacgggctgggggcgcctggcnnnnnnnnnnggcgctctggggggagacggagccgggtgaggcgggggccggcgaggcggggatccctggcgcttccgcaccctcgtcgcggagggactccaatgggggacccaggttcaggggcgggggggcgctggcagtctcctgtgcgtcagactcacgtcgccgtggatcccgggacgggctgggggcgcctggcgctggggatagctgggtgaccgccgcttcctccattccgggtgggcctcaaaagcttcgaggtctctggcgttgggcagcgggggcatgcgccgctccgcnnnnnnnnnnatggcctcaaaagctccgaggtctctggtgttgggcagcgggggcatgcgccgctccgctggccagcagctgcgccccgcgtaggcgttcacctcagcggctcctgcaggcggctggcagaggcctgtgcagtcctgcctcgagcctgcgcgtcggggtccagatgcaagacagagttgagccctgggcccggaaggcagggcaggcccagacggggagtggtcgcagcccgtcactcgacggcaggagaaggatacagcagggcatgcccaagaaagcatgctattgctacacgggttcacaccttaacacctggggcgcggcgggcaacgaggaatggtggcacgcgtgcgcagcagacggtgaccccgcctggaagcgcccctgcaggcgatgtcacagacggtcggacggctcacggcaactcgtagaatggtatcaggaggccagggtagctctacagttgagccaaaggccccaaggagtcacccgctctgcgtccgtgtctctcccaccgcctccgaaggggaccccttcccgcactgagattttccactcccccaatccccccccctcacccaagatcgggccattcgtgctcccaaccttggagggcacccctggcatcagtacagtgattacacaataccacatctggaagatctgaccaaggggcgagggttgctgcaagcgttcacaagagtctgcgcaggggagggacgccgcacggaagcgtgactggcgacagctgcctgcctcagctctcgtccgtcgaccgtatgtttcccgtggcagccagatggttgaccaccctgtccagtgcccgatccaccatgcctgtgcagccgcggtgtggaatgataaggtgtcggagtgcatgtgtggccaaccaaaaaacgctgtattgctcatgcatgtttgcatatggatgaatgttgggtgcagtggcacagagttccagggagccccctgtacatgccaattctcgtcgaccgcagtcataaatccccctcctggcccctcacctgggaaagtcgccgacgcatgtgctgactccagcttgccattcgccttcacctgcgggattgctcaacaagactatcggtcagagacaagttgcaatatataagcacctggtgcctcaatagagaatgatccgcaactcgtcttttggttgtagcatactgtcagtcacatgcatgatgaccccttgaaatgagtcgatatcctcatcagcttccgtcccacttcccatcacgcctcacacttgccttggccttggtgtgtcgggcgatcgccaggaggcgcttcagaagtcgtctgggaagcatgtgagccttccagtcggatcccatctagatgagagtgggggagggatcagggcttgcggataaggtcccctcctttcatatggatgtggtaattggaccaggaggggtttgccgcctggacatgtccagcgagaatcactgtcccaagctactgcagtgcttaaaggcctcgcttctttcccaatcccagagaggcccaagggctttccccctagtgcagatcacctggaccgccannnnnnnnnnggtggaaattggaccaggaggggtttgccgcctcgacatgtccagcgagaatcactgacccaaactactgcagtgcttaaaggcgtcgcttctttcccagacccagagagacccaagggctgtccccctagtgcagatcacctggaccgccaaagagtatgcagggaaggtgacccagctcatgtgcaccagcatcaaggtgttgaagaggatgatggtccaccacggcaggacccatccacgatagaaaacgtccctggcatggcgagggtgtgggggaaaggactctggcagccgcactggagttcagggtccggctccctgcactccagccagccgccgaccactgcaggcaagaagtactcagggcgacctccaccccccccgcagctggcactgccctcgcagcacgcactcaaaggcacaggagctcgccnnnnnnnnnnagctccctgcactccagccagccgctgaccactgcaggcaagaactactcagggcgacccccaacccccccgcagctggcacagccctcgtagcacgcactcaaaggcacaggagctcgccccaaactgccagaggaagaagatgaagctggcgtaggtgtaggagcagaggaagagcgtgagcttgatggggatgagcatgagcggtggccggttcagccagaacacgtggagctccagctgctggggcactccacctggggtcgggatagggaggatagggagccttctccatattgatcttgccaagtctcgtcggagctgggggtgctccatgtgtgtcgacagcagagtgcagcacacggcatgcccagcagatggccaatacttctggcatgagtcaatgtgagacagggctggctggtggctggagtctggcctgctgatgggtgccacgccaagttccagaccttccctcaccacccctcccactcactattagtgacatatcgaatgatgtgctggagcttggtgttcgtgagcgcaaggacggcgccattcagcgcgaagaagatcatggtggggtagcctgtgccacgaggtgggggggatggggggcagctagggccacaattgaagagttgcggtttgccgtggaaagtgccttgaacaatggtcgtcttcatgtcacgaatgacatggctgcagatctcttgcagcatctgcgcagcacatgtgccgacatgcccctcttccttccctctcctcgtaggcagggcccgcgggctcaccataagggcccgccaccagccagtagatgacgatgagcagccaaaattcaagggacagacccacgacggccgacaggtcgtcctccagcgactgcacgatgaagctgattacttgggggtggaggggagacggtgagctcttgtcgacccttccggtccgcagcagcggctgtgggtcactgagaggaagtcgtgaaacatgctatgccgtctactcatcgcggcaagcgctcacaccccgagccatgcacgtatgctgactcatcccnnnnnnnnnncatcatctactcatcgcggcaagcgctcacactccgagccatgcacgtatgctgactcatcccagacacccctcccggccccatctcactccaggaagttgaaggaggcgggcaggcggtgggtgaggcggaaggacatgaccagggtctggtactgcgtcctcgtcagcgagttgggcgccaggccgtgatagaggcagaaggcaaactcccgccaccacgccgcccagtgccgccagcgcttgtcccgctcaccacccatgcgtgcggccggggcctcgaccacggtcgaggccccatcggcgctgggcgggacaccctcagaccccggggcggcgctgccctgcctcatgagggtctggatgcggcgcagcgcggtcgccatgccctcgtcgaccagcggggaggaggagggttggcggggctcccctgcagccccaccccctgccacgttggcggggctggagctggcgcctggcgggccatactccgccgcatctcctccaccgtgcaggcgggcatggtactgctcgatctgggcattcaccctgggatcaggcaatgcgagagtcaagttgagtggagagagttggagagaggggttcattctgggatgcaggagtgaccggggtggttggatcgccaaacccctctgagatgaaataccgaggccgcacattccaaatgaggtgctgacaagtgccctgggcctcgggtgcggatgagactccgaccaaagcctgccgcagcagcccggcgcagggtttctccatgcattgcctgcctccaaaaccccttgcccctcttcctccccttctcccgcccacacaaacagcaaaagaaagcatggctctcacgacgcacagggcggcgcgctcgtggtccatctcgggccaccgtctccagagccggatgcgggcgcgtgccacggagtgaaggaagaaggagcaggccacgtgcgtcagggccaccacgaagatgaggatgtgcacctgctccagggccaggaaggagacgaggggcacccgcccctccccgcaggaggtcagccccggctgcaccccaacgcagggcacgtcggcgccggcctcgcaggcatgcgcgtcgcaggcgcagagcccctccccgcccaggcaggtcggcccccccgcgcgcaggaggcaggcctggacgccggtggagctggccaggcagcatgcgcactccctcgccagacgagtgcccagggaccaggcggggcgagccccgtctgtgccagacactgatggaggaaagggaggcatgtgtgggtgtgtgggtgtgtgctgggcaggcgccaagctcatggcaactgctcgagcaagtggaatggcgtgatgaggcgaggcaccggacggttgatgagcacccctaccatcctggatgaacatccccacttccaaaaaaacaccaggccaatgtgctccacaccgcagatgctggagatatagcgctggatggagaggaggatgagggagatcaggcccagtgtggtcagctcctccgtcatcttctcgaccgccgccaggaacccgcggcgattggtgcggcgcaggtggtcccggatcctgcccatgatgaggttgaacaagaaggacaggaccaggaagaagacgagaacctgggggggggggaggggagggggcaggggggcattgcaagtgcaggcccgaccacctgcgtgggctagggttgtgtgacaagtgccccagccctcactcaccagggcgacgatgtaggtcggggtctcgaagagactggtgtccccctcgcctccagactgcgaggaggaaaattattggcatgataaccagcaaagctatccctccgatcacgtgtgtgagccggagcagtgccaaggccacccaccatagtgccaaagcgcgttcgtcaactctaaacgctgcctctgccgagctcgccatgcagcatggcctttcgtattgagcctcaatgttgacttcacgagagtataattcgaggtcgtcccccatgcatcgaggaaggtttaacccccgcagtactcggtgagtcaagatctcaacatatcagctcgaggcgctagaatgtaaaacaaggtcaccctacttggagatcagatcgcaccgcattttcactccgtgacacttcacgcatgatatcgtaaggacatagtttgtattcaccaatgcctccctatgccttcctgatcctcgacatcaacaaggtcacgggggtcccctccccactatgaggactgccgagaatgggaccctggatgaagccagggaggccctgcaaaaccttgccccccagaagctggaggagctgaagcgggccttcgctgtgtacgacaaagacggtatgccatggatctgcgcctgggaccccttgcgtgtcaggaatgaacagcatcaaagccaatgcctgccgtgcatgcctccagggaatggcagcatcgatgnnnnnnnnnngtgaacagcatcaaagccaatgcctgccgagcatgcctccagggaatggcagcatcgatgccggcgagctgcggggcctcctacaatccctggggcagtatccaactcccctggagctgatagacatgatggagaggatggacacggatggatcgggggcaattgactttctggagtttgcgacgtgcctagcagagaacgacgaggtgggtcatccagccaggcagtggtgtgaccatggcgcatggagaagtcagaggtgtgtgtgagtggcactggcatgtacggccggcccnnnnnnnnnnaaggcagtggtgtgaccatggcgcacggagaagtcagaggtgtgcgtgagtggcactggcatgtacggccggcccttgctgcgcataggaatgagatggcggtgcaagaactgccgtggggagtcccaggggctggcgagttctggaaggcatgaggcaataaggttttcggctgaacccagacattcctcactgtctcatccttcacactcacttcccttgcacccgttgcnnnnnnnnnnattttcgtctgaacccagacattcctcactgtctcattcttcacactcacttcccttgcacccgttgcgtacccagacagctgagctggaggaggaagtacgggagctggagtcggtcttcctcctctttgataaggatggatctggccagctgtcggccgatgaggtgagcatggggtgttagttttgggtcagcttgacaggcaagcttgcagctgaggggaagggacagccattgtggggcctccttaaccgtgccnnnnnnnnnnnnnnnnnnnnnnnnnnnnnnnnnnnnnnnnnnnnnnnnnnnnnnnnnnnnnnnnnnnnnnnnnnnnnntgctgggggtggacatgacggcccaagagacggcattccttgtccaggaaatcgatggcgatgggaacggggaggtgggctgggttgggggggtgattctggcggtcatgtgtggtccctagtccaaacagccatgcagtgcctggcaacggggttgtgggctcctggcaggcgccagcacacaatgtcacattgtgctctccaaaaacttgcacagatatcctttcaagaattcctggattatgttgtggcgttccagggccccgtggatgactgacacggagtcctgagggatttcacatcctcgcctatgatggccgatgtcgtggtgaattccttgctgacgtggagctcgcctgcctccctggtcatgacatgacagcaaagcacttccggcattctcgcttgccttttcccacctcattcaaggagattgcacccttggaccaatactgcagnnnnnnnnnngcggcagtctcgcttgccttctcccacctcattcacggagattgcacccttggaccaatactgcagagactgtgactttcgattgtattcctgaatttgtccgataaaggagagcagtggtgccacgagcatgacactcccggctgtgcttactcgcctggcaaggccgtgnnnnnnnnnnctcctgaatttgtccgataaaggagagcattggtgccgcgagcatgacactccaggctgtgcttactcgcctggcaaggccgtgcagacaagctggtcaacgcatcgcaagcacatagataagagaatcatgccaagaccggctcccgcctgccaaagaggcgattcaagagaccgcccttctttgtctcctgcacaattgggcttggttcttgcacctccatctgcagtggggatggagtggagaagacgttgaagcatggagaggagccagccagtgcggggctggtgcttcatgtcaacgcctccactatacatgccaggccacggctgcatcgctcaagctcccgcccccaccttcccaccttcatgtcttcaaaggccaagcagagcacagccctgccccccgtcagccgctggatcgcggcgacgtgctcgtcgtgctctccctcgggctccaaggggtgctgcaggattcggcggcacggctgtatcctggcatgcatcttcagggagtacttgagcagggtgggaactgcctctgtggctccgctgcacgccagcggcatgtggggaagggagtcgggaagacatcagaccagctccttgggaatgccctgccatgcctcccccggccctgcacaccctcggcacgcaaacacacccccacctgaaactgggcagggtcagcttcatgcgggggaccttgcgcgagggcactgtcggcagccgcagcgcgcacagcgtggggctgtgccgagcctcggggccaggctggccacgacggcccgcctggtcatccagcgacaccaccaggcagggggctgccggcgccgcgctctccgcgcgcgtctggccccacccccgagcctgggtcgcagcgatctcgccccccggggtcccgccatgccaccaggcactgtggcctgcagcctggaagcgtgcggcgtgggagggcagccccacggcctgctgtccgtgctgcaacgcggcggggctgttcaccagcacccgccccgcccaggcgcaggaggtgggcccgtcccagaccaggcccgccagcgctaccagctcatcaaaggccccggcggggctggaggtgtagcgggctaggtacaggccgcccagggtccagccgaagaggctgaccagggggaggtcggccgggatgtggcgccgggcctggaagtggggagggggaaatgtgggtgggcgccaggcgcggacatgcccggccccacctgtccatgggagggagccggcccaggctccctgcacgagcccacctcgtccatggcatnnnnnnnnnntggccccacctgtccatgaaagggagccggccctggcaccctgcacgagcccacctcgtccatggcatcatggatctgtgcaccacatccgtgataacaccccacctcatcgactcgaaccagggacagctggtagagggcgcggccctcaaactcccagggccccgatccgtaacccatggccacggagggggggggacagctgatggaccccccaggctagcagctcctcaggatggcacctgatctatccgtccttttcaaattttcatacaccatgcattggctgatcagcatcgannnnnnnnnntcccatggccacggagggggccggacagctgatggaccccccaggctaacagctcctcaggatggcacctgatctattcgtccttttcagatttttatacaccatgcattggctgatcagcatcgaatggcgcccaggagagtgctgcatgccccatgcgaacccgaccctgagcagatctgcatgcgtgctggatatgctgcgcgatcgcatgaagcgaacgggcacaagctgtcactgatgaaaggatgggccaccctgccgcgcctctgcagccgtgccctagtcacagggagttccgatgcctgactagaacggtgccgcggaaggctgcggcctcccgcgccgtgccctgctcagccacgatgctcgggcacgtcgagaccacctgcgtggcgctggcgccccagctccttcccagcacggatctggattttacatctgctgcgctggcgccgcagtacatgaggcgccaccatcccgagacctggctgccgcactcccagctgcgctccctggcagacccggtaaccatcctggccggcagccgggcatggaccagacccagcgactgcctggccgcctgctgcatcgatcagagcgtggtgctgtgctccgccggcgcagcgggccggaacaccgtcaggatgtccgtgctgccgctggcggtggcgctcggcactgctgctgcggaggtgtgctgcttgatgatcgtgcggggtccctcatgattgaggatcctaggggcctgagagcccacacctgaagcatgtaagggtcttcacctcacctctctctccccatttcatctcccaggtcgtgccggagcaccgccccgtcagcgtccagctgcccggcaccatcctgcaactgaccctgagcagccgcctgtgcgcggggtgggggacgccccaagaccccggcgccctgcccctcctcgcagcccgcacgctgcacggggtcacctgcctgaagatccgggagcaccccggcgaagggggactgctggcgctgcaggctctgggccccgttcccctgcccacggagagcgcggacgtggcctggagcgcccacttcgcaggccgcgctttcctcatgtccgccgacgcgtccctcgcagagctggaggcgggacccgcgggggtgcggctgctggcgagcggggcgggtgccctgctggaccccgggcggcccctgccgcgcggctcgcgcggcgtgctggcctgcaggccgacggcccacccgcgcaccgccctcctggccgtgctctccagcctgcagctgcgggacctgcgggagcggggcccggacccaggcccccacccggcctcgcccccgctttgggtctgcgccaggggccgggtgatctgcgccctggcgggcccccagctgctggcggtccctggcgcgcccgccgagggggtcccccccctggagcacctggccgccctttccaccaccggcccggagatcctgctcttcgacctgcgccggcccggcacgccggtggccgcctggccgctgccctcccagcgcgaggtgcccacctcactggccttctggaaaggaggaacgcagggccccgccctccacggctcggcggcgcgcgccggggccgtcgccgcctggcgcgccgccttcgaggaggagggagcggggcgcacgctggcgacggggcgtgcaggcctgcacgcnnnnnnnnnnatccatcgccgcctggcgcgccgcctttgaggaggagggagcggggcgcgcactggcgacggggcgtgcgggcctgcacgccgccctccccggcgccgcctttgaccccggggaccgcgtgctgacctggcgcccggtggcgctcgagtcctttgcggcggtgcagccgccggcgacgctggcgcag

SEQ ID NO: 44125 - DNA, 61 bp, Chlorella protothecoides
gaacatcggtgagcagattggaggaggcgggggggtgacaccggagatgcggtgttgcttg

SEQ ID NO: 44126 - DNA, 61 bp, Chlorella protothecoides
tgtgtgtgtgtgtgaggcggtgggggggggggtcgcacatgtgtgggaaaggagggtccta

SEQ ID NO: 44127 - DNA, 61 bp, Chlorella protothecoides
attgggtagaaaaatcaactgttttggcagacggtggagcgagtgataaaggaaaattagc

SEQ ID NO: 44128 - DNA, 61 bp, Chlorella protothecoides
ctattcaaggtacagtctgggtcggggagggattcaagtgggcaaacagcgtgcggcaccc

SEQ ID NO: 44129 - DNA, 75 bp, Chlorella protothecoides
ggcgttgtccgctgcagagggcagcggcgctggtggggaagcggctccttcccggggcgctgtcactggtctgga

SEQ ID NO: 44130 - DNA, 1873 bp, Chlorella protothecoides
  modified_base (140)..(220): a, c, t, g, unknown or other
  modified_base (1075)..(1084): a, c, t, g, unknown or other
  modified_base (1249)..(1306): a, c, t, g, unknown or other
  modified_base (1571)..(1580): a, c, t, g, unknown or other
ctggcggccgccacgcgggacgagctggccgcctacgtcgacggcctcgggtccgcgcggggtgcgccggggtcaaacgcgccgggggagcccgggccggcgcacgcgagggcggccgccgcgctgtttgcggcgggggnnnnnnnnnnnnnnnnnnnnnnnnnnnnnnnnnnnnnnnnnnnnnnnnnnnnnnnnnnnnnnnnnnnnnnnnnnnnnnnnnggggggaccacgggcgccaggctgctgaccctggtgcagaccctggcctccgacaaggtgctcgctgctgcgaccccggggtatgcagcccccgtgccgccgcccgtccaggcgagtgcgggaggggtgatgccgtatcggggtgtgtgtggtggggggggtggggaccgggacggcggctgcatgcagacgaagaacggcatgccgtggcagccttgcggggctgctcacaggcagcgccccgcctcgactcgcgccatccagcctgcccctcctccctccgactccaggcgcacgcctggacggcgctgggcaagatgtgcctgatggacgaggcgcttgccaagctgtgtgtgcccctgttcgtgcagcagctgcgctccgcggcggcgccggcggtgcgcaacaacatcatggtggcgctggcggacctggtggtccagttcaccgccctggtgaggaaagcgcggggaggtcctcaaggggaaggggggagatggtgctggggacacggagaggggccggctgggcgtcgcagcgtcggccaggacagccagtctcggatcggctggctggacccgacgccgggtgtcaggaacgagagatgcccaggtactccattcgagcacccgggccggcactgactgaccgccctgctgaccctggggtgcaacaggtggacgcccacgtcccggccctggcggcctgcatcacggacgacaacgaggtcgtgcgctcccagtccctggcgctgctggccaacctgctgcagaaggtgctgagttgctgcccgggagggggggggggacaaggcagtgggggactggaggtgactctgcagccgatcactttgcnnnnnnnnnngggggggatgggagggggggcggggcaaggcagtgggggattggaggtgactctgcagccgatcactttgcagtgggcagggtggcccatcagcattgtggtgtgttcagcaacggggagccaagcaggtgtcccatcgctgggtttctccaaaggagcgggccnnnnnnnnnnnnnnnnnnnnnnnnnnnnnnnnnnnnnnnnnnnnnnnnnnnnnnnnnngcgcgggcccctgttccaccgcttcctcctggcgttggtggacgagtcccccgccgtcgcgcgcatggcagaatacctgctgggcgacgcgctttccagccaggtgcggaggtattgctgggagtgggggtgggcagggaccaaggtgagcacgggcctgcgccatgggcgccgtgcatcgcagcgatctcatccagaagtataccaatccattccccctcccactttccctctgccaggcgcccaacctggcgtacaaccactnnnnnnnnnnacgaggtgagcacaggctgcgccatgggcgccatgcatcgcagcgatctcatacagaagtgtacaaatccattccccctcccactttccctccgccaggcgcccaacctggcgtacaaccactttgtggagtcgttcttcgtcctgaacgcatgccgggagggccccggcgcgggcgcggccgtggccgcctgcatggacctggacgccgcaacgggcgcgtccgtctgcggcggcggcggcggcgacgctccaggccggcgcccggccacgcgccgtctggacggcgcgtcg

SEQ ID NO: 44131 - DNA, 61 bp, Chlorella protothecoides
atctggaacacggccttgtccggcagccccgccaggtcagagtgggtggccaggtagcggg

SEQ ID NO: 44132 - DNA, 82 bp, Chlorella protothecoides
gggggggggggggggggggggggggcgcgctgtgacactcaaggatatcgatcatgggaggacaggcagatgccctgctcct

SEQ ID NO: 44133 - DNA, 61 bp, Chlorella protothecoides
ccgggaggtccttgaagagcgcgatgacgacggcaaagccgagcatgacggccgaggccgc

SEQ ID NO: 44134 - DNA, 106 bp, Chlorella protothecoides
gcgcggcggcgcgggcgccgggacggacgctgagctggaggcggggatccgggccctggcggagcacgcgcccgagtacgtccagctgaagccctacggcgcgtgc

SEQ ID NO: 44135 - DNA, 61 bp, Chlorella protothecoides
gcgcgggcgggaggacttccgccgctccccaccccgtcgccgcgagatgacccctcctgag

SEQ ID NO: 44136 - DNA, 61 bp, Chlorella protothecoides
ggtagtatcacctcaaaaagagggaaagagggaaatgtgaaaggagcatgaactaggggca

SEQ ID NO: 44137 - DNA, 8348 bp, Chlorella protothecoides
  modified_base (99)..(181): a, c, t, g, unknown or other
  modified_base (705)..(714): a, c, t, g, unknown or other
  modified_base (1256)..(1265): a, c, t, g, unknown or other
  modified_base (2001)..(2010): a, c, t, g, unknown or other
  modified_base (2099)..(2181): a, c, t, g, unknown or other
  modified_base (2528)..(2537): a, c, t, g, unknown or other
  modified_base (2808)..(2817): a, c, t, g, unknown or other
  modified_base (3013)..(3022): a, c, t, g, unknown or other
  modified_base (4024)..(4033): a, c, t, g, unknown or other
  modified_base (4664)..(4673): a, c, t, g, unknown or other
  modified_base (4732)..(4741): a, c, t, g, unknown or other
  modified_base (4876)..(4885): a, c, t, g, unknown or other
  modified_base (5154)..(5246): a, c, t, g, unknown or other
  modified_base (5519)..(5528): a, c, t, g, unknown or other
  modified_base (7426)..(7435): a, c, t, g, unknown or other
  modified_base (7738)..(7747): a, c, t, g, unknown or other
  modified_base (8180)..(8248): a, c, t, g, unknown or other
acgcggccgcgcacggcggggtactgcgcatccgcgacatgctggacagggctgagcagggcctggccgaggtggcgctgcacagggaggccgaggccnnnnnnnnnnnnnnnnnnnnnnnnnnnnnnnnnnnnnnnnnnnnnnnnnnnnnnnnnnnnnnnnnnnnnnnnnnnnnnnnnnncgggcgaggtcgcgcgcggtgcccgcctgccgcgcatcacggggtccgacgcgcccgccccggtgccaggcccggaggagggtggggcgttcccgccgccggccacggcgaccggcgcgtcacacccgtcccatccaccaggatactccacggcgaggagcggtgtggcgcgggcgctgcagctgcccgcgacctctgagccttccgatccagttccgacgtcgccggcagggggctcgacgcggtcgcgaggcagcacgagcagtggcggggccaggcgggcgctgagtctgctggccaggacggccggggtgggcctcctggccaccgcagtggccctcatctccgccaccgccgcccccacggtgagcgtgagggggggtggaagggaaagcatggcgcagagggcgggttttcgaggcacagttcccagaccacatcacatggagtcaggtaccctgttcctcaacccgccccgttctcatgcctctcgcaggtggccggggcaattgctcagaggcggnnnnnnnnnntgggaagggaaagcatggcgcagagggtgggttttcgaggcacagttccctgaccacatcacatggagtcaggtatcctgttcctcaacccgcccccttctcgtgcctccctcaggtggccggggcaattgctcagaggcggacccagcgtgagcaaggcagcgacaaggcgtggcagcgaccgcagaagaaggggcatatggcggatcccgtgcactggacgcaggcagcgcctccaagaaagaagggccagcaacgccgcagtggggccccggggtcaccgcagcgactgccccccgtcgtcgccgtgcagccgccccccagcggcagcgagttcccgatactgcctcccccggacgtgagccatgccatgggctgacgttcagctgacgcaacgacaactggactggctacgatggctctcatgggtgcacattgcatgaacgatgctcgatgacacttttgcttgattggaacgctgagagacgcgcttgaagcgagtcagacgcggtgaccgcacccctgctttggcttggtggaannnnnnnnnnatttgcttgattggaacgctgagaaacgcgcttgaagcgagtcagactgaccgcacccctgctttggcttggtggaagatttacccagcgcccctcctcgacacacggaccggaaccgactctcgacctgcgccgcatgagcgactgcgattcctgcactgtttacgacctgggtcttcgaaagcacccagtaccatgcatctcattatgtgatgcacatcttatcccgaaagatggcgtctttgggtgcggaaatttggaaacgaggcggaggaagcgacgcaccatctcacctgcccatgcccggtagctgggtgggatcacgcttccgtttgggaccagtcctgtatcggtacatgagcgaccccagaccattacccacacgtcttcttcaacttcgaattctctcatctcgctgcaatgacgctcgcaatgaccatgtcgaccgccggggtgcgccccaccttccgggctggaccggcacctcgcatccctgccgcacggcgattccacaggcccaatgccggccaggtacgataggatgtccagtgtgcgagttggaaatggacgtgtactgtgtgttctctccgtcggatgttctcacggtcgtgatgtgcatcgttcggtccgtcgacatctctcgccattcactttgtccgcacgacagggtatcggggacgccgccaaggacgcccagaagaaggccgggcaggccgcggaagatgtgaagagccannnnnnnnnngcgtcggatgtcctcactgtcgtgatgtgcatcgttcggcccgtcgacatctctcgctattcactttgtccgcacgacagggtatcggnnnnnnnnnnnnnnnnnnnnnnnnnnnnnnnnnnnnnnnnnnnnnnnnnnnnnnnnnnnnnnnnnnnnnnnnnnnnnnnnnnnactatgctgtcgcatgcaagcaaccctcaccaacagagtgtccatccaaccctgcagtggagccaagagtgtggttcagcaacttcaagggacccccgaggagatctccaaccgctctggactgggaggggatgtgacttctgatgagcacgtgagtggtttggggctctatgtggagtttggaacgcatggtacaaacacctgtgcaagaataggaaggggaggcgtttcttgatgagatacagaatgaacgacctttgcattcgctcatggggactgtatatctttgaccaatttgcagaagggcggcaaggatgaaggccctcgctccagggcggagaagggtnnnnnnnnnnccaagaataagaaggggaggattttcttgatgaggtacagaatgaacgacttttgcattcgctcatggcgactttatatttctgaccaattcgcagaagggcggcaaggacgaaggccctcgctccagggcggagaagggtggtgcccggggtggtgagaagtgggacgatgtcaagggcactggcaccgagaagagggagaaaggtgacagcaagaccaacgccaagggcgttgatgcggcccgcgagagggcgtctgagctggacgacnnnnnnnnnngtatttgcagctgcaaacaacatatttgcataaagtattcatcatggcaagtgacgacacacatcggcaaactgctgatgattcgccttttcctgtgacactacgcggggtccgacacgagaggagggcatccggtggatttacctccctcccgtgagcaagtttcctgcctcgttcacacatccgcatgcgagtnnnnnnnnnntgagaagagggagaagggagacagcaagaccagcgccaagggcgttgatgcagcccgcgagagggcgtctgagctggacgactggacggggactggacagggcgcgagcaacaagcagtgaattgacctatatgctttgagcgaccctattccttccctcctgtgaccacacctgaagacacacccctctcaatctggacccctggtggcctgagccgattcgtggaacccctttgtattcattgtcaacttcccatctgtgtggtttaagattttgtaaagcaagaatctatttgcagctgcaaacaacaatttacataaagtattcatcatggcaattgacttttgaggaataggatgattgatgacatacatcggcaaactgctgaactgctgatgattcgccttttcctgtccgacacgggaggagggcatccgctggattttttacctccctcccatgagcaacatccctgcctcgttcacacatccgcatgcgagtcttaggtgtgcttcatcagacaggtggcctcctgcggggacatgctacagcgcgagcctacacgaatcgagctgcgtgcagaggacaaggaagaggtgcgcagccatgatcggaaccgaggtccacgccgtacgtcatcttgtgtgacggctacatgagcaaacacttcatcctctgattgcagtacctcgcggtgaggagagagcagcaggaagcacgtctgtccgccctagcagagcaaacggggaaacagccactgacgccccttttcgtggtgagcgatcgggccgggcctaccataccgagtaacggtctgcttctggtgaagatgtaacgtcgcgacattcaccattgtaacaactcaccatcacccctctgcaggggaggaagccgtcgacagccgcgcgtctcggcctggcaaagtgatggaggtgggtccttgatgccggtggggggcacagtcagctggccatgctgttgagtcaatgcactggtggaannnnnnnnnntctggcaaagtgatggaggtggggccaatgggggcacagtcagctgcccatgctgttgagtcaatgcactggtggaatttaggccatgacgcacccgctgccgctcagtgcgatcagcgcctatccatcctgatgcaggtcgagatcaagctgcggctgaaggacgaggaggcgcatgcccggctggcggcggctctcaaggcatcctaccgcaccacccacgagcaggaaaactacttctttgacggcagcagcgccgagctgagcagtgcccgcgtgatcctgcgactgcgtttctacaactttgacaagaaggccctgctgacagtgaaagtgggcagggaggtgggggggagggatgtctcgatacttgcacgccctttctctgggggtttggtgcacccctcttgtagcattcggctgatcaaaggacttgaggtgtgtggagttttgaagagactgccatgtacccctctgcagggaaagcaagtgcttgtggatggagtggggcgctgccccgaaacagaggtggaggtgccgcctgtacaggcacgcgggtacctgagcaatcccaacaagctcctggaagcagggctgcctctcgtggacggcctgaagcagtgagttggcnnnnnnnnnnctcctcattatgctcgccgcaacgtgcatctgcaggatgccaagcgcgcaatcaaaccnnnnnnnnnngaggctttggcctgcggagaccccactcaggttgcaggatgcctgtgggagtgtcgctgtgaacatgggtgcagtcattgcccaggggtgggcaccccaagttgctctatgaacccttctcaccccgcttgcgtnnnnnnnnnnccagtgtctcgtgctcaccgtctcagcctccagctcgtacacggtcccgtgatcgaagcgggtctgatccagctccagcaccaagccttcccagtcaaactcctggcgcacgttgcggaagccgcctaggcctttcagccccttgagtccatactgcctgcacacgcaagcggggtgagaagggttcatagaggcaacccagggtgcccacccctgggcaatgcctgcacccatggtaacagcgacactcccacaggcatcctgcaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggcagccctgcttccaggagcctgttgggatcgctcaggtacccgcgggcctggtcaggaggcacctccacctctgtttcggggcagcgccccactccatccacaagcacttgctttccctgcagtggggtaaatggcagtctcttcaaaactccacacacttcaagtcctttgattagctgaatgctacaagagggctgcaccaaccccccagagaaagggcgtgtacgtatcaagacatcccttcccccccccccccccccccccccccnnnnnnnnnncgcacattgtggcgagcataatgaggatccgaaccagctgagactcagcattatgacactcctcacaacctttatgtgcagcccaagccagaggaggtcaagcccaagctcgaggcactgcttacaaagcacggcgtcgcctatgcagactctgcctcctccaagtttgccaacttcatacagaagtcgctgcgctagggtgggcaagctcagcatccctgatgctgacaagggaaggaccattggctgtccatgctgccttgatttccaatgcagcggcccccacctgtgctctgctccctgctgcactaccccctgggagccttgagaaacatgaccacaatgacttttggcataatgatgttgtgcaacaccagatggggtggtgcccaagggtagtacatgctcagtcttgaaacttctagttcccaccgcctgcctcccccgggtcggtgtacgacagcttggccgccctttccaggcgctccttcagcgaccgcacggcggcggcagcggggccctcctcgccctcctcctcctctgccaccttccagcttggccggtcctgcgcgcccgcccccgccgcccctggctgcagcgccatgcccgccgcgcccgcctcgcctgtccaccgcttgcccagctcggccgccgcggccgccgcggcgcgctggaactccagctcgtccccctcctgctccgccaactgctgggccgcctggagctgctccttgagcgtctcgtacctgggtgtacgtgttgagtgcgtttgtcagggaagcagccggttagatgcagcagcaagagcaccacagcagggaggcatggacaggcaggaagctattcacttccagcaggcaactccatggcctctgcacatacttgctcatgagctcctggcgcctcgacgtaaactggctggggaagaggcccggaaaatatctctgcgcagggtggttggacaccttgtgaaggtttgaccataggatgctggatggaatccagattgccagtacccatgctgcctgacccacgaagaacaccctgcacatcttgatatcaccaattcaccctgctctcccgaatcacacctggatgaagccaaagatgagcacatggccgacaggcgtcaggggcaggatgaggatgatggtgaaggggatgaatgtcagcacgtctctgaaagttcgccgcagcgcctgcacctctcttggcttgagcgtcccgcctgcgggttgtgaaggagggtgagtacgcgactctgccttgcatgcgatcaggagtaatgcttgctgggaaacccagaggtgcacaatgggagtctgccaccagcactctccaaatgggcagtacatcaaaacgtatcttgaaccaaagcctgccctagctcagtgcgcccacctgccgcggccctgccaatcagtttgaaggcagacacggtgtctgacccaagcagacgcagaccccgtgctccaaagtcgacaccatcgagcagcttcccgataccttccttgacctgcaagtaggacaagtaggcagtggtgttgcccctcatgacatctatgaacatgtattgactgtccatttgcgggtcaaccctggccaagagtgacccctgccaaactctttgagtacccaagagtccgctccaccaagttggcatacctggaactgcaacctcgccatgttgaagaggccgcctccaaacacctactcgacaaagaacgatgcggcaccgtgagtgaaggatcaggcggtctcacgcgcaatacctgggcaaaggatcattctctgcatgcaggagtccactccctggactatgaatagctagaaacagcaccctggcacccgatgttccgccctttccacctgggtgtccccgagccccatggaggttnnnnnnnnnncgaatatctagaaacggcaccctggcacccgatgtcccgccctttctacctgggtgtccccgagccccatggaggttcgcaggtcgatgatgtcatctgccagccgcgccagctcagcggcctcgatgtacaccagctcgtcctcctccagcgcggcagccagaggcgcgagctcctcatccagaaccttgaactctgcagtagagaaagggggaatttggggggtgcatgagcaatgaggaaggcagattgctgatatgccaaaggctagcatggatagacagcaaagatgcaagcagcagnnnnnnnnnngagtcgagaagggggaacttggggggtgcgtgagcaatgaggaaggcagattgctgatataccaaaggctaatatggatagacagcaaagatgcaagcagcaggggcccacgactcatgtgcatgacgaaggccaggcatcgtacacacgcccctccccttcctgcagccacccagtcccctctcagttcgccccagaggctccagcgcgctgcatcctcctgcggaacccctcccccccctccaacccccttcccaaccccaaccccagtgcctcgcctgcgatgagcagcgcaacctcgtcgctggagcccaggcggttgggcgtggccgcccgctccctggccgcaccgcctccgccggcatacccgtccacgatgtccagggcctcatcctccagcgcgcagtggatggcctccatctccgcctgcagnnnnnnnnnnnnnnnnnnnnnnnnnnnnnnnnnnnnnnnnnnnnnnnnnnnnnnnnnnnnnnnnnnnnnggatggccaggcgggaggacagcacgcccacgcgctcgtccgccgcgcgcagctcggcggcggcgcgcaggcggcccgagggtcccgcgcggcgcagccg

SEQ ID NO: 44138 - DNA, 111 bp, Chlorella protothecoides
gctcgcagggcgggctgcgggcggggcggaggaggtcgcaaggccacccaccgatgcagcgcactctgtgccagacgcctcacccactgggaccgacgccatgcagtaccg

SEQ ID NO: 44139 - DNA, 61 bp, Chlorella protothecoides
agaagccgtcctcgggcgtgatgtggatgggggagaaggaccccgcctccactgcgttcat

SEQ ID NO: 44140 - DNA, 61 bp, Chlorella protothecoides
ttgtttttaacactttttgtattttcgttagctttatcttgagtatttttttcaacacttt

SEQ ID NO: 44141 - DNA, 450 bp, Chlorella protothecoides
  modified_base (138)..(239): a, c, t, g, unknown or other
cggcctcggaccccccgccgccctccaccgccgagactcccagccaggcgtcggccgcggcgccccccctcgcacccaccacagaggagccggcgggcgaggaggcggccggctccgtggcgctgccgccgacggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagctcccagcgctggaggaggaggacgacatgttcgagctggacgaggagcacgaggagcgtgccgccacgagggcggccgaggcccccgcggccgccaccggcgtggcgcggccgacgatgtcggaccgcgacgtccggcggctgatcgtggtgaagccgtcgctgcgctcgccggccaagcccgccgccgcggcgcccgcggcgctgga

SEQ ID NO: 44142 - DNA, 5292 bp, Chlorella protothecoides
  modified_base (108)..(117): a, c, t, g, unknown or other
  modified_base (189)..(244): a, c, t, g, unknown or other
  modified_base (852)..(861): a, c, t, g, unknown or other
  modified_base (1020)..(1029): a, c, t, g, unknown or other
  modified_base (1413)..(1422): a, c, t, g, unknown or other
  modified_base (3652)..(3661): a, c, t, g, unknown or other
  modified_base (5214)..(5223): a, c, t, g, unknown or other
gcggccgcacagcccgcgacgacgcgctgcaggcgacggcggtgctggaccgcgcccgccgcgccgtggcagcgctgtccgaccgcgtcgtgaccacgctgggcccgnnnnnnnnnnggcgccgcgctgggcgccgcctttggcgccgaggactggacggtgcggctgttcgcggaggagggggtgcgnnnnnnnnnnnnnnnnnnnnnnnnnnnnnnnnnnnnnnnnnnnnnnnnnnnnnnnntgcgcgcgggccctgcctttgcgctgtcgctggcactgtcggccgcggagcctggcctgcgcgccgccgcggagctgggcgcctggcagctggtgtcccccggcgcggcgcgcggcgagctggtcgccgtgccctcgctgcgcgaggtgcaggaccgcgctttcccccgccccaccgtgctcctggcctgggaggtgacgggggaggaggaggtccccgccggggtcgtggccctgctgtcccccgacgccccggacgtgctgtcccacctggccgtgcgcgctcgcaacctggccgtgctcttcgccgcctgccacgacgccgcgccgctgcgcgagctggaggccctggagggccgggtgctggagctggacagcacggccgcgggggcggtgacctggcaggaggccgacgaggaggaggtggaggggggcggggggagggccacaccggcgggtgtggccgcggggaccaagaagctcacccgccccaccacgcccaagtgagtcgactgggagcctaggacatgttgtttgggggagggggcgttcgtgctgattgcaggaagggggtgggttttcgaggaattggagcgcgggagggcgcgnnnnnnnnnntggtgtttgtgctgatggcaggaagggggtgggctttcgaggaattggagcgcgggagggcgcggcgatgccttggatggtatgcagggtgcccatgaccttgtcaggctggcctctgggactgcatcgcataccaggaagcacacccacggcgctcannnnnnnnnnagctggcctctggggctgcattgcataccaggaagcacacccatggcgctcatactacttgggtgccagataccccacattcaactctgaacttcccactccccccctcaggtggtgcggcaagtgggtgctgggcatggacgagttcaagcagggggtggtgggtgccaagagcaacaaccttgcggggctgagggggcgactgcccgagagcattcagctccccgcctctgtgacggtgggtgcgacgcagggggtcttgtgcctggcggagaatgtttccgtaagagtgggggtgctgatggctggggccttgcatcactgacctggggcaggggggtgtgcagtccagtgtccttacccggcctctggggcttcaaatcnnnnnnnnnnaagggggtcttgtgcctggcgagaatgtttccgtacgagtgggggtgctgatggctgggcccttgcatcactgacctggggcaggggcctgtgcagtccagagtccttacccggcctctggggcttcaaatcagacagcccttggtgctggggtctgggtggttgaaactgatcactggaatgtggaagtgttcgtcctccccctcccatttgtgggtgtgcgatcgatctatgattgccttccccctccccccctcccctgatcatactcacagatcccgtttgggtcctttgaaaaggcgctggagagccgggagaacagggagctggccaagcagatccgcgccgcagtgtcctcggtagctccccacagccctggcccggccctggcgcggtgccgcgacctggtgaaccaggtcgcggtgccctccgccctgcgcaaggagctggaggcgggcatgcgcgccgcgggcatccccgtgccgcaggacgaggagcggtggcaggccgccctgtgcgcgctcaaggtggagtattggttggatggaggggagtgtggacctggggaaagaagggtgatcatcatgtgggacacccctccagagtcacccctcccaaacccaccgcctcctcccaaactggcaaacccaacaggcggtgtgggcgtccaagtacaacgaccgcgccttctactcctgccgcaaggtgggcctccgcttcgacgacgtgcgcatggcggtgctgtgccagcgcgtcgtccccgtgcgctacgcctttgtcatccacaccgccaaccccgtctccggcgacgccgacgagatctacgccgagctggtcatcggcctgggggaggccatcgtctccggcgccgtccccggcagcgcgctcgccttctccgcgcggaaggatgcgctggacgcgccgcgcgtcctgctctaccccagcaagtcgcgggcgctggtggtggacgactcgctcatcctgcgctccgactccaatggcgaggacctggagggctacgccggcgcagggctgtacgaatcggtcaccgtggacgcgacgcgcagcgtggtggcagactacagcgcagatgacctgctgatggaccccgggttccggcgccgcctcatgaccgacgtgtgccgcgtgggcctggagatcgagcaggtaatggagtgtggaggggttgaggggaggagggagggaattggagtggtgtgtgtgaggtgatctgatggttgacgaggcggtgagcaccgtgtactgaggatgtagggaggtggagaggagggagagccgccgctgggcctgcgtcaggatcttgggccttccgcaccaggataccctgcccaagcaagccttttccccctcacccccccgcccaggccctgggttcggctcaggacatcgagggggtggtgggcaaggatggtgcgatcacggtcgtccagaccaggccccaggtctaggtcggttcctgaatgaagtagtaccgtgccaatgccggctttgtcgctggagaccttttgccatgccccggactctacttcaacctggacacctgtaaactcgaaaagctcgcaaccagatgtgatgccgttcaataggaggaggaaagcagcagcaccaagtcggagggtagtccttgacaattctgggtttgagcacagcacctcacccgcagccaaaactgctatgtcccaataaatcacttcccgtcatcggttccggagctcgatttccggcatgtctcaaactgcgagaggtaccaggttcgattcctggatggtccatcacaaggacccgggccattagctcatatggtagagcgctcgcttagcatgacccttttttcatttttaccgttgtggtcggcatgagactgcagcaggaccggctactcgcgacccggggctgagtttccggaccacctcttgggatagccggccatacctctgtcagtcagtgttacagtcacgctccgtgcaaggcccttgctcccttcctccgtcagcaccccacgcactcagccacgggctcgctcgctgtaggcatgtgccatgcgtcttgccacagacttggccagcgctgccagcgtgtctgacgttgccacctgcgacggcgcatcaaactgcccctgctccatccagggggacggcagtggggcttcccagctgacatggggtgacgtgtcccctcgctgctcgttctgcgggcctgcatcctcgcnnnnnnnnnncggggcttcccagctgacatggggtgacgtatccctttgctgctcgttctgcgggcctgcatcctcgccagatggcaaccccacgtcattgaggagagggtcgtcgccctcgtcgtccaaaaaggggtcgccgtcgccatcgttatccatgagcggcaggccgccatcaccgccccgccccagcggcaggcgctcctccaggtgcctgcaggccaggctgcagcgccacagtgcgtcagagtccaggcacatcgagtccagcgccgcccggccttgggggttgggagtgcggggacgatgccggagtgagaaggcggagactgggaggcattcgcggaggtgcgaaggtgggccggcagcagccggggcgacagctcatcctcccggaacctttgctgatggaggaccatcgtcactgcagccccagctcacagatgctgcttcgtggatctccaccgcgcctggaaaccctctcaccgacacgcacccaaccccctacatactacacacccctgggctcactgaggtcccgatgctggagcaggtgcttgaggagcgtcagcgcctcgtgcgcaagcgtggccctggcatcgggtccccagtccaccgccgggccctcgccagcaccgccatctgccctgtcacccgccgggccctcaccaccgacaccatttgctggccgggcgagcacggcggcatggaccactcgggccagcgccggcgcggccccggcgtggaccagctgcgcggcggcttccgggcggggcggccaggcgacgaggagggcggccagcgcccccagcgcatccgcgatcagtggggcggggcggccgccggggtctaagcacgcgagccaggcggggcccagggggtctgaccccggctgcgccgcctcgcccgtgccatcctgggtgccgcccgccgagcaccccagcgcggcgtccagtgcagtgccgagctccgggtccagcagggcgcggccgagcaatgagagggctgcgggcgcggcggcgcgtccagccagcatcctcgccagcaggccccccgtcagcagctccgacaggaccctggcggggccggctccctgccccgcggccagcgtgtgctcgaccagggcggcaaggaaggacgcggcggcggccagcagcgcctcggcgggcggcacacgccgcgggctgggagcctcgccggccggcgtttcatctgcatcggcggcatcggcggcgtcggcgacggcgctcaccctctccgccatcccggcggcggccaggcctaggccgctcagacccccacgcaggctcgacccggcgcagctcgcggccgcgcggaactcgggcaggtggaggccggggggccgagtgccgaggtcctcgaggcacgcatccaggcctccagcctccgggtcggcggcgatcggcgcgtcgccgtccagcaggtccagcacgaccgtgccgacggtcagcatggccgccagcatgcgacagcgcagcgcggcggcgcggggttgagtcagcgggtgcgcgcaggctgccgcgtccgcggccgcctgcgcnnnnnnnnnngcagcgcagcgcggcggcgcgcgggtgagtcagcgggtgcgcgcaggccgccgcgtccgcggccgcctg

SEQ ID NO: 44143 - DNA, 61 bp, Chlorella protothecoides
tcagggcagtgtggaccgctgagtggctgggtgggcagcgctgcagcggcctttgtgcagg

SEQ ID NO: 44144 - DNA, 97 bp, Chlorella protothecoides
tgggtggggtgggtctcaggccagccgccacgcagaccacacagctccctctccatgcaccgagccccgcacccgtccagccccccccccccccgcc

SEQ ID NO: 44145 - DNA, 4627 bp, Chlorella protothecoides
  modified_base (155)..(245): a, c, t, g, unknown or other
  modified_base (553)..(562): a, c, t, g, unknown or other
  modified_base (762)..(771): a, c, t, g, unknown or other
  modified_base (1886)..(1895): a, c, t, g, unknown or other
  modified_base (2397)..(2406): a, c, t, g, unknown or other
  modified_base (3442)..(3451): a, c, t, g, unknown or other
  modified_base (3977)..(3986): a, c, t, g, unknown or other
  modified_base (4257)..(4266): a, c, t, g, unknown or other
acccgcgccggcccaacggctggtacccctgggagcggcgcgctctgggcgcgctggacttctacgccgcgctgcacctgctgggagccgtgctgcccggcgccctggccctgggcgaggcgcgcgcctccctgggcgagccgcggctgggcgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccgccgcggcgctggcgggcatcgccagcctcgtcaccgccgtctgggtgatggacggcagccgggccgcgctgcgctgggagctggcgcggctggctgtgctggcggcgctggggccgcgcctgggcgcggccgagtggctgggggtgggcggcgcgcgcgctgcactggccgcgctggccgcctcgggcctcgtcgtcctcgcccacctggcgcgagccccggcctccccccgtagcaaggcggattgagctttccaccccgtgaccttgcagcacatgaatgcaccaattttgaaagagaccctnnnnnnnnnnactggcgcgagccccggcctccacccgcagcaaggcggactgagctttccaccccgtgaccttgcaacccatgaatgcaccaattttgaaagagaccctgtgtgtgtgtgtgtgtgtctacaagccatttttctggtccctgtcgtagatccatgagatgattgacttgaaagagccagcctcccatgaacgcattcgcnnnnnnnnnnctataagccacttttctggtccctgtcgtagatccacgagatgatcgacttcaaagagccagcctcccatgaacgcattcgcagcagcggtctgcatgagggtgcgccgaccgcatcagggcaaaactccgatgaagatgccggatgatctcgggggcatccaacacatacccaacacccgatgttaaaaatcaaccttgtgtatgagaggcagcagcgggacccaggcgtgatggccctgcaccctggctgcggagtgatccaggcggagtgaggtaccggtccctctggcgcccccgccatggcggccttcaagcggtacagattctacgacgccctgatcaagaatgacacgggcctccccgacacggtgacctgcgccgtgcaggacgaggcgctccagctcttcctgggctgcagcgacggcaccgtaatctgcctgcacgctgatctcagcctgaaggccaccttaccctcacatgccggcccggtgcacgccatagcatgctacgatgtgggtgactgcgggggtatcggacgggtgtagtgtcctcgtcatggtggtgcagggtgggcgccgaagctggatgcccctcgtcctgcccatcacaggccatgtcggtgcacaccttcgtggcctctgcacacacacatgtgtgttttacatatgacccccttcgcagcatgatgtgctgtgcacggtgggcgaggagggggccggcacgcccagcctgactctgaagatctggaacgggcgggaggggtcgggcgcgcccatgaaccccatggtggccaggctcttcgccaacaagtccccacccagcgacgccgtggcggccgccgacatccacgtgtcggccctggagtggcccaacctccatgtcgcggtggcgctcagctccggcgccctgcacatctccagattcgacaagggtgagggtgccggggtaggggctagtgggcgctgtgcctcggggtgtttgcacgccgcatcatcgccatatatccgttggactttgcgtacggtgtggacatgctttctacagtccctcgctatgcttccgggtttcatccgccgcgtcccacccagtgtccctcccccacccccacccccnnnnnnnnnntacgggggtagttggcgctgtgactcggggcgtttgcaccccgcatcatcaccatatactcttggtcttcgcgtacggtgtggacatgctctctgcagtccctcgctatgctcccgggtttcatccgccgcgtccaacccagtgtccctcccccacccccacccccccacctctcacacccacgcactcacaggcaagctgcggtgcgccggcctgctctgcagccccctgcacctcagcagcgaggaccgggaggccaccttcctggcctttgcgcgcacccccgcggcctccctgctctgggccaccacgcgctcagccacggcggcctggcggctgccgcgcggtgaccgcgcgctgctggagccgagcggcgccgagccgcgccgagccacgctttcctcggccacgcaactggccgtggccggcgcagaggcggtgctttccttcgacgtggagcacggccagacgggggcgctggcgctgcccgggcccaaggccnnnnnnnnnnggaggcggtgctttccttcgacgtggagcatggccagacgggggcgctggcgctccccgggcccaaggcctggctggcaggggcggggtcccacctggccgtcgcctcgcccgaggccggcaccggggctgccggcgccggggtcaacggcgccgtgtccctgcgcctattggaccccgccaaccgcgtgctggcgggtagcgccgagctggcgggcccgctgcgatggctggccgccacggccgcgggtgtggcggcgggcacggccgacggcggcgtggcggcgctgcgcccgctcccgctgcgcgcgcggctggcggtgctgtaccgcacgcgggcctatgcgctggcgctggcgctggcgcgctccgagcgtgccgacgcggcgacgctggccgaggtgcgcctgcagtacgccgatgcgctgtacgccaagcgcgactatgatgccgcgctggaacagtgagtgggcggcgggtgggggggcgctgattggagagtggagcagtggggttgaggggatggaggggaggttgctttttggaagaggtgaatgatggagcgagggggggggggtttgatggcattcaaggtctctctggggagtcttggcgcctcgtgacgtgcacccctcctccacacaagcgcccccctttccatctcccctccacaacaacaggtatctgggcaccatgggccacctggagccgtcgtacgtcatccagcgcttcctctccgtccagcgcctggccaacctgaccacctacctggagaagctgcacgccgcggtgtggtcaagtgggggggttagaaggggagaatacatggggtgggggacagaccacctctccctcagccgggtcttgagcctcggcacctggacaggactgtgagtaactgggtacccgtcctcccaggatcaccaccacgcaaaccccacccatgccatggatccgaagtttcccaatccgcactttcccaatcctcttccctcttcccgccttcctccctttccccaagggcctgggcagccccnnnnnnnnnnagcaaaccccacccatgccatggatccaaagtttcccaatccgcacattcccaatcctcttccctgttcccacctttctccctttccccaagggcctgggcagccccgaccacaccaccctcctgctcaactgctacaccaagctgggggacggcgccaagctggacgccttcatcgccggcgcgggggacggcgccggcgcgcccgcctttgatgtcgcggcggtggttcaggtctgccgcgccgcgggctacttctcccacgcgctggccgtggcgcgtgcggcgggggacgacaccacctacctcgatgtcctgctggaggactgcgggcgctgggacgaggggctggaccacatgcgcggcatggggcggcgggccgctgcggccgccttgctcaagcacggcaaggtgcgcagggatagtctatcttggtgggagggaggagctgcgctgttgcaccattggttttggtttcttcgaggagggggtttgggtgtgtggtttggagacagcagatgccctgnnnnnnnnnnggtccatcttggtgggagggaggagctgcggtgctgcaccattggttttgatttcttcggggagggggtttgagtgtgtggtttggagacagcagatgccctgctcattcaatggatcggctgtgtgtgccttgctttccagggctcgcgcgtgagactccagccaggctgcctcggggcacagacgagagcatgggcatccgtcgtcacaccccgcccacgcgcaccgccccttcctcgccccaccgcccacccagggcctgctggcgcnnnnnnnnnntcgagagcatgagcatctgtcttcacaccctgcccacgcgcgccgccccttcctctccccaccgcccacccagggcctgctggcgcacgtgccggtggaaaccacggcactggtcatggagctgtgcgtgccgcccggcggcgtggcgacgcgggacgccgatgccgacggcgatgccggccctgtggccagcctggccgactacacacacctgtatgccgaccggccggaggacctgcgctacgcctgcctgaccatcatcaacatgggcggcgcgggggcgcaggcccagcgctcgctgtaccgcacgctgctggacctgtacctcgccggcctgccgggccaggccggccaacaagat

SEQ ID NO: 44146 - DNA, 10696 bp, Chlorella protothecoides
  modified_base (200)..(209): a, c, t, g, unknown or other
  modified_base (278)..(312): a, c, t, g, unknown or other
  modified_base (703)..(898): a, c, t, g, unknown or other
  modified_base (1667)..(1676): a, c, t, g, unknown or other
  modified_base (2653)..(2662): a, c, t, g, unknown or other
  modified_base (2930)..(2939): a, c, t, g, unknown or other
  modified_base (3666)..(3675): a, c, t, g, unknown or other
  modified_base (7938)..(7947): a, c, t, g, unknown or other
  modified_base (8369)..(8378): a, c, t, g, unknown or other
  modified_base (8857)..(8866): a, c, t, g, unknown or other
  modified_base (9138)..(9147): a, c, t, g, unknown or other
  modified_base (9210)..(9219): a, c, t, g, unknown or other
  modified_base (9290)..(9299): a, c, t, g, unknown or other
cgcgcgtcgccgggtccagcgcctgtgtggcaaccacgcgcagcaccgtgcccgtcagcccgcgcagctgcttgcccagtcgctcggcggcggccgccacgccgcgcacggccgcggcctcctccgcctccccgcccagcgccgcatccaggagcgtcgccgaggcacgcgacacgcgcgccccggggatgtggcggggnnnnnnnnnncgtccacgatcgcatgtcgcggcggaggggcggtgtcggagcccttggcgccgccgcttttcgtccacnnnnnnnnnnnnnnnnnnnnnnnnnnnnnnnnnnnacgatcgcatgtcggggcggaggggcggtgtcagagcccttggcgccgccgcttttcgtccacaccaccgcctcggcaatgcgcccgtcctggaagcggcgcagctccgcgcgctcgtcgccccagaaggcgcggaaggcgcgggagccctcgacgtcctcggccgaggggccaacgtccacgccgcgtcgcgcagcgaccgggtccagccgcacggcgaccagcaccgcggcggcggctgggccgggcagtgggcgcgccgggtccgatgcagtgagtcgcgccacgacgcgcacgctgcgcgcacggtcgcccagtgcgcggcgcgccacgtcgcgcgtcgcggcctcctgcgcgcgccagggcgcggcgtcgctggaggccaggtccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcgttcagcgcgcgcagcgcgcgccgggcggcctcccccgccgaggccagcgcgccggccgacagcggcgccgccgcgttcacccagccaccagagtccaccagcacagcgttgtgtgcagcgcgccaggcggagggggaaagcgcggcgtcccgcgcgccgcccgcgccgcgtggcaccgtcagccccgcgccggcgtgcagcttcctgctggaggacagcgtcaccagcgccgcccgcaccaggtccagggccgacggcagcgagctctgtgtgaggaatcggaaagggggaaaggggtgggaggggattcgatgccgcagcaacatccttggcctctcgaggatggtgaccatccggttcgacccagccagggcccccccccccttttccttttcccgactaccacttaagcatctctttcacacacaagcatcacaccttggcagcggtgtagagcagcagctggacgaggaagccagggctcaggccgtcggcaccctcgtccagcgagtgtgcccgggcccagaccagcagcagggcgagggccgagcgcagggccgggttcctggctgcttcctcggtcacctcggcggtctgcctcagcagcagcaggtcctggtggaggagcgtggcagggaacatcgtgagctggctgttccgtattccgagactgagccccagaggcagcaggcgggaacaaggacccatcgggtaggcatcgcccggtgtctgggtcatggataagaatgggcaactcaacggcccnnnnnnnnnntacctatcgggtagacatcgcccggtgtacagggcatggataagaatgggcaactcaacggccccttcccttccttcttttcaagcacagaactttgcaggctgacaggcattcccatcaacagccgaccgccccatccacctccccagataccctccggggtagagataccaagtacctcgaggatgctgtggttgtagtggggcgtgggagccggctggccgtccgctccgaccacgcccctcaggttgttccggtgcggggccagtttggaaagggggaacgtgccctccgcgggcacggcgtgcaggcgcagcgtcaggccgcccaggcctgtagtggccgctggttgcagcgcgaggaaagggcggcgcgggtcgctgccggcctcccatgcaatggaccatgtggacgggtggcgttgcagcctggccgcgacttcggcaaggtacagcgctctctttgcatggtacctggaggtggtggagatggggagggaagggtacggcagggccatcggttggtaaagccaggacagagagccacctcgaatcacggcccttgaactcctgccgcaccggttgttcagctggtccttgttgtcaaagcaggaggccggtatctcgagcgccacgtcgacgctgagcacgcctccctcccccaacaaaacgcactccagagcggctggtccaatcgcgcgaaccaaaatgggtgcctggtacttgaagggtcggttgcctgggagaaagctcatggccgcaagcagcagctgcacagactccatgaaggccctgctgtcggcctgggttggcgtcgcagtcgccaggtgttccgacagagcctccaggtactggctcaggccgggccccaccagggcggagtctgccagcgcatcctctagtacaccgttgatctgtgtgttaacgaggggtaatggaaaggcgtcgagggagctgggtatggatcctgatgagatnnnnnnnnnnaacaccgttgatctgtgtgttaacaaggggtaatggaaaggtgtagagggagctgggtatggatcctgatgagatctcgccttggataggaagcagcagggcccatgccgcatgggcgaggggagtggcatggtccagtcaattccactcatcagcctaggcacagacctggagggccatcaggctgcctgggacctccatcaaggtgtcttcgtgagttcggtgggagattttcgccggcttggcggctttgctggagtttccaagnnnnnnnnnnggagttcggtgggaaactttcgtcggcttggcggctttgctggagtttccaagctcagtaccggtgcctccatcctctgagtggtccccattgtcgatgtctgtgtttgggtcgaggtccgactcgaacctgcagtcctccgagtctgaagaagactttgccatcctataaacagaatgtatatccttggcctatccagcaatcatgtcggagagctcgttgtgagtgtgcagtatgatatagtggcaggcgcgagtagtaactaccctgtcagaccatggtagaggctcgcatcagcttgcatgcaaacttcggagatttaaaaataaattccagggtcccttccatgttttaagggacactcgtcgatgcgacggagaggcactcgcctctcctgtgctgggcagtgaatgccgggtggctgggcgcgcgggcgcgccaccctgagcgaaactctgtaggaaacttgcaagtcaatgcctcctagatccggtcgagaatcaggggcagcattcatctccagatttcaatctgcaagtatgtttacctattaacatgtgagaggaggcttgcagcggcgtcgttgaacgaggaaacccaacctcggtcgcgaaagaggccatgacccgacccaggtctctattccgtaaagccaaggattatatcacctacgatctggtggagattatagccccgcgttccatcccaaatcctcctggatacgtgnnnnnnnnnngacctcggtcgcgaaagaggctatgacccgagccagggcgttattccgtaaagccaaggattatgtcacctacgatttggtggagattatagcccctcgttccatcccaaatcctcctggatacgtgcctccaagaaagcgcagcttgtcagaagtgctacaggtaagtgcaggcaatcctttgtggcaggccctgggcagttcgaggagcgcctgtcccacgacatgtctccatcaaatcctgcagaatgtgtacaaaggcaccaagctgtactttgatagctggagtcaggagaagatagaccgacacctggctgagcattatggcgaggactacatcagggagaaggccgagaaggagacttccaagaaggagtggcaggagcttgtcgaaggctttggtgagtgcaagaaccttactcaaggagtgcaggggcatgaagtgatgccgggcgttgcctggcttgccaggatgctcaatcaatgtgagatgcggtgcttcatgccagctcttcccctctccttcctccaaaggtgatgcggccaagggcggcggcaaagccatggtgcccttccttcaaaatctttacaccagccgggcagccgcatacggtcaagccctccgacaatttgtgacagggtaccgggagggcattgctgagggggtgccggctccccaagcggatccaacggatgctgctggagagtcacagcaagctgtgacccagccatcgagggtgcgtcctgggcaagacagtggagactctcagccggagacagggagagatttccccagaaagccggtgtcatgactctttactcttggagctgttgccaagaatgcgcttgttgagtccgcaatggagtctctctaccccagactgaactttcaataacttgtcgcttgagcgtcgccttccgacacccacatcgctcaacatgacttttgaactggctttgactcttgagtatgcttgcctgaggttattttagcattcactgccctcgtgcacttgtgtcacaccgacctccacctttctgagtctgacgcacatcagccattgctccaagcacatgatggtggggattgaggggcttgagtgccactgcagagcaaggcaggacagattccagcagagtatgtgctgtacctcgttactgtcatcatcagagcggcctggatgcatgcagaggtgttgccgtaggggaactggaggctggctactgccatggctggtcagggacgactgatggttggctctcgtctcatacgaagagggggcggaactcgccatgtgagagtttgcagagctcattgtagtttgccatgtctgggcgtggagatgtgtgggggagcagttggtgtggatgtgaaggagtccgactcaggcatgcaaacagaggattggtgcagcattcacgatggtcttccacagggctgtcgtcgcatcccattcaattccagagatctaccaaaaggtctgccatgcatcgctcaccaaagttgctcccgaatcctgtgctggactcttccctcagagcggtggggctgtccaccgtcccctccacctcgatgaagaggtcggagggagccgcccctcgcagcgccaccgtgacgatgccatcgtcggcagctcgaagctgcagggagttgccctgcacgccctccaccttgcccaccaggcgcacccgcttgccgatgtgctggcccaggagttcgaaattcacgcgaggcgcgggagcagagatgttgatgccctgcattgcgaatggatgtctgtttgagtttctatggagacactcgatctattgattggtggacggtatggtgacggtctgtttgtgtcgtgttcggatcccgcgaggggtgtttgagtggagagggcgcttcacgcgcagcagcaccagcactcggtcatggggttttcctggaagtcattcaacgcatgttcacccacgcatacgaccctgccgcctccccagtctccttgcgcagaatcagcattctcgcctgttgtcatgcctcacagcaccggggaatcagggtctcgaacccgcactctgcagcatggaaggcctgtgaaagacaccggcttcatcatcccagcacccccgtccaacccactactcctcctccgcgggggcggcctgcgccgggtactgcgcggccacgtcggcccaggtccgccgcagatcggtcagctcccgcagcagggccggcagctcatccagaggcacacgcacttgcgcggtgctgtcgcgctcgcgcagcgtggccgtgccgtcctccaggctggtgtagtccacggtgacggcgaagggcacgcccagctcgtcggtgcgcgcgtagcgcttgccgatggtgttccccgtggtgtccaccgcgttggccagccccgcgcgcgtcagcgccgccgacacgcgcgccgcggtggcgttcagctccgcgcgcgcgagcagggggaagaccgtggccttgacgggggcggccagcggggagaagcggaagacggagcgcttgtcggagccggcgcgccagtagaaggagtgctcgaacaggcagtacagcaggcggccgatgccgaaggagggctcgatgaccgcgggggtgaagctgcgccccgtcaaccgcttgcgctccttccggatgtccaccgagccgggggccaggctgtaggtcttccccccggcctccagcgtcgccggcccgcccgcctccagcgcggccttgactgccagcgcgccctcctcgcacagcgcctccagcgcggcggtcacggccttggcctcgcccttgaaggcctggcccagcgccttcttgttgggcagcacggtcagcgtgtccacctcccgcgcctcggcaaaggtctcgtacgcgctcagctccaccttgctcatggcagtgtgggcgcggaggtcgtaggcggagcggtcggccagccccgcgcactcgatccagccgtggctgcagtgcacctcgcagtcccagcagtcctcggcgtagtgcgccatctcgtggcgcaggtgctgccggaagcgcacgcgcgccgggtccaggccgatgcgctcgcagaagaggtgggtgcggccgatgaagtaggccagcgtctcgttggcgatcacgccgccggccaccgcctcgcccagcggcatggggagcgcgcgcttctcctcccccatctgcagcgcgcgggagtagaggaggggggccagggacgccacgctgccgaacttggggtggcgcttgtcctccgggtggcagaagtgctcgatctcggcctgggtgaactcacgcacgcgcagcagtccggagcggggggagatctcgttccggtacgaattcccgatctgcgatgtggaatgggggggatagggggggagggtgtcatggggaagtgagtgtgatggggaggatgtgggggcgtgcccctcagaagccagccacgcaaccagcttcgcagcccagcctcccctcaaccctgcacccaaccacaatcctgagaacaaccccactcagcctccctcccaccaacacccgaccactaggcacctgggcggcggcaaagggcagcttgttgccgttgtagtagagcaggtccttgaagttgacaaagatgccctgcgcggtctcggggcggaggtagcccgtgaggtcgcccttgggcccgatgctggtcttgaacatgaggttgaaggggaagggcgtggacagctcgttccctgtctccggcgcggccacgccgtagcgcgtcagcgccgcgcccagctccgccacgcccagctcgccgacgcgggcgtgcaggtcgcgcgcggcgcggcgctcctcctcacccgccggcggcgtggtgcggccctcgaaaaccgcctccagtgccgcctccaacaggtggtcggcgcggtggcagtccccggtcttcacgtcggtgaccatgaagtcggtgaagcgctccacgtgccccgaggccttgagcacgatctcgggggtgaccgcggggcactccacctccagcatgccctcctccagcacaaagtgctggcgccaggcctgggtcacgttggacttgatggcgcagccaggggggccgtagtcgtagaagcccgccaccgagccgtagatcttgaaggaggggatgacaaagagcttgcgctccagggcattcacctggggaggggggcgtgggtgggattggtatcgaagagagtgggacaaagtcagagagtacgcaagaaataagcgcgaggtcaagaagatagtggtgcatnnnnnnnnnntgtgggtgggattggtatcgaagggagtgggacaaagtcagagagcatgcaagaaacaagcgcgaggtcaagaagatagtggtgcatgcacagcttcctggatacagacatgtgggcaaaacagtcgagccctttggcatgttgagcatggatgaatggactgacactgcatgctcgccgcatgtgcagaaggtacagaattcccagcaatcgccgaccgaagagccagctctcccagcacgcaccacgttggcgcggaaggactcgcggctctgcaccccgctcttcccagtggcctcctcatatgcctgggaggagggtcgcagcaggcactcagtcagcacaatgtgcggcccaacaccccatgcatgccgagtggcagtcgggacccagtctcgagccccaaaagcaagcagactgtnnnnnnnnnnccccaacacctcatgcatgctgagtggcagtcgggacctagtctcgagccccaaaagcaagcagactgtcctgtctgcacatcctcttacccgcaccccatgccatgtcccaccttctgcttctgctcctggaccaccttcagctgcttgagggcctcaatggccgcgtcgacggccgcctgggagcgtgcaggaggagggagatgggcatgcctgcaggtcacatccatatgcaaagaatcccatggatacctaccttgtcagccttgccatccttggcgtctgccttcagcgatcgcacaatgtcgccctgtcgagccacgctctcgatggcctcctgcagcgcagcctccaactcggcaccttgggcagacatgctttccatatgctgcagtgatgtcaaaatgatgccaatacgatcatggcgtccttgctgggcctttgttggaggtgggtgcggtcacctcatcggaacacgnnnnnnnnnnttgcagtgatgtcaaaatgatgccagtacgatcatcgcgtccttgctgggcctttgttgcaggtgggtgcggtcacctcatcggaacacggaaatcgtgaaaatggaaaaccgacgggatgcttgccttccaacacactgcctacatcggcagagaggagcacaaacatacacatgcaaggcggtggatgcttcatggggcccaagtatttttcaggtgcacccctctggcatccctagactgcgttggactcctgtcttgcagcaccgggnnnnnnnnnngtttcaggtgcacccctccggcatccctgaagtgcgttggactcctgtcttgcagcaccgggnnnnnnnnnngtctttatagtacataaagaactcatggcaaacagcgtgctggctcagcctgccatggccatgcagtgcgnnnnnnnnnnagtgatccgctataccaaactctttcctcaacagcacgcatggctccacgggagcatcccattcagattctgtatagtacatagagaactcatggcaaacagcgtgatggctcagcctgccatggccatgcagtgcgacaccccggaccctccctaccccagcaccgacctcaaacctgtggcccagccacagattgccttggaaagacagcccgacgacccctcaagccacacgccagtggtttccttgaccagaatcgacacagctgtgcgtttggtgaagggggggattttagctcggcagggttttgccagtgggttgcttggggggctgacgacagatgacgctcagccacaacccccccccgacccctttcactcgagtgcagagagagagcccaatggatgcccaggtgcaaagcctcatgcacgacccggcctttgcagccgcagtcagcgcaggccaagtccgtgctgcggctgaggctgcagtggcggcgtacaaggtgcggggcgtatgtgtgtgtggtgtggtgtggtggtggaagggggggggttccagcgccatgcgtgcgctttgggctgtggaggggttggtggaccggttgtcggaaaggccaggctcaagctcgccctcccgttctgtctcgcatccgtctgctcccacactgaatgtctgtgccttcccagcgacaataccctgtctaccctcgcagcggcacaagggcctcccggagcatgcacaccgcaacggcgcccaccccagccgaccgcggggtccgctcggctacggcaccgctgcacggggcaagacgctgccgtccccggcgtcccccggcgacggcgccgccgggctggagccttggcagcgcgacctcctccgcggcctgaccctggagatcctggccatggaggaaagcgtgccgtggggcctggtgcggcgctactggcgcaccaagcgcaccggctggcgccgcgccctgcgcgtcgccgaggggcctgccgacctggtggcacggctcagggtgaggcggcgtgttcaggctgcgtgcccctctgcgcaggggtcagcggctgccgggaacctcctgtcgctgcgcgcctcgtgtccttggtgctcgtcgcagagactccctcctgcatgtggggccagtgtggacgtaatgaggcagcattgtttggggccgcacccagcacacacccctcacgcgcacgcaggagctgcgcgcggcgctgctggccgacgacgccgcgctggccacctgcggcgaggcgtggcaggcggagctggacgcctgcgctggcctgccggacgggctggagcgcgtggcgggcgcctgggacgagctgcgcgcctgcgtggcggggtggctggagggcccgcgcggcgcgacccc

SEQ ID NO: 44147 - DNA, 61 bp, Chlorella protothecoides
cgacgtcgagcggtgatcgcgggtggggggggggtcaagtactcggatccacctgttgatc

SEQ ID NO: 44148 - DNA, 78 bp, Chlorella protothecoides
gcttggaaggacgggcaagcgtgcctcgcgcaccgcacagaccgtgcgcctcgccctccagccgatgcgatgtgacag

SEQ ID NO: 44149 - DNA, 61 bp, Chlorella protothecoides
tggtggcctcccccgacggcgccccgccgcagctggcgccgccccagctggcgccgccgca

SEQ ID NO: 44150 - DNA, 61 bp, Chlorella protothecoides
caaaggcacacaaatggcggcgtaactctccgagcaggtatcatgctgcatgggtgaatgt

SEQ ID NO: 44151 - DNA, 61 bp, Chlorella protothecoides
ccgcacgcactgcctgtggcactggcaggggctggaatcgacctgcatcaggtaaacttga

SEQ ID NO: 44152 - DNA, 61 bp, Chlorella protothecoides
agatccaccaagattatcgtggccgtggagggcctcaaggcgggacagaaggcttgctcgg

SEQ ID NO: 44153 - DNA, 72 bp, Chlorella protothecoides
tcgcccgcgttgcgggccgggccgcagcccggttcctcgccgcccaccccggccccctcgccgccctcggcc

SEQ ID NO: 44154 - DNA, 61 bp, Chlorella protothecoides
cgggtgggaagggggagtggtgggtgcgggggggtctcgcatgcatggcaacccaggaata

SEQ ID NO: 44155 - DNA, 61 bp, Chlorella protothecoides
gtgatgcaaggggggtccggagagaggagggggggcatgcaaacagaaggcttggcttcaa

SEQ ID NO: 44156 - DNA, 73 bp, Chlorella protothecoides
ccagggcttctgcttcctgaacagcgcggcggtggccgcggcagcggcgcgcgccgccggcgccgcacgggtt

SEQ ID NO: 44157 - DNA, 1185 bp, Chlorella protothecoides
  modified_base (417)..(493): a, c, t, g, unknown or other
  modified_base (627)..(636): a, c, t, g, unknown or other
  modified_base (890)..(899): a, c, t, g, unknown or other
ccccgccccccgtgccccccggcgcgggcgtggcgtacgaggtccgcgtgctgggcctgcgcgcgccctggttcggcctggtgctgcgggcgcggcgcgtgcacgccgcgcactgcctgacctcggtccagttctcgccctgctcgcgccacctgctgctggcctacgggaagaagcacgtcagcctgctgcgcagcctggtgcacgagcgcggcgagacgcggcccatgcacaccatcctggaggtggtgcgcctggcagacggcggcctggcccgcgtgctgccctcctgcgaggacgagatcaacgctgcctgctggcacccgcacccgggcggcggcgtggcctatggcaccaaggagggccgcctgcgcgttgtcacccacgaccgcgccgacctgtgagtgctgggggggnnnnnnnnnnnnnnnnnnnnnnnnnnnnnnnnnnnnnnnnnnnnnnnnnnnnnnnnnnnnnnnnnnnnnnnnnnnnnattcagtgagtgggaggggatatagaggtcagaagggggtggggtggggtggagagtgagggggaacaaaggagcgaggggacaaggggtgccgctgtgtgaactcctggggaggaaactgtgtcagtagacannnnnnnnnnagaggggtgcccctgcgtgagctcctggggaggaaactgtgtcagtagacagcagactgtccttcgctgagaaggcctggggtcggcaaggggtccgagggagcatacatgcatacatgactgtccttcggtgcttcggcgaagcatagcacctcccaaatccctgcttcctggccatgcccgacagagccatagaaccccatcctaacccccccccaccccaatcaacacaccaccaggtgcgacgagcatgnnnnnnnnnnatgaccgagccatgggaccccattctaaccccctcctccatcaacacaccaccaggtgcgacgagcatgatgggagcagtggcgcgccggcgccgcccacgcccccacctggctcgggggtgctgctgcagtacatggagggcctggcggccacgccggtggccgcgctgcccgagcccgtggaggagctgctgcgccgcgcccaggcccgggcccacgagatggtggagacgctggcggccgcgcccgcgcacgcgccggtcgcgcccgccttccagggcccctt

SEQ ID NO: 44158 - DNA, 74 bp, Chlorella protothecoides
acacaggatgctaccgcacagctgcgctcccttgcttccaaacaaagctgatgtcagcgtctcagcagcaccga

SEQ ID NO: 44159 - DNA, 61 bp, Chlorella protothecoides
cgctggcggtggcggcggccacgagggcggcggggcctcctccccagcgcaccagtaccac

SEQ ID NO: 44160 - DNA, 61 bp, Chlorella protothecoides
atgttagaagtcgatgtcgggcacggggggggcacagcatgaaagcacaggccctaccccg

SEQ ID NO: 44161 - DNA, 61 bp, Chlorella protothecoides
tgggagagggcgactcctcagggctcggagggggagactcctgcgggctagggctgggcga

SEQ ID NO: 44162 - DNA, 61 bp, Chlorella protothecoides
gcctggcgcccctggcgatgccacggcaacaccctgccgacggcccacgtgatggcatgca

SEQ ID NO: 44163 - DNA, 61 bp, Chlorella protothecoides
ggctggatggtggcgcgggagacccgcgggggcctgccgatgggcggaatgctggcggatg

SEQ ID NO: 44164 - DNA, 61 bp, Chlorella protothecoides
ggccgctgcaagcctcctccccaccactgccagcacggcaaggacagggacggccgctgca

SEQ ID NO: 44165 - DNA, 61 bp, Chlorella protothecoides
gtgccatcgacagaggatgctgcgcccaggatggccgccaggcaggccgtccagcgctgca

SEQ ID NO: 44166 - DNA, 61 bp, Chlorella protothecoides
tggacagtcccatggtatgaagggtcgaggggcgaatggacccggacttgctgaagccctt

SEQ ID NO: 44167 - DNA, 61 bp, Chlorella protothecoides
ataggatggggaggtggtgccaccgggtgggggctctccgagccatgaaagccacgagtcc

SEQ ID NO: 44168 - DNA, 61 bp, Chlorella protothecoides
tcccctgccaggctccagttggaggcgggggcggggtctgcagcgtccacttcccgcgtgc

SEQ ID NO: 44169 - DNA, 61 bp, Chlorella protothecoides
ctcgatggacgcatggcagcttcgtggggggggagaatggtaccacgcgcatgctagagtg

SEQ ID NO: 44170 - DNA, 61 bp, Chlorella protothecoides
catagatgcgctcctggccgcggcacacgcccaccagcaccctcgccgaggacgcagcgcg

SEQ ID NO: 44171 - DNA, 61 bp, Chlorella protothecoides
gcgaaaccaatccgcggcatttagtagcggaaaagttagaccaaaccatgaaaccaacata

SEQ ID NO: 44172 - DNA, 61 bp, Chlorella protothecoides
agcgccatcgccagccccggccgccgcgcctgaccagccgcccccagcctcggtcactgac

SEQ ID NO: 44173 - DNA, 61 bp, Chlorella protothecoides
ctgggcacagtaactgccagacatggcaggggatggaagcaggagactggaatccattgag

SEQ ID NO: 44174 - DNA, 61 bp, Chlorella protothecoides
gaatgcatcggctttctgtgagcggcggggggctcgggcggagggacctcatgcccgtatg

SEQ ID NO: 44175 - DNA, 6122 bp, Chlorella protothecoides
  modified_base (142)..(151): a, c, t, g, unknown or other
  modified_base (833)..(842): a, c, t, g, unknown or other
  modified_base (925)..(985): a, c, t, g, unknown or other
  modified_base (1335)..(1344): a, c, t, g, unknown or other
  modified_base (2529)..(2538): a, c, t, g, unknown or other
  modified_base (3002)..(3011): a, c, t, g, unknown or other
  modified_base (3090)..(3251): a, c, t, g, unknown or other
  modified_base (3641)..(3650): a, c, t, g, unknown or other
  modified_base (3752)..(3761): a, c, t, g, unknown or other
  modified_base (4356)..(4365): a, c, t, g, unknown or other
  modified_base (4431)..(4634): a, c, t, g, unknown or other
  modified_base (4994)..(5003): a, c, t, g, unknown or other
  modified_base (5644)..(5653): a, c, t, g, unknown or other
gcgccccggaggccgcgggcccttcctggctgggggcgcgccgcgcgcccgtcgacatcgcctgcgccgcgggttcggggtccagtcccgccgccgccgcgtcgtggcactctggctctgcgcccccggcctacagcctgcnnnnnnnnnnggggggcgcgccgcgcacccgtcaacatcgcctgcgccgagggtgcggggtcccgtcccgccgtcgccgcgtcgtggcaccctggctctgcgcccccggcctacagcctgcaggacgcctggccgccgggggccggcccacgtcccgccccggcctggcccaagtccgaggccctgccggtgggggcgcccacgctgccgacctccctcagccctcacactcccgacacggtgctggggtgagcgcctgggctcggcggagagggggaccttgagccgccgagttgaggggggcatggacgaccagccgcaggggctgactggctgtggcaaggggaggaggggtggtcgctgcaggagagggcaggcaggggagcctcctgcgctgtggcctgctggcgtgaggtcgccgggccgcgtctccccgcggtgcacactctgacgccccggcgccgccagatccgcaacccacgtcggcaagacccccaccctctccccctccgcaggcccggcccgctgcagtccgccacctggcgccgccccgaggccggcgcggtgcccgacgcccagggccttccgcccaccccgccgatccccccggcccagccgccgccggcggcactgggcgccatgcacgcctcgccaacccccctgccgcccatcgccccgggcacccttggctnnnnnnnnnnccggcactgagcgccacgcacgcctcgcccgaccccctgccgcccatcgccccgggcaccctgggctggctggcccggcccannnnnnnnnnnnnnnnnnnnnnnnnnnnnnnnnnnnnnnnnnnnnnnnnnnnnnnnnnnnngccctgcgctggccacgctgcacccggtggtcctgctgggtgccgggccgcaggtggggacgcagcccgtgggcctgacccggctcccgccagacccgggctcctgcacgctgctggcagacggcagctggtggatcccggtgcccgtcgcggcggcgtgccagcggctgccgacctccgcctgagaccccgggctcgggcggggcaggccgggcggctgcgcgccgcggcggcgccggctgcgcgcggctgggccgcgagcccggcatccagggccacccacagactccggtgagcgtcgacagtccctctcccccatccccccccatcacgcaagaacggcctggtgnnnnnnnnnnatgagcgtcgacagtccctcttccccccccccatcacgcaagaacggcctggtgaggagcccgaggcttcccattcaagcacagcccgggcaccccggacatcaactccaaaccgtttcactgtcagccccgaatgccgcccgatcctccattgaattctttgttgctctgtccgggaggaccctgcgacgacgctcgcgggtgcaccctccgagcacctccccccgctgtcacggggaggtgccggacggcacgattgttgcagccccgagccccacgagcgagatggcaggagcgggagcggttgccagcatgcgcagccacagcgcttccctccgcccctccaccgagtgtaccctacttttccaccctccctctgcatccacggcaccatgcactgatacatcttttctccttcctgtcttctcccctctcctcgagcgtgcagaccgacagccagcgggcccagagactccctgaataacagggacccgggcccggcacaccttcgccaggctcttccctctttcactcttgagatgtgtaggcaatatatgcagtagtgtggcatgtaagtatcgcagcgttccctgggacccgtccaggaatgggaggggaggcttgcaggggtcagcgccggcccgggatcacctcgcgcctggcatagcggtccctgctccggctgcgcaggcgcgactcgcgccgcacttcacggctccgactgcggtggcggtgctcccgcgcgggggagtcgtcgtctcggccacggctgcggctgcggtggcggcgcttcctctccggcgattcgccacggctgcggctgcggtggcggtgcctccgcgcgggggagtcgtcgtctcggccacggctgcggctgcggtggcggcgcttcctctccggcgattcgccacggctgcggctgcggtggcggtgcttccgcgtgggggagtcgtcgccacggctgcggctgcggtggcgccgatcctgtacagacgagtcgacgcggcggactgtcgacttctcatgcggcgagcgcccacgctcatcgcgggagtgccgcccatgccgggacggagatgcggcgtccctactcctcccctcctctttgatcgtgcgcgctcctggctctgctggatcatctgcctcacccgcggcagggccatcggtcctggcactgccgcgatnnnnnnnnnncgggggagtcgtcgtctcggctgcggctgcggtggcgccgaccctgcacagacgagtcgacgcggcgggctatcgatttctcgtgcggcgagcgcccacgctcatcgcgggagtgccgcccatgccgggacggagatacggcgtccgtactcctcccctcctctttgatcgtgcgcgatcctggctctgccggatcatctgcctcacccgcgccagggccatcggtcctggcactgccgcgatgagggtcgcgctcaggcatagccccagccccacactgtacagcggaaggagggtcgcggtcccttcccgcctctgatgcactaccgacgtcgtcgcggctggcgccgtcggcggcgggtgcatcgaccccgttctgccccggggtggccgcctctgcacctccagccacagcgccatctggtgcatccacatgtcccagcgccctcagcatggcgctgatnnnnnnnnnngagcggaagaagggtcgcggtcccttcccgcctctgatgtactaccgccgtcgtcgcggctggcgccgtcgtcggcggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcacctgcatcgcagaaagtagcgtccgctgctgaaatctggttgagagcattcataaagaagggcatgggcagccgccagggaccagcgctggccagtggcacgctccgcgacaggctcatccacccctctcccaggattccggagcctgcgacgtggacaccgcggtggcatgccaccaaatcgtgcccccagaacacacttaccatcccctcccagggcgctgcgacggcccagcagcaccctgcgcacggccgccagcgagtgcgacttctggtgcagcagcatgagcacccgcttcctcagcgcctcctcctggagcagccagagagagcccagcaccagcgcagcctgaaggggtaggtggaaagcatggcagtatggagacannnnnnnnnnattcatagccccattccacgtcctcccttccaccctccacctgctgcaaagtgaacagcccggcctccattcgtgccagaaggagttcgtcctcgtccatcnnnnnnnnnntgccagaacagtggggcgagtacccgggcgtcctccatcccctctgccacacaggaccggtcgtagacccattccacgtcctccctttccaccctccacctgctgcaaagtgaacaacccggcctccatgcgtgccagaaggagttcgtcctcgtccatcgcctccaagacctgagcagaggcgagcctgtcagggggaagagccgcacagccggtgaggagttgaggggccggtcggccgcatgggcctccccacttcacgtctgggaatggagcgagcagcttcaacaccctgcccttccccattcccccaagcccacctttcttccccagccgccacacgctgctcgtatcttaggtacacctccaccagccggtccaccttctcaaactcgttctccacaaacttgctggccacccggtccctccgggacgaggtcggcagcatctgcgagggatcggttggagaacggagtgggttgggggagcacttggcctgcattgcccttgaaattcttcagaagatgcttgcctttgcggccagcaccctactcacacacccctccccacctggaacaggtttgtgatgatggannnnnnnnnnaggaacggagcgagcagcttcaacaccctgccctcccccattcccccaagcccacctttcttcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggcctgcattgccgttgaactcttcagaaaatgcttgcctttgcggcctgcaccccaagccacaccccccgccccacctggaacaggtttgtgatgatggacaccgaccgctcctcctcctcctgccgatccacctcatccgccttctttgtctgcgtgcggagggaggtgtgtggcgggtcagcatgccaggagccatcctctggttcacatcgaggttctggcctacaacttcccactcctccaggcttccaccaggcaacctgcacagaacactgctgaccccagtcaacgccactccccgtccaccacggccaccgtacaccgacatgccttgatcttgcccatgaagatgccgnnnnnnnnnnaccaggagccctcctctggttcacattggggatctggcctacaacttcccactcctccaggcctccaccaggcaacctgcatagaacactgctgaccccagtcaacgccagtccccgtccaccacggccaccgtccaccggcatgccttgatcttgcccatgaagatgccgaagagggacttgaggccgccggcgtccaccagcctctcgcaggcgggctgggagttggtggtggcaaagtcgatgcagcgcagggtggccactctggcagcgctgttgcccctcaggatgagcagcatcagttcgatgcctgcaggacgagagggagaaagtggtgggcatcaggatggtgcaaggaggggtggtggggctgcctcgaattccaccgggagcagcaatgcctcgccatctcgacacgaccccagggtcgcatgcgtggccaggggcggggcggcccgctcggaagtggaacagtgagcaagataccatggggcctcccaggatacactgttcttcacgatccccacacaatctccagacaccgccctggctccgcacattcacccctgaaatgccatcgccaagcggctgtccctctccgcttcaccagcaccacctgcttaacttgaacacccaacccnnnnnnnnnngcagtgagcgagatactctggggcctcccaggatacactgatcttcacgatccccacacgatctccagacaccaccctggctccgcacattcacccttgaaatgccatcgccaagcggccagccctctccgcttcccaccaccacctgcttaacttgaacacccaacccagttttttcccttccccacccctcctttcccatacacaccacacacaccttccccctcgacaaacgcgcgctggccggcggagagggcgagcagggcgcagagtgcggtcaccaggttctccaggtactcctgctcctcgccctcctctgccgcgcgcgctctgtacggcgctgcggcctgcagcagtgcgtccacgccgccaccggcgaccagcgcctcgcgcggctcgccccccgcctgcaccaggatgcccagcagctcggcggcggcggcgcgcaccgcgtcgtcgcccgcgcgcg

SEQ ID NO: 44176 - DNA, 61 bp, Chlorella protothecoides
tgcggctgtggccaggcatggcaagcggggggcctgagatcccgaaatcaaacagggcatc

SEQ ID NO: 44177 - DNA, 109 bp, Chlorella protothecoides
catgatgcaggccgcgctgggcacgctgccgcgccgcctggtggaggcgggccgggcgccggatgttgcgcgcctgttcaagaggtgcggctgccgtctgttggtgcac

SEQ ID NO: 44178 - DNA, 1299 bp, Chlorella protothecoides
  modified_base (125)..(323): a, c, t, g, unknown or other
  modified_base (490)..(659): a, c, t, g, unknown or other
  modified_base (1076)..(1085): a, c, t, g, unknown or other
agaaggggcagcaggatgctggcgaggcgggcgggtcggccggcaaggcggcggcggcggggcctgcccccgccaaggcggcagccaaggccgccagggaggaggggcgagcggggcgggggcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgccgctcgacccctccctggcgatggcgccgccgaccggcggcgccgctgttcccgcgccctcgcgtgcgtccccggacgcggcgacggccgcgcgcgacgcgtcctttgccgccgcgcccgcgccgtccgacgcctcctccgtgccgctgtccgcgcccttcggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgcacttgctgcccacgctgggcgccgacctgctggaaagcggggcgggcggtgcgcgccacgccgaggcgagcgccggcgcggcagccgagggcggcgcagtgccggcgggcggggtgccgggcctgggcccgcccgcgcgcgggctggcgcccgcctcccacccgggaccggacccctttgacctgcacggcggcagcctcttcgcctcgccccaggcggcgctgtggcgccaggccgggcccgcgcttgtggtgggtggggatgttgttggtgtcgagaagtgctggtggggcggaatgggagggtgttttcttcatggatatgcctcttggacgcaacccccccctgttgcactgatcgaccgggggacatgcactgcccaccccagtttctcactttctcaacctccccgnnnnnnnnnngccccccctgttgcactgatcgacctcgggacatgcactgcctgccccagtttctcactttctcaacctccccgcaaactcccacaacgtcaacccagcagggcaacgaaggcctgatgtccggcttctaccagggcggccacgccggcgtgagcctgcacgggctggaccccttccacggcggcgacggcgctgcggccgcctcggccgaggc

SEQ ID NO: 44179 - DNA, 61 bp, Chlorella protothecoides
cacgcagggagttggaagaggctgccaaggggtttggagatcgcgtgcgatccggtgaagg

SEQ ID NO: 44180 - DNA, 83 bp, Chlorella protothecoides
accttggcgcttccgcgtacgctaacctgtgaacacggctgccgggtggggggggggcagtggcatagatccttgctccatcc

SEQ ID NO: 44181 - DNA, 61 bp, Chlorella protothecoides
cgccacgatcatggcagccaggcggcgggggtgcgtgcaagcaatcatcttgcccccggcc

SEQ ID NO: 44182 - DNA, 61 bp, Chlorella protothecoides
gcataagcccacagcaaactgttgtggagggggggattcaaaattcagaggctggactgta

SEQ ID NO: 44183 - DNA, 6875 bp, Chlorella protothecoides
  modified_base (88)..(97): a, c, t, g, unknown or other
  modified_base (363)..(372): a, c, t, g, unknown or other
  modified_base (756)..(765): a, c, t, g, unknown or other
  modified_base (1124)..(1240): a, c, t, g, unknown or other
  modified_base (1385)..(1394): a, c, t, g, unknown or other
  modified_base (2188)..(2197): a, c, t, g, unknown or other
  modified_base (2708)..(2717): a, c, t, g, unknown or other
  modified_base (3162)..(3236): a, c, t, g, unknown or other
  modified_base (3307)..(3316): a, c, t, g, unknown or other
  modified_base (3387)..(3650): a, c, t, g, unknown or other
  modified_base (3717)..(3726): a, c, t, g, unknown or other
  modified_base (3899)..(3935): a, c, t, g, unknown or other
  modified_base (4418)..(4427): a, c, t, g, unknown or other
  modified_base (6147)..(6156): a, c, t, g, unknown or other
  modified_base (6321)..(6330): a, c, t, g, unknown or other
  modified_base (6600)..(6609): a, c, t, g, unknown or other
ggacgagggctggtggcgcgagtaggcaaaagggcttggcctggagggccccgcgcctgtcggggacgcccggggtccatggggacgnnnnnnnnnncgcctggacgcggaggccctggccctggccgccgacgacccgggcgcgggcgaggcggtggccgcgatgctggacgagggctggtggcgcgagtaggcaaaggggcttggcccggaggcccccgcacttgtcggggacgcccggggtccatggggacgctgatgagccgcggcccccggctggctgccagggcgtgccatgttaccaggagcgcgctcgcaccacgacaacactcaccactcttcatcctctctcttgcacacccnnnnnnnnnngggctgccagggcgtgccatgttccctggagcgcgctcgcaccacgacacttaccactcttcatcctctctcttgcacaccccgttgacttttcatgacgacctggatcattgagcacacctgcctggccttgcatgtaagaattgaggggcaggctgggattggtttttggggagcacctaggcggacacagggcgcagcacattcccccgcccagactggtctggctccggcaaagtgcgccacgctttcgagtgccgaacgatggtctgacgctggacattctcaccagataaatcagttggattccgagtaagcacgcgcgccgttgcccgtaaaggagggtgagactatcccacacgaactctcgacacaccagtgttnnnnnnnnnnccgctggacattctcaccagacaaatcagttggattccgagtaagtacgcgcgccgttgcccgtggaggagggtgagagtctcccacacgaactctcgacacaccagtgtttcgggggcccccccgcagccccccgccccgtttgggcacacgagcctagcccatgagccagagtatagaggcgctgcgctcgcggcaagagcagattggggcagacctcgccaagctggagcgacaggtgtgggcatgggatctgtgctggtccaggccggcctgcgtgtcgcctgccatggggtgcctccccctcaaaccatctccgtcatcctgccgagctttcagccacatgtattaattccaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntacatcaaaggctattccttccttggagtatcggatgagtgtctcccctgccatgctcaggggccgccctcaacgcaatgcaaggttgtacagcctcgccacattcgcaatgcgcagggctttgaggggttcctgacatccaagnnnnnnnnnnaccctcaacgcaatacaaggttgtacagccctcgccacattcgcaatgcacagggctttgaggggttcctgacatccaagaatgccgccgccaaaaacaagaaccgggtgttcaggctggaagaccgtgccatctccctgtcctccaccacctccccagcggtgtgttcattctttcacgttcagtggatttgatcaaggtacaatgcgcaagcatcgcggcaagctcatcatttgttgtccattgtcgccatgcagacccaggagatcctgatggagcaggaacaggctcggacagaagccctgggctttggcagggcggcagggggcacctatactccacaaaacggaaatggatacggcaagggtcgacgtttgtgatgttacggtccatcctgcatgcagggggctcactacggctggaggggccgagcagatgcatgggcatcagagaagaatgcggctggagagattgctgcgtctcggtgtacagatggttgaccggcctgccatctctcttgctccccccaccacttgattgatggaagccatcaatctgagccttcaggactgcctctatatgcctccagctgccgatcctcttcggaactccatcgctcctccagatgcatggcctggtccctactcctcctcacgatctctgtgcctaaacaagggaggcatgactgctgagtagtattgcaatgccatatggtcgctctggtccccatgtactaacgacaccacctcaccgtttgattgcgacatactcccctgggagtcctctgcaggcannnnnnnnnnaattgcaatgccatatggtcgctctggtcccatgtaataatgacaccacctcaccgtttgattgcaacatactcccctgggagtcctctgcaggcagccagcggggggtggaaggcatgctaagcgatcgaatcattctatacctgagcagcccgaggttgagcagccactgcaagcatgcctgtggacctcaagcaaacatccctcaccttgctggttctgcccgccggatctcctgatgacagccggcacgagcgccaaccgccgcgtgttgtacgagccacaccctccgcacttgagccccacaaggttatactgcactgtgcatgttgatctgtgggaccaagaggggtgttaatctggtcacgacacctgcacactccaacaactggtcagcggcaggagctgacggcatctgtgaacactgcagctagctgcagccagctggcagcatattaatggggctatgtacaagcattgcgaccttgaactgaactactgcccagatgannnnnnnnnngttcacggggctatataaaagcatttcgaccttgaactgaactactgcccagatgaggtttgacctcgacacccttctggtgatcctactcgacgcacaacccttatgacccactcacaggcagtcgttgcagaagatctcggcctgccatcccacatactcctctgggagagggtgtgaggccgcgatggagtccaggtaccgccaggtggcggagttgtcttgcagcgagcgcttgcagatggggcagcaggcacagactgagatgctgtcgctccgttccaactcctgtgcatgttgagttttcagtggcatggattgatgcagggaggtggggtggcctcgccgtctggaccgccgccgccgctgtcctcgcattcccgcccggaacttcggcccccctcacccgcccttcccctccccatgcgcacactcgccttgaggnnnnnnnnnnnnnnnnnnnnnnnnnnnnnnnnnnnnnnnnnnnnnnnnnnnnnnnnnnnnnnnnnnnnnnnnnnngtgcatggctcgttccacgcagacgtgccggcccctgagcttggtggagtagcaggagccgcaggtgtcgnnnnnnnnnnatgcatggcccgctccacgcagacgtgccggcccctgagtttggtggagtagcaggagccgcaggtgtcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacaccgtgttttattgagcgcataagatgggagggcggggggggggagggggcagggctcgcatacnnnnnnnnnnggccgccgtcctcgcattcccgcccggagcttcgccccccctcgcccgccctccccctccccatgcgcacactcgccttgaggcaggacgagtggatggtgtgcccgcagggcagcacggctgttggctgcacgctctcaaacaggtactcgaagcagacggggcagttctgnnnnnnnnnnnnnnnnnnnnnnnnnnnnnnnnnnnnncagtggaagaaattctcgcggccgcccacgcggcagatgccgcagtcggcgcagtggaaggcctgcttggagacgtcgtcgtcgtagaaggggcagagggtgcacgcgtaggcgccaaaggccacgccgcagcggcagcagtggtcccctactggctggcgcagggagcacagagcgcacacgacctcggtgaccagcgagcggtccagctcgtgcctcaacttcacgtcctgagatgtggaggggggaagacaggacggagccattgatgcacggtgtgtcattgagcgcataagatggggagggggaggggggcagggattgcatacagctcatgggagactgaggagagcaagatctggcagctccaaggcgatgccacggaatgctgcagccagtgtgcgccgctggacacctcacgaggatactggtttgtccgcgtaggtcctattgcaaaggccatgcacagcagcgcaccttttnnnnnnnnnnagctcatgggagactgagcagagcaagatctggcagccccaaggcgatgccacggaatgctgcagccaatgtgcgccgctggacacctcatgaggatactggtttgtccgagtaggccctatcgcaaaggccatgcacagcagcgcaccttttcattgtcatgcttggcctcgttgtggcagtgtcgacaccagaaaatttccccactgtgaggcattcgggtgggggaaagtttcgttccctggagcacatgcaaggcatcagtcactttacattccacctggggcggaggccaaccctcccagtagcccttgcaatagtaccccatccatcgcaccaacatggagtgaccagcttgacacgccggcggtaatgggagcacccaaattcgcccaagcccctgttccgtacagctcgaacttcaggtccgccattgtcgtcaccatcggtactatcattcatgtcaagaagatgtggagcagggcgcagcgcaaagtaataatcactctaggcgaagaagaggggtgaggggatgccaggtgactactgcatggtccaaaagcattctgtcaagtctgtgaacgccatagcgggggcgtgtcacctgaacatgattgtcataggaacagaatgggtcccttgagctttcagcgggcacgtgtgtgttgcttgtgttggctgcaagtacgaagatcctggcgcgcccacaagagttcgcaaaatctggggcgcgctaggctccgcaaaaccggcaatgcgcaatcctgcatctcgtttctgcatgggagcagagactatggtgcatgtcacaaatatgatgaaaacaggtacaatgacgcggccttgacggtcgccccgcccctcgatggatgggttgcagtggcggagtttggcaccgcttccaaaactcctgctgcagcatgacggcaacccctccctagggcagggcgaggagcatgcccaactactacaggcccttgactctggctctgttagcctggttttgggccccagccagaccgcagaggggtgagcagtggcttgggtgggactgcagggccttgcccgcgtcacaacagtttccgataattggtgtggagcctacacgtcgccctgtgctttccaggagcgtgctggtggcggggcttggtcagaggctggtcgtcctggggctgggcgacggtgcccacgacctcgcctttgacaccgtgctgactgagtccgagaggatcaccagcctcgcagtgatggagagggaccccggcgccaagagtgggtcggttgcaatttgtgcggtggtgtcgtggcatggcactgtccatgctggtcccaggcagatcattgttgaggatactgtttggggatggcagcaatcagatgtgtccagcctgtcctccatgacctgcagatgccctcctcacggcaggtacggcagcatcacagctcacaggatttcccccccccgccctggctcggcacatgcaggcacgcagccggccgccatcctggtgggcacctcggccggcttcctgcaactgcactccccggacgcccggctggtgctgcgccaggccctccacgacagagccctgctcagcctcagcgccaggtgcattcatcctgacgaacgaggcccacgccgctggccagatgtacgacaagcccctgtgccctccaacgctcacctgagtgccccacctcccctcccccattcctcctnnnnnnnnnnaaacgaggcccgcgccgctggccagatgtgcggcgagcccctgtgccctccaacgctcacctgtgtgccccacctcccctcccccattcctcctctccaggtcctgcgatgcaggggccggggtgccccatgctctggccacctttgagaatgcggtggcgcgcnnnnnnnnnncgccggggtcggggtgccccatgccctggccacctttgagaatgcggtggcgcgcgtggcggggtgggatgtggcagccgccatgcagtggcgcgcccggtcctggtcaatggccggctggggcggcgggtcggagccccccgccctggacgtcgccaagtggaccctgggccgcggggtcggtgagttgtgttgtgggaccaggcatcttgcaggggacagggcggggacatcaagacttgcgtgcacagagagggcactgccccggcnnnnnnnnnnggtgttgtgggaccatacatcttgcaggggacagggcggagacatcaagagttgcgtgcacagagagggcactgccccggccgcgcgcttcacacacctgcaccccaccggccccggacaacacccccaacatcccacccgcccccaggtccacgtgctgcggcgctgtgcgggcccgccgtggcgccctcactgcacgctgagctggcgcggcgctgcgccggcgcggcccccccgcccccacccgccctgcggctgctgaccgc

SEQ ID NO: 44184 - DNA, 79 bp, Chlorella protothecoides
cagctggctcaccctccatctcctccctaacccccccaccccccttggattctctccacttcccctctgccagaccgcc

SEQ ID NO: 44185 - DNA, 61 bp, Chlorella protothecoides
tccggcatgctcgcctgcgggaggggcggggttgggcggcgagggggtgaaagggagacat

SEQ ID NO: 44186 - DNA, 61 bp, Chlorella protothecoides
agacgggccaggtggccggcgtggagggggggaccaagaagactgagggcctggggctggg

SEQ ID NO: 44187 - DNA, 67 bp, Chlorella protothecoides
accgaccggaggacgaccggcacaggtgggtgattctgaggagggagtcgggggtgggcaggaggga

SEQ ID NO: 44188 - DNA, 83 bp, Chlorella protothecoides
gggtggcgcaaaagtgtgtgtctgttggggggcggaaggggaagtttggccatttctgcgttccaggttggctgcctggcgct

SEQ ID NO: 44189 - DNA, 61 bp, Chlorella protothecoides
gtgggtggctggggtccgcgtcattggcggggtcatatagggatggcggcttcctgaacag

SEQ ID NO: 44190 - DNA, 61 bp, Chlorella protothecoides
tgaacagtggattaagttcatgaaggatggcgttaatgccactcctctcccgactgttaac

SEQ ID NO: 44191 - DNA, 64 bp, Chlorella protothecoides
taaccctaaccctaaccctaaccccaaccccaaaaaaccctaaccctaaccctaaccctaaccc

SEQ ID NO: 44192 - DNA, 61 bp, Chlorella protothecoides
taggagacagtgcggctgctacaaggggggggatgggggacagggcgtgaagtatcactgc

SEQ ID NO: 44193 - DNA, 61 bp, Chlorella protothecoides
cggagagagaggtgggagcggggcaggaggggctacggtacaggcacgggaccaccacatg

SEQ ID NO: 44194 - DNA, 115 bp, Chlorella protothecoides
gcccgggctggcggccgccggcgccggccgccggctggaggtccgtgccagcctgccggcgcgctcgctgccggcgccggagccttgggcggcggccgaggccgtggccgtggtg

SEQ ID NO: 44195 - DNA, 61 bp, Chlorella protothecoides
gcccaacactggcgctcccaggcttcccacccctgccccgggccgcaatcagcaacagcag

SEQ ID NO: 44196 - DNA, 93 bp, Chlorella protothecoides
ccccccaaccccataccccctcaaaccccacacccctccaaaccctttacactcccgtccctgtccagaaagcggcggcgtgcctgctggtga

SEQ ID NO: 44197 - DNA, 61 bp, Chlorella protothecoides
ctgacttccctctgagaatggctgctcgcccccctatctcccctggctcctgcactcaatt

SEQ ID NO: 44198 - DNA, 393 bp, Chlorella protothecoides
  modified_base (146)..(312): a, c, t, g, unknown or other
ggcacgcccccagccacgcgctcttcaacggcctgctgggcgcgtgcggggtggcgcgcagccccggcgccgcgcgcgaggtgctggccgacatgcggcgcgcggggctggagccgcggcgcgacgcctacctggcactggcctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgcccgacgtgcgcatgcacacgctgctcacgcaggcctacggccgcgtgggccgcctgcaggacgccgcgcgccactacg

SEQ ID NO: 44199 - DNA, 850 bp, Chlorella protothecoides
  modified_base (134)..(263): a, c, t, g, unknown or other
  modified_base (554)..(616): a, c, t, g, unknown or other
gccgcgagcctccacgcggccgctccgaggggacggagcgtggggtcgccaccggggatcggacggtcgcgcggcaccgctcggcggaggagcggggggggttgaaggcccccgacggcgacgtcaccgacccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaccttcagcacgatgctggcgccagacgacggcagcgcggaggccgcggcgctgcagcacccggacgccggcggcgcgctgcgccgcttcgcggtggtgggcaacttccgcgccgagcgcgacgagttcggcctgcgcctgcgcatcgcggagcccggcggcggcgcgcgcaccgtggagtttgcgttcgacctgtcgcgggacaccgcggcctccgtggccagcgagatggtggacgacctggcgctgtcgcccgccgacgcggccgacatcgcggccgccatccgcgnnnnnnnnnnnnnnnnnnnnnnnnnnnnnnnnnnnnnnnnnnnnnnnnnnnnnnnnnnnnnnntcgccgcgctgtcctccgacctggaggcggcggtgagcatgaacctggaggccgcgggcgaggcgctgcaggcaggcatcctgcactccgccgcctcggccgccgggaacgaggcctttggcgtgggcgacgaccatggggagggggcagggggtggggacgcgagcgccggggacggggacgcgagcgccggggacggggatgcgagcgccgggggcggggacgcgagcgccg

SEQ ID NO: 44200 - DNA, 61 bp, Chlorella protothecoides
gccgcctcggacaaggtgcacagcggctggggtggtgtcggacacagtgggaccagcttgt

SEQ ID NO: 44201 - DNA, 104 bp, Chlorella protothecoides
ccgcgtcgctggggcccagcgcggggggggagctcccgccgcccgaaaggtaggcgaaacggcaggccgcggcctccgggagccccagcgcggcgcgctcctcg

SEQ ID NO: 44202 - DNA, 2925 bp, Chlorella protothecoides
  modified_base (178)..(305): a, c, t, g, unknown or other
  modified_base (833)..(842): a, c, t, g, unknown or other
  modified_base (1151)..(1242): a, c, t, g, unknown or other
  modified_base (1837)..(1846): a, c, t, g, unknown or other
ctgaggcgctggccgaggcgcgcggcgtgacggtggacggcgcggaaggcgcacctgcggcgctggcgctgcgcggccgctgcctgtacgcctgcggcaacctggcgctggccgagcagtgcctggcacgtgcactggcggccgacccagactgccccggcgcggcgcgcccgcttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcaggtggcaggaggcctgggacgagtacagcgcggccctggccgccgacccgggcctgcgcgccgaggcggtggcgcaggtggcctgcaaccgctccgcggccgccggccggctggggcgctgggcggaggcgctggccgacgcggaggccgcgctgggcatggagccggggtatggtcgggcgcgcgcgcggcgcgccgcggcgttggccgccctggggcgccacgacgagggcctggccgagctggccgagctgcggagcacgcagcccgagtacccgggcctggaccgcctgctggccgacgcgcggctggccaagaagaaggcggagcgcgtggactactacgccgtgctgggcgtggaggaggacgtccatcccgacgcgctgaagaaggcctaccgccgcgcggccctgaagagccacccggacaaggtgtctgtgggtccatgcggtgtgtgtgtgggggggtgctgtgctctttgacgacggcgttttagtgtgcgagtgtgccagatgtccctcggnnnnnnnnnngtgtggggggtgctgtgtgtgtggggggggtgctgtgctctttgaccatggcgttctagtgtgcgagtgtgccagatgtccctcggacgggtttccttcgtccccaacctctccccatcccccccccgcaacccaccccaccccccaaaggcggaggagggcgagcgcgcagaggcagaggtcaacttcaagctggtgggtgaggcgtacgcggtgctcagcgaccccgccaagcgccagcgctacgacgcgggctggtccagcaccgagatcgagagcggctgccccgagggtggctgctgcggcggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcaacggctttgggccgagctacggcggcgggcccaccttcgcatcggggccccagttcagggcgcggtggtgatcggggtcctagcacccaaccccggcgctgcgaggcgccgtggtgctctgggacaccatggatgctatccttccgtctcaagggaggagcccttcggcccttgcctgcgaggtccttccccccttcagtaactcaatcgctgggcctgcggcgtggtcccgctccagtcccatctgctgattcaaatacagtgtgcagcgtgtgtacagccgcagtcaagtctcagtagaaccggctgacaaagcccagcttcttcaggatcttggcgtatgtgctgtgcatgatcttgggctgccccagctcgcgccgctgccgattggacttgttaaaccgcttgtgcacgtggccagcgcgctggtacttgatcttgcccgtgcctgtcgtcctgaaccgctccttgaaggccctgatgggggaaggaggtggggttgtggggcccctctacggcgaggcaccgcaccgcgcactctgtgcctccccttccacacgctgcgcagacccgccagcccctggctcattcnnnnnnnnnngcggcgaggcaccgcaccgcgcacgctgtgcctccccttgcacacgttgcgcagacccgccagcccctggctcactcccccatcactcacgaggaaggttttagcttgccgccggtgtgggggggcatggggttgtgcgccattcctcgcatctgctgggccaagcacggcccagctgtggagccgagtggtgccgtggcaacgtccgcagccctgggcaggccccgggtcagggttccgccaatgcaggatgctaatgatctcagggatcccagctgctgtggtgcagcgccagtgcaagagactgcgaccgactcgtgcgctatcgtccgcgacagggctggacgaaggaccgtgcagagtgcagcccacgacatgtcacctggaagcgacgcaatatgctatttgtaccaagttctagtgtgttatacttcatgcattcgctgtctgatccgtcacatagcaggctcattcgtttcgacttgttctgacacagcgacccagcagggagggaagggggcctgggcgatttgacctggtcagggggtcctcctcccttgctgcgtgctttccatcgctccttgcaaagccggccgcaccgtcgacttcggtctcttttgtctaggggtggcggtggagccttagcccgtgttgtcaacatgggtgagtcgcacggagagggcagactgggatgactggcgggcgccacccggcgccagccggcgggtggcatcacctccccgagcgaatgcccgggggcgtgatagccatccgtacagcaccggggtgggatgctgggacgctgcaaggcgagtggggcgcatgtgtgtcgtgtctcgtgcttcacgcagttccccgggccttccctccccaggtatctcccgcgactctctccacaagcgccgggcgaccggtgggaagcagaaggcatggcgcaagaagcggaagtgagtagtcttcctgctgcagtctctctcccagcgggcgttgggggtgctgcatctccctggggagtgtgctgtgctgactccccctttgcctccccctgccccccacccaccacccccacctccgatgct

SEQ ID NO: 44203 - DNA, 94 bp, Chlorella protothecoides
cggggggagctgtgtccctggacccaggcaagccagacgcgcccgccggcggggcggggacgccgggccggcgattggtctggcacggggagcc

SEQ ID NO: 44204 - DNA, 61 bp, Chlorella protothecoides
atgacatgctcgtcggtgacggccagcaggagcgccgcccagtccgcgcaatcggccgcgg

SEQ ID NO: 44205 - DNA, 61 bp, Chlorella protothecoides
cccgccccgccgcccgcgccgctcgtgcttggccaccagccgctccttggcccgccgggcc

SEQ ID NO: 44206 - DNA, 61 bp, Chlorella protothecoides
cccgcccgcgctggtggccgagtacatggccggggggagcctgaagggcgcgctggcgcgg

SEQ ID NO: 44207 - DNA, 61 bp, Chlorella protothecoides
gtatttgaaattttttgttctagtaatacttatatttcacttaaagataatgccataaatt

SEQ ID NO: 44208 - DNA, 70 bp, Chlorella protothecoides
ctccgcggccgcgctcgcctgggcgtgggggagggtgagggacgggcgggagggggttgagtatcgagtg

SEQ ID NO: 44209 - DNA, 971 bp, Chlorella protothecoides
  modified_base (85)..(94): a, c, t, g, unknown or other
  modified_base (149)..(158): a, c, t, g, unknown or other
  modified_base (275)..(284): a, c, t, g, unknown or other
  modified_base (816)..(889): a, c, t, g, unknown or other
acctcgcccgaggcggcgggggagcgcaggctggcggttctgtcggccatgggctcccacccctcctcccccgtcaaggttaccnnnnnnnnnnttggcggttctgtcggccatgggttcccacccctcctcccccgtcaaggttaccnnnnnnnnnnccccttacacacacacataggtgcacaagtttgggggcacgtgcctggcgaccccggagcgcatcgacgcggtgtgccggtacctgacctcgcccgaggcggcgggggagcgcaggnnnnnnnnnngacctgctgctggccatggtggccaaggcggggcgccgcgacgagagctacctcctggagctggccgcgctgcagcagaagcacgtggccgccgccgcggcgctgctgggcgccgactcccccgcgctggtggagtttgtggccgggctggaggctgacatggccgacctgcgctccatcctgcacaccctggccatcgcggggatgtcggcggagcccttcgaggactacgtggcagggcacggagaactgtggtgcggacgcctggccgcggcgcgctgccgccagctgtgcgccgacgcggtcttcctggacgctcgcgacgtgctgaccgtgcgcgacaccgccgacggcgcgtcggtggacgtcgagtacgacgccagcgacgcgcggctggacgcgtgggcggcggcgcatggcgcgccgcccctgctcctcgccacgggcttcgtggcgcgcaacccggcgggccaggccaccacgctgaagcgcaacggcagcgactacagcgccactatcttcggcgccctgnnnnnnnnnnnnnnnnnnnnnnnnnnnnnnnnnnnnnnnnnnnnnnnnnnnnnnnnnnnnnnnnnnnnnnnnnngagccggcgccatcaccatctggagcgacgtcaacggcgtctactctgcagacccgcgcaaggtgtgaggttttcttttggg

SEQ ID NO: 44210 - DNA, 61 bp, Chlorella protothecoides
aggcgattgaggcgagactgtgtggcggggggacgccaatgcatcactccaaaagaagcag

SEQ ID NO: 44211 - DNA, 61 bp, Chlorella protothecoides
tgacgcacgaggtggtggcgcggctggagggggcgccccatgccggctcccagatcctgcg

SEQ ID NO: 44212 - DNA, 61 bp, Chlorella protothecoides
ccgggcaggaggagggcgtgtacggctggggggcgctcaactatgaggagcagcgcctggc

SEQ ID NO: 44213 - DNA, 61 bp, Chlorella protothecoides
taggggaggggagggttagggggaggggggagtattggtgcacaaacatccacattgcatt

SEQ ID NO: 44214 - DNA, 61 bp, Chlorella protothecoides
ggcaggagtgggcgcgggggtgggctgggcgggggtcggcgcgggcgtaggctgggcagga

SEQ ID NO: 44215 - DNA, 79 bp, Chlorella protothecoides
ccctcctttgacagctcaggacaaacacttaatgtcaatcatggtgtcgaggaggactccagtaattctctcccgacac

SEQ ID NO: 44216 - DNA, 61 bp, Chlorella protothecoides
aatgaaagtcttggggacgcaatggcgagggtggcggacgtcttagatcgatggatgcgct

SEQ ID NO: 44217 - DNA, 61 bp, Chlorella protothecoides
ccagtgccgccagcgcggcggccagctcgctggcctcgccctcgctggcctcgctggagaa

SEQ ID NO: 44218 - DNA, 61 bp, Chlorella protothecoides
aatatgcgaagggggggcgggtgaaggggggatttgttctgacatctgcaaaccaggaagt

SEQ ID NO: 44219 - DNA, 61 bp, Chlorella protothecoides
caccgcgcccggctgcaggcccaggccctctggcaggcgagcggatgccgcgtcagagtgc

SEQ ID NO: 44220 - DNA, 61 bp, Chlorella protothecoides
agcatcggcaagatccgttgaatacggcggggaaactctcggagcaggtctggggttccgc

SEQ ID NO: 44221 - DNA, 1805 bp, Chlorella protothecoides
  modified_base (136)..(145): a, c, t, g, unknown or other
  modified_base (215)..(336): a, c, t, g, unknown or other
  modified_base (684)..(693): a, c, t, g, unknown or other
  modified_base (763)..(772): a, c, t, g, unknown or other
  modified_base (1138)..(1287): a, c, t, g, unknown or other
gggcaatggcggcgaggcgcaggggctgccggggcgggaggggtgtgtgtgtttgtggacgggagtcctaccgcgtgccagatgcagcccctcggatcggccctggacgggcgcctcgatcacctcctcgccccgnnnnnnnnnncggtggttgggtgcgtgggttggaggaggaggggggagggggcaatggcggcgaggcgcaggggctgccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtggacgggagttctaccgcgtgccagatgcagccccgcggaacggcctggacgggcgcctcgatcgcgtcctcgccccgatcaagtcatctccccccttccccgacacacacatgaacacgccggcacaggcccagggcgtggaccccgccgcgccgcgcgccgagtggccggcgcccgccctgcgcgccgtcttcgcccggctccagcacggcgccgcgtcggacttcatcgcggcccggctgctggccggggcctggggcccgggcgactggtggcgccgccggctcaactttgcgcgctccgccgcgctgcacagcatggtgggcgggcggccggatgggcgnnnnnnnnnngggcgaggggtcggggttggggacggggcgcgcatctgtgggccagagactcccgccccgctgcaggacnnnnnnnnnngggcgggcggccgggtgggcttgcctgagggtctggggtgagggtcggggttggggacggggcacgcatccgcgggccagagactcccgccccgctgcaggaccaggcgagggctgtgccccctcccccctctcaccatccacccgccccgaccctctaccgcagaccgggtgggtgctgggcgtgggagaccgccacctggacaacatcttgctgcacgagcgcgacggccgcctcacccacgtcgacttcgacctggtgtttgacaggtgtgcgcgtcggaggggcctgggcggaggcggggaggggtcgtgcatgatgaggggatgcctggacgggggactgtgcaggccggggctggctggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgccccgagaccccgctttcccgacgacccacaccccttcctacacactgcaggggcagggagctgaacgtccccgagacagtgcccttccggctcacgcgctgcatgctgctcgcgctggggcccgtgggcgcgggcggccccttcgccggcgcctgccacgccacgctgggcgcgctgcgctcccacgccgacgtcatgctgggcgcgctgggcgtggccctggacgacccggggacccgctggcgcgtggagggggcgcaggcgggcgtcagcgggctctgggccaaggtggccgtggcgcgggcggatgcgctgcgtctcaccagcgccgcgcgcacgctggagcggctgctgccccggatggagcatgcgctgatgcccctcggcatgcacatgctgtacttcatcagcaagctgcagatcgaccacggcagggacggcaggggtctggcgccggcgggcgacgcggccgcggcgccgacaggcggggcgcacggcgcgccggcgggagaggc

SEQ ID NO: 44222 - DNA, 81 bp, Chlorella protothecoides
cctcgccggcgacgtcctttggctttggcgcagcccccagctctgcagctgcctcgccggcgacgtcctttggctttggcg

SEQ ID NO: 44223 - DNA, 486 bp, Chlorella protothecoides
  modified_base (128)..(137): a, c, t, g, unknown or other
  modified_base (241)..(367): a, c, t, g, unknown or other
gggggggggggcgcgggagaccgatgatggcggaacacagatctcggccctcgctggtgcacatggcgcagagggtggcgcgcggggccctgcacggcctgcccagcgtggctgctcgtgggtctctnnnnnnnnnngaacacagatctctgccctccctggtgcacatggcaaagagggtggagcgtgctgccctgcacggcctgcccagcatggcccgccgctcgtgggtctctgatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaaacgtcagcgcccctgcattccccccaccctcccttgccaggacgcggaggtcggacgggagggcggcgacatgaagggcgaggaccaggagtgatgccccacatcatatccccccc

SEQ ID NO: 44224 - DNA, 61 bp, Chlorella protothecoides
atgtttatgttggtttcatggtttggtctacctttaccgctactaaatgccgcggattggt

SEQ ID NO: 44225 - DNA, 61 bp, Chlorella protothecoides
gtttgggtttgggtttgggtttgggtttggctttgggttagggttagggttagggttaggg

SEQ ID NO: 44226 - DNA, 73 bp, Chlorella protothecoides
accaccagcctcaccttgaacagcctgcgcagtgtcggcgcgtcaggggaggagggggaaggcatgtggaagt

SEQ ID NO: 44227 - DNA, 61 bp, Chlorella protothecoides
gagtgtgcggacattctcgggcatggcagggggaccgatcgagatctccatcaaggagtac

SEQ ID NO: 44228 - DNA, 583 bp, Chlorella protothecoides
  modified_base (369)..(447): a, c, t, g, unknown or other
ggcggccggcgccgcgcccgggcagcagcagcagcagcagcaacacatggtgatgatgcccatgcacatgctcaccggcgactcttcgagggggcctggggctctgggacaagtgagttttctcgagggggagtggtggaggtggggagaggaggccatctttatttgtcagacaaggctcctgggcatgcggctctggctgcatgagtggccgggaatcttgggggtccatgcctccgaaggcctggccagcagaggcatgggctcaagcgctgagcattcacttcactgtgggttccggttgctgccggcagtctgcatgtcaggctccccttggacgggcctggccctctcccccactcccccccnnnnnnnnnnnnnnnnnnnnnnnnnnnnnnnnnnnnnnnnnnnnnnnnnnnnnnnnnnnnnnnnnnnnnnnnnnnnnnnacccgctgtgtccccgcaccaacacctctccctcctcacccctcctcaccctccgctcagatgggtctggtgcccatgctgtggccccagggcacgcccgccccgcagttctttgccctgcagcaggcccaccagg

SEQ ID NO: 44229 - DNA, 150 bp, Chlorella protothecoides
cgcggacgagttcctgcgccggctcccgacggacccgggtgtgctggggagcgcggggctggcggaggtgggcaccggagcccaggcgcccggcggccttggatccctctccgcccccgccgaggccgccaggctggccttcctcctcac

SEQ ID NO: 44230 - DNA, 75 bp, Chlorella protothecoides
aggacgtcctcaagatatgttttcagatactgcaatacaactacaacccgtttttgcacaatggattcaaaacat

SEQ ID NO: 44231 - DNA, 61 bp, Chlorella protothecoides
gatcagggggagcgcggtgaaccaggatggacggtcctcgagcctgacggctcccaatggc

SEQ ID NO: 44232 - DNA, 61 bp, Chlorella protothecoides
cagagatcgtggctgggagagctgaccagggggggggctgacaaggcgctgacctttcatg

SEQ ID NO: 44233 - DNA, 115 bp, Chlorella protothecoides
ctctgtcccctcgggcctccctgcaggcccgggcctcgtgaggacaggggggcaggcgccgcccggacctcagaccacacaggctggtctcgtcctggcccagccaggcggcagc

SEQ ID NO: 44234 - DNA, 4368 bp, Chlorella protothecoides
  modified_base (378)..(387): a, c, t, g, unknown or other
  modified_base (610)..(619): a, c, t, g, unknown or other
  modified_base (863)..(890): a, c, t, g, unknown or other
  modified_base (1176)..(1185): a, c, t, g, unknown or other
  modified_base (1926)..(2010): a, c, t, g, unknown or other
  modified_base (2607)..(2616): a, c, t, g, unknown or other
  modified_base (3697)..(3706): a, c, t, g, unknown or other
gcgcgcggcggcggcgcgacgccggccaaactcggcacgcaccgagctgcgcaccgcgccgcgcaggagcgacggcaggccgcccagcgtgcctagcgcgcgctccacgccctggagcagggccagcaggcgcgccatggccgtctgcgaccccaccgacccatggtagtcgcgcagcaggcccagcaccgcctccgacaggcagcccaggacctgggaggcggctgcggcggagtccggtgcccgcggtgtggcctggcgggaggaagtcggcgtgttgccagtcgaggagacggcgttcccggtcgcgccgttgggcgcggtgtccgccccgtctccaccgctcacttccccggcccccgccccacccagcaccgnnnnnnnnnnatgcggtgtccgccccatctccaccgctcgcttccccggcccccgccccacccagcaccggcagggccttgacgatggtgttggcgctgtccagcaggcgcccctccccgctcagcacgaattggcggaagtggacccaggcgtagagcgctaggtggagctcgggggtgatgcccagcgcaggccagacgtgggcgcggagcaggcccaccagctcgtcgcnnnnnnnnnnctggcggaagtggacccaggcgtagagcgccaggtggagctcgggggtgatgcccagcgcgggccagacgcgggcgcggagcaggcccaccagctcgtcgctctcggccacgtactcggcctcggacagtgcgtcaaaggtgccgcgcagaaggcggtccgcgatgctcgcgcagaggagccagccaaagtcccagcccgcgtcgcagcacgcggccacgttgccggccgcctccaccaccgcnnnnnnnnnnnnnnnnnnnnnnnnnnnncgtcgtactcgtcggcgtcggcgacgtcggcgcggcgcagcgcgccgcgcagccgtgccagggccgcgcggccggagccgtcgctggcgccgcgccagcgctgcgtcgccgcctggcgcagcacacaccacagcgtggctgaggtgccgcaccgccagcgcacaaagttcttgaagctggagaaggaggaggggcgcaccgtctgtggcggtaaaagggaagaggggattgggggggggtcctgatgaggtctacacgagggtggcagaggccagggcgacatggnnnnnnnnnngggggatggggtggggtcctgatgaggtctagacgagggtggcagaggccagggcgacatggattgcttagaggaggccagcagtgtgtggcccgggcccaacaagatgcctgcgccgcagttacagacggcatatccccagcccctcctccacacctgctgccccactatcccaaccccccttccccaccttgagcaggcgtgcgtgcatgtgcagcgtgccgatctcctgcttggcccctgcgtccagtgccgccacggcgcgcagctcgtcggagcgcgcagcgctgacctccagctgcgcgcgcagcacgcccagcagcgcgggtgacgcctggtccccggcagccgccaggaaggtggcgtaggttaggtccttgagctgcgactcgtccaggtccagcgtcacgtcctggatgctcagctccaggccacgatcggcgggcgcgggggcgggcgtggcggccgacgtgacctcggccgacggctggggagtgcgcggcgtggcgcggcccagcaggctgccgcggcgggaggcgggggcatcgcgctggctggagggcgcgcggcagatggccataaggtccagctccccgccccgggcgatggaggccaggagcgcgcccacgtcgaccttgtccagcagccagtcctcgaagccgctacaacccacgggcagcaggatggacatcccatactgctggaggctctgtgggggggggggggggggggggggggggnnnnnnnnnnnnnnnnnnnnnnnnnnnnnnnnnnnnnnnnnnnnnnnnnnnnnnnnnnnnnnnnnnnnnnnnnnnnnnnnnnnnncgcgggcccgacaggtcagactgcacggctacgcccgcccctggaggaccttggtcctactcaacgttgcagcggcatgcgtgaccgcccccaaacggcgcactagccaggaaaggggggtcctcgacgagcctgccgggaccacggccagccctcaccttgaggagctggcacagaagccgcctgcggtccagtacaacctcatccaacgtcagttccagcatgttttatcccagatgcacgccttccatggactatcggggagcgtctgccacgccgagtccagccagatcgtgctcggcgggtggtgggacggaaggaaccttgatcgccaatgccggaacgccaggcgctcgacccacagctgtaaatgctccggatgtgtttgcaaacaggagacggtgcatgcgcccttcacatcagccaaacgcggtcagggagcgggatcgggacagatgtccttcgcgcgcccccgacacatgcatgccgacttgttgtctccagtggaggtccactgccctccatttccctcgtgtccatctgccctaccctcccccaagtatctatgtcacgttggttctttcagtcaggccgcgnnnnnnnnnngcacatgcatgccgacttgttgtcttcagtggaggtccaccatttccctcgtgcccatctgccctgccctcccccaagtatctgtgtcacgttggttctttcagtcaggccgcgctgtgcattgcacacatgggattatcagaggatccaccgcggcgatcactccttcttgtccttcacctccgcatcttgaacgttctcggcgccggcggcgcccgcctgcccggacagggaggacccgatcttcatggaggcggtctgcagcgcggtcaccttctccttgaggtccgcggaagaggcggactcaagcgccccccgcaggtcggcggcggccgcctcgatctcgtccaccaccgcctgcggcaggcggtccttgtactccgccaagctcttgtcggcggagtacagtgccgcgtcagcgtcgttcctcgcatcgatctgggccttgcgctccgcgtcctcgcttgcaaagcgctccgcgtccgacaccatgctctggatctgggactcggacagcccgccactggactggatggtgatggactgctccttgcccgtggacttgtccttggcggccacatgcacgatgccgttggcgtcgatgtcaaaggtcacctcgatctggggcacgccgcgcggggagggcgggatgcccaccaggtcgaactgggagtgtgaattgaaggggggggtgagaggggtgtatgggagaggactctgggctgagctggaggggatggggaagcgatggagacctggcacatgctctgaccgtcacaacggcaggctgcgcccggggaaagccccacccgcatcccatgaccaggcactcctcaactggccagacacacctgccccagcatgttgttgtcgccggccatctcgcgctcgccctggaagaccttgatgcccacctgtggttgtgtgaaggtggcagagaggaccattgacaattattctgaggtttaagtctgtcccctgactgttcaaacactgcccctcctatgtgttgttttgcttcccttccccagctcacgagcatgctgcacttgcccccgcccctcccccgccctgcctcccnnnnnnnnnngggtggcagagaggaccattgacaatcattccgaggttgaagtctgtctcctgactgttcaaacactgcccctcctatgtgttattttgcttcccttccccagctcacgatcgtgctgcacctgcccccgcccctcccccgccctgcctcccagccagaccctgtgcctgtctacgttcagaagaaacccccaaaacatacctgcgtctggttgtcggcagcggtggagaacacctggctcttcttggtggggatggtggtgttgcgcgtgatcagcttggtcatgacgccacccagtgtctcgatgcccaaggacaggggggtgacgtccagcagcaggatgtccttaacgtcgccacgcagcacgccgccctgtgcagcgcatggtggtggggtgggaggaaagagcgtcagccgatggtgggaggggcatgggaggggaggtgcgcgggggaggtgtgtgtcattcaggctcaccccccccaacccagcctgctcatacgagcatgggaaaaggaatgtgcccgccattctaaaagtcacagagcgagcacgttggagtgcgttcctctgcgtgccatggcatggcaagtcactatagcattaccatacccaaaacggcatggccatggtctgggcacacgcgctctgacaggcatgca

SEQ ID NO: 44235 - DNA, 61 bp, Chlorella protothecoides
accgtggtccacgtcgttgacgacgaggggcccggggaggaaggagccgccgccgacgcgg

SEQ ID NO: 44236 - DNA, 108 bp, Chlorella protothecoides
caggcgctctgcctccgggcggagggccgccagctcggccgccagcacgtcgcgtccctcggtcgtggcacgcacccgctccgccgcctcggcctccagcgccgtcac

SEQ ID NO: 44237 - DNA, 9526 bp, Chlorella protothecoides
  modified_base (115)..(314): a, c, t, g, unknown or other
  modified_base (642)..(701): a, c, t, g, unknown or other
  modified_base (867)..(979): a, c, t, g, unknown or other
  modified_base (1494)..(1503): a, c, t, g, unknown or other
  modified_base (2081)..(2090): a, c, t, g, unknown or other
  modified_base (2301)..(2310): a, c, t, g, unknown or other
  modified_base (3589)..(3598): a, c, t, g, unknown or other
  modified_base (5008)..(5017): a, c, t, g, unknown or other
  modified_base (5272)..(5281): a, c, t, g, unknown or other
  modified_base (5645)..(5654): a, c, t, g, unknown or other
  modified_base (7688)..(7697): a, c, t, g, unknown or other
gcggtggcggccaggccgcggcgcagcgcccagaaggccaggcgcgcggccgcgcgctcggcgcagccggggcgcaccttgccacgcccgcccacgtgctcgtacacgaggcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatccacgtgcagaagtcctgggcgggtgggggccgggatgtccaggtggacggtctgtgtgggtgggggggggggccgacgccgcgcagaggggggtccagcctggcagcacgtgccgaggggcgcgctcgcctctgcgttcgtcgcactcctgcccatcagcgccgctgcactcctgctcccgacacctggagccccctcgcccgcactccctccctccagcgactccacgtcctctgcggacagcaaggccaggcgccggacacagcagccgcagcaggcggcctccaggtcgccgaaggaggccccgccgccgccggcgcgccgnnnnnnnnnnnnnnnnnnnnnnnnnnnnnnnnnnnnnnnnnnnnnnnnnnnnnnnnnnnncgggcccctgcaggcgcagtccgcgcaggccacggccagcgggtcgaggtaggcgccctgcagccggcacagcagctccgcgccggtctgcgccaggttggtccccgtcacgcacagccgcacggcaccgcgcccggccgccggcaccggcgcggcgagcagcacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcacgctgtgcacgctgggcaccaggcggtggcgccccgcgtctcgcacgcgccagcgctgcgccacctcgccgcggtgcagcagcgccagcgccgcgccgctctgcaccagtgccgtgcccgtgagccagggcgaggcggggccgcggccgcggccgccggagtcggtgccgcctgcgccgcctgcgtcgtcggccccgggaccgacccgaccagtcatggccgccagcacagcgcccagcgcgtcttcgtcgcagcgcggtgtgccctggaccacggcctgcacggtgaggtgcaggcagccagggcgcaggtaggcctccagcgaggccaggccggagccaggtggcgcgcaccaggccgccagctggtcggccaggtccggtggcagctgctccggcgtcgcgccaaagagcttgaccgagattcgggagaggaggagggggggtccgggcgacggggccgccgcggtggggggcgaggcgggcgcgcggcgggcgcccggggggggggcnnnnnnnnnncccgggcgacggggccgccgcggtgggaggcgaggcgggggcgcggcggtcgccgggggcggcgacggggcctggcccccatccgaggtcttcgggtcccatgagctcgcaggccagctcgaagccgtcggaggcggcagggagcggggtcgggggcagcagcgcctccagccccgcgggcgtgccgccgccgccgtcgtcgctgtcgccgccaaaccccggcggcaggtccaggacgggggagtcagccagctgctgcgtcagccatccgctcagctcctccaccagcgcgtcgggggcgctgcctgtgcaggcgccgtcgctgcggctctcggacagggaggtgcaggactcgccgcccgcgagccagggctgcgacagggaggaggagctgggggggcgcgtggccgtgcccggcgcccacccccagccagtcgaggggttggcaaggtcgaggccggcccaggctcgctcgggcatgatcttggtcggggctccactgctccccggtaggcagccgccgttgtcggagccggaggctggcatggttggagtgccgatgggggcggatggagacnnnnnnnnnncaggcagttgccgctgtcggagccggaggctggcattgttggagtgccgatgggggcggatggagacgcaccagacttacgcctgcatggcgtggcggggggttgctgaggtgtgactggatgcttcacgggcagtcacatcgctgcttgtgaggaccagaagggggctgtcgcagacccaggcaggtaccacatggcccacctccgggcnnnnnnnnnntgctgcttgtgaggaccagcatggggctgtcgcagacctaggcaggtaccacatggcccacctccgggcgttgtgcttctccagctgcttgcggcacgacttgcgctgcccgtcaaactccgccagggggtggctcacgccgcagcgctggcagaacctcagcagctcgccgtccttcaggaagctgggcgccttgatgtgctcctcacagatcctggagtgaaaggagtggagggggtaggagacaggggttgggaagggacagatcagagagtggagggcacaagacttgagcatgccatgctgggtcgggcgtttgggaatgtttgcatcgccaccacatctggctgcactcaacctcccagccatgtgcggcggcacgcagcaggcgcaggcatcccaaccaagccacacgcgtccattggtgtgcaaccactccttacctgttcctctggtggtaaaaggtgaggttggccagcggtttgtggcagccgtccgcctggcagacgttctcgcgcacaggcttccgtgccggcgcaggcgccggccgtgagggcctgcccggccggcgcgcgggctggcgctggaccctgggggcgctggccgtggcgcagcatggcttggtcaccggggtcgcgatgggggtggccaccatccgcaccgagtcccacgcccagtctgccgggtcccagctgggtgaagcgcctgcatgagtggatgggttggaactgaggcccgcgcgctgtcgattccagggctggagcacgggagaaggaatcgcacgcggtcgcaccggagaggcgctcggggaggcctggaggaggcacgtcgtcggccattgggtgagagcgtggggcgggtgtaccagcaccggacccttcagcgcattctccagccgccggtcttcgccggtagacagagaccagagctttgggtcgtcttcatgcgcatgtctccactctcatcaaaatcgttgtgggctaaacaccgtcaggcgtgtggctggaggtcaaccccgagctggtacgaaacctatgagccctatgacaaggttgtcgccggtaccgagtttcggcgcctctcctgggaatagctacgggggttttctcctgatatcgtcgcacccgccacccgtcatgcgggcgtagggtgcgctttccgtgcccacgacctcccgtagcaaaatgagatgggggagtaccatgcagtacccagaaaccctgcgatatctgagatgcacgagactttgaatcaagcgatggcaatggcgcgacacagnnnnnnnnnnttgagatgggggagtaccatgcagtacccaaaaacctgcgatttctgagatgcacgggacttcgaatcaagcgatggcaatggcgcgacacagcgtgctgcacctgactttaaaccagaacaagtgaacaacggtccgtggtgaagctgctctcgagcagccctgcacatcctgaatcttgcgcggtaagtgaccgacagaaggtggcgcagagcagctctttgctgtgtcgtgccggatgcagtggtgttctaccgacaggaggcgcggcggacgatgatcgattcgaatttcactgcactgaaagctttgcgagcccgtagatcagccatggggtggacctctacctgcaccccgggctcccccatgttgaccacggctgaggttgactgcgccgctcgctccacctcccgcaggctcgcgtggtcccagggccccacccagtcatggtgaatccgaaagacaaatccatcgtggcaggggagagcggcggcggtggcggtgggggtgggggtgtatccctgggcaagggcgcctgggactgcgacaccaacacccccatcccccccgagaaggaggcgctggtgttcgaggaggtggccaccatggactacccattcgagggcatccccaccgttccaccgcgcaaggacatggaccactttgccttcttctgcggcgggtgccggtaccgcgtctcgggccagccagactggaccgtggccaaggtcggcgtgttctgttggcacctggatcatgagcccgccctgtgcgtctgccagtctgcaggaacctgggatgaggttgcgatcctgtattcaacatcaaccaccactcgctgcagcttctgaccatcacgcccccaaaccccagtccagcgcacccctctcctgcagatcaagcaggcgctgtttgacggaggcatcgcccgcgccaacaagccagagggcgtgcggaacacgccaggcatccaggcatggagcgacctcgccctcatctacgccggtcagcgcatggaggacgagaagaccctggcagagtaccacgtgcctccagtgagtggctgaaggggttccgcagtgtatcaccgcgctgcagcaaggtgaaaaccgtctcgccagagggctgccgcgatacgcagcggcgagtgactgacagagcttcccactggctctcacacccctctggcctacgtgccacgcagggctgcaagaccatgatagccatcgagggcgccaagctggaccagaggcggccagaaccagactcggcatactggaactagggggggggaaattgttgcaactgcggcatgcgctggcgtgcaccttgcgcttacttgcgatcggcatgcggggtagtttcacacactgagctcctgttcccgctgtccacgcccttggagccgcnnnnnnnnnnactcacttgcgatcggcatgcggggtggtttcacacaccgagctcttgttcccgctgtccacgcccttggagccgctgaatggttttgtacatattcgctgcaccgcccatcggacattgggcaggactggctggatttattggtgaaaacagggccaaccaccaacgagcaaagaaaacactggggcaagcagccacacatcagtggttgcctggaaacaattcggtgctgagtgcatcaactcacaatgggcnnnnnnnnnnaacacattagtggttgccttgaaacaatgcggtgctgagtgcatcaactcacaatgggctgcgcagggcccctttcagctgagtcagcctgctggggatgcgccgcaccgctcccctcccgggccgcagcggcggctcgggccgcgagtctcgcctcggcctcagctgtctgcctctcggcccggagctggtccagctgggcctgccgcctcgtcaggctgtcggccctcacgtccccaaacagtctctggaagcagggggagggtggtgcggtcgtgatgacaggggtggctctggggtaatcccccttgcccttgccatcctcaagattctagggtcttcagatctccatgccatgcccccnnnnnnnnnnagtgcggtcgtgatgacaggggtggccctgggggtatcccccttgcccttgtcatcctcgaggttccagggtcttcagatctccatgccatgccccccaagccccccaaccgcactctctccctgtcaatgggatacctcaagaacaaggcctcgtccatacccccaacccctccctcctcccatccgcacaccaagcctgcccaacctgcctcaccccggcattgttgccctgccaggcggcagctgtgagggggtccaggactatggccccgcccatgaacactgcacccaacacagcaagatagacggcgtctgctcggctgaaacccctggtgagccggtaccaggcggcaattgggtctgtggccgtgcagggagggcaaggagcttaatgcagagggggggggaaaggtggggggggcaaaaggagttaagcttggagcactcaaggcctggactcgcacacagtcctcaccaaaagaccggggcgggggagggcggtatcgagccgaggagccccctctggaggcccagccgccatagtttggggtctggccacgcgggggaggccggccgcccgacccgggccgccgacctcctgtaaggtatcagtcagggtgtcagaacatccgcgcaaaccaacaggatcagtccctgccgtgcggcacagccgtgttaggagcgcatgcatcatgcagaccctcccgtgcacccgccccctgtgcaccttgcatcagggcattgtatgcttccgtcagtgccttgaaatttgcggccgctcgttcctgcgcctgggctcccgactgcgcaaacctgcagcatgtatgacagtgtatctggcttcatcgtcgctcaaacccccctcattcaccagagtgggatgatgggagtaggggctgacaatacagcccaggcaaggacatgcactgccgggatttcatgcacaccacacacatgtcgggatgacacttcatggctgcgcggcggaaggctgccttgatgtcatccttgctcgctccaggcttcacgcccagggcagcatatggatccatgccaccctcacccctggagctgcccggccatgtcagcgacctgtcccactgtcacgcacgagggaaggggctggtcgcgggctacaagcattttataatgcaactgaatgcttaatgtatcatcggtatgtcatgtcataaagtatacaaacgaatgcctcaattgtccttggtgtgcaaggtgccatcatctcgcgccccgccgagaggacgagggcaccaaatcctggcgagacccggcgatgcagggtttgcaatgctcggggcgcgccaagtacgggcgcccttgcacacgctcccttcgatcgtgctgtgagacccttgggggagcagcgatatcctgcgcaggctctttcccccacccagacctcccccggaaccctgcagacccggccctctgggagtaagggcaggccgctgtgaatgcatggcaccctctccaatacatctctgcattcttctctgattccctaagcctgggggatgcctgcggcgtgaccactgcccctggcacaggctcctgcactcgcgacccacccctgtcgacatggacagccccatcaccaccctcggtgtgaccaccctgtccatccaccgcgtggccgcgaccctggagaagctcatcagccgtgtggaggagccggggtccccctccctgctcacggaagagctgtcccgcaggctctgcctccaggacccggtgggtgggctaggaatgggagtctctggtgtcccctgcgacctgccctgggtccagcaccagactctgggcggtgtgcttggtcgccagggatgatgggaaggagccagcgtgctgcgccgcagggcacctggcgttggcctcggcgcccactgcccctcccacctcgcgacgtcccctcgattatccggtgctgtctcacccctcacccaccttccagcctctgactctggtgcccccacccctctcaccccccctcacacacacgcgcgcgcgacannnnnnnnnncgcccctcccacctcgcgacgccccctcgatcatccggtgctttctccccccccacccaccttccagcccctgaccctggtgcccccacccctctcacccccccctcacacacacgcgcgcgcgacacgcaggccttcgcctggctacgggaggagagcgagcacgcgcgcccgcgcctgctgtgcgaggcgcggcacgacgagctggccggcgcccccgccggccccggccccggggcgcgcgagggcctggtctcgcgctggcgccagaaggagcggctgaagacgacggcggtggccctggtggtgtgcctcaacatcggcgtggacccgcccgacgtggtccgcgtgtcgccctgcgcgcgcaccgagtgctggatcgacccgctgagcatgccggcggccaaggccctggacgccatcggcaagagcctgcaggtgcagtacgagcgctggcagccgcgcgccaagtacaagatgcacctggaccccaccacggaggacgtgaagaagctggccacctccagccggcgcgcggccaggggcgagcgcgtgctgttccactacaatgggcacggcgtgccgcgccctaccgccaacggcgagatctgggtgttcaaccgctcctacacccagtacatcccgctgtcgctgtatgacctgcagacctggctgggcacgcccgccatctacgtctttgactgcagcaccgcgggccagatcctgcacagcttcaagcagttcatggcgcagcgcgcgcaggaggcggagggctacgcgcctggggcggcgggcaacggcagcgcctacgcgccctcctccgcgccctccaccgccagctccctcccgggtcagtgcggggtggggtgtgggctctggcttcctttgtgtgcgtatgtgtctgggtggtcgggtgtgtctgggtttgaggccacgcatgcacgctgggcgggtgtcaactgcgcgtgtgtgtgcggtgacgcgtccaccccccgcctggcctgaatgcgccccgaccccagccccactccgcacagggcatcccatctcctcctccttccaaacaccccaacccaccctcccatcctccctttcccaatcgcgcagagggggggctcccccccagccacccgcccgccgaccccatgcgctcctgcatcctgctgtgcgcctgcggcgaggccgacgtgctgccccagaccgcggacctccccgccgacctcttcaccgcctgcctgaccacccccatcaaggtggcgctgcgctggttctgggcgcgcagcgcgccgcgctggcgcgacgcgctgcccgaggaggagctgcgcgcggggctggcggaccgagtgcccggcaagcagacggaccgcaagacgccgctgggcgagctgaactgggtgttcaccgccatcaccgacaccatcgcgtggaacgtgctgccgcgtgcgctcttccagcgcctcttccgccaggacctgctggtggcctcgctgttccgcaacttcctgctggcagaccgcgtgatgcgcgcgcacggctgcacccccgtctcccacccgcgcctgccgcccacgcaccagcatgccatgtggcaggcctgggacatggccgccgaggcctgcctgctccagctgcccgccatgctggcgccgggcagcgcggtggagtacgtgccctcccccttcttctccgagcagctcaccgcctttgagctctggctggagcacggctcgccggacaggccacccccagagcagctgcccatcgtcctgcaggcacgctcggagtattgcttttgtttttgtcagggggggcgggggggagtgggggag

SEQ ID NO: 44238 - DNA, 61 bp, Chlorella protothecoides
actcctggccaggggcagggttgcagcaggggagctgccacatccaggcgagaggatcgag

SEQ ID NO: 44239 - DNA, 61 bp, Chlorella protothecoides
gctcattgccatgcgaggttattggcaggggtgcatcacctccaccggctctgccctgtgc

SEQ ID NO: 44240 - DNA, 61 bp, Chlorella protothecoides
gggctgcgctccggggcggaggccagcgggaacctccgaggccccggcgtcgccgcactcg

SEQ ID NO: 44241 - DNA, 61 bp, Chlorella protothecoides
ttcagcctttgtgacgaaagtaatggcaggggacagtgggcctccccagatgcatggcgat

SEQ ID NO: 44242 - DNA, 68 bp, Chlorella protothecoides
ccgccaccacggcccctgccgagatcgacgccgcaacgagccccagccccagccccagcccggtgccc

SEQ ID NO: 44243 - DNA, 61 bp, Chlorella protothecoides
cgtcccgagtaggttcagtggtagaggctggtatgcttcgtaaagtttggtcacacgggtc

SEQ ID NO: 44244 - DNA, 74 bp, Chlorella protothecoides
cgctcgcgactgggactgcgtgacctgcgccgccgctcgcgacggggactgcgtgacctgcgctgtccagcttg

SEQ ID NO: 44245 - DNA, 418 bp, Chlorella protothecoides
  modified_base (149)..(287): a, c, t, g, unknown or other
ccgcacgcgcggtgggcgcgcccggcgccaagttccgcggcgtgcgccagcggccctggggcaagtttgcggccgagatccgcgaccccacgcgcggctcgcgcctctggctgggcacctttgacacggcggaggaggcggcactggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnactttgacgacttggagacggccgagctggtgcggctgtacggcgcgccggcgctgccggaggacgccgacccgggcgcctcgctggcctccgcggcctccgcggccacgcgcttcgcgccgggcacctcc

SEQ ID NO: 44246 - DNA, 61 bp, Chlorella protothecoides
gaggcacacacagctggtgcaaggggggggggaagggggcgcgcgggagcgacgggtatcc

SEQ ID NO: 44247 - DNA, 64 bp, Chlorella protothecoides
caggtgggctggagggaggaggggagggctctgcggggggggaacaataacatccgtcccagct

SEQ ID NO: 44248 - DNA, 61 bp, Chlorella protothecoides
gttcatggtaatgattctttttatgggcgtcccgcaaggatgctgccactgatgctgggca

SEQ ID NO: 44249 - DNA, 65 bp, Chlorella protothecoides
ccctggacgtgtacaggtgcaagggggggggggttgcatgggaaagggggagggcggggagtgtc

SEQ ID NO: 44250 - DNA, 61 bp, Chlorella protothecoides
ccacccgcgccagcccctcagtactggcgggtgcgccgcatctcatccagctcaaagtcga

SEQ ID NO: 44251 - DNA, 69 bp, Chlorella protothecoides
gccaggcgccgcggcgcagtccagcgcccgcgcgcgtcaacctccgcctcgggcacgggccggcgcccg

SEQ ID NO: 44252 - DNA, 29395 bp, Chlorella protothecoides
  modified_base (146)..(155): a, c, t, g, unknown or other
  modified_base (313)..(399): a, c, t, g, unknown or other
  modified_base (777)..(786): a, c, t, g, unknown or other
  modified_base (999)..(1030): a, c, t, g, unknown or other
  modified_base (1295)..(1304): a, c, t, g, unknown or other
  modified_base (2096)..(2105): a, c, t, g, unknown or other
  modified_base (4336)..(4345): a, c, t, g, unknown or other
  modified_base (5238)..(5247): a, c, t, g, unknown or other
  modified_base (5886)..(5895): a, c, t, g, unknown or other
  modified_base (7173)..(7186): a, c, t, g, unknown or other
  modified_base (7267)..(7276): a, c, t, g, unknown or other
  modified_base (8585)..(8662): a, c, t, g, unknown or other
  modified_base (10945)..(10954): a, c, t, g, unknown or other
  modified_base (11163)..(11172): a, c, t, g, unknown or other
  modified_base (12959)..(12968): a, c, t, g, unknown or other
  modified_base (13395)..(13404): a, c, t, g, unknown or other
  modified_base (16282)..(16291): a, c, t, g, unknown or other
  modified_base (16859)..(16868): a, c, t, g, unknown or other
  modified_base (17777)..(17812): a, c, t, g, unknown or other
  modified_base (18806)..(18939): a, c, t, g, unknown or other
  modified_base (19052)..(19061): a, c, t, g, unknown or other
  modified_base (19174)..(19183): a, c, t, g, unknown or other
  modified_base (19385)..(19438): a, c, t, g, unknown or other
  modified_base (23714)..(23723): a, c, t, g, unknown or other
  modified_base (26398)..(26407): a, c, t, g, unknown or other
  modified_base (28614)..(28623): a, c, t, g, unknown or other
  modified_base (29303)..(29320): a, c, t, g, unknown or other
cggcgacgccacgccgcccaagcccgccctcgcccgcgcactgctggaactgctcaccgcgctggcgcgcgcggtcacccgcgtgcccgcgctgcccgacgggcgaggcgcggtcggtcatggcgagtcgtggcggggccctgggnnnnnnnnnnctgcccgacgggcggggcgcggtcggtcatggcgagtcgtggcgagaccctggggaggagggcgtgctccccgggcggacgcggcgcggcgcgctgcgcgccctcggcttcgccctgcaccccgactttggcctggcctcccgctggctggtgtcggnnnnnnnnnnnnnnnnnnnnnnnnnnnnnnnnnnnnnnnnnnnnnnnnnnnnnnnnnnnnnnnnnnnnnnnnnnnnnnnnnnnnnnnccgggggcgtgcaacgcgcgcgtcaggcaggccgcctttgctcacgtccggaccctgctcggggagcctggcagcccgcatgcccagcacaagcccacagcgggtgagtgggtgtgggagggggaccggggagtgggagggggggcggggggggagactgcccctaggtaccgcggcggtccgatgacacagtagtgcgggctccgtcggtcctgcgcaaccaaagggctggcgtacgccagctacctcctaccccagcccccgctgtggcatcgacttccatgcaaacagacacccgtggcatagtgacagctctcatcacacaccactctgtcagaaccatttcccccaacatcccatgaaacacacacacagacnnnnnnnnnncacaacgtccatgcaaacagacacccatggcatagtgacagccctcatcacacaccactctgtcagaaccactttcccaacatcccatgaaacacacacacagacttctacgtcaggcaccactttgtccagttcctgcgcctctaccacaacccacaccgcgaccaccaggccctgctgctgtgccggcagcacctgggggtgttgcaggtnnnnnnnnnnnnnnnnnnnnnnnnnnnnnnnncgcctgctgcagctgtcggtcctggacttttgcacgcgcgaggtgagggctgctggggggcctgggcgtgggatttgtttggcaggagatgaatggtcgtgcaggcggggagttgcgttgtgcggcgaactgtcgggcccctcttgatacgcccgggctacaccctgcgctcagccgagtgacctgccgagtcgcatgatctttgacggcctccaacactcccccacacacacactcctgcgacactgcctgctccctccgcagnnnnnnnnnnggttgcgctgtgcggcgaactgtcgggcccctctcgatacgcccgggccacaccctgcgctcagccgagtgacctggcgagtcgcatgacctttgacggcctccgacacccccacacacacgcgctcctgcgacactgcctgctccctccgcagctgagcctagagatgggcatgcaggagtccgcctgggcgccggcgcagcggacggagaccctcagcatggacagcgccggctcggtggcgggcctgcgcgagggcctgccccacctccggcgcctgtctggcgccggcctggggggcacgggcccgacggaccccgggccgcacagcagccgcgccccctcccccgccaagcccacgcccgcggtgccgcggctgcgcctgggcggagccccggccccatccacgggcgtgtccccaggcgccagcagcgtgtcccccgccgggtcgcccggcgccagcgccacgccggggacgagcgccacgggccccgtctccggccggccgcccctgcacccctcagcccgcggctctggcaccccgctgcccagctccaggcacgcagagtgggggggaggagggatgcatcgaggggaatggctgcagaatctgacgggcgggggctggtgcatgggggggccggagggtttccgtggtcattcccatgaccgatggtcatgactgatccctcaccctgcacaggctgcactccgtctccggcccgctgtccggcggcggcgccccgccccgcgtcccctctctgagcctgggggccgggccctttgccgcgnnnnnnnnnnaggggaggagggatgcattgaggggaatgcttgcagaatctgacgggcgggggctggtgcacagggggccggagagtttatatggtcattcccatgactgattgtcatgactgatccctccctgcacaggctgcactccgtctctggcccgctgtccggcggcggcgccccgtcccgcgtcccctccctgagcctgggggccgggccctttgccgcgcgcacggccagcggcaccctgcagctggcgctccccgccgccgccagcatcctggaacgggacgaggacgggagtggcggcagcggggacgactctgagagcggaggcgaggccagcagcagcgaggcggattcaggcgccggcgacgccgccgaaggtgccagccagagcgactcggacagcgactcgggcggcgacgcgtcccctgggaccggcacatgcagcgacgcatcggcgcccggccacgggcgtgaacaagacacccgctccgcgcccggcctgccggcgggcctggtgctcaccggggatctcgaggaggacctggaccggctggaggaggcggaggcacgcgccgcggcggcggcggtccggcggggccgggccggggctcggcgcgcgggcaagtcagccccctttgcaggcctgccctcgcccgccggctcgggggacgagcgggcgcactcccccggcgcgtcctccgacagcgaggcggcctcgcccaccatcgcggcggtgaggggcccggggtcgcggcgcgcggcgccccccgccgccgtgcccgccctggccctcgccaaggccctgcctgtggtcagcagggttgccggggatggcaaccccggaccaggaaccaacgctgctgcggagcagctgcgacggcccctgactatgccgcggctggcgctgggcaagagctgccattccacgctggctgggcgggaggcggcggcgatgctcgtgacttcccgcgaggccgagtgtgggagcggggcgcggactgaagggtcggcgcggatcctggaggcggggtcggggggtgccccgggcaccctcgcgctcatgggccagcgccagcggtccctgccctccagcgcacgccagcgccgccgctccatctcctccgtgacaggtggcgacagggtggcagggcaggggaggtgggggtgagggggattgagctgggaggtcgacaggcacgatgaggggtggtgggaagtgacagcgaatggcttggggactcgctgtcacatgccatccggagctggcgacgctgcccatacacctgctttttaaagtctttgttctccctcgagccgaaaggggaagggtttgtctgtgcctcagtccaaaccttgccttccccccagatccccacacacgaccccacactcatcccaaactccaatgatcacaaacccacagacgcgagcgagcccgggtcgctggccgcagagctgtcttaccgggaggaaaggaaggcgcggccgctgtacgcctcgcccgcgctgcacgcccaggtgctggccttggtgctgcgcctgctggtctcgcccgcggggcggatggaccgcggggcgtcggaccccttcccctgcgagcgcggcctgcccaacgcgccgcacgtgctgcgccaccacctggcgcacccggccaacgcgggcgtgctggcggacctggcggcgcgctgtgcgggcatgggcccggccacgctgcgcctgctgcgcctggtctccggcgcgggcttccgccccgcctggtacgcgcgccgcgcgcgcatgagcggcgcggcgggggcctacgccaccgtgcaccgctgcgcgctgccggccttcctggcggactcgccgggcgcgccgccgcgccgcgtcgtcctcaaggtcctggatgcagcgcgcggcgtgcaggaccgctgctcatccgtggacgtgcacgccgaggtgggggtgatgcaggcactgacggacagccgccgcgccgcgcgcctgcacgactacggctttgacccgggggaggaggcctacgtcctggtcctccaggagtacgcctgctcgctcaggtacctggaaggggggggggctcctttcattctgatatatggggagagggggggggattgtcgaagcatgcactcccgaagggagggtggcagggaccgattttcggcaggggtctgagaatacggcggtggggctggggaggattgagcgatatgggtctgggcgtcaggcggagnnnnnnnnnntgacaggggtctgaggaagtacggcggtggggctggggaggatggagcgatatgggtctgggcgtcaggcggaggtggcaccctgtagggagggacccacccgcttgaccttgccccacccccctctcacccccacaggcagtggcggctggcacaggccgagggggggcccaggcaggcaggcacctacctccgaatcttccgggagattcttcgtgcagtgcaggcaagtctgggagcggggcgcctgtgcatgggagtgagtgggtgacgaggcggtggtgcagcggcacgctgtgctcgatgggccaagggagacaggggtcctgataccgcggaacaggatggtgcctgaagctcgcatgcctgaggacctcaggggtactggcatgtcgccatattccttccccccgcctccctatgacaagggagaaccttttgcatgtgtgcatctgctgattttgctgctccttgtcctaagaaacgccactctttgtcgctcccatgcaccacactccacgctcttattccctgctctgcccctaaccctcacccccgccaggaactggccgatcgagggatcgcccactttgatctgaagtgcgacaacgtcctgctgcagccacgcgacccgccgtcctcccaaggaccaaggggcacgcctggcagcatgcaagacgccctaccctttgaggtggtcctcgccgactttggggagagcatccagtttgacagccgggccgaggccggggcgcccagcctcgctgctgcgtcggggtgagcaagccagtgcatgagtgagaaggaatggcaatgctgacaggccatgcctcatgtggccttccacagtcctccagcttcttgtcctgtcacacgcagtgccccctggcccnnnnnnnnnntggggcgcccagcctcgctgctgcatcggggtgagcaagccagtgcatgagtgaaaaggaatggcaatgctgataggccatgcctcatctggccttccacagtcctccagcttcatgtcctgtcacacgcagtgccccctggcccgtcatgtcgcccccattaacaatctcttgtgcactcgtttagggtcagcaacgctggcgcagaccccggccagcagctaggagccacggcggcgatcaccaaccgcgtgcggggcaccgacgtcttcaagtcgccggagatgctgctgctgggcggcgcccacgaccacatggacggcgaccggcggcggaggaggggagtggggcccgcctcggacgtctggtcgctgggctgcctcctgttcgagctggtcaccggccagcacctcgtcaccgacccggactgggccacgctcgtggcgcgggtcgccgccgggcgcctgcccctcttcaccccagaccgtctgaggctgatccaggtgcggtgaggggggaaggatgcgagggagtgtgtgggtggagtgtattctgctgcaatcatggcgccaaattccagtcgacagaatccactacctccctaccatgatgacgcaggactgccctgccatcctggannnnnnnnnngttctgctgcaatcatggcgccagatgccagtcgacagaatccactacctccgtaccacgatgacgcaggactgccctgccatcctggacctcatccgattcatgctggtgagggaggcacagctccggcccaccctcagggatgtctccctgcggtgagtgccggccctggaggggttagcaggccagggatgagggttcttgttgtttggcaaacaccaagtcagggacttgacaccaagatcccagcgcagatgcccatgctggccagggccatgcttgccatcggcactactgtgtgcgggcatgcactcagcacacataccccagaccctgccggcccatccccaaaggaccgtcaccgctgctcgcatgcccctacattcctcacacgcagtgtggaggtggctctagcatgcctggggcagcagccgttgacgagacccgcggcagggaaccccagggcaagacaccacgagagcacttgctggcccaggccgcccgacagcgagcccatgcaggtgccgcccggtggccttgaccgtctcgacgccgcgtggcccttgcccgacgcgcccccagccgtgccgcccgcccagcccctgacatccttcctccccgtcaagccctggctgtcggtggggcccctggcggccgtgggtagcagcggcgtgcttcagggatcgggcggcgcagggggcgacggctggtcggctggaggccccgcctccctactccttctcgtcctgggcgagggagctggcggcggcgggggtgcggacgccgcgcatgtcccgtgctgtggcggtgcggcggagcccagatcggcagcgcgtccccgggaagagcctcctggagaccgcttcgcgacccccggcgcctcgcccgacctgtcctcccccgagcgccgggggcgggctcccgcctccgactccagtgtcgccggctcgtttgccagcccggtgagggcggagcgcaacaccttctccgtcaaccccctgtggagccccgacgcgcggtcgatgggggctccagatgccgagcatgcgagcgacgatgacggctggaggcaacggtccagcccccaggcactcgcgaggtggctcgcgcaggagactgccgggggggagcgcggagaggagagggggatcggcggccacctttccccatccggtcatgcgcacgctgcgcctcgctcgaccagcccggacagaaaacgggcggtggggcgcaggctctggggcgccctctggagcggcgagcaccgcagcggcgggnnnnnnnnnnnnnnatgatctgatgcgaggccggggcgtggcagcggagggaggtgaggatgcggtggatgagcgggatgccagcggcgacggtnnnnnnnnnnctgacctgatgcgaggccggggcatggcagcggagggaggtggggatgcagtggatgagcgggatgccagcggcgacggtgccagggacggcgtcggcgcgacaggagagcgcctcgcaccaaaccagcaaccgtcgggccccgtccccgctcttcctctcgaagaggagggcgccgttcatgacccggccgccaagcacctggcgagcgcgctggccggggtcatggcgcacggccccgaggcggaggccgcggtgagggccgccgtggcgagcggcgtggcctggcgggcgagcaccccgccacccgcgccccgggagccggcggcggcgccagggcacacactcgcgcacctgacggccacctggcgcgagtgggtgggccagaccctggactgcctggacggggtgctggggtgcggcacggcggaggagcctcggcgcctcagcctggcgtgcagtccagggtccgaggcggcgctggccctgctcgccgtggccgtgctcaggcggcgcggcaggctctgcatgctggaggccgccaccgcggcggccgcctggggcctggactcacgcctggaggcctggcagctggaaagtctgccaatcctcttggcagatgcctgagcggcatgcatcgtcgaggcgcagcaaagagatggaggacccccgcttgcacgattttcccatacacaaggacagggctgcggcaagtacactgtctggtttctgcttccctggtcagacttcctttgtatctgtggcagcgtcggacacatcgacagagcacgctgggaagttgcatcgatgcacgctggcacctgagcatgcaaaggcggcaaaaacgacccctcccccgctcagccaaactgagacgccagcagcgccctgtactcctccagcagggtcgccacctcgtgcatgcgcaggtcctcggcccggaggtgcatgaaccgacccggcatgcgggacaggtccgcggcgtccccgggccgctctctgagcgcagccgcaaaccccgccctggccaggcgccggtagtcggccaccagcgcgcccacgtcccccagccgcagctcctgtagccgtggggggggatgattgaagaggggtgctgggcttgggagtgggctggtggagaatggaccgtgcctcccctggaccagttcttttatcccgagataagatgaaaccgtggactgcccccccccccgggcaatagcactgctgtttcatacttcttctgacccacaagaaccttccactgggtgaacaatcatgcgcaggacccccccccccccacacacacnnnnnnnnnnnnnnnnnnnnnnnnnnnnnnnnnnnnnnnnnnnnnnnnnnnnnnnnnnnnnnnnnnnnnnnnnnnnnnacgaggccaggaaggagcgtgccgcctgcactgcccggccccgatctcctcctgtgccgctgggcaggtcgagaacccgctggcctagagccagcagggctgggtcaaattcgctggccagcacacccaggggtagcaggtcggcggcgggggcggtggcaggtaggcccagcctgtccctgaggctggagaaggccgaggtgaggcccagggggacagcggggaggtaggccagccccgctgcggcaaggcccgaggcagcgcccggggcgggggacagcggccggttgctcgtggcgggcggcccctccagggtcaagtgggggccgccggggcggggcggggtggggtgggcgggcgccgagtccgccgtgtcagccacctcctccacatgcaaccaccaggcgtcccccagcgtcgtcctcccgtccgtgcctgggtggcagatggaggagggcgtgacgatggatcagcaggtcatggctctgaaacacagccatggatgaccgagcgcagcagaacattcacgcactcagggatccctgaacgacggaagtacaggcttcccccccgagaccccgccacagcctgatctccacaccccacctccaaacaggagcaggcggccgtcggacacggcagtgagcgagtgcttctcccgtgcgcagggcgtggcggcgtcgtttgaccccggtaccgcggccctccacaccagcgactccgcctcccggtccagcatcgagacgtcttggaggagggtgggcggtggtgggatcaagggggggctccatgcagcgtccaaggagggtgctgacgcccccgctgcggcgccgacaaagacctgtcggccccgtcacagctggcaggcgagcagggccctctgcaggacgcagccgcagccccctctctctcagcacacactcaccgtcgaggcagacgccgcggctcttgatgccgatgagcgagcggtgctcggtgaagccgccagacacgaggaagcctctccccgaggcggcggctgcgtggcctctcctgggcagaggcacggcgccttccagggagagcagcgtccaggaggccgtcgcagggggggcaggcccggtggctggcttcccatccccgccggggccctcccttgacgttttcacagcggcgccggcgcgctccaccaccacattcaggctccagagctcgccgctgacgccgtagttgtcacccccaaacagcagcagcctgttgggcagtgcgcacagcgtggccgagcagcgcggccgcggccgggcccctccggcggcacccacctcggcccatgcgcgcgcggcgatgtcgtagcgccagaggtcgtccagccgacggttggacgcgtctgcgccgccgtagagcagcagcgagctgccgtccagggaggccacgaggcaggcgcggtcgcgcgggcagggcgtcggcgcctccgcctcggtctccagcctggcccactcccacgtgtcggtgtccaggcaccagaggtcattgaaggtgtgcagccgcgcctgctgcttgacgtacacgtgtccgccgaagacgtagagccggcgccccagcaccgcgccggcgtgaaaggcgcgggcggaggggccggggccggtggggttggagggcgagttccagctgccctggtccagacccagcacggccagcgagtccagagcctcccgctcccggttgatgccgcctgggttggtgtgtgggtatgggggggaaggggatagtaatgggaggtggagatggggactgagtgggttagagggaggtcaatggtggtgtcacctcccccccccgcatggcctgtgtccacagtaccggtctcagaacacaccagcaccctccactcaccatggatgatgatgaactcgtcaccccaggcggcgtggttcttgatgctcgcggccacgtgtccacaccgcgcctctggcaagctgccctggaagttggactcggcagacagccacacggcccggagtgcggtcgtcatgttggcggggcagaggggagcatgtacaggggatcggatgcccactagatggtcaggaactgcatcagatcaactcgcggagctggcactggggctggtgagggcagggctgcccggctgggatgctcaccctttttgggcggtggcagggttttgggatcgcgcacagacccccaggattcacgacgaagcgcgaccggtattcatatgcttcaagactttttcataaatcaatgaaagtgcggagattgatgcttcgagcgatgcccacnnnnnnnnnntacgaagcgcgaccggtgttcatatgattcaagactttttcctaaatcaacaaaagagcggagattgatgcttcgagcgatgcccaccatccccagtccacgatccgaatcggcatgagtctgcatgaacaattacactcggctgggcgaagtgggctcagtgagaccatcttgtggggccctcctttcctcatgtctccctgatctcnnnnnnnnnnaatccgaatcggcatgcgtctgcatgaacaattacaacactcccgcatcggctgggcgaagtgggccgctcaatgagaccatcttgtggcgccctcctttcctcatgtctccctgatctcgccagctgccatcaccacgatgggtttcaagggccggccccaccgcttggcggcgaggttggccctcttgtctccgaaaacctggcccagctcgttgaaggcacggcggttgctgcttggatagaacgtgggcacacgttgcacagctgccagcacatcaaacccatctgcatggagcatggggtgaggtaaagagggttgggatcgggcccaggcatgaatgtgttggaacctcatttgacagctcatcaatgcagtgccctgctccagacacagcctgctgccatgtctggcaaacaggggcgatgccctcacccagaagctcgccaatgacgacgttctggccatccaggcttggaacaggcccgggccccgtcgttatgagcatgctgacgttgcagtagctggggaggcgctgcaggtactgctcatcctcgttttctggggattgggtttgggggtaccattatgggaagggttgcagcggacagggtgggaggggacccacctatcgactgtttgcctccacagcatgtccagccgtgcatcagcctctgtatgcagcccaggcccccccaccaccttggcaccagttccagggacaactcacctgtgaccgcaaggctgacggtgccgggccggcggtggggcagctggaaggaagctggctgcatgagatcggtgtttggctgggagcactgcgcccccgccacatacccaagcctcttggggccctgatgccccagcaaaaggtactgccccggcaggaccttgtttataagcgactggtcatactttccagcccgaatggtttccaggattgaggctgttgaggccggggccacatctccatacagtcctgtagggaggattttctggccgtgagttcatttgatggcacgcaggcatgtacaccagatggcaggcgctgcctccatatccctgcatcctgcatgggaggcattttgcagggacacggcatcaaccccttgcccccatgcacactgaatggctctttcgcacccagagtcatccttccaaggtaggccggtgcctcacaggccactgtgtctcccagagttcgcgcccgattgactccggcatcgcagacccccacgtcaaagtacacccggtgtgtaatggctgggctcggggacggctctgcaccgcacgccagtggcagtgtggctagcatggaaggaagggccgccaaaagggctcgacgagagagtccccactcactcctgctactcaacttctgtgatgagggcatgtgagattctccatgctcgggtacaccccgacatgggtgacatcgggaggggtgagcatgggaccgagcatgcccactttcgaggtgcgtgccgcatggctgcgctagcgaccgcatggggtgggaggagaggtataaaatctatgtatcacagtcagaagacacgttttggtctggcgaatggcaaatgccccggtataaagaatccaaacgcatgagggacaggaagggattgagccggattccgctgcgccccagatctaggtttccgagcacaccgaacaccacattgtttaaaagctctcacaactcgatgcttaccttcaatggtgtatacaataatacatgccatcagattgcagagcggtcttgtgacatctgccaatgtccaacnnnnnnnnnnaagcacaccgaacaccacattgttgaaaagctctcacaactcgatgctccccttcaatggtgtatacaataatacatgcgatcagattgcagcgcggtcttgtgacatctgccaatgtccaacgctgcagcattttgggggaacgtcgatctcaaaaagtggcaggccgctcttgatgactactggacgctcatagaaggctggaaaccagctttgctggacaatgagaggtattcgatgtgtttggggctgcacagagcgctggtggtgcctgggcggcggggagttcgttcatcgctctgcaatcttcagttctgccttacggaagaccaatcaacatcccacatcacacagccgtcccatgccgcatcccagatggctccaggaagcattgccgggcgtgattcgagccagggatccccctgannnnnnnnnngccacccctcccagatggctccaggaagcattggggggcgtgattcgagccagggatccccctgaactgcatcatgaggagcttgtgcgtttggtcgactggaagctttctcgaggaaagtggcggcccaggctccaagcctttgccaaagagctggctcctgcgagtgtagctgatgccagccggtctgcctttgcctcttcatacaaggacagctcgtctggagcagaaccaggaccctctgcgctgaagtcggcattcttggagctcaccaagctcaaggtggggcagggctgagctggtctgtgtttactggggggataatgggatatgcgttaagaattgccctggaatgtcacatgtaggtggatccttatttttaagtaggaaaacagccagagtcattcgagcagtctggcaagacacgacggcactgtgcataatcgctccttgtgcaaccttgccctctccggcccagggagtgggtcctgccacggcctccgctgttctgcaggcgtttcatcccagcattcccttcatgagtgatgaggccatgatggcagcgcttggggaaaaggcatacaccatccccatcgccttggaattcatcaagactcttcgcgagaaggctgctgagctcaacaaactagatgcagaacgtgagtgatgaggcgtttgatgcatggctgatgaagcacctgtgaaacatctcctgtacgccaaggattacgtgctcattgacgagtgtgagcccggtgccatcttgctacgggggccggaaaacattgcaggacctgtgacaatcttgccattgccaccgaccctgtcctctttgcctgggatgtgccagggagaaggagctggactgccaaggacgtggaacattgcctctttgcagatcaccttgccaggatggttgttgaacgtggggcgaggccgcctgcagccaggggcaagaggaagcgttaggaatcgaggcatgtatggtgttcaatgtaagccctttgggacctgatgactgctccagtgcccgacttgactgccaggaaacaaaatgatgcttcattgagcaggaccccctggaggggggagactccgttacccacccggtctgccactacgcttcgattccggcgcgatggtggtccatgccacgcaccggccctccacccgccaccacgggcctccgccagcttcgagggcgcatttgttacaaggttccagatttgcgcttgtgcgtcggcgtcttgtctcgcatccttgctcctcgggctttgcacgcaggcgccatcgaggttcaaacgagaacgcgccgatcaagtggcgacttgaccagcgtgcaagcgcgtgatcaaggtgatccaaattcagtctgtcgtgtggaggcttccggagcccgcaaaggctgcgcgctgacggacctgaccgactgagctaggggtggaacctgtgctcccctctgctgatcggaggcaggcaggggctcgaccgcgcattgggatccccaagcagtgaacaggcgccgaactcgttcgccgggggacacccgatgtcaataacagagtgcgtggaggtgttgccaggtgggacggagaccctctgcgcccctgcaggccggccgatcagacccggcacgccctgactccctctccctgcctccctcgcgtcatcctgcaattcccgcaggaggtaggcctcacacctcctgctagctgctcgtgggaccgtgccacccttacgacagcatgacggcttccctggagtggcacttcagccaagtctttggcgaacggacgcctggagaggagatccaggatggtgagctcagagaaaggggaggggcctggcaagcttggcggcgagagctgcctttgtgcccctcagtggtcggaaggctggagcccccagcagtggcagaggcgcgcctcgcccatgaccaacagggttcactgcagtggaaacaacatggtcccccggcaatgctcaggagcactgctgacctggaaccaaagcaagcggccatcacctgacccccctctccgctcggccctccctgcagccgacatcatctctgccgtggagtttgatggggatggcgagttcctggccacgggagatcatggagggcgcgtggtcctgttcgagagatgcgcgccgtcacacctggcaaacgaggtgggcggggagggatttggtggagatggcatgcagtgccgtgccggtcgacatccgtgggctgcgcaatgtgtcaatcccctcccgacggcacaccatgcttccccacacactcaacagcctgcggactcccggcccgcctcgccccgcatccccaacgcctacgagtaccgctacctgaccgagttccagtcgcacgagccggagtttgactacctcaagtcgttggagatcgaggagaagatcaacagcgtccggtggtgccggcgagactcccctgccctcgaaacccccacagcccaccacctcctcaccaccaacgacaagaccatcaagctgtggaaggtaggtcgtggggtgcggcctctttcagcatgtcccctcgagcatgatgcagcctgaatggccatcttggtccggcaccggtctgaggtggcgtccggccccccgacagtctctggcatcttctggccagcacagctcctttggtagggtcagagcctcatgaaccatcgctcacttctctgctgccctacaccctgattcctgcaggtgtacgagaagcaggtgctgagcgtgagtgggctgaacatggatgctcctgggagcagcggacagaggccgagcctagagggtggcggcgcgccaccgtccctcaaagaaagggagcttcgagtccccacggtgagacgaggccatgggnnnnnnnnnnggggtggcggcgcatcaccgtccctcaaacaaagggagctccgagtccccacggtgagacgaggccatggggccccatcttggttactcatgtttggtcttgggctcagcattgaggcgggaggctagggtacgcaagccttcacctgtaaacgcctgtgtctccacagcagggcggcagcgagccggccctgtgggtgtcgccattgggtctcgggcaagtacacacttgctgtgcatccgacgcctgaaccacccccgctctcctctgcaggtggagggccgggaaacgctgatgaccagcaagtgtcgccgcacctactccaacgcccacgcctaccacatcaacactgtgtccctgtctagcgacaaggagaccttcctgtcgggtgcggcgtctttcatgggatggggaccctgcgcctgcatctcgcatgtgctgggatgggcggagtcctgttctgttcacgggaggatgctctccttcaccatgcgcctgccacgctggcgtgcctgcgggctgcagcatctgaaactcactgcagatcatctggcccgtgaggggaacnnnnnnnnnngggctgcagcatctgaaacctactgcagatcatctggcccgtgaggggaacccacatgctttgattgcccatccccctcactgtgtattgtctcgccctgctcttgccacatgtgccccggttgtattaccacccacacccacgcaccagtatcaccccaccacacacagccgatgacctgcgaataaatctgtggaacctggacgccgagccccaggcctacacggtggtggacgtgaagcccgccaacatggacgacctgacggaggtgatcacgcgcgcggccttccaccccacccacagccaccaattcgcctacagcacgagccgcgggtcgctgcgcctggccgacctgcgcgccgccgcgctgtgcgacgcgggggcgaagcattttgaagacgcgggtcctggcgggcccaagaacttcttctctgagatcatctcctccatctccgacttccgcttctcggcagacgggcgccacctcctcgcccgcgacttcatgaccgtcaagctttgggacttggccatggactcggggccgctggaggtgcaccgcgtgcacgaaagcctgaggagcagggtgaggagggaaagaaaggaggagggtggtgtttgggcgggggaacggaggaaagttgagggggtcgttgcggggccattggcgaatggtgcgggtgggtggctgaagcactggaatgcattaaaaaagggggaggggggcaatgggagccactccatgccctgacgattagatgtttggctgcggcagccaaggcatgaggcgagattgctagggaatggacattgccctgcgacaagcgacgcgtccttctgcagtccagcccctgactgcatctcaatgcaccttcctaacaccccaaccccccccccccccccccttccccnnnnnnnnnnnnnnnnnnnnnnnnnnnnnnnnnnnntcttcctcctccaacagctgtgcgacctgtacgagagcgacagcctgtttgacaaatttgatgtgggcagctcgggcgatggccggcacatcgccacgggctcttactccaacttcttcaagtgaggctgaggggcgtgcgaccctggaagggacgagggcggataaggtgttctgcttgggaagtgggggttgtgctggctgccatgccagtgcgccttcaccagcaacgcctgcgtgtggtttacaaatacccaaaccccccgccgcaccatggcacagagtgttcgaccgcagcaacgaggtgggcagcatgttcctggagtccagccgggacccgatgcgccgccggctgcaggccgccgccaaggtgagggaggagcacgagtgagaggaaagggaaggggggagagggagtgctgtaccgggcattttccgcgggcgggcttacttcctgcccaagggcacgcagcccgctgtcatggggtggtgaggaatgacgtcgatgccaccctcctgagctcccagaaatctgcctaccttttcccgaccacccatcgcctcgctcgacacgaccccgcagcccgcctcccgcttcgggctgtcgcgcacgcgcacgcgcaccgtttccacggctgaggaaagcgtgaccagcgacctgagcagcaaggttctgcgcctgtcctggcacccgcaggcgccggtgatcgcgaccgctgcagcaaacagcctgtacctgttccagggccgggcgcaggacggcagcgtcggctgacgcccgccgctccaaacccctgccaccgcaatttcatgttcacacttgcccccctgcctctgctcggccgctctcgctacgcgcatgtgtcacacgattcatgagggcagggcgggtgtatatagggggccgactgccagtggcagtcaggctgcgccagggtacaggcacgtcttccaaaaatacagggggaaggggaaaaggaggagcacgctacgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaatattgaagatcccagccagaaggaggctgagcagatgggaggtccgcagacaacctgtcagccagcactcagttgaatccttggtatcgccagaagctccaccaccccnnnnnnnnnngaaatattgaagatcccagccagaaggaagctgagcggatgggaggtccgcagacaacctgtcaaccagcactcagttgaacccttggtatcgccagaagctccaccaccccnnnnnnnnnngggggggcgactgccagtggcagtcagcgccagggtacaggcacggctttcaaaaatacaggggcaggatgtccagggaaggggaaaaggaggagcacgctacgacaaaattgtgtttgggtgggcccggcaggtggcacggagcccgccctggggagaggggggggaagtattcttcggcaccaaaattgtcctattggcnnnnnnnnnnnnnnnnnnnnnnnnnnnnnnnnnnnnnnnnnnnnnnnnnnnnnngcgccctctgcagcgctgcactggtcgtctgccagggggccatcggtgaaaaatgccagactttccagctccgggggaagttctggggatgcacaggcatgcccatcagcctggtggaaaaggcgggcaagagggattaggaagggcagagcaaatttggggaagccccatagcaaggtgggaagccacctcaagcacaccctggtatccttcaccaaccacccacttggtacctttagggacccggtagaggcttgcgctccgccccaggcctgcaagccttgaggctgtttttgaggtgtggatgcttgagggggctgctgaggcaggagtcctcgaagagtgggcgactccgtggacgccgacgtggacacgaaccgaggtccagcaacgtgggcgagcgtgcggcacgtgatgcggccgctgccagtagatctaggtcccgagaatgtggcacatccagggctcttgggattgtgggtggtgacaagactctgcatgctcctcaatgccgcccggccaaggggactcgccggtgtcggacggtgggagacaaaggggcaactacctcgacgctgtgttcgcgcgacgtgggttgtgttatggtcacttgggtatgtaatcagcagagaatcgtttcagtacaagagacaggaagcgggattatggttatgatgccccacacccgacattatcccttatgtggaggatttcacgtgcatgccctccgacactctctttccacactttcctcacggaatgcggcgaccacacaatgaagctctctggtgcatgtcctcttgtgaagcaaagtaccaaaactttctgtcctattttgttggttttgttgtcaagataaacattatacagcatcaacagacgctatctgccaatcagttagtctaagatggtgccaggcacaatgtaccctgctggtcgacgaggtatatacagtggctgaatgctagtcctgcacctgcagcggcggaacgcacccatgatgacaaaacgaccgctccccatgccgactcagcgccgggtcacccgtgccatgcgtgctgtggtgggcagcctcagccacagcacaagcatggcaaccagcagcaggccggcatagaggcagtctaggatgatgatgttgcgcgtcaggtcccccgcatccacgccgatgatgttcaggaaggccacccccctcacgttttttaccgcagcgtagccctccacctgccagggtttgaaggtggtgatgcggctggcgcgggggtcatgatgggtgcggctgcaacatgttaaggcctctccggggaccagccatcgatggaggaggtgctctccttttccgcgagcatcaggtccctcaaccaggacgaacccaggccatgcaatcattcaacagcaacccctgatgcttgcgtgaacaaaaaggctgctcaccacaaagtcgagggagagggtggccacctcattggtgatgagggcagtgtaggcgtagaagaatacagaggcgtagtgcagccacctgatccaggcggcgatggaggccacgttcacgaaaaagccgcccaccaggagggagatgaggagcacgacattcatcaccaggctggccttccctgctgtcgtgcagcctgaaaggaggaggtattttggtgtggggaggttgagtgcggacacaggatacttcatttgaaacatactgcacggcgatttattggggaaggcaggtggctgctgaagacatcgagactgctgtgaacacagagtgggctcccaaaccccggtgcagcgcgctgtcaccaccagccccgaggcacctaccgactgtgactgccagtgcaaaggcacctaccaccagggagaaggtggccagcacaaagaggaagacagctacgatcgtggaatcggactgcagccccatctgcggcggcggaggtgcgagaatcggccttgccacagcacatcatcgcatcggtgcaggtatacagtgagcatgcacgaccgagctgccacccaacgtccgtgccccactccatctctgcaccaaaatccccccccccccctccaggacgcacaaggcccagacccaccatggggtagaatggcgctgcatacaggaaagcagggatgacgcgcaggaggagaccgtccagtgcggctttcgtcaggaggtaggagacagggtgatacattccccctgcaggtgccaggcaggagcgcgggggtggtgagggcccgcgctggcatatgctaacaacaggaggagactccatacctcccggatgcacacttgcttgctcttccctttgcactaccactgcaagccatgtcagggctgacctttgatctcacgcatgacgagccgccgctcggccatgaacaagtccaccgcggtcaggctcgtgaaggcaaagaaggcgaggatgaagaacaggccgcctgggcgggagaggccggaaagggttcatgggatgatcgtcccgcggcattgaggcttgccgcaggggcagcagcgaccacccggcaatgcacaatggcaaagaccgggcccccttcccctccacccctccgcatctttgatcgctcacccgcccggttctgggccccggagatgtcgaggccgacgttgaggaagatgcagccggtgaagatgcccatgcccaatgccatggcccagtgcaggaggaggagggaggggttcctcgcgatgtccagccccgcccgccagaacaggaccgccagctccagcgagcgcgagcggccggggccagggtcggagaccgtgccgcgccccgctgcgtccactccgtgcgacccctccgtgcctgatcgagtggttcccggccccgcctccagctccaccagagccagttcctgcgcgtctgctgggcccttctcggcggctccatcctttccagcaccaaccgttccatggccggcaggcaggactcgagggctgccgccgcccgcggccccatttccctgcacccccgccagcagggcgcctagggtcacggggtcggaggcggcgtgcagcatgtgctccgcgatggcatcgccggcggggcagggcacgccgcgcgacttgaagaaggcggcggccgaggcggggtcgccgccgtacaccgcgcgcccccgcgcgaggaggtaggcccggtccaggagcgagaacatggccggggagggctggtggaaggagagcacgacgatgcgcccggccctggcgacctgcgagtgcgaggggtttgagtgtctcgggtggtggggggaggggcctggacatatgcatggtcgggttcaagaaagggagtggggtgtctcaaaacgagggtgggggatggtgctgatggctgccgcccagaccaggggtgctccggacacatcctccatggcgtgcagtgcagcgactgtgaaccatcccctcacacacgccaaacgtttcccccacccctttcacacacccacacctcaacccccaagaaacaggaacaaccacgatccccaccctcttcaggctgtgcatcaggttcagcgcggtgaaggagtccaggcccgaggtgggctcatccaggatgagcacccccggcccatgcacaagttccatggcgatggacacgcggcgccgctcgccgccggagatgccgcggcgggagagcgcggcgccgcccacgcgcgaccgcgccacgccctccagccccagctcctgcagcacggcggtgacgcgcgccgcgatgtcgccctgcgaggcgcccgcaccggccccggtgcccttcagcagggctgcgtagcgcacgcactcctccacgctgagcgtggccagcagggtgtcctcctgcgggacaaaggcggggcccggaccgcaacgtgcggggctgccctccatgaccacccgccccgtcagggccgcgcggcggtccagcgcctcccccgactgtgccaggatccccagcagcgtggtcttgccggatcctggcggttaaaggcaggggggggggaggtgagagggtcgaggtggtgcggaaaggcgacgtgattgagaatcgtggtggggataaggtgggaggagcgcggtctggagactcagtcagggtgaggcatgtaaagggccagcgattgctggagccgggtcaagtaggaggtatgctgtaagaacagctcttgtctaccggcaggaatacatgatgtgccagacagctgaccagcccatgaaacaacccctcctctctataaaacggagacccaagcagaccccttgcatcgcagcgccccgcaaactcannnnnnnnnntcccatggaacaacccctcctgtctatgaaacggagacccaagcaggccccttgcatcgcagcgccccgcaaactcacctgatggccccaggagaccgaccagctcgccgcgctcggcgtggcccgacaccccatgcaggatggcgaggccgtcgccggccccacgccgcgcgccccacggggcgcaggccgcccccatggcacccagcaccccgctcgccggggcggggacgacgcagcctacggcctcccagcgaagcgacaggggaccgccgcccagcgaccccggcgctgcgatccccagggcgccggatgcaggggctggcgccggggcggtcggccggccctcgccccccgacctccagacgacggggtggaaaaggaggtaggccagcaggaaccccaccaggccgatcagcgccatcagcgggatggcggcgatgacggggtcgtagttcttgctggatgcgggggccacgtagttgcctgggagtgcacgatttggagatgggcttcggtggtcgagcgccaatcaagaagttccacgcctcgccgccccatgcagagcagtggagaccccttcctcagcctcacacaccttggctggcggtgtacccctccacaatgcactgggcgttggtgcagggcgcgatgagggtcacgaaaaagtcctggatgtcgaacgtgcactcccccgtgacctcgttgcagctgagcgtgcaggggttgccctcaatcacgtccaggactccctgcaggtcgactgcatggccaagatgaggagcgtcgcagagtgaggcagggggtgtgtgggcgatgctttgggacacagcagtctgagggaccaggaatcaagctttcccagcccaattgccgtaggagcggcgatttttatgccggaacatgcagctattgccacacttcctcactctccccaagacagtatatctacccggacaggcctcttcgcaggagcaggatacactgctgcactgcgcgacgctggttccgagctggaaggcacagtttgaagcccggcaggacaaggggttgtctgctgatgatgtcagcgcaaaattcacctgtgaggagggcatagatgggcggggttgcgaatgatcagctggcgaggtaacttgaacagtggcgacctctacgtgtagatgcaccccaagacaacacaaggatgctcgtcactgttgtacccatgctcaggcatccctcctcgggcccaacacccacgctgcaatggggcgcattgtcgccagacaagctgcctccggtgacggcttgcgcatttgtcgcagacgcagcctctcccgagcctgtggtgttgcagtagacgtaaaacgtgccaggtacaattatgccgtccaggccagttccctgcaatgagattggagcctttggatcatgatgatgaaaggtaatcacgggcaccttcaagcgccatccacaccttgcacaggcttctggagcgcagggggctgggttccacttctcatcagcaggctgggtcatgcgagtgcatcctcgaccctccagcagtcgcaacaagtctcccaaaattctgcatgaaactgtgcatcattgcccaaggcatccccctgcaccaacacaccttgaggtcgcattggtagctcaggaaggcggtttgctcagtgaagttccgcgaggagctgcaggtcccgctggacagtcctggcacgagggccgagcaggcaccatcattctggcaggctgtgcaccccagccccccccagtcctcagcgcagtcgcagctggccgtcgagctattgtacacctggagggtactgcaggctgtacagcaaagagtggagtggggcatctgagggttgctgggagggtgcctgggaacatgcagtttatagagggagaaagaagcccgggcttgggcaaacagcttcagctcagcccacgtcgcctgccatcgggcacagcactcactctgtgtggcgacgcacggggcgggccccggtggcgggctggggggcggtgggctggcattcgcgctctccgggcagctcgcgccggcgtccaggggaaaggcggaacagtaccctgccgccatcgtgcacgccacccccgaccagccacactcgcactcgcaagcgggctgggcggtggcgccgttttgcggcaccatgcaccgcccgtgctcgccgcaggcgggtgtgcagcccagggcggtgccggccaccaggcgcaggtctgttacggtgtaattggtcacgcctcgcaacgggctcccgccgagggtgccctcgtactcgcccaccatggtcaggtccaggccggagagggtgaggttcagcgcctggccatcgccggtcacagccacggtgccagagccggtgccgttgatgcccagcaggggcacgggctggttggtggccaggagagaggtctgggtggagccgccgccgctgaccagcagcgaggcgtccacggcaaagatgtctgccgtcgcgccggggacgaaggccgtggtggagaggtcgaactccacgtcctgccatgtcaggttcaccagggtcccgctttccagctggggagtggcagggggaaatgtgggacaagaggagatttgtgctccggcgacacgtcatgggtgccgtacccaccaacactgttgcatgcctcatggcaatgcnnnnnnnnnngcgggacaaggggagatttctgctccagtgacacgtcatgggtgccatacccgccaacactgttgcatgcctcatggcaatgccatgggcaggccctgtccatcctgtaatgctcacaccagtccacacacacttcgtaccagcactgtggtggggtacatggccagcctgcctgtggcgttagtggtggagagggtggcccccggcagggctgccagcacgccctcccccgttgtggggcaggcatcgacatctgaaagcagcagcaggacattaccctgcagccccgtgacgagggtgggcgggacgagggcgagcggggccgccaggggctgcaccaccgaccccccaaactggaaggttgaggcggatggggccaagctcagggagatattgcaggtcccatggacgtatgggatccagaagagcaacacgaaccctcccaacattcggcgggtgacgcccagacgcgatggggggcaccgtgtggctcgccgagtggcagtgtgggcctcctggccgctgcaaactcttcggctgaccctttgttctattcgatcgctacaaacatgattgtgatttgaatcgtatcgtctgagctgcatcgtgcctcgattccgtgtaccgccttccctgatcacgaaatgtttacgacagaagctgccccacgccgcaattactcgcatcggggcgcattcgtgtttcaatcgcgatacaagtggcatgtgtataaggaattcaaggtccagatttaccgctcaacccatcctcgaggcataaggatggtcacacgtacgagagtcagtgtgctgccggaattcttaccctgcttaacgttggcagaagacgcggcgtgcacaatagccaatatctgcaagaggaaggctgcacgcttatctggagccacggcaatgtggagcgaatgacatgatcaacaaaatattgcgtgattgtcttacaggttgtagactgcgttgcagggggagccaactggaatccctaatggcgggaggcgattgcagcgcgctgcgtccagggcaagagagctccgtgggcccaccatacaatgacctcgaagagtgtagcgtgcaatgccaatgcaacccgctatataataagatccttcgcactcccgtcactgcttgcttttattccgagcgcagcctgcgagggacattatacacagaccccaacaccacttttcagcgtcggcgggccacgctcctggcgcagaggagcacaccttatttcctcccgtgtgcgacgccgctcgaccaacattggcagcggtgatgggtaagcggaagtctggtgcgtccagcacctttcccgagaccatcacccagcagccggcccagctgcggtcagccgcgggtccctatgccgtctacttcccatcgggctacgacccggcgactggcgtcaagtgggaaacatacacacatgccaagaagcggcatagcctgattgtggggcgcacggtgggtgcagtggtagacctgggtggggtggcctgttttgctgaagaagtgtatgcatgctcacatgactggcattcctgcatcctcacaacccccgcatttgcatcgatcctgactgcaggatagcgtcgacttcgtgggcgggagcatgggtggagagcacagcaccgcccctccctgcaggtgtcctggggtgggctggtggggtggaagctcacgccgcccacatcatgtcgccctgcctgttctccctccaaaacccccgaccagcccttgcggcggcaaagtccggcagcctggcccacatgctccatggccaggacgcaagttttgctgctagagtaacgtggatactacgtactgactgctggcggtccatgccagactccagcggcaattttcatgtaccacacatctcatgtgatgcgactgcaacattctcttctctgcacttctgaagcttcttctcttgtcagcacctgagcacgagactttcagaacctaggcactccgccatggtcatcgccccctcttcgccatggaccgggcccttgcccctcccccatcacctcctcacccccttccccctcccccatcacctcctcacccccacttcctcatcacctcctcacccccccttcctcatcacctcctctccccccctcccccattcccccatcccaaaaggtacgcggtgggcgtgttcgaccgtgccagcggcgcccnnnnnnnnnnattcccccttccccatcacctcctccgccccttcccccttccccatcacctcctcaccccaatccccctcccccatcacctcctcaccccatttccccctttccatcacctcctcaccccccctccccattcccccatcccaaaaggtacgcgctgggcgtgttcgaccgtgccagcggcgccctgaccctggcacccctggcgcacgaccgcctgctgcggctggagccgcgggtgtgcggcgtggactacggcccctccgaagccctgaactcgtcggtggaggggttggaggagcgcaaggccgccaccctccgcctggtgggccagctgggcagccagcggcggcagcggcagctgctggcgcgggaggcggcgcgcgtcgacccccgcgccacggtgtccagccccgaggcactgcgcgggcaggtggcgcgcggagcggcctcgccctccaaggaggacctggtggcggcggccattgccgggcgggcgctgcccccgcacgaccctggcgcgaccaccgcgccgcgggcctaccccacgcgcggcctggtctgggacgcgctctgggacgcgctgccggtggaggcctacctgcgctctgcgcgtgagggacccgcgccggcgaaggacgcggacgcggacggcgccggcgccgagggcgcgccgcgcacggnnnnnnnnnnnnnnnnnngggacccgcgccgacagaggacgcggacgcggacggcaccggcgccgagggcgcaccgcgcacggcctacgtcgc

SEQ ID NO: 44253 - DNA, 61 bp, Chlorella protothecoides
ttctgaccagtacccattacgtggcaggggggtacaagcctgtatgcttgggggactttca

SEQ ID NO: 44254 - DNA, 790 bp, Chlorella protothecoides
  modified_base (119)..(128): a, c, t, g, unknown or other
  modified_base (338)..(347): a, c, t, g, unknown or other
  modified_base (504)..(513): a, c, t, g, unknown or other
ccctttatcaatcccccccccgccccccacaaacccgacgagactcacccccacgtcttgcagcacggccatgaattcagcgcgctggcgcaggatctcctgctcttgcaccaggaacnnnnnnnnnnacttctcgcagcacagccatgaattcagcgcgctgtcgcaggatctcctgctcttgcaccaggaactcgcggtgcgcggccacgatgccgcgtagctgctctgggcgcaggcacagacgctgcaggatggcgcgccaggtgcccacgtcctggttctcctgcgcgtcggggacgcccaggtcgccgcgcacggcctgcatgcgcatggcnnnnnnnnnnattctcctgcgcgtcggggacgcccaagtcgccgcgcacggcctgcatgcgcatggcgttgtccgggaatagcaccgcctgctgccagagcagaaggcccaggcggcgcagcagcacgcccgcgctgcggtaggcctcgcggctgaagtggtacgcnnnnnnnnnnccagaaggcccaggcggcgcagcagcacacccgcgccgcggtaggcctcgcggctgaagtggtacgcgtcggcgccgtgctggatgaccacgccttcgcgcaccgccaggcgcgagtcggcgtcggccgcgcccggggcctgccccgccgcctgcaccagcgtctcggccaccgtgtcccacagcagcgcggcgcgcgggtcggtgctgtccaggtgcggccgcgcgtcgccggtggaggcggtgggtgtgccgccgaggggcgcagcctcgccggt

SEQ ID NO: 44255 - DNA, 77 bp, Chlorella protothecoides
gcctgctggactgcatcaccatacggtgaggggcagagggtggcttggggggggggtggcgagcagggggaggaagg

SEQ ID NO: 44256 - DNA, 61 bp, Chlorella protothecoides
cagtagccatgcccgagacgcagctgcggggggccatggcctgcgaggtgaggtttcgtgc

SEQ ID NO: 44257 - DNA, 66 bp, Chlorella protothecoides
catgatcacattcagctgccaggcccccccccctgagcccacccacccgctggcccccgagctcca

SEQ ID NO: 44258 - DNA, 61 bp, Chlorella protothecoides
tccttgattacttattggccatggctcgagggcctcctgtatatctctactcagggtacta

SEQ ID NO: 44259 - DNA, 78 bp, Chlorella protothecoides
aggctgcgctggcggcgggggaggcagccgccgccacggagggcggtcagcaggcggtgcccctctccggggacaccg

SEQ ID NO: 44260 - DNA, 72 bp, Chlorella protothecoides
acaggtctcctgctcgccagctctccacatccccccgccccacccttgcccctcctcacgccgcaacccacc

SEQ ID NO: 44261 - DNA, 64 bp, Chlorella protothecoides
cccagaccggccgtctggccattgcagtccccctccccccccggcaggccagaggctccacaga

SEQ ID NO: 44262 - DNA, 61 bp, Chlorella protothecoides
aaccgacttgggacttgtttggcggaggagggtttgcccgccggtccagcagctctgggcg

SEQ ID NO: 44263 - DNA, 61 bp, Chlorella protothecoides
tctcattggctgcacaaaaggggggcgggggtgatgtcagtgtgcagagcgcagggcgcca

SEQ ID NO: 44264 - DNA, 61 bp, Chlorella protothecoides
cagcctgtgctgcttcgttagccatgagggggctgagacgcacccaggatgcacgcagctc

SEQ ID NO: 44265 - DNA, 70 bp, Chlorella protothecoides
cgccagcgtggacgcgcgcatggccatgctggtggaggcccccgccgccgtggatgacgcgctggcctcc

SEQ ID NO: 44266 - DNA, 61 bp, Chlorella protothecoides
acgagcagccagggctcctttgtggccgggggctgcgaccactcgcagacataatactcct

SEQ ID NO: 44267 - DNA, 67 bp, Chlorella protothecoides
cctctttgagccggagtcggcggtggaccgatgattgctcacaggatgtccagcaacttgcggtgta

SEQ ID NO: 44268 - DNA, 61 bp, Chlorella protothecoides
gagggagagtgggaggagagacgcagggtgcgagggagagtgggaggagagacgcagggtg

SEQ ID NO: 44269 - DNA, 61 bp, Chlorella protothecoides
ctcaagtgtcaagtgcagggcttggcgggggggagacctttagtcctagacaaatggagcc

SEQ ID NO: 44270 - DNA, 74 bp, Chlorella protothecoides
cgtggcctggtcacgcacctggcgcgcgccgacctgggtcaaatggcagaggacgcgctgctgtgcctgcgtgc

SEQ ID NO: 44271 - DNA, 61 bp, Chlorella protothecoides
gcgcaccttcatcgagcggtacgggcagtatgcggccacgctggcggagaaggtgggcacc

SEQ ID NO: 44272 - DNA, 61 bp, Chlorella protothecoides
ggccactcacctatgatcacggcggctgccctctccagagaattttcatataccaccgcat

SEQ ID NO: 44273 - DNA, 67 bp, Chlorella protothecoides
tcgctccactctgcaggcaccctcccactctgtccatttccaaacccacgccagcgcaccgcaacgc

SEQ ID NO: 44274 - DNA, 61 bp, Chlorella protothecoides
ttggacggtatcccacccaaaacaggcaggggtgacatgccccgcctagagacggcgcgat

SEQ ID NO: 44275 - DNA, 61 bp, Chlorella protothecoides
cgctgaggtcgcgggacgcgcacaggcggggggtccgctggacctgcatcaagggagttgg

SEQ ID NO: 44276 - DNA, 61 bp, Chlorella protothecoides
gaggaatcaagggcgccgccgctccggcgggggttttccgaacactgcgccctgaggatgc

SEQ ID NO: 44277 - DNA, 61 bp, Chlorella protothecoides
tgtgagtcgaggctgtggttgtgaagggggggacagggtcggtgcacgcatcttttggtgc

SEQ ID NO: 44278 - DNA, 67 bp, Chlorella protothecoides
ccgcccgcccgcctgcatgcctgtgagggctgggccggtcgtttgctgaccgggacccctcccccag

SEQ ID NO: 44279 - DNA, 61 bp, Chlorella protothecoides
gcagctgagatcgctgtatcccgtggctggggttttcctttttggcatggtgtcgcacgag

SEQ ID NO: 44280 - DNA, 61 bp, Chlorella protothecoides
gcagtggcggccctggagcggctgccagggggtgcggttgtggcgccctggaccgccttca

SEQ ID NO: 44281 - DNA, 61 bp, Chlorella protothecoides
ctctgcatcagacaaggccttttggctgggggtcaagccgagagccggcttggcatcgctc

SEQ ID NO: 44282 - DNA, 138 bp, Chlorella protothecoides
ggcggcagccaccgcctcggcgccgccggcgttcgccgcggccgcgccgagggcagcgcgcgtcagggcacccggctcggcgtcgctggccccctggtcaccccccgccgcctctgcgtgcccagccctcgccgctgc

SEQ ID NO: 44283 - DNA, 61 bp, Chlorella protothecoides
aaggggcgttttgttgtcttcatggcaggggtgagtggcgcactgtagtgttccggcctta

SEQ ID NO: 44284 - DNA, 64 bp, Chlorella protothecoides
tggtggctgctgggccgaatgctgtggctgcgtaaggagcattgggaatgcatgaaagagggga

SEQ ID NO: 44285 - DNA, 61 bp, Chlorella protothecoides
gtatacaggaatctgtgggatgtggagggggggggatggtggagccattcttcgaacatgg

SEQ ID NO: 44286 - DNA, 61 bp, Chlorella protothecoides
gctcgtagaggtgggcaaagagcagcgaggtgtaccccgggggcgggaaggcggcggccgt

SEQ ID NO: 44287 - DNA, 68 bp, Chlorella protothecoides
tacgtgcacacccttgcctgcagtgatggggggggggcgggggggggattcaggtgattgaatgtcac

SEQ ID NO: 44288 - DNA, 61 bp, Chlorella protothecoides
cgacggaaaggccgaggacatggagggtgggctcctagacagccgccttcagtggagacct

SEQ ID NO: 44289 - DNA, 95 bp, Chlorella protothecoides
ggggtgcaacacccagcaccccggtggtgcacagccggggacacaacccaggggcaggaggcgaggaggagaatcaacggctgcccgacccgggt

SEQ ID NO: 44290 - DNA, 61 bp, Chlorella protothecoides
ctatgcagcctgatacctgctcagagggttgcgccgccatttgtgtgcatttgtggcactt

SEQ ID NO: 44291 - DNA, 61 bp, Chlorella protothecoides
tgtttgaaggagggtgaagtgggggggggggggatgtgaaggggaacggtggttgtaaaga

SEQ ID NO: 44292 - DNA, 61 bp, Chlorella protothecoides
atttcaagacatgtcagaggctggcgcaggggtgcctccttggggccatggcagaagcagc

SEQ ID NO: 44293 - DNA, 19761 bp, Chlorella protothecoides
  modified_base (180)..(256): a, c, t, g, unknown or other
  modified_base (528)..(537): a, c, t, g, unknown or other
  modified_base (1187)..(1196): a, c, t, g, unknown or other
  modified_base (1980)..(1989): a, c, t, g, unknown or other
  modified_base (2149)..(2158): a, c, t, g, unknown or other
  modified_base (2302)..(2311): a, c, t, g, unknown or other
  modified_base (3045)..(3054): a, c, t, g, unknown or other
  modified_base (3416)..(3425): a, c, t, g, unknown or other
  modified_base (3898)..(3907): a, c, t, g, unknown or other
  modified_base (4813)..(4822): a, c, t, g, unknown or other
  modified_base (5028)..(5037): a, c, t, g, unknown or other
  modified_base (5532)..(5541): a, c, t, g, unknown or other
  modified_base (5742)..(5751): a, c, t, g, unknown or other
  modified_base (6309)..(6318): a, c, t, g, unknown or other
  modified_base (6402)..(6411): a, c, t, g, unknown or other
  modified_base (6650)..(6659): a, c, t, g, unknown or other
  modified_base (7279)..(7288): a, c, t, g, unknown or other
  modified_base (8740)..(8749): a, c, t, g, unknown or other
  modified_base (9081)..(9090): a, c, t, g, unknown or other
  modified_base (9953)..(10013): a, c, t, g, unknown or other
  modified_base (10113)..(10122): a, c, t, g, unknown or other
  modified_base (10593)..(10602): a, c, t, g, unknown or other
  modified_base (10693)..(10721): a, c, t, g, unknown or other
  modified_base (11304)..(11313): a, c, t, g, unknown or other
  modified_base (12811)..(12820): a, c, t, g, unknown or other
  modified_base (13336)..(13345): a, c, t, g, unknown or other
  modified_base (13428)..(13437): a, c, t, g, unknown or other
  modified_base (13618)..(13627): a, c, t, g, unknown or other
  modified_base (13929)..(13938): a, c, t, g, unknown or other
  modified_base (14570)..(14579): a, c, t, g, unknown or other
  modified_base (15626)..(15635): a, c, t, g, unknown or other
  modified_base (15934)..(15943): a, c, t, g, unknown or other
  modified_base (16478)..(16487): a, c, t, g, unknown or other
  modified_base (19055)..(19064): a, c, t, g, unknown or other
gagcaggagcacgtggcgcgcgatcagcgcgtgcagcgcgcggtactgcgacggccgcagcgcgccaggcgccaccgccgccgaggcgggcggccgccccgccggcgcgaggtggctgcacagcgatgcgatgctgggcggggggttgtcggtggctgcggcggtcactgcggcggggannnnnnnnnnnnnnnnnnnnnnnnnnnnnnnnnnnnnnnnnnnnnnnnnnnnnnnnnnnnnnnnnnnnnnnnnnnnnacctgggcagggaagcgtgccgcggcctgagccagtgcccgggcagggctgccgtggcggcctcatcagcatcacagggccggtgccacttgagggcggcggcgccctgggttggggagggcagaggacatcgtcggtggggcgggggtcacaagggatgacgaagttgtgctgcatggtcatgcgcggtctagaaaacgcttgctcatgcatgcagggtcggggatgcggcatggagggaacaaaccaacccaacctccaacaaaactgcnnnnnnnnnntgtcctgggtttgggagggcagaggacgtcgtaggtggggtgggggtcacaagggaggacgaagttgtgctgcatggtcatgcacggtccaggaaacgcttgctcatgcatgcagggccggggatgcggcatggagggcacaaaccaacccaacctccaacaaaactgctatgcgctgaccagaggtgcagctgcagcaacagggctgaagtcctcgtcggcctcggagccagatgcctcctcctcgtccagcggtaggtggcccaggggatcgccgagggactggcatgggcgagggagggagcaagtgagtggatgtcaaatgttagctggcatagtactcaggcaggtgcctgggatgaatcaaccacagcaagttggcaaaataatgtcctcccatcaagtcgaccacacggctccatccctccttggacaccaagccccttcttcacctgtatgaatcgccggtactcggcttcgcccatggggtctatcgtggggacttcgtcctcagcctggagtggtgaatgtgttcagaagagtgaaggacaaggcgtgcacccttgcaaagcaggcaagttcaccgattaccttgtatagattggttggccgagcttcgatgccatgaaacattcattcatctcccacannnnnnnnnntccttgcaaagcaggcaatttcatcgattaccttgtatagattggctggccgagcttcaatgccatgaaacattcattcatctcccacataaacctggcctcctgatacccctttaagaccacccacctccagcagctcctccagctcatcgatggtcatgtggtgaaggggggcctgggcgcgcgtgcggcgtgccaccggggtcgggaggggcagggcccctcctgtcgacgcggatggctccagggatggagggaagggcatggagcccagggactcctcgacataccccaggccatcaaacaggtcgtcctcttccaccatctaccaggttgggagcatggaatcgaaagggccttgattcagagcatcttgcatggaccataggggtaagtcgatgctcgacaggcacgcagcagctgctatggagagctgcgcatcatacatgcaaggcaggtccgtggcacctgaccaatgccgtttgcctttgacacatggggcgcaccttggcaatctcggcatctgtcaggaggggttccaggaacagggcagagctttcctcagcctcagggtggtccagcacgggtgtttgcggttgggatccgaatggagttgagcgggggctgggtgggccctcgctggcgctgtcatccgcctcggactcagaccccgaggtcgcacggaagtcctcatcctgcgatatgatgaagacaggcggcgtggtgcctgtcaatgcgagctgcgcgagagtagaatgcacggcctgaggataggcagccactnnnnnnnnnnggacaggcggcgtggtgcccgtcagtgcgagctgcgcgagagtggaatgcacggcctgaggataggcagccacttcaccgcttgttaatccccccaccagatcacctggtcatcgtcctccgtctccgacatgaaaatagaggcaggctgggtgcccccnnnnnnnnnngctcatcgaggtgattgctccacgctatgcctaggtctggccatcccgttcatgcgtgttccgcacacacccaacaggcgccgagcgaaagtctacatagatcttgggcacggaagttgagcatatttcatttcatgctcattnnnnnnnnnnacgcacacaccccacaggcgccaagcgaaagtctacatagatcttgggcacgaaagttgagcatatttcatttcatgctcattcatcatcagccgagaggaagctggcatccctctacgagcgatgtctcgtcacggagcaagtaggcgatctgacgtttgaagtttgcatggcgcgcaggcgaacccaaccttctctcggcgaccccggggcacgggagtagagcgtactttgcaccactctgtctcgccattcttcaaaggaatatcatgataatcaggttgtactatctgcgcccgatgggtcgctgaaaggccacacccttggctccatcagcattcccatccggtgtccttaccgagcagggatgcaaatgcctcgtacccggctgccgacctcgcaattctgcgaataaagcttgcagactgactgatttggtacggattgaccaagaatggcacccaacgggtttcggccaattagccgccctcaatacatttctttcaggtgtcctaagactctttctcgattctgctgtcaggatggagtggccgcggaacgaatggcttgcacatttttaggcttcatgatcttgtaatacttggtgacagggccatccgcatctgtgcatgtcccttaagcagtttgcattcttcaaacccttgtccattggggcttttttgggtgccagagtgaagtctttggcccttgggcaacctctgagcaattcaaannnnnnnnnncttaggcttcatgatcttgtaatgcttggtgacagggccatccgcatctgtgcatgtcccttaagcagtttgcatacttcaaacccttggccattgaggcttttttgggtgccagaatgaagtcttcggcccttgggcaacctctgagcaattcaaagaatgtacttgggaggacacccagcagctggatgctggctcctacagaccatgtagagcattaaatggagtgtgttgagagtagtacgtgatgtatgtgctgaaaccttacccactgtgctggaatgggatgctcattcaatgggccatctcttgctgactttgaaactcaaatcattgacaccatcccatctcagccaagcaannnnnnnnnngaagcaacaaatggagtgtgttgagagtagtacttgctgtatgtgatgaaaccttacccggtgtgctggtatgggatgctcactcaatgggccatctcttgctgactttggaactcaaaacattgacaccatcccatctcagccaagcaagccgtcgtaacgattgcctggcaaagctgtctcactttccactcttccctagcccttgaataacctgacagtcgcaataagcaactttgtacgtgcatcagtcacagatgccaagtgatgatcgtatttacggcagggcatgcccaagaactgtgactcaggatcacggaattggacccaaagggcaataaccacatccagcatcaacccaggtagaacgcactccgcgcgcggaagacggaggtgaggcactgcactcagagatcgacggccgcgacccatcacgacaccattcttgaagtactactgacccattcaagcgnnnnnnnnnnctgactctggatcacggaattggacccaaggggcaataaccacatccagcatcaacccaggtagaacgcactccgcgcgcggacgacggaggtaaggcactgcactcagagatggacggcagcgacccatcacgacatccttcttgaagtactactgacccattcaagcgatatgcccgttgctgagcatccacgcccggtctgagcttggggttggacgctgcgcccgagggatgcccgagcgcggcccccgacaccaagggtctggactccctcccttcccaccgggccccttccagagctcccgtgaccgcgacatggcctcggacgacatcgaggacccgctgctgccagaaccggcgagccccagggccatgccggccgccgacctccctcctgccagcatgagcaagaactggccagccctgcgcctgtcctccatgtccacccgccgactctcccccagcatgctcggcggcggcgactttgacaccgtgagtgactttggtgttatgcaggacgccttttgagtcgctgccaggtgaccatggccctcccacagcggtggcatgggacacccaccctgtgtccccattccgtatgctgccgcctatctgtctcctgggcatcagactcatcccccatacccacactttgaaacccacattccacagcaactgtcccccgccggctccttcatgtctgccacctcctggccggcaagccgcggccccagcccccacaccgccatgcgtcgagcggcccagccggactcgccaccccaccccctggctcccaccagctggcccggcctggggcgcccgggcccgccgggttcaattgaccacacacccctgccctccatccccgagccgggcgcgattttcccatcccatgcgcctgaannnnnnnnnnaggttcaatcgaccacacccccctcccctccatccccgagcctggcgcgattttcccatcccatgcgcctgaagtccccccacacacagcccccgccgccgcggaccggcacacacgcgccgcgctggttggcctgatcgacgtcatgctggggctgcccgtggtggcctcctttgcctccatcatcttccaggcccccttcttcnnnnnnnnnnacacacacacagcccccgccgccatggaccggcacacgcgcgccgcgctggtcggcctgatcgacgtcatgctggcgctgcccgtggtggcctccttcgcctccatcatcttccaggcccccttcttcgcgccttacatcggccagctggtcaagctggtctgcctctcctccgccttgcaccagctcatcttcagcctcttctccaccatgccctttgccatgggccaggtccaggacgtgggcctcatcttcatgtccgccatcgcctccaacgtcgcgcgcgcctgcgcgggggagggcgtgcccgccgacgagaccctggccaccgtcctcgtcaccctcaccctctccaccgccatcgtcggcctgctcatcatcgccacaggtgttgcggaggggggaggggggggggtcgtgcctgtggccctgggctaggacaccacatgctgggaggggaggggtggcaccccggaccttgcgcgtgcctgggatnnnnnnnnnnctgtggccctgggctaggacacctcatgctgggaggggaggggaggcaccccggaccttgcgcgtgcctgggatgctcagggattgagattcgcaaggccaaccctgcgcagagtaatcgcgtagtcccatgacccctcaacctccccacacacgaatcttcatccccctttcacaggcatgctgaagctggccagcctgnnnnnnnnnnttcagggattgagattcgcaaggccacccctgcacagagtaatctcggagtcccatgacccctcaacctccccacaaacgaatcttcatccccccttcacaggcatgctgaagctggccagcctggtgcagtacgtgccgctgccggtgatcggggggtacctggccttcgtgggctacttctgcctggcggcgggggtgtcgctggcctccggcgtgcacatcgacgaagacccaatgacctgggcggggttggccagcgccgacgcgctcctgcatctggtccccgccctcctcctcctcctgctcatcacggcggtgcagcgcaggtttagccacccgctggccctgcccctgttgctggcggccgcgcctgtggtgttttacgtcgtgctcgccgccggcggctggacgctggcagaagcacagcaggacggctgggttacaaagccgaccgtgagcaggaccattgcttgggggtcggatggcgtctgtcacctttgggggggcatctcctcacacatcacgactgggaaggggatggcctgccatgaaatcnnnnnnnnnngcctggtccccgccctcctcctcctgctgctcatcacggcggtgcagcgcagatttagccacccgctggccctgcccctgttgnnnnnnnnnngggggggcctctccacacacatcacaactgggaaggggatggcctgccatgaaatcaggcgtggggactcatagctgcaccgggaagtgatgcgaagtcagcgcaggctgttgcaaagtcaggatgtgccctgcgtggatgcgccccaccctgtaccagcagcccaagaacgctgtgggagccctgctgtccacggaacgccgcaccaccgcccccgaagagcacgcccgtgctgtggnnnnnnnnnnggatgcgaagtcagcgcaggctgttgcaaggtcaggatgtgcccagcgtggttgcgccccgccctgtgccagcagcccacgaacgctgtgggagccctgctgtccacggagcgccgcaccgccgcccccgaagagcacgcccgtgctgtggcgccacggccatctcaactcgatcctgtgctccacccttcccgcagccgggcgagaaaccctggaagttctgggaggcctggtcgctgttcggcttcgacgccttcccccccaccaccatccactggcgcttcgtgcccaagcaggcgggcaagatcctggccctctactttgtggtggcctttgggtccagcatggacgttgccgccatccaggccgacgtggcgacgcccctggactacaacaaggagctggtcaccgtgggtgagacggaggcggggtcctcattgtcggtctgttggggatggtggcggggggggtggcatcttgtgcatgtccttgccttgccaacccaaggcgcagcgcttcagcgcatcagccaccttgacattcgatgggctgagcgtgtgcctgactccttgtgccctctcctccctttccccccctgcagggatgagcaacctggtgannnnnnnnnntgatggtggcaggggggtggtatcttgtgcatgtccttgccttgccaacccaaggcgcagtgcttcagcacatcagccaccttgacatttgataggctgagcgtgtggctgactccttgtgccctctcctccctcccccccctgcagggatgagcaacctggtgacgggtatggcgggcgtcggctacaccggctcctacatcttctcccagaccctgttcaacctgaaaatgggcgtggactcgcccgtcatgggcatcattgtcgtcggtgggttctgtggatgtggggtgcggtagaacggtgtgagatgggagcaaaggccaggagaggccgttcctggcgcatcgtggggcctgccgatcatgctcacacctgcactccgacatcccacccctccacacacacagtttcggaggtcctgctcttcatggcccctgtgaatgtgatgatttacctgcccaacctcctgtttggggccatggtcatgtggataggccaggacatcctcaaggcgggtgtcggggaggagcgggggagggggagctggtgagcattgcacgcttttctttgcgtgcctgccagggccacatgtagagtcggtatcggcaccctccatctccaatgacacccctccatgccaagttcatgctcctgaagtctcctcctcacatctgccaactcatctctctggacccttccttatgttggacatctttgaactcacctgcccttatagaatctccctacttccctcctcaatgcacaggactggctgttcatcgcctacaagcgtgtgtcgcacgtggagtatgcgctcctgctggccacgtttggggccatcacgctgtgggggctggagctgggcatcgccgctggcatcgcggctgccgccctccacttcacctactcgtgcgtcgatgctggggcgggatggaaggaaagggaggtttgcgatggcggggctgccggagggacgctcctctcctgtagcttctttgggcccacaccagttctgtgggccccaacccacttgtctgcgctgccgtcgcacgctcctcccgctcgccgatcgcccggcaacaaatcatctccaatccatcccgcgccccctttcctccttcatccgcccttccagccgacatcaaccccccacacacatgcaggtatgcgcgggtgacgctgcgcaccttcagcgtggtgccgtcgcggtcgggcgcggtgcgcacctgggaccatcgccgggtgctggagcactttgtgccgcgtgttcgcgcctgcagcctgcagggctacctcttcttcggctcctccgtcctggtgtccaccaaggtcctggccgtggcacaggacctggtggccagcctgggccagctggcaaggcaggagagccgtggccggccgcgcacgcagcgcgagagcgagaagctgcagggcgccctgattcgggcnnnnnnnnnnttgggccagctggaaaggcaggagagccggggaaggccgcgcacacagcgtgagaacgagaagctgcagggcgccctgattcgggcgcccctcttcctcatactggacttcaagtgggtctggtggggggttggttggcgtgagtggtggtgaaagcattggatgggaggctgtcttagagggcctgggacgtcccaacagcaagctcatggcccggacctcgtttgaacgacccagggaatgtggataagactggcctaagatggcagtgccctgttcgtgacatccagcctgccctccgaaaagcatccagcctccctgcccctaacccnnnnnnnnnntgacctcgttcgaacgacccagggattgtaaacaagactggcctaagattgcagtgctctgctcttgtcatccagcctgccctccaaaaagcatccagcctccctgcccctaacccacccccaccaccccgagtctcgctccaaacaatcgccccctcccaacacaggcgggtgcagggcatggacgccaccgcggcacggacctttgtctcgctgcatgtccgattgcagcggctcggcgtccagctggtcatcacccacctgcccgacgaggtgcccgccctgcgcaagctgctggcctcccagggcctgatcctgcggacgccctcggggcaggaggaggggcacgtggcggggtcggagatcgaggcggcaggtggggagtgtgggtggagggcagcggctggcctagggtgggtagaggagagaggggccaacccagatcgagctaaggggtgcctgaagttcgggtttcaggcctgagctgatggaccaccaccgccctttgcagtcaatctcccactggcaccacggcctcataccagagcgcccaaccccccctcccccaacgcacaccaaaacaggcacgtgccagtggtttgagaccatggaggcgggcctgcacttctgcgaggagcagttcctggacgtggccattgagtccggcctctgctcgccgcggcgctcggatgtgaccctggccgaggcgctgctggcacaccgctccctgtcggacgcgcaggccgagcccggggggcccgcgaggtttgaggccgccgccgcgctgttgggccgatacgtgcgccagaggaagctgcggtgcgctgcacgagtattggatgggggggggggggggggggggnnnnnnnnnnnnnnnnnnnnnnnnnnnnnnnnnnnnnnnnnnnnnnnnnnnnnnnnnnnnntccaggcagacacggtgcattcctcaagaggctgctgaagggctgctgaggccagggtgctgactcctctcaaccacccacccacccacccctccgtccnnnnnnnnnnaccaggcagacacggtgcagccctcagggggctcctgaagggctgctgaggccagggtgccgactcctttcaaccacccacccacccgcccctccgtcagagagggcgaggccctgtttgagagcggggacgagccagactgcttcttcatcatcaagtctggcaccatcattgtggaagtcagctttgcagagaacgagcaccaggggaagccgggggtggagggagcccccaccctcacacgggcccaaaacaggtgaggagtagttggtgggaggcgtgcatggcaggcagagcaaggtgaccaagaagggggtaaggatgccaatgtgttgtgggacgggagttcagccagactgttggactgcatggaagagtgcttgcagtggcaagcgctgtagtgtgcacctcagcagccccacaccgactatggaatcaatctccaggccccgcaagccccccccccccccnnnnnnnnnncagtgtgcacctcagcaggcccacaccgagtatggaatcaatctccaggccccggaaggacccccccccccccccccccacccaccccccnnnnnnnnnnnnnnnnnnnnnnnnnnnnncccacaaccctggcaggacctttcaccacgacccaggggcggtggtgggcgacttcgacttcttcgccgggcggagaaggaccttccgggccctagcccttacccccgccgcggtctgggtcatctcgcgggcagtgctccaggcggtggcagacgagagcccgtccaccgtggtcctgctccagtccatcatcctgcgcgcggcctccctcacggcggtgcacgccttcgaggtgctggagaagctgacctgaagcttgagcggcggtgtgcgagacagattggatgcgtctgcgagtgcccacctttccatgggagggcgacctccatccttggcgcactgaagaagtgctccccttgccggtatacaccttgagtcattcctggattgaacgaatttttctttcgagtcccgccccattggaactcgagcggacgtacaacccgattgttagtttcctggcaatgaatcacgcagcaggcgcagcagcctgaggatctggggtgggtggtgggtgtgtcggaggagtcggctgaatggccgcgaaatttgctgggcgcagcaggataaaggacaggcatnnnnnnnnnnttcggaggagtcgcctgaatggccgctagattcgctgggcgcagcaggataaaggacaggcatggaacattctggacattacatattgtcatggcgtgcgctcggcctcccacagcgctaggatgtgagcatgggcttcaggctcgttgcagggctactccctcgatcaggtacagcacacgctccatgtggggacatccgtgccttcaacacggtggtaatctattccatccggtgcataatgccatcagagacgtattcactcatccagaccttcccatgcagccatgccgaccggagatgtgcctgtggagcagtcgcaaactcacggagtctgtccccctccccctctggcgccccatcgcgtcgagatgttggcctgggcatcgctgtcagcatggcagcgctcctcctccccatttccctgcccctgccctcagcagcccttgtggaaggctacactcccatggaagccctcaaaggtggaagggggcttggggctgtgcatgctagcacttgcatgcgcacccagagcctctctctgccctcgcgccagtccctcgctacaatcctccatccccccccctcgctccctctccaggtaaaaactacggcaagccacgaatgagctacagcgattacgtcaccaccccgtcaggactgcagtaccttgatgtcaaggtgggcagcggtcccacccccaagccgggtcagcgggtgaccatcgactgggcgggcgtcaccatcgggtactatgggcgcccctttgaggcccgcaacaaggtgcttgggggagaggccagtgcgtggcatctgggaggggaatcgctttgggggttgaaaccttgtcatgtgccttactccggcccgtgtgtgatcatgcgactcagccgccctcgcctccctgctctcaccctggcctcctctgggcacaccatgcctctgcacagaccaaggggggcgccttcacaggggacgacaaggagttttaccactttaatctgggctccggctcggtcattccggcggtggaggagggggtggcgggcatggcggtgggcggcatccgccgactcatcgtcccagaagagctgggctaccccaatggggacatgacggccctgggacccagccccaccaccttttccggtgcatgggggatggtttctgtgcgtttgcgagagcatgcaccaccggagcaggggcgtccggctcttggggaatgttcccagggcattggcgcccccacccctgcacgccccctctccctcaatcacccctcccacgccccctcccctgcgcaggtcagcgggccctggactttgtgctgcgcaaccagggcttcatcgacaagaccctgctcatcgacgtggagctgctggacgtgcgctgacgcgccatcgcggccctggcgcctcacgcgcagcctactcacactctggtcgatgaacactcggaccggcggcctgaagggcgcactgccaaccaaaattgcaannnnnnnnnnagagctgctggatgtgcgctgacgcgccatcgcggccctggctcctcacgcgcagcctactcacactctggtcaatgaacactcggaccggcggcgtgaagggcgcactgccaaccaaaattgcaacgcttggggggggcaagcatgggtgtgggaaaattgcgcggcgcagcatatgcagggtgtggcctgttcagagcatggactgtgcatggagactgtgaaactgtctcaggcgtggcccatgctccgccgtggaagagtgagaagggggcgtggcaggaggggtagtgtgagtggcgggggacaagtgtgccggcgagactcctggatgggaggctggcagcatgatgccagccaggctgtccagcccgagggccccgccaaatggtgatcagatgcccgtgctccgccagggtctaaaaatcgcagcggcggggcgtaccaagcgcctgctcctgtacttcaagcccggtacgggggggggaagggcgccgtgggaggtgggaggcggcnnnnnnnnnnagcggggcgtaccaagcgcctgtttctgtacttcaagcccggtacagggggaggaagggcgccgtgggaggtgggaggcggcnnnnnnnnnnctgtttcccggcggcggcggccgctgccttgcgtcgcgagcggccgccgccgccggggtcggtcgacctgctcgctccccgctcctcgccgcggatggcaggcggccggctccaggcatggggggggggtggggcgaggcgctgcgctccggcacgagcctgttcccctgcgcagactccnnnnnnnnnnttgtttcccggcggcggctgccgctgccttgtgtcgcgagcggccgccgccgccggggttggtcgacctgctcgctccccgctcctcgccgcggatggcaggcagccggctccaggcatgggggggtggggcgaggcgctgcgctctggcacgagcctgttcccctgcgcagactcccgcctcgcctcgccccttccaacatgagcacccacgcgcccggccacaccgccccgcccatcgcgacggctattcgtcgcgccgcccgtacacacggcggtggcgctcgtccacctccttgaggnnnnnnnnnntcgcccagcgccccccatcgcaacggctattcgtcgcggcgcccgtacacgcggcggtggcgctcgtccacctccttgaggtagtaggtgcccggcgccaggtcctccacacggggccagagcgtggcgtaagccttggccccgcgcagcgcctccgcccgcgccacggcggccaagaagtcggcgggcggcgcggcggggcggcgcgccaggcgcaccgccaggtccgacccggcctgcaggcgggccagggagaaccgcgaccctggggccacggcgcggccgcgcagcgacaggagcgtggccgagatgcccgagccgtagctgtagagcaggacgcgccggccctccagcgcggcgcccgtggtctccagcagctgggccacgccggaccagacgctggcggtgtacatgttgccgcactggcgctgcacgcatgtccccggccgcaccttggcgtcgtagctggcgtgcgtcgcgcccagcagatacttctccagccccggcggcatggcggtgggcgggcaggggtgggcgatgggtgtgtgggagtgggcgggggacgggtcggcccggccgttgctcacgccgtcggccgcgccgccgccgcgcgtggcgcccagcagcgccgnnnnnnnnnncgggtgcgtgggagtgggcgggggacgggtcggccccgccgttgctcacgccgtcgggcgcggcgccgccgcgcgtggcgcccagcagcgccgaggccccctccagctgccccgccagcgcgcccgaccggcagccgtccaggtaccacaggcgcgcatacgccttctgcaccagcttgttgtagggcgcgtggaagagcacgtggtccaccgcgtccagcgtgcagggcgcgtgcagcgcgcgctcgaagcgctccgcgtaccgcgcccagcacacgtccagggtgtgcaggtagcagtagacggacagcgggccgtccacggcagggtaccccgtcgtgggcttgtagaagtcgtaggcgtgcgccatgtggctggcctgcaggcggcgctccagcgccagcggcgcgtcggggccgaccagcagcgccaccgcgcccgcgccggaggtggggcgcgcggggccgggcgcgtagagcgcgatgtcggagcagaccaccaccgccaggcggccgtcccaggcgcgggactcgacccaggccgcggcggccagcagcgccgcggtgccgccgtagcaggcctgcacgcagtccacgccctccacgtccgtgttccccgtcgcctccaggatgggcatcaggtaggtcttcagcgacttgctgccgtccacgccggactcggtgcccacctgcaggtgccccacctcggagggcgacacgccgtgccggcgcagcagctggtggaacaccgtcaggcccattgacacggggtcctcgcggtcgccgcagaaggacaggccttgctgcggagggggggggtgggggagggggggggtcttagctccacaggcagggataagatgcgagacctcagggagaggggggccaggtcggggcacggcccatgctggcatggcaagtgaggcacagagctggggtttcgcggttcaaatgcgagatgaggcagggcgatagcactccagtccgggaggcaacccgcagcgatattgaaaaagacccgcctctcgccctcccacgacacgacacnnnnnnnnnntggttcaaatgcgagatgaggcagggagatagcactccagtccggaaggcaacccgcagcgatattgaaaagggcccgcctctcgccctcccacgacacgacaccccgcacctggcccaggccgatggtgtactttccggatggcacgccatcgtgcttctccaggtcctcctgccggacctgcgcgccacggaaggggaatggggccgcaggatcgacagtggcgccggtcggccagaacaagtcagggtgtgcgcgccttgaaacgattgaaacgcaaccacccctggcaggccctnnnnnnnnnntcggacctgctcgccagggaaggggaaaggggccgcaggatggacagtggcgccggtcggccagcacaagtcagggtgtgcgcgccttgaaacaattgaaacgcaaccacccctggcaggccctctgctcgtttcatgacctacataggttgtgggaaagtagacctcggccgcgagaatgcccacattctccgcttggggcggggcggggccagactcgtctatggacatgccgacagggccgcgaggagacagacccccttcaggctcgacgaatcggcctggcatgtaagctcatgcagtgatgtagctggttcctggtgcgtgtgtcgcctcctacccctgccacgcccaacggaagcccttccgggggcgacgatgactcacccacacgcaatcctcgtcatcaggcttttgaagggcatccccctcagctcgtactattgctcgtctacggccaacaggttactctgggaatgtaccccatcatgttgctccggcagtgtctgtaccctgagcattgctgaatgcattnnnnnnnnnnacttttgaagggcatccccctcatctcgtactattgcttgtctacggccaacaggttactctgggaatgcaccccatcatgttgctccggcatcgtctgtaccctgagcattgctgaatgcattgagagcacgcgtcttcagttcgttgaggtattcaatctggacccgctgtgcctgagagccggccgcgccctgcagagccacatgctccatcatcacctggatgccttggagcagctctgcaccgctgtggtgggaggatatggaatgctgtgggtgatgcctgtcagaagaacggctctgttggccatgtggtccacacccttcccggtgtgcatggggctacaagcacaggcacccctcatttgcacaatttggccctacctcgatccctgcttcccagccatgtcctgcagcatgcttgtccactgctcctcatctgcttcaaggaaggcatccatcacgcctggccggccctggccgccaggctgaatgtccagcagggagcagccagcaaacatttgcaggaccttgcgcagcagcagcgccatgcctgagaggatattgggtgacagacagggctcagtatgggcagtgaactgggaggggtggcacattgtgtgacacgatccagcaaggttgccacagcatgctcatctgcagccctccctgcctctgcactgtgcataccaaggatgaaaagcagcacatggcagtgacctggactcctcagaggcttgccatattgctgtgaaccccctcacttccaaacattgcatagaggtactgtcgccacagatcgcttattctcaaccacctggcaccgtccaccccctccccagcacatggccgcctccacgacatgatatcactgcctctgcctcaaacccttaccctctatgctgtcagactcagacttccggatccaggccatggccgaggtgacgaatgcctcgtccagttgggtagagtgcgccgccatcaccccccgcatggcccgtctcttgtcggtactcaacggcagctgccactgccccgagtcgccgtccgcccccgcctccaggacccgttgcaggagccgggatgagcgctgcacctggctctcgctttccttcaccatctcgtccaccagcagcatcacgtccgaggccagctgggtcagactctcggcctctgcctcgctgctggcagtgtccctgcgggcggccaggcgcagccagaacccacggtcgaagctcagcaggtttttggccacggcctcgggaaaggagcccgaggcgcgcgcggcggtcaggtggtcgatcagttcatcgagggccaccacatccgccaccccgaggccctgggatgggatggcgcggggagggcccgcatgatgagtccaggacaagcgtctcttcgtattcctggggccatgcacgcgatgtgtggccttgaaggcggggacgtgccggagtggaggccctgcacagactcggaagagtacggcaccaaaagggcgcgcgtgcatcactgaagtcgcatgcatgtgcttagtttgcgcgatagaatgcaagtctgaagcatgcaccaccccatgatgaacagagaggctgctgtgggccgagtcgacaagggatgcacgtgggttcctgatctcgggagtaccgttctttcaacgcgacagcgacgcgcatctctcgacccagactcgacgaaaatctgataaataatgtaacttgttccctcaagtattcctgggaaggttgtgggtaccctccctcgcacggcaggtcagcccggaagtgatccctgagacatggccggtccaggcccatcgtcgatgagccaagcgcggtgggagctggagaacgccgtccaaactgtgcaggactccgatgttgatgccgtgtatcactggaacccggccgagcagcgggaaatgcagcaggcccgcccctggctccaagaccccacatactttaaaaggtgtctggccgggcgcggagattcgggtcaggggtgccgacttcaatgcatgcaagacctgacctgtgctgacccacacgcccgtacccaccacagggtccgcatctccgccctggccctcctgaagatggccatgcatgcccggtctgggggcgatctggaggttatgggagtgatgcagggcaaggtcctgggcgacacctttgtggtcatggacgccttcccgctgcctgtggagggcacggagacgcgcgtgaatgcccaggcggaggcctacgagtacatggtcgagttcctggagaccaacaaggtggtggtcggcgggggttggcgggacaagagggtgggggtgtacaggtggcttgcaggaggctggagtcttgggaagatggggtgcgactgtctgggagataaagctcaggagttttaggctcagcatgccacatttgggaatgcacccaagactcgcccaggcccctgcgaggaggcacgatctctagcccactgtggcctacttgtttatccttgagagctcagtgtctgacatgcaccccactcctccctccaacaggcttccgggagggaggagaacattgtcnnnnnnnnnngcactgtggcctacttagttatccctgagagctcagtgtctgacacgcaccccacccctccctccaccaggcttccgggagggaggagaacattgtcggctggtatcacagccacccggggtacggctgctggctgtccggcatcgatgtcgggacgcagctcaccaatcaaaagtatcaagagccattcctggcggtggtggtcgacccacacaggacggaagccgcagggaaagtggagctgggggcgttcaggacctaccccgaggtgggtgggaggctggtggctgctggcgacaggatcgcagccttgggtgcagggaggtctatcctggccgcgccagggcgtgcagtgctctgtgctccccgcacctcgcttccgagggcatggactgcttcgtccgtgccgattctgatcccgctgtggcacctccccgctgtgcctgcatcccagcaggggtacaaggcgccggatgcaggtccctccgagtaccagaccatccccatggagaagatcgaggactttggggtgcacgccaaccaggtccgtgctgatgtggaagcaggggtggaggagtgaggggctggttttccagcgagggctggtattatggagtcgcagcaagcatcctctctgctgactgtaaattatgtgcaattcctctgcaatgcatcacccttgcacacccgccccccc

SEQ ID NO: 44294 - DNA, 61 bp, Chlorella protothecoides
gcgggcaagttccacagcgtggcgctgggctgcgacggcgcggtctggacctggggctggg

SEQ ID NO: 44295 - DNA, 9608 bp, Chlorella protothecoides
  modified_base (165)..(210): a, c, t, g, unknown or other
  modified_base (338)..(347): a, c, t, g, unknown or other
  modified_base (454)..(463): a, c, t, g, unknown or other
  modified_base (752)..(761): a, c, t, g, unknown or other
  modified_base (966)..(975): a, c, t, g, unknown or other
  modified_base (1196)..(1205): a, c, t, g, unknown or other
  modified_base (2179)..(2188): a, c, t, g, unknown or other
  modified_base (2369)..(2378): a, c, t, g, unknown or other
  modified_base (3654)..(3663): a, c, t, g, unknown or other
  modified_base (4473)..(4482): a, c, t, g, unknown or other
  modified_base (5235)..(5244): a, c, t, g, unknown or other
  modified_base (6386)..(6395): a, c, t, g, unknown or other
  modified_base (6856)..(6865): a, c, t, g, unknown or other
  modified_base (8795)..(8804): a, c, t, g, unknown or other
  modified_base (8896)..(8965): a, c, t, g, unknown or other
ccgcgctgggcgccgccaaggacccgctggtgcgctgcgcggccgacgccgaccgcatcgtcgctgcgctggtcgccgcagcgctgccggctggctactccgtgctccccgcccccgccgccgccggcggcgtggcgtgattgcgcagaagggggggggggcccnnnnnnnnnnnnnnnnnnnnnnnnnnnnnnnnnnnnnnnnnnnnnngtggcgcaacctggcgccctttgcgccgcggcacggcctggcaccctttgcgccgcggcacggcctggcgccctgtgcgccgcggcgcggcctggcaccctgtgcgccgcggcacgcccgccccctcnnnnnnnnnnaacgaccaaccaatcgcctatatatctacaactgattcctttcccttcccacctgggcgacgcacgcccccaggcccgcttgcctccccatggcagtcctcctgccnnnnnnnnnncacgaccaaccagtcgtctatatatctacaactgattccattccctttccacctgggcgacgcacgcccccaggctcgcttgcctccccatggcagtcctcctgcccctctgaaggggccacatgcacgtcccccctgtttccgctccagtgcccgcgcgcccccttgacggggcacccctcccccagccctcccttgacggacccccgcctgggcgcggccggggggcccacctttgcggttttgagcactgagccccgccccctctctccacaaactgaccttacgnnnnnnnnnngctttgatgaccccccgcctgggcgcggccagggggccccacctttgcggttttgagcactgagcctcgccccctctctccacaaactgaccttacgcccttcgtcgtagcctcgcgccagactcttgtctcggaattgtcgcgcgctgcgatccatcctgggacccggcggctgtcttcatgcgtccttttgcacaggcgcggnnnnnnnnnntgcgccagactcttgcctcggaactgtcgcgcgctgcgatccatcctgggactcggcggccgtcttcatgcgtccttttgcacaggcgcgggcggcccccggcccaaacattgtttgcttcttgaacaggcgtgggtccctgcctggctcggcgccctcccccgctgaccctgcgcagcgccctcgtcctttgcacctcccgctgcgtttgcatcgttgtnnnnnnnnnncccctgcgcagcgccctcgtcccttgcacctcccgctgcgtttgcatcgttgtcgttctgtccctattggtggtcgtcacgggtgtaatcgggatgacagacacagacagatggtcataaaagtgtgggtgggggacgtgagcaaccaggtgcgcaaaggcaggaagcaggcgggcgcccgcgcggtggactggccgtccccagcaccaggtcagatgcgcaggatgtcgcagcgcaacgcgtcgcaggcacgctcgccgggcgcggcgcagaggtgggcaaaggtgccggcccccgcgcccttggcggcgcggccggggttgatgcacagggtggccccgcctggcgccagccgcgcgaagggggccaggtcagagggcaggaccaggaccgcaggggtctggtcaggcagggccagcgccgcccgcgcccgccgcgcgtccagcggcagccccgggggcggggggaagagggggaagtagctccgctgctcgaggacgtgcgtcgcaagctgggccaggcggtcaggggcgggggcaccggggtcaagccgcaccagctcctcccgccccaccgccatcagccagtccacggaggtgcagcccagggcgagacccgcatcctccaacatgattgtcgtggggttgggcagcggggtgagagcaggagtggcgggggcggccagacgcggagcgggggcggggaagacgggcgggaggtggaggtcgcgtggggaggggagcagcagcacgcgcgtgccggggcaggcccccgagaaggcctcgacagttgccaggaactgtccgagggtgggggcgggtgatgttgccggaatgacagggcgggtgtttgatgtggtggggtaggcagaagggcagatgttcaagtttagcggcacgctgccaggagcccggttcattttgcccctctgcaccgttgtggtgtgtcacagaccgcaaccccccccacccccnnnnnnnnnnggttgccaggaactgttcgagggtggggacgggagatgttgccggaatgacagggcaggtgtttgatgtggtgtgatgggcagaagggcagaagttcaaattcagcggcacgctgccaggagcccggttcatcttgcccctctgcactgtcgtggtgtgtcacagaccgccgccccccccnnnnnnnnnnaggtcaacccatgctcatggagcatgaattgccacgcaccctggtctggaaaatggactggaaggtctcgtctaccagcccgcccgccagcagcgggtgtgcctcgtccacccacggccccgccagcagcaggtgggctgggcgcaggcgccggcagtgctccagcagggcgtgcaggggcgcatactccagattctcagggcagcagtaggggcccgcagcgaggacgacagaggtgggcgcggctgggtgggaggggccggtcttggcgtccggctcgcgggggccacacagctctgccgctatgatgcagtgcccggaggggttggtgccacgcaggctcaccacctgacccgggaagaggcggaaggcggcgaggcgggagacatccagccggacacgcgcgccgccggacagggcctgggacccctccagcagcagggactgggggttgagccggccctcctctaccagtagcaggttggtaggggtgagtgggtgacttgagtgcggggccacaaggatggattcgggcgaggtggagggcctgccggcagattcgggcctgtaacgactccctggcatgagcagtcctcataccacaagggcgccggccctgactcgaggacatcgcgcactgtacttctcacgagcaacctccacgctggtcacgccgggtcccccttgctccacctcatggacacccgccgacctgtgtcgcagcagatgcggcccacgaagagggtggcgtcctggcacgctgagcccaccgggtgggcctcggcgccgtcttgtcccgcggcctccacctccaccgccctgatgcgctgctccagcaatgccgcccggtcttcgagcgagtcggtcccgaagcgggcctcgctgggcaggggcgtgcccaggatgcgaatcgccgccagcgtggccccggcggcacaggtggccagcccggggttgtggctgctgaccagctgcgcactggcttccgtgggacgcagcggggtcgaggatgtgccagactccctggccagggagggcagggggctgttcaccgcggcgcgagcctgcgccgaggccgccgttttcgtgtggaggtaggggctgatcctctggctgggggtggtggcgctccgctgcctgtaggcgatgcagggatatggggggagttgcaatctggaaggcacaagatgagtgatccatgctcagcagcacttacggctgtgaaccatgggcgattccatcccataccaaacccacgccctcgggccactcagcnnnnnnnnnngcaagatgagtgatccatgctcagcagcccttatggttgtgaaccatgggcgattccatcccctaccaaacccacgccctcgggccactcagcaaggccccgccacccacccgcccgtgaggttggtcttgtctgcgagggccttggcgctggcgctgcgctctgacgctgcaaaggcctctacatcctccagagtcaccccagctgctccaaacctggtgtggcagatgatgcatgggcatgacaatttgattttcagtggctccttgccccccagcataacagggtacacatccagctgggtcagtgccggcacccgcatcgtaccgattgatggtcatgaagcgatcgaaggatgcagcgagggctcccgtatcagttccggccttggcagctacatccaccagctccgccagcaccccaggctcgaggcccttgtaggccgtggagtgccgcaggagagcggcctgcacgagcgcctccatgccggcaggtccctcgcgcacaaacacagcctacttgatgtgagatttgggtggaatgcggatcacccgacgtacgccaggcatggtttgccacccgggctgacccctcccacattcgaattgcgacatgggcattttgccacgctggctctcccgcgcctccggcagtcgcgcccaagaacttgcgccttccatcgaacacatttacaatgcaagagcgtggaaggacgggctaggactcggctccagaccttctcctaatttctccaccagcacccgagactaggcgtccggtcggagcgggcggactcggtctccatgattnnnnnnnnnnaacatttacattgcaagagcgtggaaggacgggctaggactaggctccagaccttctcctaaattctccaccagcacccgagactcggcgtccgatcggagcgggcggactcggtctccatgattatcccagtgcgctgcttcacatgcggcaaagtgattgggaacaagtgggacacatacctcgacctcctccaggcagaatattccgaggggtgagtcgcggtggagcgcaagaggcgttgagcgaccaggactggtggtttctgcagttcgagcatgcttgctgcaggctgccagatgctcactggtttctcctcccatcgccccagggatgccatggacgccctgggcctctcccgctactgctgccggcgcatgatcatgacgcatgtggacctcatagagaagctgctgaactacaacacgctggagcgggcgcccaaggtccccggcggatgagactttgtcccttgcttccttcctgttcttttctctcccgctacacacttgtaccaccccctttaaagactgtgccgtctttgcccatgtaacaggcagccaagccacaggtgtgtcttgtcaagcgggacagggcagtcacggagtggtgcatggggcggcgagccagcatgcattggtaccctgcgccccttgggcgggggcccgacatccaagcatctccacccccctctccccacgcctccatcctcactccccattcatccggcaggtgacggcgcgcctgtgggcnnnnnnnnnnagtgtgtcttgttaagcgggacagggcagtcacggagaggtgcatagggcggcgagccagcatgcattggtaccctgcacctgcgccccttgggctggggcccgacatccaagcagctccaccccccccttccccacgcctccatcctcactccccatccatccggcaggtgacggcgcgcctgtgggcctccagcccctccaccgccgccatggtggccacggtgggccccagcaggtccagcccctgccgcgtcagctcctgcaccgtcatcttgcgcgtgaaggtgtccaggctgacccccgagtacatgcgcgcatagccataggttggcagcgtgtggttggtcccgctcgcgtagtcccccaccgactccggcgtccagcgccccaggaatacggagccggcgctggccacgtggggcacccactcccccgcatcggcggtgtttatgatcaggtgctccggcgcgtaggcctccacgaagtccagcgcctcggcccgccccgccacgcagaccacgcgcgagtggcgcagcgcggcgcgcgtcgccgcggcccgcggcaggcggtcgcactgtgcggcgacctccgccaccagcgcgcccacgtccacgcccggcagcgcgaccagcaccgcctgcgagtccggcccgtgctcggcctgggacagcaggtccagcgcgacgtgggtcgggtcggcccctgcgtcggccaccaccaggacttcgctgggccccgcgggcatgtcgatggccaccatggcctctcccgcggccagcgccaccttggccgcggtgacgtactggttgccgggaccgcacaccttgtgcacctttggcacggaggccgtgccccaggccagcgctgcgaccgcctgcgcgccgccggcggcgaggacgtgggtcacccccgctgcgcgcgcgcagtagaggacctcgggcgcgatggagccgtcggggcgcggcggcgtggccagcacgatggtgcggcaccccgccagcgaggcggggacggccagcatgagggcggaggaggggagcacggcggtgccgccggggacgtacaggcccaccgccgagatggggcgggtgacgcgggagcaacgcactcccggcatcgtctccagggtcaggtcggggnnnnnnnnnnggccgcgatggggcgggtgacgcgggagcagcacacccccggcatcgtctccagggtcaggtcgggggcggcctgcgcggcgtggaaggccgcgatgttggcgcgcgcggtgtcgaacgcggcgcgcacctcctcgggcaggtcggggacggggaggtcctgtcgattcgggaggtggtgctggtgttggcatcgcaggaggcgtgcatgagaacactgaaggggtcgttgtgtacttgcttgggatgcaatgagcgagggagaggggagggaaggcaacacagacgtgggcagctgaggaatacggccgaagatgacggcgtcaccggcgcggcggcggccatctgtcgtgagtctccacagcagtcagcaggtcacggactctgagcctctgcgccatccactcagagaacccggacacgggccccctgcccctccactccacacggaacgaccacccnnnnnnnnnnagccatccggcgtgtgtctccacggcagtcatcaggtcacggactctgagcctctgtgccgtccactcacatggacccccagcccctccactccacacggaacgaccacccccgaggcacacctcgatgggggtgcacaccgccgcagggctggcgtggtcgaacttcagggtgtactcgcgcaccgcctcgtcgccacgtacgcgcacatcctcgatgatgggctccacctgggagcgagggaggggttggctggctggcgccgagcatgggccccggccctgcaggccgatgccggcagcgccaagacacctgccgcagtgggcgtcccctgacaccacccatctcaacctccccgccacaccggccccatgcacaccaccccctcaccgtcttcaggatggaggcaaagtcgatgcggggccgggcggtggcagcccggagctgggcagcgtccagttccgatgcctggaggacctccatgacccctgggggagcagagaccgcctgtgccgatgcctggggacacctgggcctgccccgtacacccgcgtggcgagggaccgctgcgggcagggagtggaagggcacgaagctggaggacactgtccctgcccgaatcgcgccaaacatgctggacacccagtcgagtcaatgcaattcccttgcatccagtgcagcaaagagggaacaccacgcacagtttatggccccggagcacgtgccatgagatcgctctcgcgcccggagcgcctgcgcatttggcgggaaggggtgtgacctcggcctcagctgcacctgccccgatggcgtacaggggcgcccatggagaccgatcacgacccacattaccagtcagcggcgtgagtgagggtggccggcagtgccgagggcatgcgtcggccctgtcacgccccgagatgtcgcagcagcagcagcagcgggatagattcaacatcgcccccgggcggggtagggacaggaacaacataggctccggcgccatggtcacgctgggcagcagcaaggtaggcacgcatgccgatcacaccaaccccgtgcctctgtgcgtgccagcgagtactccttccggcccatgccgctccccctcaccctctgccacgcccgcccacgcgcagcgcaccaaggcgggcgtcaagctagcggtaccaaagcccgtcaatctcccctccctgaagaaggtgagctcctgctgccgtgctcacggatgtgtacgccagtggcggaggtcggggtgtctggctcctgcctccctccctgggcccctattcaaatctccgccggcctcgcgatccgcaggagcatgccggcaccatatccaccgccctcgcagcccgcggccagggctggggcggggaggagggtgacatgcctgacgcaggggatgggcaggcctccctgatcgagaaggcgacctgggcctccgccgaggcagggccgcgagtgccggtgccctcgctcgcctcccggcatcgccccagtaccttcaatccctacgagttcccctccctgggcgcggaggcccggcccggcccggcgccaggcacctccgcgcacctcgggacctcgggcaactgggacgaggacgagcgcaactaccacggcccggggccgcagggcccgccccagaggtcccaggatgccaggtgggggggatggtggggggcggctggtctgcttgcgccctgccgtggcctgcggccgtgcctgggtcgagcagagcatggggcagcgggtgggcctgagtcgcaggcgcggcgcctatccaggcaggaccaggggcagcccacgcctgcagccggcgctcgcatccatggcacaccacgtgtcgacaccacagggagtcgtacggggagcaaggctacccctcgcgttacagcgggccggaacccccgccacacctcgagcnnnnnnnnnnggccgtgcctgggtcgagcagggcatggggcagcaggtgggcctgagtcgcaggcgcggcacctatccaggcaggaccaggggcagcccacnnnnnnnnnnnnnnnnnnnnnnnnnnnnnnnnnnnnnnnnnnnnnnnnnnnnnnnnnnnnnnnnnnnnnncggccaccgcgaggacctggagccacggggccgcgccccggcggggccgcgggactggcgccgccagcgcggcgactcgcccccgcagcccccgtacgggggagggcccggcgccgggcccttcaggtgcggcgaatcgatggtcgtggatttggtccccattcttgtatggggagtgagagttgtcttcgctctcgcacaggtcacctgcgctgtctgtgtcacgccccgctgtcatcggcagcccaaaccatcaccgctgacgcccctgctgtgctccccgatgccgtcctcctgtttttgctgccgttgtctgtcgacgccggaggccccggggtcattccatcgcagccttgtttcccgtctgcccctgcacccctcgacgcccaagtgccatgcgatgatccttcccatgcaccccacccgatgccatcacatcgcacaaccaacctccctcgcaggccccagggcggggaggagcgctggtcgcgcggcccagccccagggccgggccggccccgggatggcagcagcggcggccggcgcgaggagtggagggatggcccgggcggcgggtacggaccccggggaggggcgccggagcccgagcccccctcggacctcttcccgcccccgcccccgc

SEQ ID NO: 44296 - DNA, 104 bp, Chlorella protothecoides
gcagccgcgcgcgacggcgcgggggtgggtgcgggcgtggcctcgccgccctcctacgccagcggcgagctggagtcggcctcctccgacgcgggggccagcca

SEQ ID NO: 44297 - DNA, 68 bp, Chlorella protothecoides
gcagtgcgcatggtcgagggggagggtgtcagagggagggggagatggcgtgcgctgggacggcaggg

SEQ ID NO: 44298 - DNA, 68 bp, Chlorella protothecoides
accctgtcctgtttttgttctcgccctgccattctctcccccccccaaagagagaatactccctcacg

SEQ ID NO: 44299 - DNA, 736 bp, Chlorella protothecoides
  modified_base (132)..(291): a, c, t, g, unknown or other
cgccgacgcgccgcgcgcgcgcagggccgcctccagcagcgcgcggcgccaggcggggagcgggaagccggagccgtgcaggccgctgtccaggtcctggccgtacagggactccagggccgcgtcctcggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggaccgtgcccgcggccgggccggccagcgcccgcggccggcgctgccaggagcgtgcggcggcggtgggagcaggggcggcatcgcagtccgtgggggccgcgccggtccccggtgctccctccccgaccggcgtgcttcgccccgagggcgcacgagtacctgcgcccgagaagtgcagcgcgcgcgcccagtcggcgtaggcggagaaggagcgcagcgtgtgccggcgctggagagtggggaaaccaaactcggactcggagtcggagtcggagccggacgaggaggcctcgtcagcagaggcgtcggcgtccatgcgatcgtgcatcgtgtcctcacgcgcgccgtcgccggccgcgcaggccccatccccgaccccgcccgccccgttcaggagcgcgcggccagcgcagcgccccgcggcgtgcgtggcgccgccgcc

SEQ ID NO: 44300 - DNA, 896 bp, Chlorella protothecoides
  modified_base (214)..(229): a, c, t, g, unknown or other
  modified_base (317)..(326): a, c, t, g, unknown or other
gggcgcgggggtccgagcgcggccagcgcgacgcggcgccgctcctccacgccgcgcagcgtgcccagcgtgccggcctccgcctccagcgccaggtacgcgtcccacagcgggcggccgcgctcggcaggcgtggcgggcagcgcccgctccagcagcgcccgggcgttggccacgtccccaagccctgcaccggggtcgcagggttgtgtgnnnnnnnnnnnnnnnntgcggtcggcaagatcgccagtgaaggatgttgaaatgtactcccgggcccctcaaccccttggccaccatgtccttaccaccccccnnnnnnnnnnaagctcgccgctgaaggatgttgaaatttactcccgggcccctcaaacccttggccaccatgtccttaccacccccctcccccccctggggggcttttgccgtcctagaatcctcacctctgaggaaggcaaggtagtgcaggacgtaccccggctccgacaggtgtcgctccagccccagctccaggatcttgcgcggcacggtgtccaccccgcccgccgccgcccactccaggtcggcgctggcggcaaaggcctgccagcccagaccctcccagcgccgcgcgcggaggaaggccttgcgcgcggcggtcaggctctccgcccgcgcgcagaagcgcaggtactgcacccaggccagcgtcccctgggcctggtccaggcccagccccttggtgtcgttgtcactttcacccgcccccgcagcgtcgggccccagccccgccacggtttcctcgtgtacggcgcgcgcgtcgttcagcgcgccgcgccgctcgtgcgcctccgcggccgccaggtgcagggccagggagggtggcccggccgcgcgccgcgcggcgtccagcacgg

SEQ ID NO: 44301 - DNA, 61 bp, Chlorella protothecoides
tcctgcgggtagctcctatggcagccggggggcccagcatccagtctactgagccgccgct

SEQ ID NO: 44302 - DNA, 61 bp, Chlorella protothecoides
aaggtgggcggccccagccgcgtcacgacggcctggggggagtcccctagctccacgcaga

SEQ ID NO: 44303 - DNA, 463 bp, Chlorella protothecoides
  modified_base (220)..(307): a, c, t, g, unknown or other
gcgccgcacgccgagctggcgctgccgggcgcgccgggcgacctggcgcacccgctggcctgcgtcgcgccccgggcgctcctgtccaagacgctgactgtgtacgacctggcctcggggcgcgtggtgctggcccccggcgacgtggcggccaccgtgcccgaggccccccgcgccggccgcctgacgctggcggcgctggacgaggaggaggtctggnnnnnnnnnnnnnnnnnnnnnnnnnnnnnnnnnnnnnnnnnnnnnnnnnnnnnnnnnnnnnnnnnnnnnnnnnnnnnnnnnnnnnnnngcttcttcgccctccgcgcctggaccagcgtggcggggcggcgcgggtacgtgctggagggctccgaggcggccgcgttcctgtcggaccgcggcgccgcgccgggcgacgagctggtgctctggcgcgacggcgcgtgggagccgccgcgcgtgg

SEQ ID NO: 44304 - DNA, 21609 bp, Chlorella protothecoides
  modified_base (123)..(183): a, c, t, g, unknown or other
  modified_base (1514)..(1523): a, c, t, g, unknown or other
  modified_base (1763)..(1886): a, c, t, g, unknown or other
  modified_base (1996)..(2005): a, c, t, g, unknown or other
  modified_base (2097)..(2106): a, c, t, g, unknown or other
  modified_base (2907)..(2916): a, c, t, g, unknown or other
  modified_base (3705)..(3714): a, c, t, g, unknown or other
  modified_base (3922)..(3931): a, c, t, g, unknown or other
  modified_base (4956)..(4965): a, c, t, g, unknown or other
  modified_base (5419)..(5428): a, c, t, g, unknown or other
  modified_base (6398)..(6407): a, c, t, g, unknown or other
  modified_base (6839)..(6848): a, c, t, g, unknown or other
  modified_base (7140)..(7165): a, c, t, g, unknown or other
  modified_base (8448)..(8457): a, c, t, g, unknown or other
  modified_base (9007)..(9065): a, c, t, g, unknown or other
  modified_base (10144)..(10153): a, c, t, g, unknown or other
  modified_base (10622)..(10631): a, c, t, g, unknown or other
  modified_base (11180)..(11189): a, c, t, g, unknown or other
  modified_base (11901)..(11910): a, c, t, g, unknown or other
  modified_base (12863)..(12872): a, c, t, g, unknown or other
  modified_base (16127)..(16136): a, c, t, g, unknown or other
  modified_base (17937)..(17946): a, c, t, g, unknown or other
  modified_base (18692)..(18701): a, c, t, g, unknown or other
  modified_base (19236)..(19245): a, c, t, g, unknown or other
  modified_base (20453)..(20462): a, c, t, g, unknown or other
  modified_base (21438)..(21447): a, c, t, g, unknown or other
cgcgacgcgcgcgcggcgacggccgcggcggccgacgcgttgggcggcgacgaggccttcgaccccttcctggtcatgtccacgggcgtgatcgggcggcgcgtggacgccgacgcgctgtcnnnnnnnnnnnnnnnnnnnnnnnnnnnnnnnnnnnnnnnnnnnnnnnnnnnnnnnnnnnnncgcactgcccgtgctggcggcgggcctgggcgctggcgcggggcacgcgctgcgcgccgcggtggccatcaccaccaccgacctggccagcaaatcagcggcgctggaggtggagctggcgcccgggcgcacggtgcgcctgggcggcatgtgcaaggggtcgggcatgatccaccccaacatggccaccatgctgggcgtggtcacctgcgacgcgcccgtggccgccgccgtttggcgccccgcgctggccgccgcctgcgccgcctccttcaaccagatcaccgtggacggcgacacctccaccaacgacaccgtgctgggcctggccaacggcgcggcggggggggcggcaataggggaccccaactcgcccgaggcgcgtgcgctgggcgccgcgctgaccgtccttctccagggcctagccaagtccattgcctgggacggggagggggcgaccatgctgctggagtgcacggcgcggggggcgcggagcgacgcagacgcgcgccgcgtcgcgcgcagcgtggtcggcagctccctggtcaagagcgccatgttcggccacgacccgaactgggggcgcatcgccgcagccgccgggtgaggggtttgggtaaacagggggagaagtgacatggtggggatgctgccaccatacctcaggcggcacggcagagccggctgcttgtaggagaaaggagctgcgtgtgactgttccctcgcccgccgcgcaccaccgccaagcggcagaggagggaggcagtgctggcagtgcagccagcccccctacctgacgccctccagcactcgttccatccgcaagcgccccagcaacccctggaaacccccacctcaacaggtactcaggggtggactaccggcaggaggacgttcggatcagcctgggggacacggagctcatgcgcggcggccagccgctggactttgacgcggcggccgccagcgcatacatgaaggcggcggccgccgcccatggcaccgtcaccatcgaggtcagcattggggatgggcccggcgtgggccaggcctggggctgcgacctgtcgtacgactacgtgaagatcaacgcgggtgagggggcatggagggcttgggggcatgggtggggcagtgccatgtgatttagatgtagggaagggggggaggcgggagtgaagagtgtgccgcgggcgctgtcacgtccgcacactccgtcgcggtcggggtaccatgtgcccatgtacagatggtggtgtgcgggggagtccaaatccatcagatcccaaccttcccgctgcacggatgagcatggactggaggggggacgnnnnnnnnnntatcagatctcaagcttcccgctacacggatgagcatggactggaggggggacgatgcagatgttcaccgttcccggccttgccctcggccggggaggctgaaatcaaaacccacatttgtctctgatccctttcttccacagagtacacgacatgagctgcgaggatgggcatgcagggatagtgcgatgggtggaagctgccgtacgtgcaagggaatgtaatgtcacacgaattgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcttcgccagcgtcatgctcaggtgcggggagggggtgcaccgccttttgagccccgaggaattggcggatatgtacactcaccacgccccggacccttaccgcaggannnnnnnnnnacagcaccagtacgccctaacttcgccaattagctaacaaacacaagcattactgtcatgccggtcgtgatgggctggccgtagatgtcgannnnnnnnnnagtggaattggcggacatgtacgctcaccacgccccggacccttaccgcaggaggacgtggcctcgatactggacgaatccgagcaggatgcggtgattcaggagctggcggcccaatccgcccgagcacggcgccagacccagctctgcgtgaccccgctgggcgcctgcctcgccctcctctacctctacttcgcggggcaggccctggttgatccatggtccatacgccaccacgccgagctccgagacgtgctgcgtcccctagccatcgcggcgggggacctgggcagcagcattgccgtggctgccggcacctgggccgtggcggcatactgcaaccagtcggagcaccagggccgcgccatcctgcgcccggtcgtggtcctggccacgctcatggccgtcttctggtccctgggcatcctgaagatgctgcgcctgcgcggcttcgtcctggacggcgcctggcgcatgttctggctccccgccgcccctgccgtctggaccctcatcacactctccgtcatcaacactgtgggggcagtcgagcgggacctcagagcgctgagggctgcccggtacaggttcaggcacatctgaatcccatcgacgggacagggtcctgaactgagattggggcctcaaccccccggagtggtcctcccaatccaaacgaggatgccaggatatctgtaggtggtctcgtaggacctcagcatatcctgggatctctgccgccctgctctatatgcttgcccttgttttttgcatggtccctgccactcctcatcctggcannnnnnnnnnggggacagggtcctaaactgagattggggcctcaaatcccccagagtggtcctcccaacccaaacgaggatgccaggatatttgtgggtggtctcgtaggactccagcatatcctgggacctctgctgctctgctctatatgcttacccctattttccgcatggtccctgccactcctcatcctggcaagtcacgctcgaggtggacaggactctccattgtttcgtggctccccttttgttgccttcaccaggacttataggcctattagtacgcctctttcaacatgtctaccccccttcacccctatttagagacacgacgcgctgccccaacccccctgcatttcatgtagctgaataactcgcttacatatagaggccgcggcttttacagagacgagactcatgctggtgtcggtgtgcgttcagacccgtcgagccagaggctctgggtgggagatgtgagggggaggaaaatcgatgccatgcccgatcgggtggcaggggctgacgaatggcaatggtggagggaacgtgtggagggggacccgtggacgccgctgcctggaaatacatcacgccaagcccacggcctggcggacctcatcgctgagcgggacgtgcaacgtcttgcagtatgcctccagcttggccgcgccgtcctcgaaggaatcgagcaccgtgtacgtcttctggtacctggggatcggattgggggaagaggcgggaagggttcacactctgccattcaagatgtgaggatggtgtgggtcctccatgggcatgnnnnnnnnnnaagaggggggaagggttcaaactctgacatcaaagatttgaggatggtgtgggtcctccatgggcatgacgaggatggcgagcaatgcatccgcatcgcatctggatgaaggacagtcgagcgcacgcctgtcctggcaccatccccgaacaatgctgtggcagactccagcgtcctgccgcactgccacctgatctgaagagcacannnnnnnnnncggcaccgtccccgaacaatgctgcggcagactccagcgtcccgccgcactgccacctgatctgaagagcacagctctcacagcccccacttccagcgtggcatgcggccctgcagtcccccccagcgacgttcatgcacccccattcctcctccatcgcccctcctccgccgcacccgtcgctgtagctcatcttgggctgcttctggaaggggtcgaactcgcgcaggccggcccggcctgaggccatgttcttcatctcgccgtagctggacagtacgcccgcgccgaaggccttgaccccgtctccttcgcgcaccacgccaaactccacggtgtaccagtagcacttggtgaggtgccagatctgggcctcgtccgcgcccagggacgccacgccgatggcgtgcgccagctggcagaaggcggggtgcgccagcatcggcacgtgcccgatcatctcgtgcacgatgtccggctccggggtccagcacgggtcggccccatgccgcatgtactgcgtgctgtggaaggtgcggaaggccaggccgttgaggaagtcgcgggggtggagcaggcccgccacgggccggatctgccagccgctgcgggcctgcaggaactcggagacctcctgcagctggggcacgcggcgggggctgaagcccagctcccgccaggaggccaggaactcggagcaggcgtgggcggggaagagctccgccagctcgttcatgacgtaggaccacaccgccgtctcctccgccgtgtactcgatggcggggatgggggcgcctctgcatacgacggtggcaggtacagggggtcacacaggttggagtgaacgcgtgcctggggatgaggagatgggaaccatacgtgcagacactggtctgagcctgacatacatgggcatccgatcatgctcctgatggagtggtgactggcacaccctctcccgccagcccagctggcgcattgaagcacacgcagccgtccttcactccacatcatgccacagcccnnnnnnnnnnaccaccagccaagctggcgcattgaaccacacgcaggcgtccttcactccacatcatgccacagccccaacaaaacctagcaaacacgtcgaccattccaagtgatatctctccaagacacttacagagagcatgcctccctgccggacacatgactcacatctcatgcttgctggcgattttacagatgtcgactcgtcgctgcttgtatgcctcgtcggcaaagccggggtgtccttccgccaactctgcgccaaagcctaggatctttccattatcgacctcactgagggattttggaatcttgaagggggcgggctgtgccttctgtggcatcgaggccgcggggggggtctccgacactgtccctgctgacgccactgggcctgcggacatggggaaacacatggggcaaaagtcgcggcgatgcacgaaggcttttctgcagaatgannnnnnnnnnaacatggggaaatacatgggccaaaagtcgctgcgatgcacgaaggcttttctgcagaataaggacattcgacatgcctccaaggatcccacacacctcgtccagcctgtaattggatcctccttcgttgagtgggccatgtcgagcagcgtcctccacgaaacgactgagaggaggagagtgccgagatcgtcagatcacaccgggtgagaacagccatcttgaggttactttctaatttcagttcatttaccacacttgcgcggcacatccctgccacatcgttgcctccctcgttcaaggctcctgtcgggccgcgtgcgacgtggactgaaaaacttaccgctcccgcccgcgccttcgttcgtttgatggaagctgcgcaccatgtgggcggtaaggagaagctgaagtggtctttacctttgcgtgacccattacagcatcgatacagacccttttcaacctaattgtgcggaaatattatccacattcctgattaagttccctgcgaaactgcgacccgaccatcatggcctccaccgcgtccggcccatacgccaagctgattgtgaacatcaagagcgcccacaacctgaccgaccccacctggctggggaaggccgacccctacgccatcttgaaggtacattgggttcgaccgcgattttgtgtctatctaggcctgtcgagcatgggaggttgggacttcccaaatccgtgttccagcttgttgcctgcatggatgctcacaatcttcttgccatcttccatgatgcaggtggctggcgctgagatccagacccatcacatcaagaacgccggcgagaatgccacctgggacgagacgtgagcgtgtgggatgtggagaagagggactagaagggcatagttcatcagcctgttctggtgtgtatggccgagcatggattcgtgtgtgaggccaggcacaccatccattccacacttnnnnnnnnnnatgggatgtggagaagaggcaatagaagggcatagttcatcagcctgttctagtatgtgtggccgagcatggattcgtgtgagaggccaggcacaccatccattccacacttcctcccacacctgcacactccctcagctttgccttcaacaatgtggccatcgaggacatcctggagctgagtgtgtacgactacaacaaggtccgcaaggacggcattatgggcacggggtccctggcgcttcgcgaggccttcgaggaggggcgtatcgacacgcgcatcccgctgtccaacaagaccggctccaaggatgctggggaggtgtggatcaacatccgcacggagggggtgagagctgggcggtccttgtggtccctggaggggaaggggtgacatcgtcgctgcaatgaggcctgctccaggtcatccgnnnnnnnnnnaaccggctccaaggatgctggggaggtctggatcaacatccgcacggagggggtgagacctgggcggtccttgtgttccccggaggggaagagggcgacatcgttgctgcaatgaggcctgctccaggtcatccgtcactcaatctcctgcctgtcgtgctgggagcagttgtccctggcctgccctcaacctggagtcctcggaggtccttccttctgcattgctccagtcgcccaagttgcacaactgcatcacctcgcatcccccccccccccccccccccccccgccnnnnnnnnnnnnnnnnnnnnnnnnnntcgcagctgtctaccgcagcggtggcccaggccgccgggctggagaccgacttcaaacccctggacatggacacctcccgagaggcgcactccgcggcagacaggcagggcgtggatgacgctagcggtggccagagcggcgccgcgtggcagtcgtcgcagacgggccaggtggccggcgttgaggggttgaccaagaagaccgagggcctggggctgggcgacggcggcaatgtgcgcaagggcgaggaggtcgtcctgggccaggacaagtacaccacggtgagagtggggtgagggagtttggttttcttgggaggtcggcgcgttggcgtgtgggcctgggtgttgtccgtgcgggaagaatgagggtgggtgggaagtggtgttgtgacttggcgtgtgtgggcaggtctttgttaaatgctgtgcacgactggcatcagcagcaacctgttaagagcactcagtgatggccattccacacatccccggagagtcgcctcaatcaacacacatgtgccgcacggctttttctcaatgagcacatgcattatggggtggcccctcccctaaatctctttcggcttggtctctctcgctcaccctgccaccccctctacacatatacctccacagaccgaggaccggtcggtggtgaaggagcgggtggaccacttccgcgagcaccgccccgtggagaaggagtttgtggtggagacgcgcgccacgggccaagagcgcgacctggtggaccaacgcgaggtggagtccctgggcgtgaaggagcggatcctgaacgaggagcccatcctctctggcaaggagaccagcagaagcaccaccacgaggaccgagcagagcaagtgaatcttgagtggataggacaggtacgctccccttatgcatcaccactccttgcactacgccatgccggcatggctaccgtcctgattgcactagtcaacccctgcctacatgttgcatgacccgtccctcacaccatcctgttgatacatgccaccatcatggtctgctcggtataaagtatgtagtatgtgagccgcagccctaaaatttcaccgcatgatggtgtgctgcacagcatgtcacgatcgggcgaccaagccctggccggccagctcattgatggctacccagatgggagcctgctctgatattacttgcacaaagtatatctccaatgtcgcatcttcactcgatgcttggtcgaggcatgacgcctgccccatcattgtccgggcggtgcatcatgaagggtnnnnnnnnnnagagcctgctctggtattccttgcacaagatatatctccaatgttgcatcttcactcgatgcttgggcgaggcatgacgcctgccccgtcattgtccgggcggtgcatcatgaagggttgcgctgtgtcaacaacggcaccaatccactcattagcgccccaaaggcctgcaacaaggtatcaactgtacttgaacacatcgcatgagaagctcggacggtccagccgtgcgcaggcggccgataaccaccggaaccccgcagagtcggacccacgcagcagggtgtcatggagcatggcggacagcgatggcatccgatcagcggtcgtcatgctgggcgcggcagcgctcctcctgggagcctcggatgcctcgctggcatcggaggctccccatcaacacccggccctgaacatggtggtgggcaacctggcagacaacgatgctttctggccgaatgtcctacgatacatcagcttcttcttctccgtgctgctgggcacggcctacgtcgccatccagcccatcatcaaactgctcaagaaaccnnnnnnnnnnnnnnnnnnnnnnnnnnnnnnnnnnnnnnnnnnnnnnnnnnnnnnnnnnnctcgcctttgccctcttcctgctcaaggggacggtgtcagcgatgctgggggtggggacggcccaggatctccctcccctctgaaaggcatccctcttatgtgatctgatgtaatgaggaagaaggaattatctcatggtcgctcaacatcggggaaacagaggaagtgcgagcatgagaggcgtgcaagcttacagagcggtcttaaactcagtggaggcacggtattccagcaatgatcacccgacataactcgactgtgccatattgacaaaggcatcccatcaactctctccacaccctcatcccttgcatggatccgtaaggcttcttgttacacaccacaaggggtttgtgtttcacagccaggagggagcaccgggcatgccattgcaagagcaaagccctgcatctccagccgcaggatgaagaacgtgagcttaagcactcaactcccagtccctagtagctgggctgtctagctcagtgacgagggttgacaaacttgctctccttgatggcggcgtctgcaaggaaaggagcagaggacctttgctgccagaacacacagcaccagcggcagatactgcctgagcgcgcatctggaggacgagaagaccacagcacgcatggccgtcacgtacccgtttggagagatgcaatgtaaaacatgatcccgcccgtcacggcgaagcccgctgcgaagggccacctgtgggtggagcaggttcggaccagagtgaatccaacgcgatgtcggcattctcacatcacggtttattcacacagtcttccccttggccccagcacagatcagtttgcctcctcacatcgtgcgaaggttgcgaatggcggagaccgggatggactcagcggtgtaagggtggagcggggcgcctgccatcgtagcagcactcactcctctcttttgaaaccgtaaaaagtctgagacggagtgcctttcgtcctgccaagggtgcggattctcgcacccgctgtaggggattttccaagggcgtcctttcttgtaagcaacgcattgctttctctcccaggccaactgcacgcatgcactgagnnnnnnnnnntttgttgaaaccgtaaaaagtctgaaacggagtgcctttcgtcctgcccaagggtgcggattctcgcaccccgctgtaggggattttctaagggcgtcctttcttgtaaccaacgcaatgttttccctcccaggccaactgcacgcatgcactgagtcatgcgaggtcgtatcttgcagggcagcagatatagaaaacacaaagtgcacagcattccgttaggatatcgatgctcctgcaaggctaggggcgaccaccaccccagcactggtatgcataggctgccctgagaatcccgctatcctgtctggccctgtgcacaggaagggttgcacagcctcccaaagcttcttcttttggacctgtttggggggaagtttgatgacaggggaataggactgtgcaactcgggggaacgcgggtacaagtagatcacaccatgcccggcatcaggccctatacggcctgnnnnnnnnnnaggggagtttgatgacagggggaatagggttgtgcaactcgtgggaacgtgggtacaagtagattacatcatgcccggcatcaggccctatacggcctggccaacattgccaacaccattcgcacctggtttggctgtgctgcctctgcttgctcgctggcatccccaaaccacactcgctctcccacttgggctccttcggggggcaggagcggctccacctccgtgtgctccgagttcgaggcgcagaggagcatgccggccgacttgatgcctcgcatgtttctcggcttcaggttggcaaggactaccacctgccgtccctccagttcctcccgcggaacaaacttgaccaggccgctgacgattgtgcgagggcccccttcctctcccaggtcgatggactccacatacaggctgcaaggggggcgagaggaacagggcatggagcctgcccacagaggtggtttgcgctggttggcagacgggcccgaaggcgttgctccagaacccacctttcggcatctgggtggactgagcactccagannnnnnnnnngggggaggaacagggcatggagcctgccccacagaggtggttcgcactggctggcagacgggctcgtacgcattgctccagaacccacctgtcggcatctgggtggactgagcactccagaatcttgccgatcctgatgtccatccttgtgacgtcgacgttctgaagaggggtctctgtgtggtgaagcagtggctcgggtcaggtatcgtcatcaccaaggagccggaaggggtgtgggttcagcatgggtgcccctgcattgcaatcctaggtctccccaatacctgttgctttctcgagcgtctgatcctcagaggctgcactgcatacccaagatccttgcaatctttcgggaagaaggccaaggggctggtgcgtttgaaggggtgtcgccgatggacagggtgtgcatggcagggcttgccgaaggattcgccaccctcccgacctgacgccctgggatgcgatgctcaattgcatgcctgagggcgaagtgaagttctgattatttcgggcaatgagagtcgtgaccttcactggtgactgcaaaggcccactctcctatccatagtacagaggaggtggccgaggtccaagcacgtgcaaactcccgtattattcttgcaaactcgccgatgtcagggaggcagttgcagacgcaagccagatcgctgacaaataaatgttgagttcttatgtaacttcgttnnnnnnnnnngtattcttgcaaacttgccaatgtcagggaggcggttgtagacgcaagccagatcgctgacagataaatgttgagttcttatgtaacttcgttgccccattgccgccaatgtgctgagcgagatccatgctagcactctgccggcgggctgcgttgtcggaggtggcctctccttcatggagagcagctctgcagcacataggacttgagtacccaacacagcatggattaaatcaaagcatccggggagtggcaaagcaggccacagaggtgagcgtcttgggattttcgcgaacccctcaggtatccttttccacacacgagtggagccactgcagcatccaaactgtcctgatcaaacataccctccatttgatttaaacagcaagcatctcacgctatttatctcatacattgtgcccttgggtcgcacggcttcaagagcctggatgctgttattctctcgacccaccaggtgtccctccaaccctctccccccccccaaaaggtccgccctggggccgtcctggagctgaatgggaagctgttgcaggtggtgcgaagcacccacgtaaacgccgggcgccagctgggcaatatctccatggagctccgggacctggccagcggcgccaagcaccccgccaagttccgcccctcggagagcgtggaggtggtgcacctggagagcaggcggtacacgtgcctgtatcgcgagggcagcctactgcacgccatggatgccgccacgtacgagcaggtggcagtggaggccagcctgtttgacccgggctcggcctacctggtggagggcatggaggtcagcatggctttccacgacggccggcccatcgtgggtgagctagaaggagggaggtagggatgggggtggggggtaaaattttccttgtggaagccttggagtgcagttcttcgcgagtgactacccagtnnnnnnnnnntgacggccggcccatcgtcggtgagctagaaaaagggaggtagggatgggggggggggaagttaacattttccttgtggaagccttgcagtgcagttcttcgcgagtgactacccagtgcacccaggctggtgctttgccggctcactcctggacaccggcgccgacgaggccctccgccacagcccctgatcgcatcgtgcaaatgttttgagcccgcttgaacccgcgcctcgcaggcgaggtgcccgccaccgtgaccctggaggtgagggaggcggccccgaccatgaggggcgagaccgcggcgccgtcctacaagcccgcagtgctcgaaaatggggtcaggatcacggtgcccccctttgtggtggccggggacaaggtggtggtcgacacacgggaggggacctttgtgaagcgggcgtgagtacgcggccaggggaggaggggggtttctgttgacgggcaggccatcccttggcaacctccctctccaacgccatgccccagaaccctacccaggccttcacacatggacccaagcatgcaaaatccccctttccagtcagcgagcgcaaaagttattcacagatgcgacaagcgcagctcagacagagcgggacagcgtgtcaagggcttcagtgcgggcgagaggagggagaggaaagggagggaggggagtttggtgcggaaggggagagggatgaagggtcaggtggcggccgcggcgcgcgcacatgggtgcgggcctcccgagcgctgctcgccgcctcaacccttaggcggacgggtcctcagcgcagcgcgcgatcatgcgctccacgacctctcgctgcacgcacaccgtggggtagctgaccatgttgaagaccacctcgtggtcccccaggtccagggcattgctctggaactccgccatctgtgtgatgaggggggtgaaggcgggggtgagcctgggtgggagcgggggggttcgagcgctgcgatgggctgcatggggacgctgcgctccccctcccttgcagggacattggcagctggaaactgaatgcctgaccggcctcccagcactgctctgctgcattgtggctggtattgtggctggaattgtggcctgagcggctgcgcctcctgacagtcctgaactgggacagcccggatgcgcagctgaattccctcccacaacaccgcccacatgcccaaccacagcactcaccgtgaccatgaggtcggcggcggggtcggggtgggaagacaggtcgcgctctgccacggtgtactcccacccgtcctgcgccagcagcaccagccggaagtgggtggagccgagggcgctgggcacgctgacaaactcctccaggggcgtgcacatgaggaaggcgggggaggtgaggaagtcgggcagatcgctgccgtcgtaggcgtgccggatcaggcggctgcatttgtgtggggggaagaagctgtgagattttgctggaggggcggagggatcacagacttgctgcctcccaggcagccagacgaggcggctggacctcaaaccccacacgcccactagcgcaaccccagcacgcacctgaacaggccctgcagctgctcgatggaggagatcaggcgcaggggcagccgcgtgaccttgctgtccccgcacagcgtcgtccagcggatgtacaggcacaggctccagtcccccaggctggggcagcgtacctgaggtgcagcatgagggggcacgccgggtttgaatggtgaatgagaagcatcttcgcgacccagccgtctggcgaggaggatgccgtacacctttgggctgcagaagcacctgcacataccaattggccccccttcccaagctgccgctgcacacctggcgacgggctgcatcttctgcgtcaacagcttgctgagagagtcgtcgcttgcgggagcgggtggttgggccctcgaatggccgcaggctgggcccggctttgtgcgtcagggcctcgtccatacgcctccccgcaccctcgtccgctccagctgccggactgtgggccgctcacagctccgtccacatttctgtagctatttgtgggacgggaattgagtcagcgcggtgtgacagctcagttcctcgtctgcggccgtgggcaggggttgaggaccttccaagcagcccgacgttccacctccaccggggcaagtggacgctgtgcctggcccctcacacgacacaggagcagtaagtgggacatatgagcgtgcctaggacccgtcatggcaatgcccaccccctgcggggcagcgctgtcgcaccagcttacctagtcccggtaccttggccacgtgcttgcttcaagtctcgcctgcgtggcccttcccctgtccaaaggctgaatgatgccgcagcgagaggccacactggattcagtacatgtacagagtatgcgtgtcctaggcctctggcgcaggcctacaagccaggcggcctcgagtcgaaggggggtcctcggcctagtttccggcattccaaattgggcgagtcagggcgctccctaccaccacgtaattggaagaaatgcatgcattcaggcgaagtcttcgcaagtctttgcatctgtatccgctctccatcatataaagcgaccacgggcactgtggagtgggagggcgaggcagatgtctcgagaatggagcaggtacgtgtcgggcgaccgggtcccggtaccgggctaccaataaccacccccgcacggcggcaatcatggatccagctcttccctcactgcaggggtaggaagtggactgttggcctggcttcagctgccctgagcgcgacggccacctgggctgtttatcggcagctgagcagtcggaggagcgtgcaggaggagggggcagaggatggcctgggcgccagctcctcgggtcgcgacccccttgaggacatgctgctcctgaacccgcaaggacgcccaggaacacgcgagcaggtgtgtgtacatggtggtcatgggctgggtgcaggtttgacattttcgatcaagggtttcaggtctgagaacagcgcgcgagggtgaatgcccgcccaaagggcccaaagatagaaagcatggtgcaagccgggcgtttgcttggagcgtatggcctcgctgcctcgactttcccgtccatgaaatgcagcatcaactccacactgcaagctcaacactgcgcaaaatgcctttgccacaggatgcggaggcccacctggcgcaccactttgacnnnnnnnnnngtgcagcatcaactccactctgcaagctcaacactgcgcaaaatgccttcgccacaggacgcggaggcccacctggcgcaccactttgacagcatccaggacatcgcggacaccaccaccatgccgtccctcctgcctgcgcttggggcggcggtgacccgcagcaccggggtccagcccttgctggagcgcttgcgggcaggggtctccggggacggcgccccgctctccgcggctgacaagctgggcgtttgggaggagctgaaggtggcctccctggcgcagctcctgctcaccacccgcctgctcccactgctggcgctgacggtgcgctgccagctcaacgtgctggggcgctacctctacctcgagtccgcgctggaagagcgcgggcccggggccgtgggcgtggcggtgccccgcctctccacgccctcgcaggagcgcttcctgtccttcgccgaccacctggcgcgggagggccacgcgcgcctgctgccggcggcccggcgcgcggcggctgcagcgctggcgggcctgcagctccacgccgggctggacggcgccgaggtgctgcggcgcctgtccgccgccctggaagccatgtctgccagcgaggaggacgcgggtgaggggctgttcctgtttgtgtgtgccactgccggatgctgcggcgtgtggcttggggagggccagggtgcctgtcagccggctccagagtcgtaggacgtgccgctctcgcgctgttcatcctgagggtctcaggtatttggaccagtcatgcgacacctcctcattgcagactcatgcgtggtcacctttggtacattccccctccctcgcccactccagcctggagggagatggtgctgccctcgccggcggcggtggcggcggcgctgactgtctcggcgccggatgacagggcattgctgccggggtcggaggggctgcttgtggatgctgagaccgtggaaggcatgctgggggaggtgcggaggacactggacagcgcatgctttgcgagagtcgcccaggtgtgcaggggtccgcccggggctggaggggaggcagaggcccttgcttgtgggtggggagtggtcaggcggagaatgtgctttggggaactggttgtcatggacacgcgtcgctcatggtttgggggttggagacctcagggaggcgcggcgagggatgtcacaccagtcgtcacgctctctggaccgccgactgccaggatgcgaggcgccggccggccgggtgctctttgatccctaggccatcataccctgacgcatattgcatggccttatcacaaatctcctacccctcatacacattcccccccccagaaatgcacggcggagacggctcgcttgtttgccgacgcccttgccgctcggatgggaaccatgactctccccctcgccaaggtcatccccattttggtggctgtggctgacgaggcgttctttcccggctcccaggcctcggcccacttgtcagagctggcggttgtgaaggagctggcagccatggtgtatgcgagcgggccgccccaggactgataatcctggaactgaacttggagacagtgctgccaaatacaacagggctctctggcaaacgatgagtgcgctgcaatactccttcacccgaacttagatgtactggactatgactctatacgtgggcacgagtctattgtaggcagaaaatttggagagccccaccacgtccgggcgtccatgcagtcgtgcaagtggtggactagggttgtgcccctcgagttcttttgcgnnnnnnnnnncacgtgggcacgagtcttttgtaggcagaaaatttggagactcccaccacgtccgggggtccatgtagtcgtgcaagtggtgggctagggttgtgcccctcgagttcttttgcgacgctgtttgcctctggtcatcttgctgataccgatcataagtgtatggagtcatgtggcggcgattcaggggccctttccctgccatctgttccaatttcgtaaaattcccagtcgtccgcacaggtgtggccgccgtcgtaccgagtcatggcaccagcttccggccgacgaggagcggggtggctgcaaagccctagcgactgcgcgaattgaggtgtcagggtcgaagcagcaggtggggggccttccgagcactctggagctgtggcgaccgaggccacatgagaattccatggaggaaagtgggaccaagcccatcggcccggtgacctagggcaacacttttgaacaacttgcgctatccaagtggatccattgcattgttcctgaatttaacactctgccatcggcattaacggaggctggacgcaccttggggcgcacatcatcgccggtcggctcaaccctaggtgcgcgcacaaaccccggcgcaacaccggcctcgcggtgttcgcgctgcgcatggccggtattgcctcttcagccgcaatgtgcccgatttttgtcgccatgaacaccaccatcggctctgtctcaccctaaaccatctcgttttgtgcaaccctagnnnnnnnnnntccgatttttgtcgccatgaacgccaccatcggctccgtctcatcctaaaccatctcgttttgtgcaaccctagctgtgccgcgaatccaatctcctgtctcacttgccgtgtccgttggaaccattcgcgccggtctccagcctgcgcgttgcgacaattctttcaccaccatttcaaatgcatcattccttcacattgccgtgtctccatgagctggacgtacaagttttggagtcccaccggtccccccggccctgccaccatcgcagttcgaaggagcacctgtcaccatggcagtctcggccgagaacctggccgccatgtacaataacttggcgaccggtgtgagcggattccccgaggagaccatccacattggagggatcgaggggtacacggacatcaatgccgggtggaccctccagtctggctacctggtgcgcgggcgtgggtggtatgggcctgtggagggtcgctatggggaaccacgcgacattgggccgcttgtcgtgtggttccgtcatgtggtgtcnnnnnnnnnncggggaaccacacggcattgggctgcttgtcgtgtggttccgtcatgtggtgtcaaggtgcatgacgtctgggccttgtgttgagttccctagactttgctcacacacaccccgcttacccccccttaacacctccaccccccactccaggtgttcttcatgcaaatcggtttcgccatgctctgtgccggcgcggtgcgggccaagaatgccaagaacatcatcctgctgaacctgctggatgcctgcttcggctccgtggcctggtacctgacaggctgggcctttgcctacggcgaccccaccgccaacgaggacggcgtgtacacgttctccgcctctcaggccttcatcggcaaccgctactttgtccagaacggcctggcccgcacctcctatgtctcctggttcttccagttcacctttgccgccaccgccgccaccatcgtctccggcgcggtggccgagcgctgccgcttcgaggcctacatgatgtacgagttcatgctggtcatgtttgtctacccagtcgtcgcgcactgggtctggtcccccttcggctgggcctcggccctgcgctcccccgccacctccaagacctcctggacgctgctggccaactctggcgtctacgactttgccggtgacggccccgtgcacatggtgggcggctttgccagcctggcgggggcttgggtgctgggcccacgcctcggccgcttcgatgcctcgggcaaccccattcccatgcccgggcacagcgccgccctgaacgtcctcggcgtcttcttcctctggttcggctggtacggcttcaacccgggctccaccaacgccatcgtgggcgccacgggcttctccaaggtcgccgccgcggtggcggtgaataccacgctgggcgccgcactgggcgccatctccaccctcttcaccgtcatgctccacacctacttcaccaccggggtggtggtctgggacctcgtcattgcaggtatgtgtttgctcgtcttcttttgtgtgggatttgaggagggggtggagttgtccatcggagcgccgggaggattgggaccctggcgagcacatgaactccgatgtgatgaggcggagaatcctcacgccggccggtgtgcttgcctgacctgcacccctgtcgctcctccttatccgcccagccaaacgcacccatcgactcacgtgcccccccnnnnnnnnnntttgcctgacctgcacccctgacgctcctcccgatccgcccagccaaacccacccaccgactcgcgcccccctccccccccaaacaggcaacggcgctctggcgggcctggtgggcatcaccggcccctgcgcctttgtgcagacctgggctgccatcatcatcggcatgatcgcgggccccgtcatgtacgccgcctcgctgatcaacctgcacctgctcaaggtggacgacccgctggacgccatcgcggtgcacgcgggcgcgggcatctggggcctcatcgcctcggccgcctttgccgaccagggcatggtggaggaggtgtacggcacgcaccccgtcaccgacggcccgcgcaactacggcttcatcatgggtggcaacggcgcggtgctgggcgcgcacctgctcttcatccttgcggtgacgggctggacgctgggcctcatgacgcccttcttcatgctcatcaagcgtgtgggcctgttccgcgtgcccccggagtgggaggtccagggcttggacgtctcgctgcacgccggctcggcctacccccacgacctccccggcccgggcaagggtggcgagcccaaggcgtaccagcagcacgccaacccgctggcggacgcggagctggacgcgcgcgtggaggccgccatggcgcgcctggccggccgcaacggcgccggcgcgggcgacgtcaccaagcaggcctgaagggaggcacggcgcccccccaacccaactcacccgatcaccagttttccaccccctgccgtaccacccctcacccccgctactatttactattccgagtcgaccatcccctgtgtaacgccatgcccgagccagccggccggagggtggggggaagcggtgccggggtgtgaccgagccgcgggagacgtgcgacctgcggtgacacccgatcgccccgccccgagtcgtgcgttcttcctttctttcaggacccnnnnnnnnnncccacgggggacgtgcgagctgcggtgacaccagatcaccctgtccccgggtcgtgcgttcttcctttctttcaggaccctgtcgagcagggttgagcggaggctaccgaatgcatgggaagaggggcaaagaaggcaggccgggatgatctcggggggggg

SEQ ID NO: 44305 - DNA, 61 bp, Chlorella protothecoides
aagctgaggatggatttcaagaagggggggggcctttgaacataatttccggagcaggtcc

SEQ ID NO: 44306 - DNA, 63 bp, Chlorella protothecoides
aggaagatgtcgaccaggcccacctttggggggatgtgtgtgtgtgggggggggggggggggg

SEQ ID NO: 44307 - DNA, 62 bp, Chlorella protothecoides
ccccccccccccccccccccccctgccgcaccgagaggtcgttccggtaccaggccaggggg

SEQ ID NO: 44308 - DNA, 61 bp, Chlorella protothecoides
cctgctacctgtggagcttactggctaggggctctctttttgctgacagacatctgcaatt

SEQ ID NO: 44309 - DNA, 67 bp, Chlorella protothecoides
ggcctgcaggctgttgcgcagctccaccgcgcccagcgagtccaggcccgccgccatgagcgggtcg

SEQ ID NO: 44310 - DNA, 6579 bp, Chlorella protothecoides
  modified_base (135)..(144): a, c, t, g, unknown or other
  modified_base (267)..(276): a, c, t, g, unknown or other
  modified_base (1035)..(1044): a, c, t, g, unknown or other
  modified_base (2720)..(2729): a, c, t, g, unknown or other
  modified_base (3019)..(3028): a, c, t, g, unknown or other
  modified_base (4013)..(4022): a, c, t, g, unknown or other
  modified_base (4279)..(4288): a, c, t, g, unknown or other
  modified_base (4418)..(4445): a, c, t, g, unknown or other
  modified_base (4556)..(4565): a, c, t, g, unknown or other
  modified_base (5245)..(5254): a, c, t, g, unknown or other
  modified_base (5620)..(5629): a, c, t, g, unknown or other
cttcgcgctgcccctgctgctggggggccggggcggtggggggcccccccgccagcgcctccagcgcgccgaaacgcaccatgtcggccttgtccctgtcgagcgacaggggggggggggggggggggggggggnnnnnnnnnnaaatacacaaatccagaatctccctctccacacacacacactcacaccgcaaccatcccagcacacgccgacactcccgccccaagcccatgcctggtggccagcaggcagagcatgttccannnnnnnnnncgaagctgctgcccggcagcgtcgtgggcgccgggtgggcgatgtcgccggcgcggcgcccgcccgcttcgcgctgcccctgctgctggggcggcggggcggtgggggggccccccgccagcgcctccagcgcgccaaaacgcaccatgtcggccttgtccctgtcgggtgaaaaggggtgtgtgtgggtgtggagcaggtcactgaaggtgcattaaacgagtctagacatggagcatacattggggggcagcttgacaggctggcgccgggtggaggatggcgcagaggcatcggcgtcgcccacttgacggtagagtgccggcctcctctttgaatgctacccgccggggtgccaatacacaaatctagaatctccctctccacacacacacacactccccgcaaccatcccagaacacgccgacactcccgccccaagcccatacctggtggccagcaggcagagcatgttccagaagggcgcgccgtcgcgcgagatgtcggcgccccgcgcgtccgagtgcaccacctccgcgcaaagccgggcaaaggtcaggcgggcaaaggggtcggcgaggttgatgggcgaggggggcgttcccgcgccgcccccggggctggcctgttgagcggcgggggagccctggcctggcacgagattcccgctgccatcccgtgccccagcccccgcctcgccaccgctgtcctgcgcatacgccgcggctgcctcggccaccatgccgcccatctccaagnnnnnnnnnncggcattcccgcgccgcccccggggctggcctgctgagcggcgggggagccctggcccggcacgagattcccgctgccatcccgggccccagcccccgcctcgccgccgctgtcctgcgcatacgccgcggccgcctcggccaccatgccgcccatctccaaggcaacggcgctgggctcgcgggcggcgaccagcgccgccaggcccagcgcgtgccgcgcgcccacggcgtcgggcgagcccaggcccacgaaacaggcgcgggagacggggtccagccccgtggccgcgccaccggcgcgtaccgccgcaaacacgctgtgctggagggcccagtcggaggccgcgccgccctcgccgctgtcgggggggccgcgcggcgtggggcgctcatccgcggcggcgatggccgcctggacgcgggccagcaggagcttgcgggcgggggcgctggcgcgcgccgccgaggcgaagaggaagagcagcgcccgctgcaggccggggtcgaggtcggggcgggccagcagggcggaggcgtggtccagcaccaccgtcagcaccttgtcgtccacttttttagacgctgcgcatgtgtggagggcgagggggccggaggggggttgagtgggtgggtggcttgggtgggttggggggtccgaaaccatgtcgccccccagtcctcactccctcacccgtcgcggggtcgaagagcgtgggcgtcccggcgctgttgcctgacaggtagaggcccgccaggtgggacagcggcttcacaagccgcacgtcctccccctgggcggggagcaggcgggccagggaggcccccgcctcgggggacaggtgctcaaagaggaacagcaggcgcagggcactggccagcgacgccttggaggccttgtcgtccgcctgggaggccaccgtgagctggtgcagcacattgctcaggcccaggggctggagtgggggggtggtagggggaagctggtatgccatggcatgcagatggacagtgtgattgacttgcttacactcccacaccccaaaaccatctcaatgactcctggcgtggcccgcctcaagtcctgctgggcaacgatctgcacacctgatcggtccccactgcagtggtgcagacgtagcgagacaagagggggtcccggccggcgcccctaccctcgggcctggactcagatcgttggacaggctggggcccgggtctacctcccacacccagggccttgaggcgggagcccacagcacttgtggcgtcccgatacaccgcggcagccatactgtgatgcaagcacacacggagctcagtatgtcactggggtcatcgcgcgtgacgtcaccagaaagaccccagtgcactccgcgcgtcgcggctatccgacgagagaaaataccgactgttcgcaatgcgagtcgtgataacaatgtagggatgcggagggatgcttcccctcctgctcagatcggtttgctaagaaatctggttccgtgtttaccgggccagaacctcagcacgagatcaactgcgggagggagctcgactgctccttcttgcatgcttgagctcgtaggtcgctgttattgtatagtgtcttatgattacagaatctgtgttcatctgcacattcacttctgaaaactgctgcgagtctacctgagcagnnnnnnnnnncattgtatagtatcttatgattacggaatctgtgttgatctgcaaatttgctcctgaaaactgctgcgagtctacctgagcagcgccgatgggaaagcggaaaagcgccaagcccccaccggcgaagagcaaagcaaagctggatgtaacgttcgcctgtccgttttgcaatgcaggtatgcacacagagttctatccccttgcactgatgtgggagcagggaatgtccgctccaccagtattatgcttgcaccgccaaaacctacacaaccacccatgcagacaagagnnnnnnnnnnatggtggctgggaacctccgctccaccattattatgcttgcaccgccataacctacacaaccacccatgcagacaagagcgtgacatgcacgatggaccgggaacggggcgtgggatcggtttcctgtactcagtgcagtgcaagctttgcggtgaagatccacactctgtcagagcccatcgatgtgtacaggtgggaccagggtgtccactggctgcctgtatcgatggggcggctgagcataggctcaggcaccccctgcagcccttgctcacaccccacgcataacaacgcagtgactggatcgatgagtgcgagcgcgtgaacgctgcatgagctggcagctcgactcaggcgagacttggcgacacctcctcaggccctgcgcttgggcctgcgggacggtgatgctcgccggcggatggcgcttgccctgccgccgggcgactgcacgtgccatcattggcatccacgcactccgggtccgagggccgccacctctgccccgtcagcgccagccggatcagagcgtgggcggtgaccaggcctggcgtcgactggcccatgccggccagcaggccatccatgcagccgcagagggcgtgcagcctgtcacagactgcctccagtcgggccccggcctccgtccagccccggggtgttgttccggagcatccccgctgggcggcggccgtccataggactgcctgcatggttagggaaggggttcaagggatggcatggtcgtggagcatgctgcgtcttgctcggccggcagcggacctcttgcggacacccagcatgtgaaggcactgcagacagcatgcatggcacaaacccatgcgagaaagatgaagaggtggtggacagcagagggcgtgcagtctgtgcctgggggtggcgcggcctatcttactcttccaggccactccaccattggggcgagtcacccactgccatccccagtccaaagtcagggacacnnnnnnnnnnttatctcactcttccaggccactccaccaatggggcgagtcacccgctgccatccccagtccaaagtcagggacaccccacactccaccctcaccacacgaaactggaacgcgacgtccccattctcgcccgccagctcagcacaggccgaccgcaggcccgagcagcggccccgcgccagcgccgccgcacggcgcgcgcgctccgcccgctcccggtgccccggcgcggcggcctccagggcccgggcctcacgnnnnnnnnnncttgcttcgccccccgcgccagctccgccagcgtgcgccgcaatgtgtccgccgactggttctgcaccgtctgcagctggctggcctgggcctggagtggagggggttgaggaagggggggggggggggnnnnnnnnnnnnnnnnnnnnnnnnnnnncataagatagccagcactgtacgccacgccaacctgtaccccaggcccaacatcattgatgtccccgctcaccacctcccccccacccccctggccgcgccttgtcgcagnnnnnnnnnnaatgatatagccagcactgtacgccacgcccacctgtacctcaggccccatatcattgatgtccccgctcaccacctcctccccacccccctggccgcgccttgtcgcagacgacggcccgccgcgcgatcgtcctttccagctccagggccaggcgctccccgcgccgcgcctcccgcgccacctgggcgcgcagcgcggtccgctgccggccaagcgccgccaggggggcctcctgggcacccccaggctctgtcgaggggcccgctcgcccagccagctcggcgcgcgccgccgccagcgccagctcggcgtcgcgccccgcggcggccagggcctgggcccggagccgctgcgccgccaggcgcttgcccaggcgcccgacctcgtctcggacggcacgcagcgcctcctccccctcccgctggtccgcgagcagcaggcccagcgcggcgctcacgctggcccccaccgccgccagccgcgcatctgaggcccccgccgccgcaagcagccgctccaggtcggccccgtgcctggccgcacaggcccgggcctcctccagcctgggcagcaggacagagaggaagaaggggggtggtgatgcactttgtacacagggtgcgagtctggtgtgcatctcccccaccaatgtatgcacacaacctggctctccttcnnnnnnnnnnacactttgtacacgaggtgcgagtctggtgtgcatctcccccatcaatgtatgcacacaacctggctctccttcctccaccgaaaattacgaggctgcctcacctcccctccagctgggcgaggcgggaggccaggagggacttgcgctgcttcgtcgccgccctgcgccctgccagccggccctcctcccgcgctgccctcagccactgcgcctgtggaggtgggggagggcaggaggaagggcttcagaggaccggctatctctagggaagaagcaagacatgaattccctagggaagaggcaagacatgaatcccaagtacctgccacccttccagccagaccgcaaccaatgcatgccacgnnnnnnnnnncccctagggaagaggcaagacatgagtcccaagtacctgccacccacccagccagaccgcaaccaatgcatgccacggcaggcagcttcaccccgccacaaaccctgtctcacctgattggcgcggtcggccaggcggcccgcggccgacgcccggcgcgcctcctcagcgcccgccaccagctctgcaagtgtgtcgcgcagcccatcaatgcggccaccgggccctgcgcgcaacccctccagggcggtcgccttctgcgcctcgagcgcgtgcagcgctcggcggcaggcggcctccgccctgcgcccggcgagcagctgggcctgcagggtgctgtgcctgtcgtcctgccgctgcagccccctggcctgggcgccgagccggccttccagctctgccgcctccctgtgcaccggaccctcctgcctggcggaggcacgagcagcgcgcgcagcgtgcaccccgatctcacgccgcgcctccacacacgcgcgccgcagccccgcgagctcccgccgcgccgccgccagctccagcgtcgcacctggggcgccaggagggtcctcccctcgttctgtgcgtactaccatggccgcctgtgcggcgcggcgtgcaccctcctgcgcggcctccgcccgccggagctccgccttcaggacgcagagccgggcgtcgcaggcacgcacgtcctccgccaacacggcggcctccgcctcggccgccacggccgccgcgcgggaggccgccccgcggtcgcccaggtcgcgggtgcgcttcgctaatattctcagcgcgctttcccgcatcctgctcgtggcctccagcgccctggcctccgcctccgcctcctcggcctcggccacggcctcccgcccgcgccggcagacattcctcgccacgagcgccgcccgccctgtcgccacctcgcgcctcgccgccagcttcaa

SEQ ID NO: 44311 - DNA, 61 bp, Chlorella protothecoides
aaagcacacaatactggagggcatcggtggggcaggacgacctcaaaaatgcgggtggtgg

SEQ ID NO: 44312 - DNA, 2925 bp, Chlorella protothecoides
  modified_base (109)..(225): a, c, t, g, unknown or other
  modified_base (385)..(452): a, c, t, g, unknown or other
gccggcgcgacggcgggggcgccgcgcccggcccagacccggccgcgggcgacggccggctggtgagccagggcgcggatctggaggcgctggcgggcgcgctggcggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcttcggcctgcatggagcgcggggccgtgctggccctggtcacagcgctgcgcgaggtgtcgctgaccgaggtcccgggcccggggtccctggcccagcccaggcaagcgagggggatggtggttttggctttttaagaaagggggggggggggggggnnnnnnnnnnnnnnnnnnnnnnnnnnnnnnnnnnnnnnnnnnnnnnnnnnnnnnnnnnnnnnnnnnnnggtgtgatggtggggagatgcagcacgggtgactgacgagtggatggcagtgtgcatgaatggtcgtagggtttggaagggccgcaatgttgacgagagacagggtcttcagccgtcagactggaagggggccccggccgagagcaggcttgcccctccgaccctccgtgaaccagcccaccagtcactgtgcatgactcgcacccaggctgctggcgctggggcgcatgacggacgtgctgctggccaacacgcagcgcttgcaggacctctgggccgtcttcctcaggtgatgtgttgagggagggtgatcgaaggtcggcgctgtcgagggccctgccgcctgtacatgctgcgtgcctgatgcacgaacccgctcctctgcagggcctgcacgccgctgcgcccccactccccccctcgacgcgttctccctgctccccccaaccccacagccacgtgctggaggtgctggccgctgcccagcccagcgcgcgcgtcgtggtggtggaggcgctgggccgcgtcgtgtccggggccctggcccggatccccgccgccgcggccgcgcccggcggcgaggcccccgccgcggccggtgcgccccctgctccaggccctccctcgggcctggagcacatgctgctggtctcgctggagtcggtgtacggcggggagcgggagccggaggtgcggcgcgcggtgctgcgcgtgctgctgagcacgctgcagcgccacggcgagcgcctgggcggcggctggggcgccgtcttccgcctgctggcggccgtgccggaggcgcgcgacgccgctgccaccgacctcggcttccaggcagtgcagctggtggcgggggactttgccgcagggctgggggcggcacgcctccgccgctgcctggaggtggccgccgtctacggcgcgcagcaggtgcaggggccccagagggggtgggtttgtggggcatgcgtcggtgagaaccgaggggttggggcagagggcggtggccggggagaaggaggaatcggagcctggagtcccagaccggccctggggatcgagctgaggacccgagtgcaaggacctggtgggctgggcaccccccccgcctcctcgtgtcccagtcctgtgaggatctgcaaaccgttcccccctcggcaagactgcatgcctgctcacaccctccaccacacaggaggatgtgaacgtgagcctgaccaccatcagcctgctgtggaacgtggcagatctggtgggcagggccgcgccggggtccgaaggcggcgcccctggcggcggcacagaggaagaggccgtgtcgccgggggcgggcctgcgcctgacccaggaggagggcgatgtcatcctggagctcatcttctcggccctgcaggcaagtctggttgagatggggagagatgtgcttgtgggggctggcgggagcgtttaagggggatcgcagggatccctccacacccttgcacatggacacatttcccctcgccctccccctcataccaccagggcctggcctctgacccacggcccgaggtccgcaactcgggcctacgcaccctgtttgcggtggtcatgtcgcagggcggccggctgtcgcgcgcgcggtgggaggcctgcctctgggacatgctcttccccttgctccgccatgccttccacatgtcggtcaccagcagccgcgaggaggtgggtgacgcgagcagctttggggtgctgtgactcacggctgtgctgtggcaggaatcttgattgaggactacggcagggacgatggatgaccggcccagggagggaacgagggaccggaagcgggtcttctggatgactgggcgccagggcgtgcctgcaaggcccctcccaaggggcccctgggcaaccaactctcgacctctctttccccccttgctgtctcagtctggccctgccgccctggggcgctcacgtggcgagaccgtgcacctggtggtgcaccactcccacaacagcgaggccaagcagtgggacgagacggtggtgctggccctgggcggcatggggcgtctgctgcgcgcccacctgaccctcatcgtcaccctggaccagggggaggcaggtacttgatggtgttcgttttcgaggggggtagcagccggggggatgaggttgtcagggtggacagatgcaggcagggcaggggtggggaggtggaggggaggcgctgggtgggaaccgcacatcgagagccctggacgtgacggcgcaggctgggcagctgctcctgtcggatgctggcatgccctggatacatgcaccggggctgtcctgccggcccatgtatctgcccggctggctcgtgctgccctgttcccaaggctgtcgggcacgctgtgcagtacgccgcgcgcagggaacccatgccctggctccgttatggccagctccgtccaggaggcttcttcacaaaccccatcccccc

SEQ ID NO: 44313 - DNA, 459 bp, Chlorella protothecoides
  modified_base (222)..(351): a, c, t, g, unknown or other
cggcgaggtggaggcccggctggaggccgagcagggcgcgggcgcggagctgcggcgagagggcgaggccctgcgcagggccctggcggacgccgaggctcgggccgaggcggcggccactgacctggccggcgcggaggccgcagccggcgcacgcgaggccgcgctgcagtccgacctgggcgatgtctcgcgcgagctgctggagcagaagcgggggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcgcatcgtgcagtcagcacgggaggagatggccgaggcgcgggcagccgcggaggacgcacggcgcgagctccgtgcggaggccgaggcacgcgccgccgcggaggc

SEQ ID NO: 44314 - DNA, 61 bp, Chlorella protothecoides
gccccttgctcaccgacaccagcggcaggggggggggcaggagcgtctgcacggtgcgtgt

SEQ ID NO: 44315 - DNA, 85 bp, Chlorella protothecoides
gggggactccctcctgggccaggggcccacgcgcctgcacgacgctgagtgacgtccgaggggagaggggcgtgtctcttcgccc

SEQ ID NO: 44316 - DNA, 61 bp, Chlorella protothecoides
acgtgaggcaggcacgggtcctcctcccccggccgcctgcacaccggccgccccgccgcct

SEQ ID NO: 44317 - DNA, 108 bp, Chlorella protothecoides
tcgggtgcgcagggtggacggcggcgtgggggggggagaggggcggttgcgcgcccgtctgtgcagaccggagggggaggcccttcggagtgcgggcctgtacggcgc

SEQ ID NO: 44318 - DNA, 61 bp, Chlorella protothecoides
gtgtcgggaggagatgccatcggcttggagggagcatgagcaaaggtatgtgcccaagatg

SEQ ID NO: 44319 - DNA, 125 bp, Chlorella protothecoides
cgggccagcgatcgccgcgcccggcggcccacgcgccagcatgccacccaagtgcgcgccggccaggcccatggaggccagcggcgcagtggcctgcgttcctggccccgcccccgccgccgggg

SEQ ID NO: 44320 - DNA, 62 bp, Chlorella protothecoides
agggagggagcaggtgggaagggggggggggtggacgtgtggaggtccagcagggaatgagt

SEQ ID NO: 44321 - DNA, 1501 bp, Chlorella protothecoides
  modified_base (159)..(168): a, c, t, g, unknown or other
  modified_base (721)..(730): a, c, t, g, unknown or other
  modified_base (996)..(1077): a, c, t, g, unknown or other
  modified_base (1289)..(1298): a, c, t, g, unknown or other
acggggcgtcgcccgcgccgacgggggcggccgcgacggccgggccgtcgccgggcacaggcgacgtggacatgcaggagcccggcgccgcgccggccgggaccgagagccccagccccggggcggcggccagtcagccctcgtacatggagttcctgnnnnnnnnnncgacggcgcggcgccctccttcgacggggcgtcgcccgtgtcgacgggggcggccgcgccggctgggccgtcgccaggcacaggcgacgtggacatgcaggagcctggcgccgcatcggccgggaccgagagccccaaccccggggcggcagccagtcagccctcgtacatggagttcctgaccacgcaggtggatgagcacgagcccccctcccccgcagcgccggcggcagctgccgccggcaccgcggaggaagagctgtatgccgcccaagagcggctggtgctcaccgagttccgggagaccctgcaggtggtcctgggtgtggcgggggtgatgcctggagcgcactgccgctgtgcaggagctgctggggaatccagggttcacatccagggctgcttctcgggcctcggtggctccctgccacggcatggcaaccaggacctggggcatccctccgatttgcccctgcactgctcctccgctcaccacacccccacccgccggcgcagatggtagcgcgagtggtgggcgacaaggcggcgcgcnnnnnnnnnncttgcccctgcactgttcctccgctcaccacaccccctcccgccggcgcagatggtggcgcgagtggtgggcgacaaggcggcgcgcaagcaccgggagctggtggccaacaacgtgctggcggcggcggtgtccgctcaggcggctgcggcgccggggcccggcacgcagcagcacctccggggcgcccatgtgccaggtgtgccgcgcctgcctgctgcccggaccagcggcggaggggttgtttcgagcgcggggcgtgcagnnnnnnnnnnnnnnnnnnnnnnnnnnnnnnnnnnnnnnnnnnnnnnnnnnnnnnnnnnnnnnnnnnnnnnnnnnnnnnnnnngacaggcttcaggaacccggggggcgccatgctgtcccatgcctcctcccagcagcagcagcagcagcagcccgccccgccccagccccaccagcagcagctgatgttcatggcggcggcggcgcagcagcaggcggcgagcatgctgcagcccgcgcagtaccctcctccgctcgggcagcagccgcagcagcatgccgcctcgccatgannnnnnnnnngagtggacggcgaaagggtttggttggaggtgcactgcccaaaccagcaaagtacgccagacgggcggaggctgtgaggggacctcgcgcctgggccccggttcgagcatcccctgcacgccccgcgctcgaaacaacccctctgcagctggtccaggcagcaggcaggcgcagcacacctggcacatgggcgccccggaggt

SEQ ID NO: 44322 - DNA, 80 bp, Chlorella protothecoides
tcgcagtcgtcgtgtcgtgaggcccgcattgtgcccgctccgcggccgcagcagcggcgtgcagctgggggcacagggcg

SEQ ID NO: 44323 - DNA, 73 bp, Chlorella protothecoides
cgcgagggcgggggagggcgccgcgccggccgcccccgcccctgcgcctgggtcgccctcctccgcctcgtcc

SEQ ID NO: 44324 - DNA, 61 bp, Chlorella protothecoides
acactgtgtgtctagatcacttcttggcgggcgcagtatattcacatacaccatcacgtgc

SEQ ID NO: 44325 - DNA, 78 bp, Chlorella protothecoides
cgtcaggcggtcagagcgccccctggatgctgtcagaccgatggcatggagggtccggatgcagaattcctgaagctg

SEQ ID NO: 44326 - DNA, 1802 bp, Chlorella protothecoides
  modified_base (157)..(306): a, c, t, g, unknown or other
  modified_base (576)..(585): a, c, t, g, unknown or other
  modified_base (745)..(762): a, c, t, g, unknown or other
  modified_base (1281)..(1290): a, c, t, g, unknown or other
  modified_base (1375)..(1384): a, c, t, g, unknown or other
cggcgcccccgcgcggcgcgcgccggcggcggccagcgccggcgccgcctccatccactcgtagccgtcgggatagaaggagaagctgaccgcggagcgcaggtcggcaccatgcaccggcgcgctttgcccgctgcgcacgcgcagcgtctgacgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagcctcgcagtcccgcgccccggcctccgccagcgggctgctctccagcgtgaccgcaaaccacaggctggacgcctccgccgccgaggctgggggtggggctctggagatcgaagcctccgcttgcgagccgtgcgtgtcggcccccccggcatcggggccggccagcggggcgcagcgcaccagccgcgtcaccgcctcgtccaggcagtccagcaggacggtgtgtgtgcccgcgcccgcgccctcgctccagccgtggctgggcgnnnnnnnnnnactcgtccaggcagtccagaaggacagtgtgtgtgcccgcgaccgcgccctcgctccagccgtggctgggcgggcctgcgctgtgggccggggagttgcgctttccagccttctgctcggcgacagctccctcgccggcctccccctcctcctcgccggnnnnnnnnnnnnnnnnnntccgcactcccccggcgcggggcgcaggaggagctgggaccccgaccggtcccagccgacgggcaggggcagggtggagccggacgccacgacgcccaccaccctcggagggcggggcgcggggggcgcctccagcaccagcgaggcctgcggggtcaggccccggcgcgccgaccccgcacgcacgcgccgtcgcacccagcgccgcacgcgcaccgtatcgctcggggagggcttgtacgcgccggctggaagggttggttgttccggtgtgagcgagtgtcgagcagcgcgggagcatccgtacgagacatagaggtggtgatgttctgtgccgcagtcccaggcgtgctggatgcaaacgtcgccggcagcgctctcctgtctcgcgtgagacgctgctgtgcatcaaggagctccctggcccccattcagcagcggcgggatgtcgccactccggatcacagtcaccccagcccacctcctctcgaaccccccccccccccccccccccccccnnnnnnnnnnatgttccagtgtgagcgagggtcgagcagcgcgggagcatccgcacgagacatggaggtggtgatgttctgtgccgcagtcccannnnnnnnnnggacacgggaaaagtccggggcgtagacccagccctccttctcacccgcggacccgcggtccagctgccagccgctgtcccactcccagccgcgcggcgggtcgacctgggggaagtcgtcgcggcgcgcggtgccgtgctcaaagcgcgcggggtccctcgggtgcagattggaccccgcccagcccacgcgcggccgccagcgctggtgctccagcacctcttccacgacaccggcgccgttgcccgcgctgccagcgccggcgtccgcgtccggcgcctcgcccagcgccacctccagcgccagggccgtcgtgttgcggacgacgcacagcgtgcgcagcgtctcgcgccgcgcgccggcctgcacgcccgactccagcgccagcgtctcggcgcccaggcgcacgggcacggc

SEQ ID NO: 44327 - DNA, 61 bp, Chlorella protothecoides
cggtcgagactccatccgatgcaacgcagccctgatcggaccgaggggcgacggatccagg

SEQ ID NO: 44328 - DNA, 76 bp, Chlorella protothecoides
agtggtgaccgcggggccaggcgcttccggttccgttccatccccgctcgcagcagccaccctgcccagcagcatc

SEQ ID NO: 44329 - DNA, 99 bp, Chlorella protothecoides
gctctggccgcggcgctgacgcacctgggcggtgccgtgcgcgccgacgcgctgcgcagcctgcaggcgctcgccgaggccgcgccggccgcgctgggc

SEQ ID NO: 44330 - DNA, 810 bp, Chlorella protothecoides
  modified_base (136)..(255): a, c, t, g, unknown or other
  modified_base (500)..(551): a, c, t, g, unknown or other
  modified_base (713)..(722): a, c, t, g, unknown or other
gcgccgcgcggcgccagcctggcgcaggaggtgcaggagcaggtggaggccggggccgaggacggcgcgctgctgttcgggcagcaggccatacgcgaggccgaggcggcggccgctgcggcgcggccggaccgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgcagtccgccttcatgagggcacgcgcgcaggagaaggcgcgcaagctggcggcgggcgggccacgtcctaaggagggcgtggaggccagaggtcgggccgggtgggggtgggtggtggtgaggggtccgtgggtgagggtcactcctgcctgtgcaggtgcgtggggtgtttacactgaggccagcatccgtgcagcatttgcttgccgcgacccgggactgtggctcgggggcaggactcgnnnnnnnnnnnnnnnnnnnnnnnnnnnnnnnnnnnnnnnnnnnnnnnnnnnncaagcggcacgactgtggggtggcgccacggtgtcggggtcgaagggctgcctaaactctcggagataatgtgccgcttgagtgccgcatgccaaccattctcctatcgctgccccaatcagccgcaggcagcgagggccagggcggcaacgccacggccannnnnnnnnntcgcttgagtgctgcatgccaaccattctcccatcgctgccccaatcagctgcaggcggcgagggccagggcggcaacgccacggcca

SEQ ID NO: 44331 - DNA, 73 bp, Chlorella protothecoides
acggacgtcgctctgagctcaccctggggaagtgtgggtttgggagtgagatcgtggcagggagtggactgga

SEQ ID NO: 44332 - DNA, 695 bp, Chlorella protothecoides
  modified_base (147)..(227): a, c, t, g, unknown or other
cacccccccccaacccccaccccccccacacacattgttgcccgcagtgtgcacctcactgggcccctccttcacgccccagcttaacatcatctacctcgacatgctggcggtgtacaagtgcgtgtgcatgggggaaaggaaggnnnnnnnnnnnnnnnnnnnnnnnnnnnnnnnnnnnnnnnnnnnnnnnnnnnnnnnnnnnnnnnnnnnnnnnnnnnnnnnnncggcgtgagcaggcgtactggtccccgggcgcgtccggctcggtgccgggctgaggagcgtacctcgccctggggggtgccctggcgccccatgggtatccccagcccccagctcctccctctcctgaccctccttgccccccacccacccacccacccacacactcaggatgtactcggagctgatcagcgtggccatcagcacgggcggcccctatgcggccaagaccagcacggtgaagctgatgcgcagcgtgaagaaggtcacactccgcttgatcgaggcatttgtggagcgggccgaggaccttgcgggcctggccagccagcacgtccccgccctgatggacccggtgctgggcgactacgcgcgcaacacgcccgacgccaggtgggccttggcgggggagtttggtgggttggcgggtacccgggcaggggagtggggggccagggtgggagtggggg

SEQ ID NO: 44333 - DNA, 61 bp, Chlorella protothecoides
gggggttgaggagcctgtggcagctcagaggtttcgatctgagcagtggcgtgcgcatgtc

SEQ ID NO: 44334 - DNA, 61 bp, Chlorella protothecoides
gacgtgcatgaagcacccacgcatgaatggtcacccacgcatgaatgggcatccacgcatg

SEQ ID NO: 44335 - DNA, 61 bp, Chlorella protothecoides
ccgtgaatggccagatggtcatcggcagggggcggcacattggccacccagaaccaagggc

SEQ ID NO: 44336 - DNA, 542 bp, Chlorella protothecoides
  modified_base (118)..(199): a, c, t, g, unknown or other
  modified_base (300)..(410): a, c, t, g, unknown or other
cagctcgcccgccagctcggccaggcgcgccaggcgcgcctcctgccagctcagcgcatcggggcccagcgtgcagcgcagcaggcccgcccgcgcctggaacagcggctcccccccnnnnnnnnnnnnnnnnnnnnnnnnnnnnnnnnnnnnnnnnnnnnnnnnnnnnnnnnnnnnnnnnnnnnnnnnnnnnnnnnnntcggtgcgcggcggaccagtcctgctcggccacgggcacgggcgcgcccatgtcgaaggacggcgccggcggggcgtcgacgaactgctgctgctgctgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacccgccccggcgctcgccggccagttgccgtcctggccggggaagccctccggagcgccgacggcatcggagccgcgcgcggccgcaccgcagagcctcgggtcggccagtgcagcgcgggcgcgcgcgc

SEQ ID NO: 44337 - DNA, 747 bp, Chlorella protothecoides
  modified_base (109)..(118): a, c, t, g, unknown or other
  modified_base (599)..(660): a, c, t, g, unknown or other
cgcccccccccgagtgacaagccacgccgcccgcgcccgcgccccgcacgcacctgctgcacatacacggcgtccatctgtggcctggcctgcacatgggcccccggcnnnnnnnnnngaacggcccgggaacacggctgtgcggcgagcagctgcgagctgagcgtcgacgacaccccccgagcgacaagcggcgccgcccgcgccggcgcctcgcacgcacctgctgcacatacacgtcgtccatgtgtggcctggcctgcacatgggcccccggcggcggctgccactgctgctgctgctgggccggcggggccccgccggcgccgggcgcgcgccccaggtcggccacacgctcctgcagcagctgcagcaggttccggcccaggtctggcgttggggttgggttttttttgggggggggggtgttcagaggggtggtgcacgggcgggtgcataacgcggcggcttgaagacgacgcgagacggccgttcgcaccgccccgtgcctggcgcgacgcgcccacgagcgatcaagaccacgatcagacggcgtggatcaggcgcgcaccccgcctcaccagccctgcacccccacnnnnnnnnnnnnnnnnnnnnnnnnnnnnnnnnnnnnnnnnnnnnnnnnnnnnnnnnnnnnnnccgcccgcgcgacacccaccgcccgcgcgacacccaccacgcaccattcctctgctgctgctgctgctgcaggggcatgtccgctgg

SEQ ID NO: 44338 - DNA, 3608 bp, Chlorella protothecoides
ctgtgccgctcccacctcccctcaagcgctccccacctccaatcaagcgctccccacctccaatcaagcgcttcccacctccaactacacgctccccgccttcgcccaaaggctcctggcctccatccaagcagtccccttcgcccccatccccctcctcgccgccaccggaacccccgacgccaccagcatacaaagcacagggcacggtcatgttcagttcgtcaagcgttgtgccattgataatcactttcaatctgagcaccaacttccgtccaaccgcaatagaatttacactattcaacgaatactacgtaccctactacatgcgtgacatgcaacccaaggacagctcattttcttacacgctagcccttgcagaagagcacccggagctgcagtcccttgcaaggtatgcaactgccatgacatacgccgcaaacaccaacctgtacacggtggtcacactgacccggctgccaacaccgccaacccccgccacccctgcttgtgtacctggctacacgcccgtgaacagcaaaggagtgtgcgacgacagcaacgccgtcccagcactctgtcaagataccgcccccactgcctactgcgcaaccggccccagccctccgctgttgatgtgcacaacctataggtcccccatcgatggcaagtgcaccagcttgccaaggaccccgttcctcaccctgtgcacgagggaagacactcgtgggagtacagcaatgtgtgtggaagcacccactgcacaacccccatctcctcccccaccgccacccagccaagtcttgtcctccccaagtggcaccctggcctggtctggcttacacttccacttcattgtcgacactgggagctatacagcatcgtatctgacagtggtgttctttacatctgacgacactctgcttgcatcattcaacccgaattccaagtccgccgtgactgaaaaaacgctcactgcacctgattttgctgcgaagctcttcgcatatgcaaaggtgggtgccacgatcaatggaccgcccgagcagcattccgactttgcactgctcaccctggtggagacctcctccccgccctctccttagccctctcctttccccctccccttcacctgtacctgagcctgcccctctgtttcctcctgccccaacccgagtcagtccttccacatactctaaaccctgcatgattccttccctccgcctcctcttacgctcccacgcccctttcttctgggtcatcggactgcaaagttatggttgagatctgtggggccacgggagcgacagacgccgccaccaactgacggaagtgcagagtgcgcgggctcttccccccgaacgatcggacagcacgcggcatctagacgcttcagtatcctcaaatccagacaccgaacccaaggcgtgtctgacattctcatcggcatcattgtaagtgcctccagaccgctgagtatattcacccatgctctgggtgctacgtgacgccatacggtgcccggagacgtgagctgatgcacctccctcgaataggtggataaaagcattccccgatcttatttaggagcaggagtccgtgggccaatgcatctggctgggtggaggctcaaatgatgataaggtgcgacagaggaagtcgtttggaacaaggttccccgcggcaggcagcctcgacgtgtcaccggagatgcattcagtcagctgtctgcaaacggtgtgacaccagtcccaacgtctgcctgcaggatcacttgcttacgttgacgattgaaacatgatggcgagccttgcttagcttgcagaactcgatgacgacaacgcagagtcaactttatgtatatgggatattcatcaacgcagtggtggaggctgaagccatcgtcgccaagcagatgccgaggtcggtggtatcattttgatgaaatcgagtcgcgacgcctgggtgagaagtcacgatgaaaattgaaaattaagatgctcgtggctccggatgggcacgatgccgacgtgatgctgctccgtctgatggggaaaggatggccaccggacggccgctgcttcacccattccatacgcggcagggaagtgaaatgaggagatgtacgttcgccttgcataggtttcctcctctcgaccacacgagtgctcaacctcctattggaaattgcttgaccacctaggtggtagtagctatcatatctcagccagggtttgcacgttgaaatggcgccgcaatctcggccacccctttggatcacaatgctcctcctgttgggcctcggtgtgctctcaaaggtgcgaataatgtatgctattggtattcatgatgtgctgtcgaacttgaaggtggggcctactcaccaagaccggctggttttactcccagattctcaccctccaccccagggcgcatgcttgtcaaagttcttctcactgccggttgtcaagtgagttgatgccggagattcctggcttgtggtgctcgcggctcgcccctaaagagtgcggagcctgaagtgcgatgtgtacactttccgctgctcatgctttccgcacgctggtacgtacacgcaattgacctcgccagatgcgcctttccctaccgataggtacgggcctcatgtctatatgctggaggtcggtagcgcggataacatttgcaggtgcgcaaagctttaacctttgtcgtggttggggtgcgtaggatggtgccaagaagatgccacgaggggctgactgtatgagagcgaccctctcctaccatgcccaacaggtggatgggctacagcaaggcgggctctgctaggtcaagcactctcacggaccttggtttgtccgtcgacgccatcaagatgcgtccctttgaggtcatcacggcgcgatcctccaagattttggtggctgtcgagtgcctcaaggctggacagaaggcttgcaccgcggacaaggatggcaacattggaactgggaacaagggcaagaacaactttggcaacaagaatgtgggcgacaacaacatcggtgagcatgatgggacagtcagatctgctgcaaatgaataattgcgctccaggacctggaggtggagacgcgctgcaccaggggctcccttcagctccaaccttttgaccctggaatgcgcagggagctctaacactgggaactccaactggggcgacaacaataggggcaccaggattcgttgtaacaatgcgctggggatccagaaggtccccaacgtttgcaatctgaaggaacttggcaagtctgtgctcaggaactacaatcagccgccaccgtcccccccaaagaagtccccgccaccgcccaagaaggcgtccccgccgccccccaagaaggcgaccccgacccctcccaagaaggcgaccccgacccctcccaagaaggcgaccccgctgccgcccaagaaggcgtccccgacccctcccatgaaggcatccccgcccccgctgaatttcggatcagatcccggaccaacaccttccagtgctccacccccttctcctccttccccctctcccatcccctctccccaactcccaccatcccccccccccccccccc

SEQ ID NO: 44339 - DNA, 64 bp, Chlorella protothecoides
ggtcgctccctggtgtggcctgggacctgctgcgccaggacgagtcgtgtggcgccgctgccga

SEQ ID NO: 44340 - DNA, 61 bp, Chlorella protothecoides
cctgtgtaatggcatgttaaagggctggggggcccaaacacgccgcggaggagcagtaatg

SEQ ID NO: 44341 - DNA, 85 bp, Chlorella protothecoides
cggggtccacacgtccacgtagtgcccgggggtgtcgagcagtctgggcaccccggggtcgatgtccgaagcgccccccccctcc

SEQ ID NO: 44342 - DNA, 61 bp, Chlorella protothecoides
gtatggagttttgctttctggacccgcggggatatagctcttaggccaggggatgacaggc

SEQ ID NO: 44343 - DNA, 61 bp, Chlorella protothecoides
aatcttgcggacttgatgaaggcttgagtgggtagactgtcaaccatcgtccagtctcgat

SEQ ID NO: 44344 - DNA, 640 bp, Chlorella protothecoides
  modified_base (93)..(254): a, c, t, g, unknown or other
  modified_base (418)..(517): a, c, t, g, unknown or other
tgcgcccgccccgcgccgccccaggcgcctccggctcggcgtccgggatgccgctgagcaccgcgcgccacgacggcttgggtcccacggccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacgagcgccgcgcctggcgcagggcccgcaggggcagccttggcgggggccttggcgctctgcacgtcctttgcccccgcccgcccctgtcgctgctgctgctgtgccaccgaggccggcggcgggggtcggggcgcgatcacaacgccgccagaccgttggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcgcgggcgccgacgctacgagagtgccagcgctcggcgcctcttggacggcgctaggcgctgcgacggggcgctcgggcgtctcctggacggacctcggcgctgcggcggggcgctcgggc

SEQ ID NO: 44345 - DNA, 61 bp, Chlorella protothecoides
cgagaggagtggagatcttgggacagctcctgccgagccgccagggccggacctggcactc

SEQ ID NO: 44346 - DNA, 61 bp, Chlorella protothecoides
ggcctgcgtcgctggggctgtggcaggtggtgggacgatctgtgccccaacaagtgaagag

SEQ ID NO: 44347 - DNA, 61 bp, Chlorella protothecoides
agagagcactgctgcggacggcgcaggagggcgccaagggcatggcctacatccacagcca

SEQ ID NO: 44348 - DNA, 61 bp, Chlorella protothecoides
gcaagcatgggtggacggcagaggggcgggggcagcgtccctgcctggcacactcctctgc

SEQ ID NO: 44349 - DNA, 61 bp, Chlorella protothecoides
ttgggaggcacccgtgagagcggctgggggggcccctcccttctcacaggcgatcgggtat

SEQ ID NO: 44350 - DNA, 26921 bp, Chlorella protothecoides
  modified_base (164)..(395): a, c, t, g, unknown or other
  modified_base (692)..(701): a, c, t, g, unknown or other
  modified_base (1186)..(1195): a, c, t, g, unknown or other
  modified_base (1536)..(1545): a, c, t, g, unknown or other
  modified_base (1901)..(1910): a, c, t, g, unknown or other
  modified_base (3033)..(3042): a, c, t, g, unknown or other
  modified_base (3398)..(3407): a, c, t, g, unknown or other
  modified_base (4334)..(4343): a, c, t, g, unknown or other
  modified_base (4619)..(4628): a, c, t, g, unknown or other
  modified_base (4702)..(4711): a, c, t, g, unknown or other
  modified_base (5298)..(5307): a, c, t, g, unknown or other
  modified_base (5483)..(5521): a, c, t, g, unknown or other
  modified_base (5979)..(5988): a, c, t, g, unknown or other
  modified_base (6234)..(6243): a, c, t, g, unknown or other
  modified_base (6605)..(6614): a, c, t, g, unknown or other
  modified_base (7176)..(7185): a, c, t, g, unknown or other
  modified_base (7681)..(7690): a, c, t, g, unknown or other
  modified_base (8188)..(8197): a, c, t, g, unknown or other
  modified_base (8565)..(8574): a, c, t, g, unknown or other
  modified_base (8639)..(8648): a, c, t, g, unknown or other
  modified_base (9329)..(9338): a, c, t, g, unknown or other
  modified_base (9732)..(9741): a, c, t, g, unknown or other
  modified_base (10009)..(10018): a, c, t, g, unknown or other
  modified_base (10246)..(10255): a, c, t, g, unknown or other
  modified_base (10496)..(10505): a, c, t, g, unknown or other
  modified_base (10568)..(10577): a, c, t, g, unknown or other
  modified_base (10634)..(10643): a, c, t, g, unknown or other
  modified_base (11037)..(11046): a, c, t, g, unknown or other
  modified_base (11397)..(11406): a, c, t, g, unknown or other
  modified_base (11724)..(11733): a, c, t, g, unknown or other
  modified_base (11815)..(11824): a, c, t, g, unknown or other
  modified_base (12202)..(12211): a, c, t, g, unknown or other
  modified_base (12614)..(12623): a, c, t, g, unknown or other
  modified_base (13053)..(13062): a, c, t, g, unknown or other
  modified_base (13598)..(13607): a, c, t, g, unknown or other
  modified_base (13884)..(13893): a, c, t, g, unknown or other
  modified_base (14130)..(14139): a, c, t, g, unknown or other
  modified_base (14274)..(14283): a, c, t, g, unknown or other
  modified_base (14345)..(14354): a, c, t, g, unknown or other
  modified_base (14835)..(14844): a, c, t, g, unknown or other
  modified_base (15085)..(15094): a, c, t, g, unknown or other
  modified_base (15376)..(15385): a, c, t, g, unknown or other
  modified_base (15717)..(15726): a, c, t, g, unknown or other
  modified_base (16399)..(16408): a, c, t, g, unknown or other
  modified_base (17102)..(17111): a, c, t, g, unknown or other
  modified_base (17516)..(17672): a, c, t, g, unknown or other
  modified_base (17776)..(17785): a, c, t, g, unknown or other
  modified_base (17866)..(17875): a, c, t, g, unknown or other
  modified_base (18845)..(18854): a, c, t, g, unknown or other
  modified_base (19400)..(19409): a, c, t, g, unknown or other
  modified_base (19570)..(19579): a, c, t, g, unknown or other
  modified_base (19889)..(19898): a, c, t, g, unknown or other
  modified_base (20122)..(20131): a, c, t, g, unknown or other
  modified_base (20735)..(20744): a, c, t, g, unknown or other
  modified_base (21641)..(21650): a, c, t, g, unknown or other
  modified_base (22343)..(22352): a, c, t, g, unknown or other
  modified_base (22499)..(22508): a, c, t, g, unknown or other
  modified_base (22673)..(22682): a, c, t, g, unknown or other
  modified_base (23033)..(23042): a, c, t, g, unknown or other
  modified_base (23169)..(23178): a, c, t, g, unknown or other
  modified_base (23923)..(24038): a, c, t, g, unknown or other
  modified_base (24101)..(24110): a, c, t, g, unknown or other
  modified_base (24173)..(24182): a, c, t, g, unknown or other
  modified_base (24333)..(24367): a, c, t, g, unknown or other
  modified_base (25352)..(25361): a, c, t, g, unknown or other
  modified_base (25941)..(25950): a, c, t, g, unknown or other
  modified_base (26417)..(26426): a, c, t, g, unknown or other
gggcagccgccagcgcagacctcgcccggcgccgacgccgccggcgccggcgcgccgcgcacgctgtcgcgccccctgccctcgggctccctttccctggcctccgaggcgagcgcatgcctgagcggcacactgcaccgaccccggcccatgcatgccgcacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggcgagggcgcggcctccgccgccgtcgccgcggagctggcgcggtgcctgcagcaccaagcctgccgggcgccggcggaggtcagggacaaggcgccgctctgcggcgaggcctggcagccgcgggacgtcgcccgcccgccggcagaggacgcctggcagccgccggcggtgggcgcctggcagcagcagctggacgcctggcagcagccgcagcacccggatgcctctcagcagcgcaacctggacgcctggcagcagccgcacctggacgcctggcagcaggtggactgctnnnnnnnnnntggatgcctcgcagcagcgcaacctggacgcctggcagcaggtggactgctggagcacgggccgagtgatgccccctgcaaccgcgccggccccacagcacgactggcgccgcggcgtgccggcttcaacactggccgccgcccgtcacgactccaggcagtatacgcacgtgcgccacctgctggcctccgtcggccgcgcctgagtgcggcgcgactcgcccatggtccgaacgtgaggacccaaatgcttgagcccccatggcacccatgcgcgcgcggacagactgccgcccgcaccttgtaccttcacctcggtttttgtccccttgtgcaccaccgcctctggtgcaccaccgcctcttgtgcaccaccgcctcttgtgcatcgccgcccccatgcggccttgcgttcccccacccctcgcccttacttggcatgtgtcgagccttgcagtcccccgtcacggaaataatccccgagannnnnnnnnntcaccgcctcttgtccaccaccgcctcttgtgcaccaccgcctcctgtgcaccaccgccccttgtgcatcgccgcctcttgtgcatcgccgcccccctgcggccttgcgttcccgcgcccctcgcccttacttggcgtgcgtcgacccccgtagtcccccgtcacggaaataatccccgagacccctcctcgcccctcatccatgcctggctgtgattcgatatataccatggccaggccacactcggtggggtcgggggtagctcaggctgtcggttcaagggtcctcgccacagtctgtcctgccccgctctgcctgttggagccatcaggaggggccnnnnnnnnnntgcccctcatcaatgcctggctgtgattcgatatatagcatggccaggccacactcggcggggacgggggtagctcaggctgtcggttccagagttcttgccacagtctgtcctgccccactctgcctgttggagccatcaggaggggccgccatcttcactccctcagagcttgagcggggcgattacccgctgccgcggcaacccacctggaccctagagtcccccgtcaggctgggctccgcgcagaggcggcgaacgtcctcactgggagaggggagggtggatgggtcaggtgtggttggagaccgagggcgaccctagtacagatcatggccagggcagtccaggagcannnnnnnnnntgcgcagaggcggcggacgtcctcactgggggaggggagggcggatgggttaggtgtggttggagaccgagggcgacccctgcacagatcatggccagggcagtccaggagcacctcggctcgcactgccctgccccgccacccacctgccgatcagggcgtcctcgaagctggccccgtccaggttggctcccttgaaggtggcgcctgcgatgcaagggaagggtaggatgagcttggtatactttgagcggttccttcacatgcacatcatgcgccagggttgagcgcgcgcccagcccacaggatgcagagtcctgcacgcaggcgacctgcgaggcaccctcggcctgtcatgccgcaccagtgatcacggcgttggtaaacttggttcccgtaaggttggccccgtcaaagtccacccgatccacaacggagctggtcaggtcggcccctacaggagtggggatggcagaggatcaatgttatgtgagcggaggttccccaggcttacgtgcctggcttccctccaagtgtgctccatggcatcgtatccctcttcagccgcctcacccttgaagtttgtgccaacagcgtaggccttggacatgaccacctcctgcatctgggcgccagacaggtcagcattcagcaggagcgcgcctgggaggggagggtggctgtgtgcgtggctgaccatacactgcgctgcgatgcgcctgatgataggttgtggacgcaccaaagaccgcccttcaccccaggtagctgcaccccggtgtcagagcatgtccttgcaaaatgacgaaccccgccccagcagcactcttcgccagccctgcttgtcctcggcaaatccatcaatccccacaacctctgcatacctgacagcaccttccctttcagctccgcccctgggaagctgcagaagcggaggtccaggatcttgtcagacaccgcattggcctggccaatggtattgccggtgaaggccctctcgcagcgcagcggatctgagcggccaggggcggcatgctgaccattgagtatgcccacggggccaagaaggcatgcactcaaacccgggcactcaacaccaggcaggcaaaggaaccaggcagannnnnnnnnntggtcaggggcggcatgctgaccattgagaatgcccacggggccaagaaggcatgcactcgaacccgggcactcaaacaccaggcaggcaaaggaaccaggcagagggggttcccatgaatcaaacgtcgcccaacctgagtcgaggggtggcaggcgctggttagagccggcgtgcgcaggcgatgcttgcagggaggcggccaccatcagagctgctgtccatgacgccacgcggggaagggacaggttaaccaatggctcatgcatgcgccggcctgcggtacagggtgggcgggagctgtgagtacggatggattgaggttatcagattggacctagagtgcatgcatgcgnnnnnnnnnnaggcgggagctgtgagcatggatgggttgaggtcatcagattggacctagagtgcatgcatgcgaatctatgacgcacatggggccgtctggtggatgggtggtggggggcgggcgctcatgcggcctcctatctgtacattatgggccgtctgcgatgtgcaaggcgacatgctggatagcattgctgaaagatctctgatcagtttcgaatcggtgccgaggatgtcgagggagggattatatcgtcgcgactttatgtcgggacgcaaggaaatgttgtcggattcgggaccggtacacagcacgcccagcaccatctgaatacaaatcgtgagtctcgagcttacggccatcgcctaacctggtgtcgcgggcgcgctaccacacgtaatgaatcctgtgggttgtctgtggatggagccgggtcatcggggagcaccccctaacaccctcctccagtcttgacgagcaccttggcagtcactcgcacagctgcccgccccgaccgcttgggcgcactaggttcccgtgctgctcagattacggagcacatagccataaacaggctacgcctagtccatttaggctagttgcgacgatgggcgagtccatgacgcgtgattagagcctgcgcctacatcgctgatcagcatgggcacccccacacagtacaaaataggggggtgtgacgtggtcttcccccaccaggcttatggcgtccagctcagcttcatgaacaagtgtgttcagtccttggaaggtggtcggaatgccctcctggaagctcccacaggtagatggtcggtggaattccactgtaaggcgaaagacaaggacccttgagaagcagggtccgccggctgattgtaccaacctcgaagccctgcacgccatcactgcaggttctgggaagacgctttcgctnnnnnnnnnnacctttgacaagcagggtctgccggctgattgtaccaccctcaagccctgcacgccaccactgcaggttctgggaagacgctttcgctcctctgttcctcccttgcctggcagcagcgcgagaaaaagcggatcgaggacgggctaccctccgcctatcctccgtcggctgctccccctccagaggcgccggcccctggcctcgccacagaggtgacactcttggttggtcttggggtagggcctcatgtctttgtcacccatgcgacctgtgctnnnnnnnnnnctgctgccaagtctctgccatgcgtgactgaggtgcagccctttccctcccagcgccaacgcgattagacctcnnnnnnnnnnatttttttgggggggtagggcctccatgtctttgtcacccatgcgacctgtgctgctggtaccaatgggagaaaccgcgccatgctccacagcttctagctgtgcttcttgcacatatgctgccaagtctctgtcatgtgcgactgaggtgcagccctgtccctcccagcgccaacgcgattagacctcaggcctgtctcattcctcaacaccaccagggaggatttctcgaccctggcagtgaggcgccgggtgcgccgccagtgcgccgcaccgcccccaaggtgttttattccactcgaacccactcccagatagcccaggtggtggcagagctgcggcgcagcagctaccgaccccggatggcgatactggtgaggtgaaggggtgtgcaccggtctcagactgctgctctgcagcgagaccgggatgctatctgccagccttgcacagccgggtcccttcatctggtgcagcatgagcttgctactcagtgcgtgagcacctgttgcatgaaggattgtcagctccatcctggagccggggacctttggacctgatccctcccatgatgtgcttccccatcnnnnnnnnnnaagcttgctactcagtgcgtgagcacttgtcgcatgaaggattatcagctccatcctggagccggggacctttgaagctgatccctcccatgatgtgcttccccatcacgcaggcctccaagaagcactactgcgtcaacaagtttgcgctgagcaagccgtccatcgaggaggcnnnnnnnnnnnnnnnnnnnnnnnnnnnnnnnnnnnnnnncaatcagcacagcaggactcgtaaacctgcaggctgaagagtgatttgcagcagattccgggtttcctgccggcctttcacttcacaaacaccacacccctgcagtgctcatacttcaaggggacccaggccgtggtcagctctggctactccagcagggtgggtgctctttgtcggagggctgtagagtcatgacaagggacccacccaccacacttcatccggccctcttcagatgctgatcattaaagctctgcaggtgcacgacatcgaggagctgcggagctttgctcggggtcaaagggcctgcccatacttcctggcctccaagtggtccaaggtggtgggactgtgcatcgagatgagggtgggtgccgagcatctgccagcccctctggacctggcatgccatgacccctccccttgatctccctgcggtgcaggaggctgacatggtnnnnnnnnnngggccacggcccctccccttggtctccctgcggtgcaggaggctgacatggtcttcagcccctacagctacctggtggaccccgtgatccgacgggcgctggacatcagtgcgtgggctgtgtggctcgtgggggctggccgcatcaatgtgtttcattccacaacgatgtcagcatcgcaatatgggctggcttccctggtgccagggggcgggtgtccaggtcctacgcacccttctgcaggcnnnnnnnnnnagacatcagtgcgtgggctgcgtggctcgtatgggctggccgcatcaatgtgtttttttcacaacgatgtcagcatcgcaacatgggctggcttccccggtgccagggggcggttgtccaggtcctacgcacccttctgcaggcgtggaggggaacatgctggtcttcgacgaggcgcacaacatggaggacgttgcccgggaggcagcttccatgcaccttccagcacccgaggtcctagaggtaggtggtgggcagaggtgggggaccggcttcgcatggggcgggtgctcacggccactgcagcacagagtgcccggccggccccaagcccgctcttcgccacaaaaaccccactcacnnnnnnnnnnggaggggggggaccggcctcgcatgggggcgggtgctcgcggccactgcagcacagagtgcccggccgcccccaagcccgctccccgccacaaaacccccactcacaccccgcccgccgcgcagatacagacctccttcgcacgcgcggtcgccatgaatggcaagccagaggtttatgcgccgctggctgatgcgctgctcaggctgcacgagtggctggtggcgcgggaggcggacgtggcgcagggcgtcatccgcatccagaagcagaaccgctttgagaaggaggaggtggtgtggcaaggtccccaggtagggagggtggcggtggcgggggggtatggatactgtggttggggaccagacatatgttatttcagggggggttgaaggtcaggcccttgccgcaccctctattaacttcaaccgctgcacatccgtgccggcggccgcctatttagggaccatcgacgatccgcagccacctgctgagactgggcaatactgaggagtacagttgatctcatgtttcccctcttccccaaacacatcccccaaccnnnnnnnnnnaattcagggaccatcgacgatgcgcagccacctgctgagactgggcaaagctgaggggtacagttaatctcatgtctcccctcttccccaaacacatcccccaaccccctattcctgcagctgctggcgcacctcaaggacatggccctgggcgccgacgcggtggaggccctctgggtggcctaccaggcagcgcgtgcagaggaggaggcgatgcagcagagccgggggccccagggcgccagcgctccgggaccggctgcgcccggcgcccccccggtcattgctgagctggcggtgcgcgtcggggggaaggccctgggccagacctcccgcctcatccagatcctgaagctgctgcacgaggtgggggccgggaactgggcagtggccgatgcaaggcctgcctggggagggtttgggtgggtatgggaaggggttgccgaggctggcggggcaggagtacacaaagtacaccgcattgcggcctggaaannnnnnnnnntcgggaagagggcagtggccgatgcaaggcctgcctgggaagggtttgggtgggtatgggaaggggtttccgaggctggcggggcagggatgcacaaagtacaccgcattgcggcctggaaagctgcctcctgcggcgaggtaaagctcgagtgggtgccttgctcgggcagaatgcatgctctcttgctggccttgtgcctgctacccttcccctcatccacccgctccctcaggtgagcacggatgggtcaagagacttcaggctggtcttctccaggacgttcatgggggccgaggggcgacgaggcggcgccctacgcttcagacgtggagggtgagtgtggcaaggggtggtgggggatggcctatcactgcatgggcctgcaggacccttccccacatgtctttgcagcgcccagggtactcgccacccttgcgcatactttacgaaactgcatgtctccgccccttctccttccccctccctccgtccccnnnnnnnnnntgtgggggatggcctgtcactgcatgggcctgcgggaccctcccccacatgtctttgcagtgcccagagtattcgccacccttgcgcatactcttcgaaactgcacgtctcctccccttctccttccccctccctccgtccccagggacgaggctgggagccagtgggtgtctgccgtgtccctgtggtgcctgaacccagaggtggtcttcaagagcctgtcaggtacggtgaattgctggacctgtacacagctgccttcctccacctggctgccttcccagggcacctggggcccagcgcacccagcgcaagcgcttgatcccagcttcaacttgcactgcagagctggcgcactccacggtccnnnnnnnnnnaatcaaccacccgacatgatccccgacactgtgcccccttccagctgggcaccccctttgacgtnnnnnnnnnnagcgcctgatccgagcttcaactcgcactgcagagctggcgcactccacggtcctgaccagcgggacgctggcgcccctggaaggctttgcctccgaggtcagagctggcgcggtgcttcatctctgatgttgtgtgtgtgaaggggaggaagtggcgagtggtgtatgacagtggaatcaaagattgacccggaggctagcatctctatttttgaatctgccccctctccctggttgcctcttaccatgcccatgtggacgagctggctcgtgccggcctccttccctgatcaaccacccaacatgatccccaacactgtggccccttccagctgggcaccccctttgacgtgcggctggaggcgccgcatgtggtggacatggcgcgccaggtctgggccggggtcatcgggatggcgccctgccgcacccagctgaacgtgagcgtgcgcaaaggagcaaggggatacgggccagcggaccggtatgctacgcgctgatgccccggctctgctcacaagggacgagggagcgaccctgggccgacgcactcctgcaggcctggaccaagtctgtataccctgtgctggcccctctaacctcccagttacatgcatgcatttccccctctccccctctcctcacccctcccagggcgtgttccggaacgtgagtaccgnnnnnnnnnnatgtataccctgtgctggtccctctaacctcccaggtacatgcatgcaattccccctctccccctctcctcaccccccccagggcgtgttccggaacgtgagtaccgaggcttaccaggatggggtgggcgcttcggtgctggcgctggtgggcaccgtcccagacggcgtgctcctcttcttcccctcctactccttgctggagcgcctgacgcagcgctggcaggtgggcacgtggtggacggttgccgtgctgttcccaccgctcgctcgcatgcgtgtgctgcagcgcggccttccgcactctgtttccccagccgcgaactgccgctgcccctccccctccacccgtgcgccctgcaagccgccccgcagaccacggggctgtggaagnnnnnnnnnnagggacgtggtggagggttgccgtgttgttcccatcgctcgctcgcatgcgtgcgctgcagcgcggccttccgcactctgttcccccagccgcgaactgccgctgcccctccctctccacctgtgcgccctgcatgccgccccgcagaccacggggctgtggaagaggctggcctccgccaagcccatcgtcaccgagccgcggggtggaggccccgaggcactggcagaggtcatgaagtcatactacgacggcgtcgcggcggggnnnnnnnnnnggcctcttcatggccgtctgccgaggcaaggcgagtcttgggagcagcggggctggtgtcgaatgggaagtcgagcgctgggaccacggcatccgctcgtgcccactgctgcgagcacagcgagggaaggcatcgctgggtgcagtacatctggtcttgcacgctgtggtcatccccccccccccacacacacaaatctgcaggtgtcggagggcctggactttgcgnnnnnnnnnngtctggtcttgcacgctgttgtcatccacccaccccccccacacacacaaacctgcaggtgtcggagggcctggactttgcggacgccaacgctcgcgctgtcattattgtaggtctaccctaccccgctgcctacgacaagcaggtgtgatgagcatggatttgaaaggacagagcaggacaggggatgggttttaggaagaggtctatgtctggccgccaccttgccagggggttgccnnnnnnnnnnagacaggggatggtttttaggaaaaggtttacgtctggccgccaccttgccagggggttgccnnnnnnnnnntctgaaccctggtactgctgcccccgctccccctacctgtgggtgtactggtagttnnnnnnnnnngttttggggaaccgtgcttggatgcccatctgcttgttgaatctgagaggtgggaaaggtctaaaccctggtactgctggccccactccccctacctgtgggtgtactggtagtttgagctgtgccagcatgccttccccccactatatcctcaggtgttggagaagaaggcctacaacgacgccggcagggccaggggactgctctccgggtcagcctggtactcgcagcaggccttccgcgccctgaaccaggtgggcgcgggcggcgccgaccttgttgcaggcagtttgggataacagcgcagaggtctgggcaccaaccctgcatcagtcaccccccacgcattcctccgatcctctcgcaggccattgggcgctgcatccggcaccgnnnnnnnnnncacccccacccattcctccgatccccttgcaggccattgggcgctgcatccggcaccgcgccgactggggcgccatcgtcctgctggactccagatttgaggcgccggccaaccagcgaggcctgtcccggtggtgagccgcgggaggtgggccggcgcatgcgattgagggggaggggggcgctggcgcggggcgggcgtcgtgcggcgcggccgtcggtcaacgtcccagcctcgcctgccctgtcctctgtccgcacacacaatttcctcctcccccaaacactccttgcccggcacccagggttcgggggtcgctgacggtgcagcccagctttgatgcggccctgnnnnnnnnnnatccgcgcacacaatttcctcctccccccaaaattccttgcctggcacccagggttcgggggtcgctcacggtgcagcccagctttgatgcggccctgggctcgctccgcgccttcttcgagcgcctggcgtcctccccccccctcacgctgcggcccaagccggagcccgcgacccccgggccgggcgcggcgaagcaggaggccggcgggtgcgccggcggggggagcgtgcaggacatgggggccgtcctcgcccgtgcgcccctggcgcgctgggtcagcgcggacaccgcgtcgttcctcgctttcctggagnnnnnnnnnngattggagggggagtcttttatgggtgcgcagtggtcggtgtgaatgcccaaatcatgagccgtagtgtgcctgcagggttnnnnnnnnnnccccctgccgcgctgggtcagcgcagacaccgcgtcgttcctcgctttcctggaggcctccgggtgcaccctggcggcggtaggcgcccggtacgccagcctggaagccgtggcacaggacgccgtgctggactgctttgcggccgccaggtggggcagcgcttttgtgcgcggggagtgcgtgggtttggggattggagtgggagtctttcatgggtgcgcagtggtcggggtgaatgcccgaatcatgagccgtagtgtgcctgcagggttgattggtgatcctggggtgttctcctgattgtgaagaacgtccaggatccctctaaacgaccctgcacccccacccccaccctccagtgagtggctgggagacgnnnnnnnnnncgaagaacgtccaggatccctctgaacgatcctgcaccccccaaccccaccctccagtgagtggctgggagacggaaagaccctggagcagctggcagctgtctggaaaccctgcctgccgcggggcctgcttgccgtgatgggggccggagatgccgacgtggctggaggccaggtaggcagcacggggtggtgcgatgcgatgtgatgccaaggaagctgataatgccggccttacactgagccctgggtgcacatgctgtttctggccactgtttgggcccagggagaggaggcactgctcgtcctggcagagggtgccgccacccagacatctccaatcgcccccgttcctcaatccatcccccgcatcaagcatgcaggaagctgacgtggcagcccnnnnnnnnnnagggtggtgcaatgcgatgtgatgcgaaggaagctgataatgccggcctgacactgagccctgggtgcacatggtgtttctggctgctgtgtgggccagggagaggaggcactgctcgttctggcagagggtgccaccacccagtcctctccaatcgcccccgttcctcaatccattccccgcaccaagcatgcaggaagctgacgtggcagcccttgcacgagcgcttcagccctggaccttggcggaggtcatccctgccatgcgacaggcctaccaacaggtgcagcacgtgggccatccacgggggtgtcctctggcactgcgaaccccgcccttccagagagcacagggcccctgccactgaccaactgttgagatgcacacggtcatccactccagcagcgtgcctgcctggaccgactccctnnnnnnnnnntgtgggcggtcaacgggggtgtcctctggcactgcgacccccgcccttctagagggcacagggcccctgccactcaccgactgttgagatgcacacggtcatccactgcagcagcgtgcctgcctggaccgactccctgtgtcccttccctacaacttgcaggtgatggaggggcaggggcctgccctgcccggagcgatgctcccatccccagacctggcgcagcaatcgtcggtcagtcctgctttgggccagccttccaccccgctgggacaagggcccctccaaggaccgccggtcaaggcatccctcatctcggcgtactttccttcatcagcaggcaagccactgtcgggggggccgtggcatttgggctcaaggggtggttgtccacctctcaagcatgttgactgatcactcatcagcatcatgttctacgatacgccttctgctcgttcccgtacgatactatggcaccaccccatcctctctgacccgccctgcctgccctgcccgtcgcagagcaaggcaagcgnnnnnnnnnntgccccatgctctctgacccgccctgcatgccctgcccgtcgcagagcaaggcaagcggtatgtgcggtcaaaagctgctgcccaggccggtgcagccaggcggcagcaggaggacggccccggctttcaggggtctgcgaccctcgcagcgcggagcgctgccgcggcggctgccttgtacgagtgatggtgccttgtagagcgaacatgaccatgaagggcacttggaagaaaggacgtctcctgcatcggacagctgtccctcccgccctgtcnnnnnnnnnngatgaccatgaagggcagttgaaggaaaggacgtcccccgcatcggacagctgtccctcccgccctgtcggggatacggaatcctgcgtcagaccaactcaatggggggtgtctctgaaacggggaagcagtagtgtagtgtctcatttaatgtatgtagctcagaaatagcgtgcgtctgttagtatatcctcgttaccgagctgctgtaatgtactaacgtcaacccggtaacannnnnnnnnntggaaggtgtctctggaacgaggaagcagtagtgtagtttctcatttaatgtatgtagctcagaaatagcgtgcgtctgctagtatatcctcgttagcgggcttctgtaatgtactaacgtcaacccggtaacannnnnnnnnnggcggcacacggctggcagcgtaagccgctcctagcatgccagccccaggctcgggtgccgnnnnnnnnnnacccgggcccaagaacgcatcctgcgttgctggagctgggatcccctctgcgatagttcaatagtaataaattaaaacccaagaagatggatgagtgcatggaggtacagcagacggaccctttgcagaccaggcttgagcaggtgtgcaccgtcgatgggcttctgcactaaccctggtacatctccagcggcgagcaataacgtcgttacgtcctcgcaggtgtactggcaggagaacgaagacgcataccaccagcttctcgccgagtactacgcgaatggcggaatgcgggccgaagatgttcccatgctggaagcgacacacggctggcagcgcaagccgctgctagcatgccagccccaggctcgggtgccggcatggagccactccaccctacagaagcgggggagtgaggctctgaatgacccagaggccagtgcaaggcggaagatcgtcattcgggggccaggccctgtannnnnnnnnncctgaatgacctagaggccaatacaaggcgaaagatcgtcattcgggggccaggccctgtacaaatacagtgattactgcacatccaatttgctctcaagggccccatagactaaatcaatgtgtgaattttctatccagaccttgcatacccatccacagtgtgcccccgcacctgcagcagattcaggcatgaaacgtggcataaactatgtacctcaaactctgaccaatgaattctnnnnnnnnnnagaattttctttccagaccttgcatacccatcctcagtgtgccccgcacctgcagcagaatcaggcatgaaacatgggataaatcatgtacctcaaactctgaccaatgaattctgtctcagaccgatagcaagactgggaaagccatcacccggtgccctatgggacgcacgggctttaatcaagcgttttattttgagtggaggtacatgcggcatctccagtcgagtatgcaccgggtgtacgggatatgctgctcttctctatggtgggcaaggctannnnnnnnnnggagtgtgcaccgggtgtaggggatgtgctgctcttctctatggtgggcaaggctagaggcaattcaaaggggcgcccactgcagcaaacgtatgtcccacagctccaatgtatggaaagggaagcaaagaccaatattacaatatttatgccaggaggtatgaagtgtatttttatcagcgtagaacgccgaattgccacgacaatacggtggctgcggtttaaattaactggaaagcgtgttgaggatatcatgcacgagcaaaggtctggccacagtacacctcacagcacaatcctgtttgctacaaatcaatcgagttgttgtgtcnnnnnnnnnnttatggtggctgcagtttaaattgactggaaagcgtatcgaggatatcatgcacgagcataggtctggccaaactacacctcacagcacaatcctatttgctacaaatcaatcgagttgttgtgtctctcatcatcgcaaatatggctcgctccgcctccctgatcctggccgtcgttggcctgatcgctgttgctcatggccagtacatcgacacagatgcctccacaggaccacaggtgaaggacatgagcttgtttttgactgcctgggctgtgcgaagatggaatttgggaggacgaagcccttgctccttgtaggaccgccaagcggtgctctcaggcacggagtccgtggaagaccagacttgaatgcctaccccagccacaatgtcatgtggtagaaccttgagcatgatgcaaagttgctcgcgtgcttgggccgactctgcgactccttcccttccctcaggtgacctacatccagcaactgatctcggggtccaagcttcttcccgaggacgccgatatccccacggccacttacatcctgccagataacggtgagatggagggcaccgccttcggggacgcgctcgctgcagacgcgctcgctgatcgatcacagcttcgcggggtggatcgcatcgggagagggtgggcccatggctcgannnnnnnnnnccgcgttcgctgcagaagcgctcgcaggacaatgtggtcgatcacagcttcgcggggtggatcgcttgcggcatcgggagagggtgggcccatggctcgatatgaaaaagggggacctggcttctcggccctctgcacccccctcatccaccatattcctccgcgctctccatgccagatgccatcaccaagttgctgagctcgttcggagtgacgttcgaccaggcgatcgcggccttgggggccggcctccttcctgctgccatccagaaccgattgaactccgtcatcctgtaccacatcattccctccggggccctgacccccacagagctgggcgccgagggcaccgtgccgaccgccctgccggaggagtccctgcagttcagcgccgacggcgctgtcatcaccacggccaccggcacctccaacgtgctggccaacggcgacagcgccggcgcatcctacctcatcgtggacgccgccctcctgccggcggacttcaacaccgttgcggagaccaccacggaggaggccaaggccatcctcgcggccctgggcagcagcacgccctcccccaccctcgagtgatagttgccctcatgttgattgcggatgtggtccacgtgcgcccacacacgttctgcctcttttggcactgtaagagtgccggacaggggcgtccatgggaggnnnnnnnnnngtatggtccacgtgcgcccacacaagttctgcctcttttggcactgttagagtgccggacaggggcgtccatgggaggggtagaggttcgcgacaccttccggaaaaatgcctggtcactcagctgcgaaggaacgcgccggaacgggatctccaagatgcatcgattacccccaaaggcgcacactctccaccgctggagcgaatacattcatcttttccagcgcagccgtcaggaagggatcccagggcgaagccggttgtgtgtgtgtgtacagtacagctggtgggcgcggcaccaccgaccggtcggagaacagggaggtcgcaaagccagcgttatacaaggtgggcagactgccactgcaaggggggaggggtgtctagcatgccctgctcaggcgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgaacttgtcggttcccgacaccctgaaaccctgacctaaaaattcagcttggaagcagcaagccgccaaaccacctcttgtcttgacatgcaggagaatccnnnnnnnnnncagcggccgggatggggacgctggccacgccggccccattggcagacccagggggtccgaggccttcggccggggttcccnnnnnnnnnnttccaaggtggggagactgccactccaagggggaaaggggtgtctagcatgccctgctcaggcgtgatgcgtccacgttttccgtcgatttggcgtcgtgcaccttgaagccgacggccgcaacacatttcagcgcaccctcggaaatgattttacattcttgtactttattttctcgagccgttaccgtgtgccattgaggtgaggatgctgcgacattatgaacttgtcggtccccgacaccctgaaaccctgacctaacaattcagcttggaagcagcaagccgccaaagcacctcttgtcttgacatgcaggagaatccaagacgccatgcaggttcgattggctcccagcaattcggcacccctgatgcccacgaaagccgacccgggcccgacgcccggcacgcctctgagcgtggtggggctcgcggatggcgtctccatcccctccactgcctcggtcgaagagggaagtcttgtggcgagttctcgctcctcggacgtcccaaccggcgaggccagtgggtcgggcacgagtagcggccgggatggggatgctggccccgccagccccattggcagacccggggggtccgaggccttcggccggggttccccgccctccaccagcgaagagatcccccatgtcgacgtggactttgtggttcggcgcctgagctgcagctccctgcccctgacggggcaggtcgtggcctatgggtgggagcaggccgccatgctcgcctccacctgcaaggccatgcccaaccagctcttcacggccctctggcccgccactgcggcctgcctggacaccttctcctcccaggtacggatggggtggcaaccgatgcatggcggggccaagctagccctgcctgcagggcggcactcgatggttgtgctcttgcgaggcggctgggtcacggtgcattccccctgcacttcgccagaggctacagggcannnnnnnnnntctggacaccttctcctcccaggtacggctggggtggcaaccaatgcatggcggggccaagctagccctgcctacagggcggcactcaatagttgtgctcttgcgaggcagctgggtcacggtgctttcccctgcacttcgccagaggctacagggcagtccagatgcgggtcctgttccgtcgcttgtccaaactgctgcctcacatgtgccatcctgtctcccacaatgacagagcatcctggacatgctcaccgcctggtcgctgctgcagcagcggtgtcccagacacttccgcctctcgagtcgggtggtggacagcatggttcagagagcactgcctcccataggtgcgggggcttggtggccggtcggtggggggttgacagggttctggggtgcgaggcccatgggcgcccagggtgccgcatcccccggtgcccttggaggtgctttgtggccttggtctttggggatgtcatgcctctctcctccatgctcgctgctggcctccatgcaatgctccttgtccccctgccagccacnnnnnnnnnnctgacactctcctcgatgctcgctgctggcctccgtgcaatgctccttgtccccctgccagccactcagcacggcctcctatgtagttgatgcaccaatctctcaccctcttctcccccatgacgacgcccagtgaaacgattgagggatagcgaactggnnnnnnnnnntctctttttccccatgacgacgctcagtgaaacgattgagggatagcgaactggcagacatggcggagctggcacaggagctcgcatcccaaggtttagaccccggcgtcgtctggttcggcccgtcctccagggacctgctctgccccgtcttctcgcttgtagtggtggaggctgcctggaggtgagacgctgtgtgggtggaaagccagcatggtggaggttggggggggtggcagtcccaggctccagaagactcccacgatgtcgcttacccctggtgtggcaccgagcaatcgcctcaggaccnnnnnnnnnntagacttccacgatgtcgcttgccccgggtgtggcaccgagcaatcgcctcaggacccagttgtcacaggctctgccattggagggaccagtattgttgcgcggatgccaccacctcctatcgtcactgccacgaacccctcccgcctttcttttacccaaccacccttccctcccactccttcagggacctgacccccggctactggcttcaccgcgatgctnnnnnnnnnngtacccaaccacccttccctcccatccctttagggaccttacccccggctactggcttcaccgcgatgctcgagccagggtcctggcagcctcccgggcttggagctggcgagcggtgccccaccgtgattccggggcactgacccagctgaagggatcggtggaatgcgccctgggtgtgctgcgacgcgccgactccgcactgcgcccgccccctgcgggccagcccattgccgaccctggtgagggcggcgtgtgaggtcgccgtgcctggggagtctcagcggcgggtgcaccgcggccagcctattggcggccgccagaaccctgctggttctctctgctgagttgctgattgattcttgaggttgacccctcaccgacctctccttgggaggtccggcccttgtgatgctttctcctcaggagcgcgctcttgtggacccaaataggtccctacacatgtccagtccatcaagcactgcaattaaacttaaatcatgtaagcaacatactaatcttcgacagcatttggaatgtcgcgccccagtgcctgccactggcgctcggaaaccacgtgcctgttcagcagttgcgctcccannnnnnnnnntatgtaaggaacatactaattttcgacagcgtttggaatgtcgcgcgccagtgcctgccactggcgctcggaagccacgtgcctgttcagcagttgcgctcccaaccgcatcctcggtcatgcacggccagccgcagggcccggcccagaattcctcatgacgataaattaaaaagaaatttgccaatcagggcttgtcgcggatcaagatggatccacagagatggatcgacttgtccggctgggtgggaaatgtttccacctcagtcctcatagtcttcgtcaataagctcctcatgcgcacggaaggaggctatagctttagattcggtgcgctttgctctcggatacatggtctgtactgctctacatgccccgtaccactctgagatctccccccctccacgcacgactccccacgtcctcgccccaaacgcagccactacattgacggcaatgcactttctgttctgcacgttcagcgtctgggtgacgcagggacttggattggtgaagcggacgtccattccaaagcgcggtgggtgaccctgggtcccgcctaggtctcgcaaaaagctggcgcccatcagccatcgcgccctccctgaccatcaacatgcccattactccgccccacccgcagatgttctcctttttgcactggtggcagacatctcaatccttgcgctgaacctgtccctcatgatcaacacggtctcgttctaccaggtaggtaatggagtgcaaggtccttccactgtcgggggtggtgatggtggtaagcagaagcgcccatgctcatgcccggtaccacacagaatgttcaactttggcacaacgcactctatgttgacatcccgtctctcccttgcccagatcgccaagctcctcatcatnnnnnnnnnngagcgcccatgctcgtgcccaataccacacagaatgttcagctttggcacaacgcactctattttgacatcccgtctcaaccttgcccagatcgccaagctcctcatcatcccctttgtgtgctttgtggagtggttttacatgggccgcaccttcacgcgtgaggtcgcgacgaccatcctcgtggtcatcatcggcgtcgccattgtgtgagtccggggtgtagtgacttcccttcgcttggtttggctccaagaagggatggggtgggctgcagggcgcgatgagacgccggcatgccatgatgtatcccctggacttgggagggtcggctcccaacatgaggttgcatggcggtgcagggctaatctgtgctggcgctaccgttcttagccggcatttccacccctatatacagctgtacttggcttggactcgcttccgattgttccctgccctgcatgtctcatgcccaccccctggactgcccttctggctcctcccaaaatgctgcactcacgctcggttcctggactcgatgccctgccccctagggccagtccacttgcaacgcgcagtgatgccctcgacggcttcccccaccagcccccgggctccactcgaagcacggctcgcgctctcaaaaccgtcgtcagcgtgcacgcctctgcccaaccccaccctgtctcatcnnnnnnnnnnaatgagacgccggcatgccatgatgcatcccctggacttgggagggttggctcccaacatgagattgcatggcggggcagggctaatctgtgctggcgcctccgtctttagccgggatttccacccctatatacagctgtacttggnnnnnnnnnncccacccccgcaggaccgtggaggacctgcgcctgaagatatctgtgactggggcgtgcatcgccggcgtctccgtggtctcctccggcctccaacagatcttcgtgcgcaacctgcagcagaagcacggcctgagcagccacgagctgctgtcgaacacggccnnnnnnnnnngcctgcaacagaagcatggcctcagcagccacgagctgctgtcgaacacggcccccgcccaggcctggaccctgctggtggtggggccgtttgtggacaaggtggtgtccggcgggtgggtgttccactacaccctcacccacggcgccctggtctggctgattggctcctgcatcctggcagtgctggtgaacatcacccagttcatgtgcctaggccgcttctccgccgtctccttccaggtgtgcatgtgtgtgtgggagggtttttgaggccgatgggcactggggaacaagatactcttgtggggtcgtgcgtgtacgggtgtacatctgtgagtccagcctgatnnnnnnnnnnatacctatcgagtgccccttgaccgtgagtcactacagcccagctttattgccagcagtcccacctcttccccccacccccacccctacctttcccccccttccctctgcaggtgctgggccactcnnnnnnnnnngacgaggaattcttgtggattggcgcgtggacgggtgtacatctgtgagtccagcctgatgctcgagtggaggtgtgagcatgcagccagggtgcctcatgaggacagggtggagagggaaccatgcgcccaagactgcccatggggcttcgtgattggcatgcagccgagccctgggcagcattcccctgaactacctatcgagtgccccttgaccgtgagccactacagcccagcttcattgccagcagtcccacctcttccccctccccccccctctccctccgttccccttccctctgcaggtgctgggccactccaagacggtcatggtgttgctgggtggctggttgttcctgggcgatgagctgtcgccgcgcaagctgctgggcatgaccctggccgtggccggcatggtctggtacggcaaggcctccgcggcggcgccggtgcccgcctccaagcgcgccgtcagccccgcgccgctgggtctgggcggtgatgcggagggcgccggcgggccgctgctgggccgggcgcgcagcgtgtcgggtgacggccgcatcacagtggggcccgtcgcgggcaagatgagggacgtggtgtgagcgaggccttggagcgtactctaggcagcgacttgggggttttggtcggccgcggcgagatctgcgccgtgaacaaagaaagcccactccctcccgagcccacccaaggcgacggggcaccgctcttgtttcgagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnactgctgcagcgccctgatctctggcccccccgttcctgaaaggttacacagtcaggcagtcnnnnnnnnnngctgctgcagcgccctgatctctggggcccctgttcctgaaaggttacacagtcaggcagtcnnnnnnnnnncccaagaaggcccactcccctcccgagcccacccgaggcgacggggcaccgctcttgtttcgagcggccacaccgttggtcctctcgcatgtgaggctcgccgagcccatgcgcgcctgcatgcacccggcgctctcggagcgttccctgnnnnnnnnnnnnnnnnnnnnnnnnnnnnnnnnnnngctgcagcgggccactcagaggtcgttgatggtgacctccacctccacgccgggctcgatggagacggaagtgatctgcttgaccacctccacgggggagtgcaggtcgatcaggcgcttgtggatgcgcatctcgaacctgtcccaggtcttggtaccctcaccgcaaggggacttgcgggtggtgatgcgcaggaccttggtgggcaggcgcacggggcccttgaccttgagctccttctccttggcgccacggaccaggtcggtgcagactgggaaggagggaggagagggagtcgggattgggtggggagggtcttgggcgagggatggagacgggtacagccgacagcctacagatgccagttgccaccactgagtggcatgcaccttccgcgatgccccgcacgctcacccttctccaggttggtgacgttcttggaggtcagggtgatgcggatgcggtggatgggcacctcatgggcctgctccacgccgaccttggtgggcttggcaacgtcagccattctgcgatgagaaagagggaggtgagaaggggagacattacaagttcctcgcttgaaactcctgccacagcaagcactggcccttggagccgaggccagcacgcgctcctcacctgtatgtggcttgaagtcttccccgagtcagacgtcgcttgtcgacctgtcactgagggatgataagagggcgggctcgtggggccatgcgactatggtcccgcagtagcgaaaatcaagggcgtcggctggacgacttcctttcctccggcacgccacgtggattctgtgacctcccttttttgcttccgtctcgtcgtgcctgggggacaagggcaggtgaaacttctttccaccctggaaaacattgatgcattcatccatagcgcgagtcgatgagcccatggaggggcctccgaagaatgtaccagtcactgggggtttggagcaggcagggacagcgnnnnnnnnnnactccaccctggaaaacattgatgcattcatctatagcgccagtcgatgagcccatggagggcactccgaaggacgtaccagtgactgggggtttggagcaggcagggacagcgcccaaaagacaccttggtgaggctcgtggctgatcagctttgcatattcgtatggcacacctccaaactgacgttatgctcgtgacgcttcagatgaggcgggcctggcggacttctcggaggctccagccctgaagcggaagaagacggtgacctgggccgatggcaagcgagttccgggaacatcctcgggtacctcctcgggcgacgtggagtctgggtctggggaggctgaggagggcgaggaggagtcagtgagtcgccaatcctccctagagtcccatgactccagaggaccctccaccgtggcgcagcaaggtatgtggaactgtggattatgaagagagggtagcttatttggcctctgccagtagacgcatgttcaggttctgaatgagtgtgtgcaggcacgcaccatgccttcatgcacacaccccaatcctcatcctccctcctggcaggtccnnnnnnnnnnagaactgtggaatatgaagagagggtagcttgtttggcctctgccagcagacgcatgtttaggttctgaatgagtgtgtgcagggacgcaccatgccctcatgcacacactccaatcctcatcctccctcctggcaggtccagcgcagcggggctcaccccccagcagccccgccggggccctgacgctgaaacagctcctggagcgcaggctggaggctgtggaggaccttgccgccatctacacggagcagctctgggacacattggatgagctggggcatgcggcggccggtctaggtgggaggggcggtgacgcctctgcggcacctggctcaggggatgtcgctctccctggggcgggccacgcaggggtcgctgaccaggccccggcagcggcacccgttgcaccgcagcctgggccgccgggcgacgacgccctgcacccgagcgtgcgggagtggctgnnnnnnnnnngggggggaggggcggtgacgcttctacggcgcctggctcaggggaaatcactctccctgggacgggccacgcaggggtggccgaccacgcctcggcagcggcacccgttgccccgcagcctgggccgccgggcgccgatgccctgcacccgagcgtgcgggagtggctgcgtcgccgagccctgggcgccgacggtgcccagctggcggcttgtcccccgccccctcttttcgaggtggcggaggaggcgctgctcacgggcgtggtgccgagccgggcgccagcattcactggcgccgaggcccgggccggcccgcgccgcgctttccacgaccagctggcgcacgtgagcgcgctggagcgacttgccgccgcatcgctctcgcgctggttggacggtggcgcggacggcgcgctggccgtgctggtggggcgacgggggcgctgggcgctgacgcgcggcgctgccgtgctggggcggggcggcggggcggg

SEQ ID NO: 44351 - DNA, 47052 bp, Chlorella protothecoides
  modified_base (97)..(106): a, c, t, g, unknown or other
  modified_base (1239)..(1248): a, c, t, g, unknown or other
  modified_base (1474)..(1483): a, c, t, g, unknown or other
  modified_base (2257)..(2266): a, c, t, g, unknown or other
  modified_base (3264)..(3273): a, c, t, g, unknown or other
  modified_base (3914)..(3923): a, c, t, g, unknown or other
  modified_base (4673)..(4682): a, c, t, g, unknown or other
  modified_base (4788)..(4797): a, c, t, g, unknown or other
  modified_base (5788)..(5797): a, c, t, g, unknown or other
  modified_base (7807)..(7816): a, c, t, g, unknown or other
  modified_base (9283)..(9292): a, c, t, g, unknown or other
  modified_base (9346)..(9498): a, c, t, g, unknown or other
  modified_base (10561)..(10570): a, c, t, g, unknown or other
  modified_base (12598)..(12607): a, c, t, g, unknown or other
  modified_base (13435)..(13444): a, c, t, g, unknown or other
  modified_base (14134)..(14143): a, c, t, g, unknown or other
  modified_base (15003)..(15012): a, c, t, g, unknown or other
  modified_base (15362)..(15371): a, c, t, g, unknown or other
  modified_base (15801)..(15810): a, c, t, g, unknown or other
  modified_base (17737)..(17851): a, c, t, g, unknown or other
  modified_base (20506)..(20515): a, c, t, g, unknown or other
  modified_base (20733)..(20742): a, c, t, g, unknown or other
  modified_base (21453)..(21462): a, c, t, g, unknown or other
  modified_base (21886)..(21895): a, c, t, g, unknown or other
  modified_base (22136)..(22145): a, c, t, g, unknown or other
  modified_base (22244)..(22253): a, c, t, g, unknown or other
  modified_base (23963)..(23972): a, c, t, g, unknown or other
  modified_base (26637)..(26646): a, c, t, g, unknown or other
  modified_base (27402)..(27411): a, c, t, g, unknown or other
  modified_base (29479)..(29488): a, c, t, g, unknown or other
  modified_base (30214)..(30223): a, c, t, g, unknown or other
  modified_base (30973)..(30982): a, c, t, g, unknown or other
  modified_base (31778)..(31787): a, c, t, g, unknown or other
  modified_base (32373)..(32382): a, c, t, g, unknown or other
  modified_base (32450)..(32646): a, c, t, g, unknown or other
  modified_base (32837)..(32846): a, c, t, g, unknown or other
  modified_base (35391)..(35400): a, c, t, g, unknown or other
  modified_base (36148)..(36157): a, c, t, g, unknown or other
  modified_base (36634)..(36643): a, c, t, g, unknown or other
  modified_base (36937)..(36946): a, c, t, g, unknown or other
  modified_base (37151)..(37160): a, c, t, g, unknown or other
  modified_base (38387)..(38396): a, c, t, g, unknown or other
  modified_base (38468)..(38477): a, c, t, g, unknown or other
  modified_base (38645)..(38654): a, c, t, g, unknown or other
  modified_base (39255)..(39264): a, c, t, g, unknown or other
  modified_base (40450)..(40459): a, c, t, g, unknown or other
  modified_base (42786)..(42795): a, c, t, g, unknown or other
  modified_base (44242)..(44251): a, c, t, g, unknown or other
  modified_base (45002)..(45011): a, c, t, g, unknown or other
  modified_base (45804)..(45813): a, c, t, g, unknown or other
  modified_base (46119)..(46128): a, c, t, g, unknown or other
ctacgtgcaggcgcgcttgatgaggtggggatcgatgtccacccccaccatgctctggcaggccatcgaacccgccagggccagggtgaccaggccnnnnnnnnnngtcgatgtccacccccaccatgctcttacaggccagcgaacccgccagggccagggtgaccaggccctcattgcaaccgacgtccatgcagcggcgccgcgcaaaccaggagcgctccatcaccgccaggcgcgggtcgtggtcgaaggcctggcccaggcggtacccgtagtagcggtggtagttgccgtggggcgccaggcgcgaacgtgggggcccggggagggcaaccccggcctggccaggcccctgcgcgccgtcggcccggcggggcgaggcggcctcgcccgtgccctccgcgaggggccggtgggccagcgccgcgtgcgtgacggccgcctgggaagaaaggtcggcgcggaggggccgctgggccgcgagggccctgggcaggaagggctggggagcgcgagccgggcgcgcaggcagcggcgttgccctgctgccggtcagggccgcggcgtcagtacggggggaggtgtgatcggtggtgcctcctggggtcatggtcaggctggcctgggtagaaagctcgctgctggccaacaccgcctgctcgccgagggctgcacgctgccgcttgccggcgggggcatcttcaggcatgatgccagcctgaagcgtttcaagagagagggccaaagttggagttcaacaacttgtcaagagggagtggcgcagaatgactagccaggcagtggagagtccagcagcacagcttacctcgagcaggagggcggcctgtgcccgcgccagcttgagtcgcctcttcttcttctgggtccgactcagtgagctggtgtccgtctctgaagtgtgcaaagacggctctgggctggcagggcccccgcgtaccggcggcatgtttgccgcagcggcagcgacacccaggggagacagagctgcgaggacaacagggggctcttaccaaaatgccatatacttcagggagtttgggattgtaggggactgttttccaactgatatgaatgttgtgccatgaataagtcgcctccttattgaaatagttattcggtgagtttgtctcgcgccctgaaaccctgggcgcgggcattgtcgattgccttcacagccagccgcatccgctccctggcccagtctgagaggatgtnnnnnnnnnnaaagtcgcctccttattgaaagagttactcggtgaatttgtctcgcgccctgaaaccctgggagcacgggcattgtcgattgccttcacagccagtcgcctccgctccctggcccagtctgagaggatgttgggttccgtctagggagatgtcgccgccctcttggtccctgcgtactcagttgccgaagttttgagagcacgtacatgctcctccaaggagtcannnnnnnnnnacttggtccctgcgtactcaggtgccgaatttttgagagctggtacatgctcctccaaggagtcaaggccgccattggaagcaggacctggccaagcctgagatacgccctcaagggatacaagaggtgcgattggccacgcaaggactctcctgaggatgaaggcatcgtatcatgatgtcgccactcggctgcgtggaaccctcttgcactgggaagctcatggaactgcactggaatcacctctcgtccctcaggcagtcattcctccctcccgccctctatcgtgtggaaatgtccacaagcgacttcaaggtaacttgacgcccatccatgccaaccccaagtccttgacttccatggctaccggagtgtcatgcctttgcttattggtaactggtgggtgctcctccaatctggacgccatgcctcctcacccaccgaccacatgcaggaccacaagtttggaccctggacagtgcacgcaagcgagatcttcgccacctctagcctctcctttgcctttgtgaacttgaagccgattgtgcgggggcacgtactcatctcgccacggcgtgtggtcaacagattcgcggagctcacctccgaagaagtggccgacatctggtgcgttcatggctcatgcacatctggcagggctgaccgtgcaggcactgggccactgctggcccgtgcctcttgcgtgtgctgggctggaactcccggcgtccacacacaggctgactctgcgccaccgcggctccgcccaactgnnnnnnnnnnttgctggcccgtacttcttgcgtgtgctgggccggaactcccggcgtccacacacaggctcactctgcgccaccgcggctccgcccaactgcaggcacctcgcccagaaggtcagcagccggctggaagcccacctgggtgcgagctccctgacccttaccatccaggacggtccccaggcaggacagaccgtgccacacgtccacatccacatcctccccaggcgggctggggactttgagaagaacgacgagatctacgacgtcatcgacgccgcctccaaggagtttgtgcgcgagaagcaggggtgcggtgggtggtactcggggggtttcagggggcaggcctgatacctggcgtggcagggatcctgctgtgcgtttgtacaagcagcactgcctgcttgggtggacatgtgagcaccgcatgcctgtagcaccacccagcctgggacgtctttgctcggacatgtatcccctccgccgcatccctcacattcgcagggaggctgctccccagaactccagcctgaaggtggacgcagacgcggagaggaagtctcgcaccccgcaagaaatggcggcggaggctgctgagctgcggaccctgttctgacttcatctcgtataaaggtgcaccagccagattattaccagtgtctcaggccccggggcgggcagagcagctgggcttttgcaggacaaggtcaggtctgcacgcctcgcccaggtctgcctttggatttccgcttgtgcgtgagctaggagagcatggtgcctcagcacgacgatgtgcctgccggctcccagggtccgggaggtgcaggccagggttgtgggccagccgccgaacgcccggccggctctggtgtggcggcggagtatcacgacgccgactttgactggtccgaggcagcagcagaggcagccgccctggtggcatctggtggcggggtttgcgcggcagggtgcgcgcctggtgcccagggcggcgcctgnnnnnnnnnncgtggcatctggtggcggggttcccgcggcagcgtgcgcgcctggtgcccagggcggcgcctgccacgcgggtgacgccggcgaggaaggggcagccaccgcgacaggccagcagcccgggagcgagccctgggagcgcttccacgcccagcatgccagcgcccgattcttcaagccgcgccgctacctcctgcacaccttccctgcgctgcgtgctgagggcctgcgcctgctggagctggggtgcggggccggggcgagcctgattcccattctattggccaacccgagtgccaggtgcccccccggggggtgtgcaggctgggagtgatgcttcagaggggatggagtgttgtgtgtgtgcgtacaatgtgggagtgaacagctcccacccgcatgcgaaacacatggcctcgcccccgctggccctcgccgtgcgcctggcaagcagagggtgtcgcgcgatccctaccgccgacccagcctcctctcctcctccccacccccgcgccagggcgctggggtgcgacatcagcgcctcggccctggccctggcccgcagcggcgcgcaggccgcgggcgtcgacgcctccaggttggccaccctggtggtggacctggagggcgcgggcccgctggcnnnnnnnnnnacaggccgcgggcgtcgacgcctcgaggctggccaccctggcggtggacctggagggcgcgggcccgctggcgggcgtcccgccccaccacgacgccgtcctgctcgtcttcacgctcagcgcgctgacgcagcgcggcgaggccaacgccctgcgcgccgcgcgtgccgcgctggcgcccggggggcgctgcctggttagggactacggcctctacgacatggtccacctccgcttcctcgccggcggcgccgcgcgcggcccacccacgcctgtcgccggcaccacatacggtccaaccccacctgacccaccccccacccgcgccttccgccgcggcgacggcaccctggcccgcttcctggccctgcaggagctcgtggccgccgccgcggcggcgggactggagtgcgaggaagccaagtacgcatgcgtggccgtccggcgccgcggcgccccggacctacgccgcgttttcctccacgccgtcctgcgccgcgcccgggagggttgatccacgctcgtggattgcggggcgggcgagcgcggtgcccccagcagcaggcgtgacccagtggacgcagcggcctcagtgtcaatttgttcctatcaagcatcagcagcccctgtggctgttctgggatcgcttccacagccagggctgtctggcctgcagtttctgcacctgcgctcccaaactgtacaccagttgtgtgcagagctgtgcaggaggggaaggaaagcgccacnnnnnnnnnnttgcgtcaggctcgccgccgcgctccgcctgcccgccgcctcggccgctccccgcggggctgtctcccccctcttccctcgtctcgccgtcctcccacccactctnnnnnnnnnntatcctcagcaggcctcatcagggcgcggcgagggtgcgctgggggacggccaggcggcggcggcggcctgtgcgggtctgggcccacgccgagatggcatgaagttggggcccatgccgtcgccggcctggtcatcgtccgccgcccccgcctgctccctgctttctgacccgctcggcgaacctgcgtcgggctcgccgccgcgctccgcccgcccgccgccttggccgcgctccgcctgcccgccgactcggccgctccccacggggctgtctcccccctcgcccctcgtctcgccgtcctcccacccactctctccacggctgtctccccccctttccacagcccggtcggccccctcgccctcccccgccgtgccgtcctcggtcgcctcctccggctcctcgccctgcgccagcgccagcatgcccaggagctggcccggggagaggtccggattcaggccctgcaggaggtgcagccaggtggacctgggccgcacctcctccatcgtgtgcccaggctcgtggctctgattgaacctggcggggggggtgggggacaccaaggggaggggcctgggggaaatcatggtgtgaacccctcgagcgaatccccgattccccattgctgccagcggttcactccccgcaaccagggctcccccacacgacggtcagcagatgcccccagcctggtcctgccacattctggacccgccccgttctccactcagcccccctggcccgcctcaccgtcccaacaccgcgaccccggcgccgcagctggcgtggcaccgcgcacagaggtcgaagccgatcgccgcggggcagtcccggcagcgccagcgccggcccacgatggggtgctggccgcaggcgtcgcagccggcgccgtagtgaacaaaggcctctgcggtccgggcaccaaccaggggggcctgcgccgccgggccctgcccctccgcaccagcccgcgcgcccgcctgtnnnnnnnnnnggccaggggggcctgcgtcgccgggccctgaccctccgcaccagcccgcgcgcccgcctgtgcggtgcccgggggccccgctgtcggcgtcgctgagcggccctgggcctggggtgccgacgcctgcgtcgcagtcgtcgtgtcgtgaggcccgcattctgcctgctccgtggccgcggcagcggcgtgcagctgggggcacagggcggccaccgcgcggtccaagaccccgcaccgtgccacggggaggggggtgggcacagcgcagagcgggcagccccaggcggccctcgagccttcgggtgcagcgtgcgctgcgcagagggcgtggccgcaggccaggacgcgggggagggccagcactgcttggcagccagggtggcagcagcgcagggagtcggggaggcgggcagggtgggcggcgtgctcgacgccgtggatgctgtagccctggcctgacgcctggccctcctcctcgaccgcacgggcggcgtagctggaggggaagctcagtcggagtgccgcgtccagggccgcgcagacctgtaggccaggagggaggaggaggtgcgggggtcctgggcgggggtgcacggggctgggaaaggggcaatcgcagcaccccgcacccaccctcggccagctcacccctggcaggtgcccgaatgcatgccggcacagcgggcagtgggaggcctcgtaaggggacatggccctgaagaggcagtagaagcagaatgcatgcccgcacaccggattcacggcgggtttgtagagcaggttgaggcaaatggggcaggcaaagtccgactcgttcatgacgaggggcggtgggccgatcgatgcctctcccgtcaaggcatggagggctgtgatggtgagaacggagagtgtattcaatgcaagggactggcttgcgatgaggcagacattcaggtcgtgaagcgggcgagcgagtcgccgcgttcccttggtatgacaacaaccctgtcggaaactccgcaaccggcccggttcccaattctatcacgacaccatcgccccagcttcccttctccatgcacgggcctcaggcccaagacgcctgcctgaatctgccccaaggtggtatgtggtgacaagacggagcccacgggtgtggagggaggagtcgcaggtggggcacacaacatcagtgacctgctgtgggtgaggggcaccgacacagccagcgggaaaactcttggcatggcgagatgcatgcatcgccgattcaatcatggggagaaggacttaacacgcgtgggcgctgcagcagactatggagcgagaacgccaggggggggggacagggcccgagaggggcctgcacccgctcacaactgcttcaggatgtcgtccgcgctgctgacggtgaaggcgcccccctcctccatattcaccagcttgaccacgccgtcgtcggccagcatggagtaccgcctggagcggtgcccgagccccttgtcgctcaggtccagctcggctccgaccgcctgggcgagtgttcgggggacgaggtgccttcatggtgctgcaaagtgcagagcgatgcgtccgggcaggtgcccatgtcgacccccatgtgccaccgccatccccaggcacaccctgcctctacgcagcccccaccttggtgaagttgccagatccgtctgccagcatgaggatcttgccgtcggcgcccagctgctttgcccaggccgccatgacaaacgcgtcgttcacagagatgcagccgatggtgtcgacgcccttggccttcagcttgtcagcgctattgatgaagccagggacgtgcttggatgagcacgtgggggtgaaggcgcctggcactgccacaaaaaccacctggggggaaggcagagagggagggctggggattgagcacagggttttcgtgcaaggagaagctcctggggaagcaccctgggcagcgggggcgtgatggtgcgaaatttacacctgccacccacccaaccatccatgagnnnnnnnnnnatattgtgcaaggagaagctcctggggaagcagcctgggcagcgggggcgtgatggtgcgaaacccacacctgccacccacccaaccatccatgaggcatgcaagacacgccgtctcaccttcttgcccttggtcagggcgcctacggtggtctcctgcatgttgccctcggcatcaaagtagctgaggttgatgtcctggggtagctgcaaggaactcggggggggaggggcggggggggcaatttgtcattacagagccttgcatgcaagatgcgttatgcaggtttgtcgccgtgcatccattggaaggcgtgctcgcaccttgtccccgaccgccagggcgctgacactgaccacgctcctccgagcggaggcacggccctgcatggttgcgttcggcacacgtgtgagcatcgcacctttgcatgtatggcatcatgtggcatctcccctgccctcacctgcgcccgtgggagtgggtttcccgagaaggatcgtggagccctggacctccccagctgacccctggccgccgggaatcgggacacacttgccgtgacagactgcattgtggcttgcatgacaacggaatgggatagacgggggagagaaagctgatatgggaccccgtgcggtgcgggctcccttgatttgggggtgtccccgatcatgttgctgggcaatcaccctttcctccaccaccccctcttctcccatcgggcatcctttcgcaagccgagcagcacgaccagccaaagcttgacaattacatccacatggagcgcaatagttcaatcaagataagaattgttaagtgcgtgcaccgctcctggccacagaggtttggacatgaccctggggcggcccatgctccaccgcgtagaggcatcggtcccccccccttgcacctcgcgcccaccctcacttcagagccgtcaggcgcgccaggatgtcgtcctcctcctggccaggggtgatcgtcgtggccttcgcgtcgctggctaccctcgccttgccggccggcgccatggcggcggacaggtccacaccgatctcgtccagcacctggttgaccacgtcgtccgtctcctcctccaggtcatctgtctccagggcggagtccatcacgtcggcagccatgtccatggcgaaggactcgcgcgcaaactgctgggccgccttctgggcgccggggaggtcggcggcggcaccccccgccgccatcgccttgccggcagatgccagactggcgcccacagtgcccgtggtggcggccgtctgcacagggttcgtgcatggggagtgttattcttggtttgggggtgaggggctccggaacggagcgtggcaaagggcatgagctgggcgcagggcggcaaaaaggggtgtcccacccactgaacatcccgtcaccccccccacaaaagaatatgagatttgccaccactcaccgccatggagatgnnnnnnnnnnatcgggggggaggggctccggagcggagcgtggcaaagggcatgagctgggcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgacaccacgcaggttggcggcctgggtctgcatcttggccatatggcccctcaggcggacgagctgctgtgccaaaatcttggcgcccgccatgttgccgcttcgggccgcagccttgatgtcctgtgggagtatcgtgcattcatttgcccagggtccgcatgccttcctgccaacgctgcacagacccgggagcccactcaaactccacatccatgttgacttcccgacagcatcccagctgcaccttgagagtcttggcctcctctcgcctcagagccaggacttccctctcgatgtcccgcacattgtgggtgacctccctctgggaggtgcgaagctgggcgcgggggtcgggtttcttaaacaagcccttcagggcggacatgccaggtgaccaggcgagtgttcccttgccccgaaaacgcgtatggttcgaggtgctttgtgttgctgggtgactggaatcttcagtcacagaagttgagttactatgttttatattgctggctctcagctaatggtaagagcaagtacttggtctcggtaagcatgctatcggggcaaacctgggcgcgcgagactctgtgacgttcgccgggccttcaccatgcgacgagtgctaccaaggccggcaaccaccggctctcccggcgcgacgaaacacctcagatacaacaaaacatgtatgaaaggctgaaaggatcaagttgccagcctgttggagaacccaaagccgcgatctggtccggacggcactcatggctgcactggcttttcgggccagggccgtctgggctggcaccgtgccccgccaggtagtcatacacctcagaagagccggtaataaagatcgcatgagacccgatgagagcctgatctgatgcttgtacattggtgcaggtaccccgagcgctgaggggactgtctggtgccgcaaacgacagtagcgtcgatgaacttaaccgggtaggactgctctgttttacgccgcgctcttgacatgcaacatgatatctaggatgtgcacaggcgggccgtcattggttcttggtacggcnnnnnnnnnnactcttgacgtgcaacatgatatctaagatgtgcataggcgggccgtcattggttcttggtacggcgttactgcctggaaggatacatctccctctgtccgcctgacttcgagcaggagttggctgaactccacggcatcggaaccgcgcctcaggaggagccgcttaagcaaccagatgcacccaggcccacggcagactctcgacatgctgagcggcaggctcacgcgcctgtcatgccgcaacagcctcaagaatccccactgagcacctcattgacgcatgtggatgactcgggtcgggccaggatggtcgacgtctctcaggtacttttggagcttcgagtgaaatacaattcatttcccccgagtgcaagtggttgtgtcgacgggagtgcatgcccgaatcctgaatatccatccattaaccctgcttccgagagcaccgtcatcatccctgcagaaaccacacaccgcgcggacagcggtggcaggagcccgagtgatgttgggacgcacggtattcgatctgatccagcagaatgccatgaagaagggcgatgttctgagcgtggcgcagctggccggggtgatgggggcgaaacaaacggcgtccctcatccccctgtgccaccccctgagcctgtcgaacgtagaggtgaagctggccctgctcgccgacttccacgcgctcaacataacggtcaccgcgtcgacagtcggtcagactggagtggagatggaagctctgactggcgcctccatcgccgcgttgactgtatatgacatgtgcaaagctgtctctcgggaactgaaaatcacagacatccgactcctgcacaagtctggaggccgctcgggggactggacatgctcttcctaaacaataccgtgtaaactttaaaatcaatcaggtgaatagttgtggcgcgtcgaacatggtgatggcggcaaatgtcacgcctccccggaaagatgcgaggtgggatgctggtaccaccgaaaacagtcaacttcaagtcacgctcggcgtatgcctttgccggcacaatagctagaaccccagtgtcgtttggcataactctcaaaatttctcactaggtttcccatacctcccaacccgcaaatgactcccagctcgccatccctctcgtgaatggagctgcccaagagcccggccgtccccatcgtgcgttacacgtctaccgcccgtctccagtctcaaccaatgtgcaagcaggttctgccctcgtttcagggcccggagagcttgctcttcacctttgaggtaggcgaaggggtgcggatgccctcccggaatctttcggcatcgccgggtatccaccagatgtgtggaggcttcgtgtcggcgcgtccattgattccccaccctcccactcccccacaggccgacgatgccttcacatttcatctcggacgtattggggccagcttcaatgagtatcgcgagctccagaccaagatcctgggccacctagtcccacgcacgctcttccatgttcgggtgagcattgggtcgcacaccaccagcaaagccacctcctcggcggctcgaccggggtgcctcggagtcaccaccccaccatgcatgcacaaaccagacgtttacaccgcaacgaatgctgtcgtgtgccgctcgcgagtcccacgcgctcccgccgcacgccgcaatccccgtgtactgactcatcaccccctgactccccctgcccggcagttgctccgccatgttcgactggcagccgctcgcatccggcactccggcactattgccagcgagatcctggcaaacgagcttgccatggagggctacacggtgtccctccagcgaggggagggtggcggtcccgggacccagtgcttcaagaacctgcgacacaccttcctcacagtccaggacccagacagccaagactccttcattgtagaggtgaggcccgagctggacggctgtaatgttttgggagtcatgctttcgtttcaagggtttgtccctcgagggcatacnnnnnnnnnnttcatgttttgggagtcatgccttagtttcaagggtttgtccctcgagggcatacactggggcagggcgtgatggaccggaacaaggacatgttgctccgatgtgctgcctacacagctgcgtcgctccctctcacttccctctaacccccaccccaccccccacagctgtctttccgggaccattttgccatccccctccagtccctgcggtatcagagcctgctggacctcctccccgacgccctggtggcgctgccctcggacctctccccccttgtggacatcgtgagccgcgagctgacccgcgcctttgccgcggcggggctggacatcccgccctggcgccaggccaagagcatgctcagcaagtggctgcccaagcgcgcgcagtccacctccctcagcgcggcctccaactccgagctggcggccgccggctccctgcactgccacccacgcgtcgtcacccacgagccggcgctgggctccgagcccgcctcgcccacctccccctggtccgaccgcgcgagcgacgccggcgacgcgccaggcggcgcctcgccgcgtgccgtcctcccggaggacgaggagccggcagggaagctgggcgcgctccgcggcgagggcggcaagcgccgctccctgctcagctggagcctggcgctgcagccggcgccggggccgcagcggcccggtgcctggcagcaggagcccaccatccgcgtggtgcagcggcagggcagccgccacgccgtcgcagcgtgaccgcgcggcgcgcggcgcgagcgcatgccatgctcacgccgggtctcctccatctatccgnnnnnnnnnntgaccgcgcggcgcgaggcgcgagcgcatgccgtgctcacgccgggtctcctccatctatccgaggccggtgaaccttgagagcgcgcgagtcgaggacgtgagagaggggagagagcggggcgccccctgtatgcctttacccagggacagtggccgcgcctgcgcgtcgccgtccgctctcccctgagagcgcagagcaccacttcccagggagcggcagggatgccccctgcagtttgtactttttgcagtcccagtattttgcaagcggggtcccttcggcccagctcatcttccttgtgcaatccttctggagggctgtgcacattaccccccccccccttattcctgccatttcgtctttccttggtgtgttcctccaccggtgccctgcacccctgctagggcagtacttcaagaatgaattgggttgccagaccatctgccacatgtaagtgggccacgcaagggcattgctgggtggcagtcaggagagcgaaagagtgcagcacgagggtctgcgcatcgccccacgccgcggcggtctctcccgggctcgtcggtcgcgcagtgcagccacgtcccacatgggtcatgcactcgctctccaggctctgcgcggcgccctcacctcccggccagcagcgccgcgacccgcttgccaagggccagcgaggccgtcaggccnnnnnnnnnntgaaagagtgcagcacaggggttgcgcatcgccacacgccgcggcggtctctcccaggctcgtcggtcgcgcagtacagccacgtcccacatgggtcatgcacacgctctccaggctctccgcggcgccctcacctcccagccagcagcgccgcgaccctcttgccaagggccagcgaggccgtcaggcccggggactcgatgccgtacagcgcggccacgcccggcgcgcccgtggcctcgggtccacacaccagaaagtcccccgccggctggccgcggccggcgaccttgggccgcacgcccgcataccccggctgcagcgccccgtccggcagccccggccagtaggcccggacggcggcctggaaggccggcagcaggcccgggtccacgccgtagtccagggcgtcggggtctgtccccggcggcagccagcaggtgtcggggccgaacctggccccccccgccaggtccagggtcaggtgcacgcccagcccgcccccgccgggcaccgggtagacgaggtggcggaaggggtgactgcacccgctcagcgcaaagtaggagcccttgaccaggaccaggggggggacgcggcgcggatccaccccgagcaggcagcgcgagacacgctgcgcccagaggccggcggcgttgaccacagccgcgcaggtcagcgagacggcctcgccgccgggcgggccgtctcgcacggccagacgcttggtcgcgccgcccacctccccgccctccaccgtgctgctaggaaggggcaagggggggggcggtgaatccatgcgaggctgggagagcgggtctgtgagacactccatgcgtgtccacaccccacgcatgggnnnnnnnnnngcggtgaatctatgcgagggtgggagagtgggtttgtgagacgctccatgcgtgtccacaccccacgcatgggccaacccgggtgacaggcgccgcacaccctggctcatgagaggacactcacgaaccctcacctgtggagcgccaccatccctccggcctcctcgatctggcgctggagctccgtcatgagactagtggtgggaggggacaggaggaggggaacttgtctcgacgtatgatcgtgcagcaaccccttcccagcgcttgggcaacccctggccccgcttcctcacaccctctccactataccccacaaacctgtggctgtcgacgatgcccgtattggnnnnnnnnnnacaaccccttgccccgcttcctcacaccctctccactacaccccacacacctgtggctgtcgacgatgcccgtattgggcgcaagcagccctgcgacggcttgcacctccggctccagctcccggatttcgccaggggtgagccgctccagctccacgccattggccgcagccgaccgccgggtgctctccagctggtccagctgctgatcgctggtggccaccagcagcttgccggtgcgacggacagggacattgtactgctcgcaaaacttgtacatgagggcattgccttccacgcacgtctgggccttgagactcccgggggggtagtagatgcctggtggggtgggaagggggttgacttgtggcactgaattcctaacgtgcggtggctgatgtgtgtggtgccctgcagacggggcatgcannnnnnnnnnaggggggtagtagatgcctggtggggtgggaggggggttgacttgtggcactgaattcctagcgtgcggtggctgaagtgtgtggtgccctgcagacggggcatgcactgatgtgccaccacacatgctcgcagactcacctgtccccaccaagagtcctttgaaattccacttggcaggacatgcgactgcttacaatgccacgatggtaactttgaccataatgcatcccacctgagtgtatgacctcgctgttccggctgcttgtctgggtgccgatggcgggtccggaatccagcaccaacacctgacgacccgccaggccgagctccctggcgatggcgagacccaccaccccagctccaatcaccacgacatccgcgtctagttgggattgggcactcgcaaagcgcctctgtagacctcgacagtgtggtaggaatggagccctacgcatgggcttggaggagaggggccagcgcccaacctgagcactacataggatcagtactaccaaaaattgtcctgaatctacaccagctgcatgacccaacctccgacctgggccatcgcagtcctgtgtgctgggcgaagtgatctagcgatttgcatcacgcgcccgcgccccggcaacaaaaccagataaagagtgttcgggaacggatgggagggcgagctcccgaggtcgtgggctgctatacatgatagaaatagggataaatcacacacttagacgttctacccattgcagctgtagatccttcccccgccgggagcatagaatgttccctcccaagagggcgttgacatggaagttcaccccattctccagctttgcaccacttagagcatcaaacaggagtgaatggagtaagcatggtcgcgtcaggcacgcagcagcggctgcagcaattttcagcggacttgctgctgcaggaattggagcacccatcaagtgagaagggcatatgccggtagtatgcgacatggagtgttgcttggggaatgtgtcgatcattcagccccttttatgatggttcccaggctaagaaggaattcgaggctgaaaagagtggccgccggcgcaagtcggaccggctttgggcacccctcccgacggatgacagacctcctgatcctggcgaatgtggcagctttcggcacgcagctcctcaccaagcagggtctcacggtgtggggtgccaaggtaggcttggcaggctgggatgctgagggcaagtgatatctacagagaaaggcaccatattaaggttgatgggcaggttgaacagaggtcagctggagggacattggaccctatctctgtgcggtccccttcctgcacctgcaatgcataccacatcctcttccttctgtgcgcagcgcgacacatttgcttcaccctgccatctctgcaggtgaaccagttgattgtggccggtcagtactggcggctcatcacacccgccttcctgcacggcaacctcgtacacttggccatcaactgtgcctccctgaatgccctggggggcaccctggagggactgtctgggcgggagaggctggcctctgtctacatggtggctgcggtcacgggcaacctggccagcttctggggcagcccttcggtctcgctgggggcctcaggtgcggctcgaggttgggatcagggggagctctaggttggtcctcacaatccacctgcagttttcgtatgataatcccggctttcacacctctttgcaccctgagctcatggcatcccttcatccccctcctgccaggggcgatctttgggctcggcggcgccctggccattttcttctaccagaatcgcaatctgtatggccagcgcagcgatttcgtgctcaggcagctgggccagacgctggcgctcaatgtggtctatggcttcgtgagtccacgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctaaaccgtctggcacacactcccagggggcacctgggcggcctcgtcggtggcgtgctcgccgggtacctgcttggacccaggctgtcgcttgctgagaccgtagacggccgtaaagcgattgtggatgagccgccgctcaggctctttgccagggacccggtgatcctgccgctgccggggggtgggcgtgggagacggggctgaggcatgcctgcctgacacgaatacggttttccgtatagattctctcatcccagcattctccagattgtaattcaacccatgttgggatgagagaggcaggaaggaggatggcccacattccagacactctcacgtaacctttggtgtgtgtcgcgctcatggttcaagcgaacctgtctgatcggatgtcaaacccaaccagacagcgtgaaaacgaatagatctcttgtgatcatttcctttcactattgcctgccgctgctccctcttcatcgcggaagggttcaccacgacatggccacggtcgtcaaggacgcagccgaggctgtgcgctctcgcctgaatgccgtcctggcaggagttggggaggccccgagcaccctgatcagctcctcccccgagtggaaagcgctggaggcgcacgcggtggccgtccagaagctgtgcgtaagggtttttggggtttggggtcagaggaaccagggcgcgctcccccccgaaggcgtattcccaacccccaccacccccatcaggcatctcaaggatctgctcagtgacgatgcgcggaccaccgccctgacccgggaggccgagggcctgtacctggaccttgcccgccagaatgcaacccccgaaacgctgcaggtggggggtggggccttggatgctttgatgcagggccatgcacagagcaggcagcaaagaaatgtgaaaatgattcatgtcgacattgcagagcctgcatccgtcagcagcattggtgcacagtctatcattaactccagcaatgtgcgtgcccccatgcagctgctcctggcgctggcagagaaggcgggtgtgaagaccaagatcgatgccatgtttgcggggcagcacatcaacaccacggaggaccgggctgtgctgcatgttgccctccgcgccaagcgcaatcaggttggcggctgtggtatgtctttgctgtaatgtccagcagagtttgtacgcatgaggcatgagctggcaatggaggcatgccggccctcacagcatgttatctggcagcattttcatttcaaacggctccccaaccaggtgatcaccgatgccggcaagaacgtggtgcccgaggtctgggaggtcctggataagatcaaggcgttctctggtgcgccgggatgtagtatttgcgtggcggttttggtatgtaaggattgggcccccatacgagtcttgcggcttagaagactactctgccatgattggaatgtcaggcttactgtcctggcacttgttacttgcccctcatcacttcccgtcccccttctctcccacactcagagcgggtgaggtctggggagtggaagggtgtgacgggcaagcccatcgacaccgtcgtctccatcggtatcggcggctccgcgctgggtcccctctttgtccacaccgccctcgccacggcccccgaggccgccgctcaggtcggtaaaactttggcattcaatgcaactgccgccctcctgtgcatgccatgagcaatggcagctggcactcggcgacaccctcttaatcccctcccttggacatccgcacccaccccacccctcctattcgaaggcgggcggccgcaagctggtcttcctggccaacgtcgacccagtggacgcggtgcgcagccttggcggcctgaacccggaaaccacgctggccatcgtggtgtccaagaccttcaccaccgcagaaaccatgttgaatgcacgcaccgccaggcagggctccgtgaattgggacagtgtatgggggcaacggccctgttctgcatccagtaactgagcggcattgtgtctcatgcagggcaggctgcctgcgtgcctggaagggtcccgcctctaagatggtatgccaagctagcctccctcatcccctccccccgccctttacccccctctctccaaagggcctggctgacggccgcgcttggtcaggaggcggtggccaagcacatggtggccgtgtccaccaacctgccggccgtcggtgcctttggcatcgacgccgccaacacctttggcttctgggactgggtgggcggccgctactcggtctcctccgccgtcggcgtgctgccactcagcctgcagtacggcttcggggtcgtgcgctccttcttggacggcatgcagaccatggacgagcactaccgcaccgcgccgccctccagcaacctgcccctgctccagggcctgttcaacgtgtggaacgccaccttcctgggccaccccaccaccgccatcctgccctaccagcagtcgctggcgcactttgcaccccacgtgcagcagctgtccatggagtccaacggcaagggcgtgtcgctggacggcacgacgcttaacttcggcgcgggcgagatcgattttggggagccggggaccaatggccagcactccttctaccagctgatccacnnnnnnnnnncaacttcggtgcgggcgagattgatttcggggagccggggaccaacggccagcactccttctaccagctgatccaccaggggagggtcatccccgccgagttcattgccatcgctaccagccagcaggatgtctacctggaggtgtgtggtgggtgtttgagaggaaaaaggagtcaagaatggcttggcacggttcctgtgcttggggtagggaggnnnnnnnnnngccagccagcaggatgtctacctggaggtgggtggtgggtgtttggggaggacatagagtcaagaatggctcggcacggttcctgtgcttggggtagggaggggttgggggttgggacggtgtcgctcactgtcgggcacatcgccatgccgccgccccgcgctttcttggagctcgtccaacccgtgcacccgttctcttctcccacagggcgagaaggtgtcgagccacgaggagctgatgtgcaacttcttcgcccagcccgacgcgctggccctgggcaaggatgccgcgaccctggcgggcgagggggttccccaggctctcatcccccacaagaccttcaccggcaatcgccccagcctgagcctgctcctccccgacctcaccccctgcaccctgggcaagctgctggcgctctacgagcaccgcgtggccacctccggtttcgtctggggcatcaactccttcgaccagtggggcgtcgagctcggcaaggtgacgagggggatggtgcatgtgtgggggattgagggtactcggggaggactggcagtcacgggaccctttccaccggcgccagccccaactctgtctgaggtgctggccggcgctcggtgcctcgccttcggcgctgcctgggcacacgctgccgagctctgcgagtgtgccgagtcaagctcccctccccaccccccctcctgcaacagnnnnnnnnnntctcgcctacggcgctgcatgggcacacgctgaggagctctgcgagtgtcccgagtcaacctcccctccccaccccccctcctgcaacaggcgctggccaacaaggtgcgcgccagcctcgccgccgcgcgctccaatggcaacgccctgcgcgccgacgagggcttcaactcaagcaccgcggcgctgctcggccgcttcctgaagcagtaccagcccaaggggccttcggatggcgcccccgctctgccctccgcgttgcagtcggcctgatgggcgcgtcggaaacgctgggcgcaaggtgtgcgaggagctggaggctgggagtgggagccccacggccatcatccggccggcccctgctccgacaggcagcccgggggagggcgcaggcagggtctcatggcttgcaagctgccagacnnnnnnnnnnagggagtgggagccccaaggccatcatccggccggcccctgctccggcaggcagcccgggggagggcgcagccagggtctcatggcttgcaagctgccagacagcagccatgagatgtatccatgtgctcgtcgagagcgatttgcttaccataacctttctctgagacctgaattggctgacaaagcacgggcggtcctcatcccacatctgagcctgggcatgtctgggcgccggggannnnnnnnnnctaggacaccaagccctcgaccctggggtgccttccaggcgctcggcggacgcagagggtgggaggcccagtgctccgaggcattcgcgggcgagggcnnnnnnnnnntagaactttgctctgagacctgaattggctgacaaagcatgtgcggtcctcaccccacaactgagcctgggcatgtctgggcgccggggactcatcagccagccacctttgcttgtgccctgccttcctgacagtgtgtggtcacaacaagatactgtgtcagtgcctcgagtggaagactgcgggtccacccctccgcagcaggcaagggcgtgcaggttcaagtggtgggagaataggacaccaagccctcttccctggggtgccttcaaggcgctcggcggacgcagatggtgggagcgcagtgctccgaggcattcgcgggcgagggctggcaactatgcacgtggcgcctcgccaggcaccactcccgccggccaccgctgcgccatctggcgcccccgccaggtcccgcccgcctcagccctgcttgcccagctccacctttttggccatgctgtgcagggagtgggtgatgccgtccacgatgcccgccacggtgaacacgccgccgatcacggcgcaggtggagatgaggaaggagaagaggggcttgcgcacctcccccaccaggatctggatgggggacatggtgtacgacaccttgaccgaggcgtggtcggcggcgtcgtacacgtgggactgcaccgtgtactcatacgcgtcgtaggcatcgtgcccccgccccgcctcgatggtggtcagcaccacctgcgcatagtgctcataggtggcgcccgtggaggggttggtgaaggagcgcccgcgcagcttgtccgaccagtcgtgcgccaggccgtggggatgcagccgggccagcgccgcgcggcgcctgtgtttgttggagggatggggaggaggggtgggggggtgttcgtggctgccatggtgggggggctggggccacgacaaggccagtgagcggagcgatgtgagtcacagacacagcctgccaggcacccaccaataatccacatgctggctccaacgactgcagaggcaggggaggacagtcgcagcccctcccacacacccccaagggccaccccccccctataaatcctacttgggcgagggcgcgaggccaaaatagaggtggttcacggtgtgcgacaggtcctgggccaggaagtcgattgagtggccgggggcgcgtgccacaaagtgcatggtcccgggcaccttcttcaccatgacgaagccggcaaagttgcagcccgaagcggcggtcgcggcgcggaccgtactgagctggcgcgcggccaggttgggcgtgcccaccgtcggcggcaccagcttgtccgccagcgcagtcagggcctccttggtgcggtcgccgtagtaggcgtcgtgctcccggtggcccatgcgctgcgaggcggtgatttgggggagagagacagggttgggggtcaggaacattcttaaagatgggaggggaaggagaagactgctttgatttggctgcccagcagctgatctcccttgcaaaccagagatccagtgagtcaaagcccgatggccacagcggcggccgatgaggcatccccggcttcaccagggtcacatggttgcagatggaccctttgcagaggggctgcagagggttcctgcagcacccaagatcacacctctcaaatccctctctacatccaaacgccgcaatccacgtacctcccacatatacccccccattgccgcctcaccacnnnnnnnnnnggaaagacagggttgggggtcagaaacattcttaaacatgggaggggaaggagaagactgctttggtttggctgcccagcagctgatctcccttgcaaactagatatccagtgagtcaaagcccgatcgccacagcggcggcggatgaggcgtcctcggcttaaccagggtcacatgcttgcagatggaccctttgcagagggcctgcagagggttcctgcagcatccaagatcacacctctcaatccctctctacatccaaatgccgcaatccacgtacctcctacatatacccccccattgccgcctcaccacgacctcgtcggagcccttgtggaagatgcggatggaagggaaagcggagatgaagtgctggcggcacagcggcgcctgcgccacgcagtccaccttggcaaaccggatgcggcgctcggcgtcggggtacttggcgtgcaccgcctcggtgaccgcctcccaggtgggcgccaggcgctggcaccaggagcaccagggcgcgaagaagttgaccaccaccacctcgtaggccgccagggtcgcgtcgaacgtggcccccgacagcggtgtggcgatgtccacgttctcgtactggaagccctgcggcgggaggtttgttttgagggggggctcttggggctgggcagtcattgcctggatgggaatggatggccattcgcgccctcaggactccattccccaaggggcacacggcaagcgcgagcatttcagcattggcattcaccaaacggagtttgtgggggtcccagctgagcacagcagtgtccagtgcaagtccacgacgcactcctgcgggcatcgaccgcccagcatgccaggcgtccaccccacaccttcgttccagctccaaaacactaccccttccaaaccctggcccccttcgccagcctcaccgggtgctcctcatcgtactcagggttgtggtgcgccgcgtcctccagccccagtccgactcgctccaggcggtcgttcagcggcaccttgcgcacagtcttggtcaagttgagccgcttgaggcccatggcgtcggagatgtccagcgtggcaaactcgcagctcatgcgcggaaagctgaggtcgaagttgacgcgcaggagttcaccgtgcgccgatcggtccacgatcatctcggtgtgggtgctggtcttcaggaaggagtgcatctcctgcgatggggacggcagggggtggtggtgggaggggctctgcgccggctcctgggtcgccattaggtacagtcggggcacgcaaggctacaccatcacgcatctcaccaggcccagcaggaggaggatgagggtggccgcggtgacggagatgacggccccagccagggttgtctcggtgagatcactacggggtgggagcgggcatctcattcatgcacagcgctccaagaggaaaggcacgcaatgaatatgctaccaataccttgggatcttcttgtagaagtccaccgcccgcaggcgctgcagcacccgcggagccatcgcgttggttgtccaactcccgacttattgccccttgagagcctgtgcacgacacataccctgatctgagccaatgagttgtgtgttccaaatacgcttggaacactacgcaaatgcaatggttctgcatgcgtctgaccatttttgcatcgaggcgagagtggtccgagcgcgcccaaaacatcaagcacattcactgcatggatgccacgatcctaaacgatctggcatgctccttcccacttgacggcatttgatggtattgctagcagcatagatacagaaactcggcgatatgacgaaagccgctactgcgggtgacgaacccatcggctggtgctatctggatgccagctcccagagccagggaccctttcccctcgactacttgcaacgtgagaggaactggaggggtcgtgcaatgtattaagtggactgatcggcgtgctgcagagtggtccccctctcgcctgtccatgcaggcctgcaacaggctggatacttccatgccgaaacgcttttctggcgggaggggcaggcggagtggaaacacctgcaagatatccccgacctccacgcctccctggaggcagccacactggcggctgccccacctccagcggcgcagggagcagcagtggatggatcaaccggcgatggcccggcagccccgcaggatgacctgagcaccttcatggctgagatctcggcgctggatgctgaggtaggggggattgctggatgctcgggccggtgctgcatcaaaggaaggaacaggaaccattcgcgcccccgattctcgcctctgttccacagcaggctgatgatgggcccagcaccccaccgcccgaggagcagaccttcactgatgacgatggcacggtctacagctgggacccggccacgcgaaagttcctgccacagggtcaggggggcccaggcggtgctgctgtgcagtataacccagaggacatggtttttgagggggaggagctggacatcccggattttgtccgcccaggagacgaggtcaggacctggtcgagggcctgggtggtgcgggggttgcactctggagcgagaaggaatatgccgagggaagacttggtggtggtcaacctgggttctgagatgcactnnnnnnnnnnggggcctggctggtgcaggggctggcactctggagtgagaaggaatgtgccgagggaagacctgatggtggtcaacctgggttctgagatgcactttgaattcgaagccggctcacagccatgtcgagtcctcgtcgccaccacagtcttccgcttccgacggagaggaggagtccaagaaaaagaaggcaaagcctgacgccaagactggcaagccagcatcagaggcagccaaggatcccgtgaaggaggagcagccttcgagccgcgaggcactgttggcagaggtacggtggattgagcagggttgattggcccttccctgctcctcgtctgtgattcatcctcggatttcagtgcttgagctcatgagccaccgctggttgccgattcccatcccaacacccccaccttccacacccaggcaaaggagaaggcagcccagaagaagcaggcgcgggcagccgccagcgcggagtggtttgagctgaagcgcaacaccagcgtgtatgttacgggcctcccagaggatgtcaccctggcagagatggtggagaccttttcaaagtgtggcatcatcaaggaggatgaccaggtgcgatgtgtgttgaattgggatacgaagaggatggatggatcgatggatggatggatggatggatggatgggcagcgtgtgcattgagtgcgccaggcctgggactgcccattcatggtagtatgtaagcaaggcttccctccgagtgcaatcctcatnnnnnnnnnnatgttaaattgcaatgagaagaggatggatggatggatcgatggatggatgggtgggtggatgggcagcttgtgcatgaaatgcgtgaggcctggtactgcccattcatggtagtatgtaggcaaggcttccctccgagtgcaatcctcattcaatgggatatcttacccactcggagcattgccactacattgtagcggcaaccccgcatcaagatctatcaggactccaatggcatgcccaagggtgacgggctagtgacattcctgaaggagccgtcggttgatctggcggtgcagctgctcgatggtgtggcattccgctacgggctccaggtgaggagaaatgttccctgaaatgagctgggagtctcacgttagattgacaggaggattgagcaaccagcatgatgaggccactctgctggcaatagccccctgcacctcattggctgcctatggcaaggacgaccgagtcctccgatgcgaagctggtcttgcgagggtctctcaacagcactttggcctctcatcccactgcccccctagaacatgacggtgtcgcccgccaagttcgagctcaagggcgagggcttcaagcccaagcagagcgccgggaacaaaaaacgtaagaagaaggtgctggagtcgttggagaagcaggccctcacctgggacggcttcgatgacaagctggcgcccacccaggtctggttgtgcggtgggatttaagatggggacgctggtgccaccagacccaagcctgcaacggagcagcttgtgtggaatcaagaccggactgctgccacatcttgggcgcggagttcaacatcaattgatgtgtgttttggcagctcgcttgattggcttatagagtgggggcgccttgaacaaaagctccatctcctcttttccagacaaggcagcaacccctccctgccggaaccacccctccatggcaggtcaccgtgatcatcaagcacatgttcaccatcgacgagatactggaaaaccccctctacagcgaggaaattgagagggatgtcctcgcagaggcgggcaggctgggacgagtggagaaggtgagatggcacaaaggtgttgtgtgaagtataatcagcagttgcacgggagcaggaagctggcatcacattgcatctttcgactgcataccgcatagctttgggagccgcctgggcaacacactctccatgcgagctttttggtcatcactgcctcttcatactcccatccacactccctacacctcaggtcaaggtgtacaagggcaaccccgatggcgtggtgtcgatcaagtttgccacaggggaggcagcagacaagtgtgtaaagctgatggagggccgcttctttgctgggcgacggctggcggcattcatgtgggacgggtacaccaactacaacatgaagctgcaggagactgaggagcagcaggcagcccgactggaagcatttggaagggagctcgaggagggagggaaggagcaatgactggtggatacttgctgcccgtaaaacgcaatctgtatgttgaaaggtgcacatccaatctttccaggactgcaaggtatgccagggcgcgagaatcactcccggcggactacagattagcgacccacaggggagtatacgagtagattgtatgctcaagtgctcgttgtagagatcaaaaacttaatagaacttggtgtgagagggagccactctagctggatcgagtgccggttccccttaagccacccacccctgtggacacccgaatccattgcagcggggtctccatggaggcgatggagggggtagtgcatgaagtagacaatgggaccgtctctgccgcatcacacaccgtgtacgtgagtaacatcttcgagaagttgaagcttgaaggtgcgacggagcgaggcgtggagggattcaacgcgtcgatgctgtcctcttatcacgctttaaaccactccgacatattcataccgcagagctcaaaaattgcatgcggacaatcttcgagcaattcgggccggtgctggacgtggtcgctcgcaagacannnnnnnnnntaccattccgacatattcgtatcgcagagctcaaaaaatgcatgcggacaatcttcgagcaattcggtccggtgctggacgtggtcgctcgcaagacatatcgcctgagaggccaggcctgggtggtgtttgagagggcagaggatgccgagaaggctgtcaagctcctacaaggtttcccgttctacagcaagcagctggtgggtggcgctgtggggtcagcgctcctctgggcaggggggatgaaagcccttcacccgggagcttgctcagtgcacatgcgtcttcagggtggacgagcaacatgatgtgtcttgcgccccgatccacacaagctggtcccaacccctacaccccgcagaagctagccctggcgaaaacgaaatctgatgctgtcgccaaggtagagggcgtgtattctgaggagtacgttgaggcgcgacgcaagaaggccaaagaagacaaacgtgcgtgggatcggcaaggtggattggttttgcagaggtcccatgaggtcggctggtgaaaaggcgagcacactccgatgtactggcagcctatcaccctctacgccgactcattgtgcttccatgctgcctctccgcagaggccgtcgcagcggtcgcagagccggctcccgtcggctacgcgccacccgtccaggggggcccagccgccgtccatcccacagagccggcggtgaatgcgcccaacaagatcctgttnnnnnnnnnntggctatgcgccacctgtccaggggggcccagccgccgtccatcccgcagagcaggcggtgaatgcgcccaacaagatcctgttcctggagaacgtccctgccgggaccaacgaaggcatgctctccgtcctcttcacacagtaccccggtttcgtggaggtacgcaggggtaggcctgtgcattgatgtttgagaaggcactggccggctgcatggcttgcgtgtcggcctcgcaagccgcccccccatcccccgctcctgggctgctccctgcgtaggtgcggctcgtcccccagcgccccggcatcgcattcgtggagtttggcgatgagcggcaggcaggcacggccatggtctccctccagggcttcaagatggccaccgacatgcccctgcgcatcacctttgccaagcagtgacccccgccgaatggtgtgtaagtgattcgctctcttgctctggcgcaagggtacatcaagggtggtttgcagaagagcaggtgcggggacgtccacgtacagattacagcaggagccgcgcagcgctgtctcgcactgcgcgggcctcacccgcgcttcagcacgttcatctcctcctcgcggggagctcgcgccactggctgcactgctgcgcccctgctggtgccttgctgtagggccgcgcctgtgtggcggagcggcctggtgaggaacatcaatgcattatcatcaggaaaccagaacctggtgagagctgtggcacaaaccccnnnnnnnnnncttttgcagatgagcaggtgcggggacgtccacattcagattacagcaagagccgcgcagcgcggtctcgcactgcgcgggcctcacccacgcttcagcacgttcatctcctcctcgcgcggagctcgcgccaccggctgcactgctgcgcccctgctggtgcctcgctgtagggccgcgcctgtgtgacggagcggcatggtgaggaagatccatgcatgatcatcaggaaacctgaacctggtgagagctgcggcacaacccccaggataccatctcacccagtgctggcagccagggaggcacctgcaccatccattcctcccttcttcctcacctgtcacaccccccgcggcgaccaggaacgcgccggactttgcccctgctgccaggcccaggggtcccgccatgaggccccccagggccgcaccagcagcgaccgccccagtgagggcgaggggggcaccctccaggcggtcgcgcgcgtctgtcaccacagatgacaccgaaacctgggccctgctgaggaggtcggtgccagtggagccgaggctgggcacgggtgggaggtaggctgcccagcccgaggacacctccgcctcggcttgtgcgtggctgccgcatgacgttcctggtgagatgcccgcattgtcacgcgccacaggtagaaggtggccaagcccacgcccttggcccgcctcgtatgcctcggcaggagtgccccgactcgacaccgggagcgaggctgaggagctggtgcttggggaatgaagagggtccctggatacccgcgggnnnnnnnnnngttcctgcagtatggcatccaagtcttcgagtgtctccggctgcggcacaaagtaggctctggccgctgagaaccactccgccatggatcacttcggcacccgcgctggtcacgagcgttcacgcagccgatgttcgtatggagctctcatcgtggttgaatctgttgtacatcatcgtatctgacggacggccgctctattgaggctgcgaggctggcaccgactcctagcgataccctatgcgaggcgcgaagtccgacagcacagcaaaaatccgacctccccgccccgtctgcggggatggtgaagcgtcgtaccgtgcatcaatttgacaaccatgtttggtctcttctcaccatgaagatcgtcgggctgtccgggggaatcgcgacggggaagtccaccttcgctgcagagttgaggactttggggttcccagtcatcgactctgatgacatcgcaaagctggtcgtgaaaaaggtgaatcattcaagggcttgaagggcagtctgtatcttttttgaacctcgtatgagagctccaaagccacggcgttgcaggggcgatgggcgcaccgacgtatcnnnnnnnnnntccgtctgcgggcatggtgaagcgtcgtgccgtgcaccaatttgacaaccatgtttggtctcttctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttgaacatcgtatgagagccccaaagccacggcattgcaggggcgatgggcgcaccgacgtatcgtcaaggctttcggcagcggcgtactcacacccgatggtagggcctactgcagacggagatctggggcatatggcatataccgaaatctagatgtctcaattatggaagagcacacctgcactgcnnnnnnnnnncggcctcctgcagacagagatctggggcatatggcatataccgaaacctagatgcctcaattatggaagagcacacctgcactgctccgcgcaggagaggtggatcgtgagaagctgggtgacatcatttttagggacccgcacgcacgccgggctctgaactcagccactcacctccccatcctggggtatctccttgctgacttgctctccaactttctacgcttcaagacagtcgtggtgggtacatggcgctgtcccgcagtcctttcggaggtcatgttcttggggtcacttgggctggcgtctcccacacttgtcgttgcttgccaagggtctccacgtccctctatacacaagcaatgctacacgctctgcatcacacccctgacattcccatccagatcgtcgacatgccactcctctttgaaacggggttctatcacttcaccagcccccgcctgctggtagctgccggggaggacatgcagcgccgccgcctgatggccagggacggattgagcgaggaggcagccgatgtccgcatctcctcccagatgccactctctgccaagaggaggctggctgacatcgtggtcgaaaatgatggggacatggaggagctgaggcaatccgcacggactgtgggtggattgctgcagcgtcatcgctggctgcacatctggtttttctcgccgctgggcctgggtttggtggctgcggccctcttctcactgcgctgaggatgtacttgtattactcaggagatttcgactcttgtatccaattgctgtagcgatagtgtacgtgtacctgcatggttgccgtgtacacatcgcctcctgtgtatattcgacctggacgcccgatacttcgctgtgtttctcagcatccggattgtccgcggctcgggaccggagtgggtgtcgataccttgatcccattttttcaccaatctctctccgtattaacagcttggagagcgaaagattcaaagaaaacaattcaagctctctgtgatgctgcggtggcgggcatggtgaattctgaggtgttgaccgggtcgacatgttcggcttcgtgagcgcgctcaacagtgccttgcaacctgtacgtcccaatagtgtgccctctggaccttgggcacctagagcatcccataaacagcccacgactgtcactcgctggccctggctgggcggggagctgactcggcttcaggatgagtattctcgtctgcagatcctgtacgcgggtctcgccacaggacgccgtgccgacccgcgaccgcatcgcctgctcacgagtaagattggtggcatccaggcgatgtgagtggcatggtggatttgcaccgccacgagatgttgtactccgggttaccttctccatacaccctgtgcactccattggcacaggcgtacgctcgtcccgtcacatcagcaaggcgcagagagtgcggccccggtcagcattgctccacccctgccagcaacctccaccgcacccctccgcacgtgccccatctggagctgccgggcaatcccaggctggacggcaccatccccccgccaagcgaccagaatggaacgaccaggtggtcagcaaacctgccaccgagaagaccggaggtttcctgagggcagggtcacgcaacgctcgcgttgcccttccgaagtctggtccaggtcagccagcgcatggtcagcagggcagcgcaaaggtcgcgagcgcgacggcccgcctcatggccgccagccgtgcacggatgctgcggagcagtgcagggggccaacctggtgcttcctgggccgtcactgtggtgagggtccctgtcaggctggggtctggggagcaggaacaaccatgaggaggtatggctgcttgcttgattgcttttccaaatggatcccctctgatgctgtgcatgcccgcctctgggtgcatcctgcgtgcgccctctgctcgccttctaccctttgctcgacatgcatactgcaggtcaccggtccaggggaggtgtacacccccacacctcgccagggaccggccccagcctccagatcagctggtgagggtggctgggctgcggggtccagctcgccgcggcaaccccagacccgagcggcaaggctgcaggcccaagcctggggagaactggggggtgagtatttgctgagagttggttaaattggattggtgatggcgcctcaagctgcaggcttactctgactgcccaacctgtgtgtgcgcaggcatgtcgctgtgtgaaatcatgcagccggttgccaaagtgtgagccccctatcttggggtggaccctccgaaacttcccatcctccgacatcaaaggcgcgaccggcgaaacatgtacaactcggtcaaataacaacaccgcacctatttctaatgatatcagactacattacatggagcagaactactccacacgaacaagctgcatatgtccacttttaccggcttgtcagatcagccaccagacgtgatcctggtgctggtgctgcacctcgcctcagaccccgannnnnnnnnncccagcttatcagatcagccaccagacgtgatcctggcgctggtgctgcacctcgcctcagaccccgatcgacggctgagagacgtcatcaacctcgcattcgcatccaagtctctattgagctcggtcacaggccttgatgtgttctggaccaactggtcccgcaccgtcttcggcaggtgagccccagggtggggctccgcttgggtgggcatgcagcaacttaccatgctccccccacaggatcgtttgggtggcataggcccctaagcacctctaggcaatcaaaccccccctcacattccaatcacgggcctctcgtctttcccatgcagacccagggagactgagactgtcctgcccctgtggtcggggtggtcatacttctcgggccgcatgcgccgccgtttccacctgtgtcgggccatgcatgccctgctgttcaggcaccctgcccccacgtacctgatgtcgggccatgacatcccgacgctgcttgcggcagaggccgggcacggggtggagctgcctgagtgcctgtgggacttgtggcgggtctacgatggtcactccaacaagtcttccaggggcatcttccagggggcgcacatgctgcggctgcaggaggcgctggagcggctgccctcccaccgacccgggctgtgcatggggggcccgccggggacggacggggagccggggcccctgatgccatttaccaccggtcctccgtactacccctgcggannnnnnnnnntcctcccaccgacccgggccgtgcatgggggggccgccggggacggacatggagccggggcccctgatgccattcaccaccggtcctccgtactacccctgcggattctacacggccgacctccaaggccgggtgtggctgaccagcagcaaggtgagctggtacgtcgcagacaccctgacggagatggtccggctcgcaatgacaggagaactggcggagaagagggggatcgtgcttgccgcctccacacctgtgacaggctgaacgaggaatgggtgtgcgcaccggcacacctgcggcccccgcttggcctgcccagggtgtcgggggctgtacagtcagggtgcaacgcaaggaagagggggttgccaagagacagcgtggtcggaccgtcgcatgctgcggcagtgtgtgcatgggggtgtgtgtaatgtggcagggccgggccacctcatgccagcagcggtgccggcnnnnnnnnnncgctgcggcagtgtgcatggggggatgtgtagcgtggcagggccggggccacctcatgccagcagcggtgccggcctgcgggcgaggaccttccccggcggcgcgcgctgcagcaccttcatgagccccgtgccggtgggcatggggatgcccatgatgatggactcgctcacgcctgcggtggggcggcggggcggtttgatgcggcgccgacgtgcaggctaagggccgtacccaacacaggctgctctctgtgtggaggtgaactccagtagtggtcggcggcgccggccnnnnnnnnnnccgtgcaggctcggggccgcacccaacacaggctgctctctgtgtggaggagaactccagtagtggtcggcggcgccggccgcccacgtcgagagcgcacctcctcgctcctcaccattccataagcgaggcacttcccatgaccctcttaatgccccggaccccccccaatttccccctctccccaacgtctcctcacccgtgnnnnnnnnnngagcgaggcacttcccatgaccctctcgatgccccggacccccccaaatgcccccctctccccaacgtctcctcacccgtgatgtcgtccacgcggccgtgcagcgcggcgtcaaacaggtggtcggtggtcttctcgaagctggccagcatgaggacggagtccttcatcttggcgatgccgaagcgcgtgatgcccagcacctccccccgcgccgtcatgcagtcggccagaagcatggtgtgtcgcgcgtcgatggccatgccgtgctgccccatggtgtaggcgatctcctccatcaccgtggcgcgcgcggcctcgatgcccagcgtcgccaccacctccgccacatggttgctccgcgtcgccaggcccgccacgccgggcgtgcccatcaccgcctgggatgtttggttggtggggggaaggggaaaggggctcaggctctcgtacatggtggcaagggaggttcaggtaggtggcaactgcacgtgtgaccgtctctgggcccctctgggggcagcgggagatgcaccagggggccatatccgtatgagacagagtcacggtgtgctgtcaagcgtccaccttatcctggacacgcaaacagggctcgatgactcccacagcggctgacagcaagccccaccaggtggcgtcgttgatctaccattccccccttcctcgggcccaaagcaccaccccatcctcctccgcaccgcgaggttggtgccctccacgagcagattgaagccgccgccctgctttttgttgatcacggcgcgctccaccgtggggatgcccctcacgatgaccccgggcagcgcattctccagcgtctgcagctggaagaggacgggcacccgagccggctccagcggcggccgcacctccagctggtcctcaccgagggtgctgaaacggaggtcatgcaggcgggtggggggaacagggtgaggaggacggctgatctatgtgagcgtactcacagctgctccgctgcctgtccagaatcggcattcccaatgtggcccccaccctcccctgctgtctacggaatcccacagctgccatcccccccccttcgcccttgctcacaggatgtgctcggccttcagcttgagtttgggcgcctccatcagggccagcttcacggtggaggcattgaggcccagctgcagcttgtggatgttctccatgtccagacgcactgcagggcaggtatgnnnnnnnnnnaggacacctcaaccccagcgccaggatcagtgtgtcccaatccctcgcggcgcaccctggacatggctcccnnnnnnnnnnagggttgcaaaggggggatgtgagcgaggggagggccagtgatgtatggggacagatggcgcggacgagcagggtctgggcagccagacaggataccttgcaacacatctgatgagccatcctgtacaacacggacctcccccttctcagcggcagggcagcacagcnnnnnnnnnntggggtgcaaaggggatatgtgagcgaggggagaggcagtgatgtatggggacagataccgcggacgagcagggtctgggcagccagacacgatatcttgcaacacatctaatgagccatcctgtgcaacacggacgtcccccttctcagcggcagggcagcacagccaatgcatgcaaaaccaagtgcgatttgcagcgggacaccaccaccccggcggtaggatcagtgtgtcccataccctcgcggcgcaccctggacatggctcccgctgggcttgagcatgatgcggatggaggcggccactccgccgaggcgcgtgcgctccaggcgccccttcacgatccgcgccgcctgctccgagccgtccaccgataaagcgacctggtttgggtgggggacgagggaggtttgctggcgcgttggagttgagggagagtctctgagatgtgcatggcgcagggtgtcagtcgtcgcactcccaacgttacatcttgatcattcccactggctgattcatgagcacgccggcctgctgctcttgccaccccagctcagcccagcgccctgacctgcatcagcggcgtggagatgttcttgnnnnnnnnnntgataaagcgacctggtttgggtgggggacaagggaggcttgctggcgcgtgggagttgagggagaatctcggagacgtgcatggcgcagggtgtcagtcgttgcactcccagcgttacaccttgatcattcccactggctgatccatgggcacgccggcctgctgctctcgcccccccagcccagcccggcgcccttacctgcatcagcggcgtggagatgttcttggccgcgttgatgatctccttgagccgcgggactcccagcgtcacgttcatggacgcgacgccggcaaagtggaacgttttgagcgtcatctgcgtgccaggctcgcctgtggatggaggagcgagcggggggatggattgatgtgtgtgggcgtcgacaagcagacagacaaaagtatatggcggcacatgtgtagcgtctcctgcctccgaaatccacacagtgcctctgatcgcaggcacaccatccacggagcgctctccccttcttcaacccccccaagagtcattcatctcccgtccgcgcaccgatgctttgcgcgccaaaggcccccaccgtcgccccgggctcgatgcgcttgcgctcgtagcgcgcggcgcactgcgcaacgaaccctgccagcgcctcgcgcgtcagcgcctgcacgcgcacgaggtgctccaggtggccagcaccccgcgcgtcggcgggcaggcccaggcgtgcccgcgcggcgcgcagcgcagcgacctgctcggcgaggaaggtcgccagacggtcgcggaaggcggcgctggagaagggggagccctcgccaaaggtgccttggcccagcacctgcgccaccgccgcctccagctccgcggggagcgggcaggcctgcgtggagaggcgcgcgccgggcgcggcgatttcttcctttgccgccccttcgccaccttcccgaggcctgcggggggagccggtcgcgtcatgggtcgcgccatggcccgtgccctgggcagctgcgctcgcgtctcgctcgggcccgcccgtcgctgcctcgcttgcgtcccgctgtgcagcgtcatgggcacccccgctgctcgccggagcaacgctggccacgcccccgccggtcgcgctgctggccgtcgtccgcgctcctcccgctcgcccagcggcgctggcgcccgtggccttgaccagggccaggacnnnnnnnnnntgcctcgctggcgtcccgctgtgcaccgtcatgggcacccccgctgcttgcctgcacgacgctggccacgcccccgctggccgcgctgctggccatcatccccgctcctcccgctcgcccagcggcgccggcgcccgtggccttgaccagggccaggacgcgctggaatgccacgggctcgccgtcctttccttccatgcccacagggtccatgccgtcctctccgtactgcagctgcaccacgccgcccgcggcattgcgcacggtgccgtcgtagtgcgcgtacaggtcctccagcgccttcatcagccggcgcgacatgtaccccgtctcggcggtcttcaccgcagtgtccaccagcccctcccgccccgccatggtgtggaagaagaactcggtgggggtgaggcccgagtagaaggagttggccacgaagcccttgcccgccggcgtgcagtcgccgcgcgggaagtggggcagcgagcggtcggtgaagccgttgggcgtgcgcttgccgcccaccgactgctgacccacgcaggccaccatctgggcgatgttgatgggggagcccttggacccacactggctcatgatgaggggggagttcagggggtgcagcgacgccatacacacctgggggtgcgttgggtagggggtcgtggcatggggcaggagggtgctgtggtggggggggagacgccacaggcgacaggcatggaaagtggatgccaccacccaaaccacaagcacccagcgcccccaccttggcggcctgctcccggatgttgttcaataccccggtcaccgaggcctccagcgactcctctgcgttgcaccccggctgcagcgccagcttccctcggccgtaggcggcgatgaagtcgtcgcactgcccgtaccccgcggccagcgtggcggccttggcgcgctgcagctccggcgccggggtcacgtcgtcgatgccgatggagaagccctggtcgccgatgaagcgcgccgacagcttggccaggcgtgacatggcctctgcggcgacggctgctgagtaatcggccatgagcacctggaagagaccggccttgttgccgccgcccagtgtcaccttgcccaggcggccacagatgaggtgggagttgtggaagcagacgtagccgtccgcggggcacatgtgctggccctgcttggtgtagatcttctccgccgtctccaggctcacaaacagcctgaatgaataaggggggattttttgggggtccttgggttgggtgtgcggtgggtgaaaggagctgggagatgctgagactgagcaagcacatgcgtcaacctactgcagggaccccatcagcccctccatctgagtattcccttgcaatctccccaccaccagcaaccaagatcctctccccagagaacccactgggccatgtctcacttgactcgggagttggggcgcaggagcatggtgaagacctgcttcccggtccacagctccagcggcttcacgattgcgggagggggaagctctatgtcctggcgattgtctgataatcgtatggaagagttggggtagagtgaggcgccccggtgcatgcgcgaaaatgggttaggaggggcaggagtgcactgctggtgaacaaacaaaatgcttgcgagcacaccagtcagttaccaccaaacaccgtcgacagtccaagggccccgcctcacccgtgaggtacgccagtgcctgcgccagcttggggcgggtgaagaacttgtccttggacgtgagcaggtaggccgaggtcagaaaatcctgggttgctgccaccaggatctccccgttcttgggtgtacacaggttgttcaccacccccatcagctgcagcgcctccgcccgggcctcctccgtctgcggggtgtgggggtgatggcgtgcagcgtcaggtctggtacatcgcagacaggcagcaccggacccagggctcccaggacgctccaatcccgccgtcgccacccctccccttccccggtcacagcccccctcgcagcacacacctgcggcacgtggatgttcatctcatccccgtcaaagtcggcattgtagggtgagcacacacactcgttgaagcgcagcgtccgccacggcatgaccctggcccggtgcgccatgatggacatgcgatgcagcgacggctggcgattgaacagcacgatgtcgccgtctgggacaggtcagggagagggatatcgtgacagggggaaagtccgggtgtggggctggtttttgtgcatcgtgctgggtagggtgtctattgatcagaaggacaaggctgagcggttgnnnnnnnnnnccgtgagcgggggaaagtccggatgtggggctggtttttggtgcatcgtgctgggtagggtatccattgatcagaaggacaaggctgagcggttgagatggaggagaaggcaccccgagaggcatggcagcgagaggaatgcatgtgaccaaacctcacatggctcctgatggtgcttcgaggagtgcaccgtactcgtctggcacgcaagggtcgttaccccttcctcctccccagccacccctcgaccaacccctcgaccatcccctcgaccaacccctcaaccaacccctcaaccaacccctcgaccaacccctcaaccccaccttcgaggtgcctctccacaatgtccccgatcttgagctcggaggcgatgcgccgccggtccccgaacctgaggaagaccttgtcgccattggggaagatgacgaaggaggcccccggccagtgcgacgcccccgccagcacccgctgcttcagcttctccatgttgtgcgctgtcacgcgctccgggtaggtcagggtcagggccatgaggcgaggcacgcacacctcgctgactcgcaggttggggtccggggagatgacggtgcgtccggagaagtcgacgcgcttgcccgacaggttcccccggaaccgcccctgcttgcccttcagccgctggaccaggccccgcgttggcttggcccccccggtctggtacattgcgctgaggccggggaggtcgctgttgatcaccgtggcgcagaggaattggaggtagtcccagtgctccatcaggttggaggcgggggcgccggcggccaggtcctggcgcagcgtggcgttggtctccacgatgttggccaggcgcatggtgatgtcgtcctcgttggaccctgccccggcgtccatctccacggaggggcggatgcagacggggggcacgggaaccgcggagatgagcaggtcctcggggcggccggccacgtccagcagctccagatcctatgcgtggttgtgtgaggggagaaaaggcggaaagggggtgtgaaaggagatgggtctgagggagacccggcatgtgcggcagctccttgtgctcctctactgcaggggtccgtcctcaacccccaggcgccacacccacacccacacattccgctccccaaaccccccaagacgactcacggcttgtggaatattagtgaagagctggcgcacgcgcagggggttgaggtcgtccatgactctggcaaggttgccacgcagctggtcgttgtactggcaggccatggccaggtcgtcttggatgctgtgggaggaatggggggaagggtgactacgctgctccgcaaagctgggtgaggccgcagttccatgcatcctcctgcttcctgccatgcccaaccttttccaatggcccacatgtccacacaaggatgccagtccacactcgcaggccggnnnnnnnnnnctttccaatggcccacatgtttacgcaaggatgccagtccacactcgcaggccggccggctccctttcagacaaaaagatactttgtgaaacagcagcatcccgataaacacacacgctgcacgtccccacctcccactctggaacaacccgcccgccactcacacgtcagcccgccccttgttccgggtgaaagggtcatggatgatcttgagcgtccccgtgaccttcttcaccacgccgttttccgcgccgcagtgggggcagagcttggtgcgcttgcatcggtccaggacgcgtttgaagacggcctcgcgctgcacgcgctccgtgcgcagcgagcggaagcggcgcaggaaggcgctgcgctcccccgccggcagcagcacgcgggagcaggtcttgcagacgcactgcaggatctgcaccgtgttcttcaggtacccgatgtggaacacgggcagctccagcttgatgtagcctgggaattgtagaagaggagaggcgagagggggttgggagaggtgctggacaaggactcgtgcatgagcagggctgcgcacaggcagtccatccacccaaggtggacaccatcggcaccctgatccacctgcttgctgcaatgatccagagcccggaggccaagcaggcatgagaagtgctgccagtgcaggtcaggcgcctggacccaaaacccctgcccgcctcaccaaaatgccctgtgcagtcgctcaggtgctggccgcacgtcnnnnnnnnnnacatcggcaccctgatccatcagcttgctgcaataatccagatcccggaggccaagcaggcatgagaagtgccgccagtgcagttcaggtgcctggaccccaaccccctgcccgcctcaccaaagtgccccgtgcagtcgctcaggtgctggccgcacgtctcgcagatggcgcgcttgttgctcacgcccagccgcccatccagcaccccattgggctgcggccggcgctccggcatctgcaggatggatgggcgtggcggggacctgagcatgctggcgaggcagcaggttatcacagccgtccgggcattcactcgcgcgcgaggcacctgagcccatttccccttcacccccactccaaccccagcatgtcaccttgtacagagccctctcgtacacatgcatctctgaggtttggatgatttcgctgggggacatgaggctgaagcgcagctgcttgctgcaccgtggaaggcggttggatgggtgggttggggcatggcagtggaagggtcccatcacgtcttcaccatgttccagtcatccctggcactcacatcctgcgggggacattgggctcctcgtacgactccttggaggaacacagcttggagcgctccgcaggacctggcggagcagggcgtgcccccgccatccctcacgggggaggcgccgagccttgcgccggcaactcgctgggcgggggggttcgcctgacacgagcgggggtattgggccgggagctcttcgtcaggatattaatatccagagctgtacacaatcaacagtannnnnnnnnntttcgcctgacacgagcgggggtgttgggccgggagctcttcgccaggagataaatatccagagctgtacacaatcaacagtacgagttagcacaccaaccccaggctgtgtatggcgcacgatggtgggtgttgcctgcatggacgcgagcgcgcgcgaaaacgctctcccgagatgaagcactgaccgggcggagactccgatcgcggcctgtatacaggcagattacgcagtcgcaatgccctgctctgcatcggaatggaacgatgaccactccagaatgaactgagcggagcctgtgcccnnnnnnnnnncacgcagtcgcggtgccctgctctgcatcggactggaactatgaccagtccagaatgaactgagcggagcctgtgcccgatttaggccctgcctggcgcggtcgggatggcccccctaaccacctacttcaaggatgaggaggactgcctgggcttccccatctgggtggccgagctggagctgatcgtggggagcgcgaggggatcctcccgccccgacagcatcgcctgcctggccctgctccacaagctggtcgccaccctcgcccgggcgggccgggaggaggtgcgggcccaccagcggcgctgcgaggacgcggtgctccacgtcctgctcaagggcgccccgccctcggtgagatcgagcgggtaatgtttcggggtcccaagacgggggggtgaaggcccccatgcattgatctggagggcactctcagatcacacccaggagcgcatccatcctcactcactgcgggcgcctttctgtccctgcgcaccatttgcctacgtgatccgctccctgggttcctggcacattatccagtccacccttgatacgcacccagcccctcctgctaatgcatctgcacaccagtcacccctcccctcccccccccttgaaactcgatccaggtgcggcgcctgctgtgcgccgtgctgtcccgcctgtatgcgcagggcgacacgctgcccctctactcccgcgtgtccagcctgcagcttttcctgggcacgcgcgaggcgcaggggcgcgagaccggcgacgccatccgcctgggcgcgctggaggcgctgaccgcgctgtacgccgaccacggcggcctcctgtccatcggcgtgcaggacacggtggccctggcggcgcggtacgcgggccgcgggctcgaccccggcgtgcgccgcgcggcgctgcgcctgacggcc

SEQ ID NO: 44352 - DNA, 61 bp, Chlorella protothecoides
cctggatctgggttgcggctcgggactgaggggggagacgctgaccgatgccggccatgtc

SEQ ID NO: 44353 - DNA, 80 bp, Chlorella protothecoides
gccgtgctgtggcggggcgcaggggcgacctctgtccccccaacgtcgacgccccctcccgcccctcctcgcagcgcgtc

SEQ ID NO: 44354 - DNA, 28583 bp, Chlorella protothecoides
  modified_base (145)..(217): a, c, t, g, unknown or other
  modified_base (404)..(440): a, c, t, g, unknown or other
  modified_base (1219)..(1228): a, c, t, g, unknown or other
  modified_base (1714)..(1944): a, c, t, g, unknown or other
  modified_base (2003)..(2012): a, c, t, g, unknown or other
  modified_base (2196)..(2205): a, c, t, g, unknown or other
  modified_base (2970)..(3078): a, c, t, g, unknown or other
  modified_base (3336)..(3345): a, c, t, g, unknown or other
  modified_base (5478)..(5487): a, c, t, g, unknown or other
  modified_base (6538)..(6547): a, c, t, g, unknown or other
  modified_base (6813)..(6822): a, c, t, g, unknown or other
  modified_base (7264)..(7273): a, c, t, g, unknown or other
  modified_base (8061)..(8070): a, c, t, g, unknown or other
  modified_base (8804)..(8813): a, c, t, g, unknown or other
  modified_base (9836)..(9845): a, c, t, g, unknown or other
  modified_base (10196)..(10205): a, c, t, g, unknown or other
  modified_base (10798)..(10807): a, c, t, g, unknown or other
  modified_base (11425)..(11434): a, c, t, g, unknown or other
  modified_base (11745)..(11776): a, c, t, g, unknown or other
  modified_base (11937)..(11946): a, c, t, g, unknown or other
  modified_base (12021)..(12030): a, c, t, g, unknown or other
  modified_base (12105)..(12194): a, c, t, g, unknown or other
  modified_base (12530)..(12539): a, c, t, g, unknown or other
  modified_base (13094)..(13103): a, c, t, g, unknown or other
  modified_base (14452)..(14461): a, c, t, g, unknown or other
  modified_base (14855)..(14864): a, c, t, g, unknown or other
  modified_base (15250)..(15259): a, c, t, g, unknown or other
  modified_base (15483)..(15492): a, c, t, g, unknown or other
  modified_base (16167)..(16176): a, c, t, g, unknown or other
  modified_base (17469)..(17478): a, c, t, g, unknown or other
  modified_base (17694)..(17703): a, c, t, g, unknown or other
  modified_base (19132)..(19141): a, c, t, g, unknown or other
  modified_base (19706)..(19715): a, c, t, g, unknown or other
  modified_base (20258)..(20267): a, c, t, g, unknown or other
  modified_base (21225)..(21234): a, c, t, g, unknown or other
  modified_base (21761)..(21770): a, c, t, g, unknown or other
  modified_base (22176)..(22185): a, c, t, g, unknown or other
  modified_base (22380)..(22389): a, c, t, g, unknown or other
  modified_base (22524)..(22533): a, c, t, g, unknown or other
  modified_base (23284)..(23293): a, c, t, g, unknown or other
  modified_base (23349)..(23358): a, c, t, g, unknown or other
  modified_base (23980)..(23989): a, c, t, g, unknown or other
  modified_base (24212)..(24221): a, c, t, g, unknown or other
  modified_base (24817)..(24826): a, c, t, g, unknown or other
  modified_base (25343)..(25352): a, c, t, g, unknown or other
  modified_base (26113)..(26122): a, c, t, g, unknown or other
  modified_base (26562)..(26571): a, c, t, g, unknown or other
  modified_base (27494)..(27503): a, c, t, g, unknown or other
  modified_base (27741)..(27750): a, c, t, g, unknown or other
gtcgcgcaggtgggtgggcgcgcgcggcgcgaccctggtccagcgatgcgacgcgcgggcgcgggcgcggggcgcgccgcgcagggccacgtgcacgccgtcgtgcccggggtcaaaccggacggaggcccgcacgtcgtcgagnnnnnnnnnnnnnnnnnnnnnnnnnnnnnnnnnnnnnnnnnnnnnnnnnnnnnnnnnnnnnnnnnnnnnnnnncgggggggggactcgcccgatacgtgcaggcgcacgctgtgcgcgctgaggtccagcgaacccagcgcggcccgggacgccagcgaggccagggggcgggacagggtgtccagcaaccacccgctggccatgtgcactgtgggtttgaggtgtgtgtgggtgtgtgggggggggggggggggggggnnnnnnnnnnnnnnnnnnnnnnnnnnnnnnnnnnnnntccatgaggtggcggggttgcagagatgcatccgagaagtgagggtgatggcaaccactgaagacccgtcagtgttgcccagacccctctcccgtgcaggggctccaacgtgctcctcggcccctccgcctcgtgtggcgccggcgcagccacgccgcggaggggtgcactgggtgccgatctccgtgcactcctgcgcccgcgtggcgcccgcggtttgactccactggcgttccccacttccccacggcctggcccccctctccctcctcgccacacacaaactcacgcccgtcgcgagctccgtcgctgggggccggggtgtagagcggggccgctgcgctgccccgccacgactgcccgcccgccgccgcagcgcctccctcccgtgcagcggcggcggcgtggtggtggtggtggtggtggtgcaggggagttggcgcgagggacagcggcgcggcgccgccgtccccgctcggcagggcggcgccgggggctgtggcatccttggcggacggggcccccacggtgctcgaggggacgagctgcccgggagcaggcacacctggtttggtcggggcgccgggcgacagcggcccgctcctctctgttgaggtgggtgagggagtgggaaaggggtcctagggctggaacctgggagcctgaaagccatgggaccctaccacccaagctccaggcggaggacgaggtggagtcgctcctctccactccgtcccccccgagcctccccacacatgcaccctccagcaccgtcgagnnnnnnnnnnttccaccccgtcccccccgagcctcccacacatgcaccctccagcaccgtcgaggccccggcccaccctttcgccgcagagtccaggggtcgaccaccaggtctcggaaggcggtcgacccggtctgcatgcgctgggcgggggccccacggaggggcgccaggcgcgaccgcagtagcgctgcggagcgcacggcggcggatttgcgcgtcgaagcgtcttgcgcggcgccgtcggtcccgggcacaccgaggtccggctcatgcctgcgcgtcagggcacttgacgtggggccagagtctggggcgctgggctctgggcgggcggcctgccgcgcagccacgccgctgctcggcccagcttcgccgctcgcaggcgcgacgagagggggttctgggcggggctcctccttgaccgccctgccacccgccggccggccaccctttcctgcacccggtcgcccgctcctctccctctcctgtgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcagcagcactcctcggcctcggcgatgggcgcacggcgccgccggtccacgcgtccnnnnnnnnnngcccccagcgtgacgaggcgcccgctccccgagcgcgccagcccaggcaccacatccccggccaccatgcgcggcggcagcgtgcggggcagcgccagcgtctgcgtgtctcgctttgctgaaccccgccggcgtttgcctctgcgtccgtctgcagcgggcccggcttcggtcgcagcaggcnnnnnnnnnncccgccagcgtgatgaggcgcccgctccctgagcgcgccagcccaggcgccacgtccccggccaccatgcgcagcggcagcgtgcggggcagcgccagcgtcttcgtgtctcgctttgctgagccccgccggcgcttgcctctgcgtccgtccgcagcgggcccggcttcggtcgcagcaggcttcgcctgccccgcgccgctcgtttctttcccacccaggacctcagcagcactccccggcctcggcgacgggcgcacggcgccgccggtccacgcgtccaggggccccggcttctgaccccggttaacgatgtcccgggggtcgccgcgcagggccagcccgttgagcgccgccgccgcgccacatgcgccgtttgtggcgccgtgcgccgcgcctgcgggcgcgtcggctgcggcttccgcacgccctgggcccctcaccgccgcagcgaggtccagcgccgtcgcccacggctcggcgcccaagggccccgcagcccagggcggggcgcccgccaggtcgtacacgagaccagccgcagagctctcatcgccaaggcgtccgccgctcgaggtccccaccagcgcgaggcgccgcagctcctgcgccaggctcgacagcacggcacgcgcggcgccctccagggcacgctgcgggtcggcacgcggtgggggcgggggcaagggcgaggggccgggcgggctcgattctccgccgccgggcgcgctcgactccccgccgccgggctcaccgccgtcgcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggccgggcgtgaactggcgcgcggaggggctggtgtcctctggaaacccgaaccagctcaggttggggccttgcacgacgtcaatctgcatggggcgcgggggtgggggaagaagctggtgggaggtcaaatagcggggggcctgggggctttgccctcgcagacgggcgggccacgatcgcgcacccaagccgtctggatgtacggcgctccagccacccgcccatggcccccaccccctctgacaagagtatgaannnnnnnnnngtggatggacggcgctccagtcacccgcccacggcccccaccccctctgacaagagtatgaacaagcgccacccccagccaatccacctcacctgcgcccctctcagtcgcagccccaggacggggcgccgctcgcgcagcgtgcgtagcgcgtccaggtgcacgtccaggctctcgatcgccgcgctgctcccctccgtggcccccggccccagcctgagtggccccaggcgcgccagcggccccaggcccaccaaccccgtgggcagcagggcctgcagggcgccggggtcacaatcccgccccagcagccgcgtggcggcctggccggccacggggagcaggcgcgcctgcagtgcgggccgcgcccagagctgcgcggggaggcaggcggcggccagtagggccagggccagagtgcaggccctggcgacgcgggccgccagggccagcactcggtccagcagcgccgccagcgaggcccctgggaaccctggcacgggctggtgcaggaggcctggaagggcgaggaggggaaggggattggagggagggggcccgggcgctgtatagaccaggcaagactctgttcaggactgatgcatgagtgatcatgcagagtctgccgctcaggggcacccggctgggaccagagggcacctcccctcccagccagaccttgcaagctgcgcaagatggtcgagggcggctgcggaggggggccatcgccgtcagctgaggaggacgcagcatgtgtagcgaccctcctcgtgcagtggggccgggcaggcctccctgcagggtgcagaggccggcctgcattgtgtttgggagttgggaagggcacaacatctgatcagtcgcttgcagccaggtggtcaggggcgtgcatgcctgcacaacgagaggtattgcatcaggatcccgggaggctgaccctcccgtacaggactttgctcaccggatcgccgctggggaccgtgggcctccaggacgacaaaggggcctggcagacctaagcgcacggcccccggcgcggtcggagaccgcagactcagcatgttgaggcaatgttgtcactgagaggacccctatgtcatactggcatggcatgttggtccatcggcgaacagcttacggagtgacaggtcgggcccacccccaaactccgcccagccatggaaagggcctgtccaagggcgtcacgccctccccctacagtgtgggattcaggaaattccgtgagtagcaacacctcgcccgggggccggggttggcaggtgttgtagctggcagaatgagcaaccacaccagttcgcattttttgggtggaaaccccgatttatccacgtgcgtcacggcaccatgagtagatcttccactggcatgcgtcaaagatatctgacacgcagcagagaggtcgtgagccagaatttcatatttatccacgtacgtacaagcatgtccctgtccctctccatacatcagcggcttttgccgtccccgtgcacccgagttcgagctcccaaccacatacaacaccgtcgctcgtcctccagtgtcgcagctgggcccccagcaaagcatgaaacagatgccagtccgtctcagaggcgaggcatcggcttgggagacctgctgggccccatcgggctgaccgtcgggagcggagaccggcctgttcaggtgggcggttcatgacggtccatgggatcgagctggtcattagttgggaccggcatgggccttgtaatgttacacagagcttacctgctcccttgcagatggacgaggcgtcgacctctgccgaggagcaggagcggcactccagcatctccagcctgaccaccgaggagtggaggaagaggtgcggtcggtgtcaggccggtgcccagcgacccgacagcagcgtccctatcaggtcagatgtatttgaatttattcatggagtgtctaagcctcgcccatccacctccctactcactgcacaggaatgagcggaatggctatgtggacctctgggtggaggacgagttcaactctgggtcccgcctcgtggtgcgtaatagtgggtggggaaaggaggattgtttttttgtgcgtgggatgcatgcccctgctagggaagggtgnnnnnnnnnnctagtgggtggggaaaagatgagaatttttttgtgcatgggatgcatgcccctgctagggaagggtgtggctcatgaggcctgcagtgtcgatgtccacccgtttcctcccttactacccccacctccctcccctcgcgcgccgctcagggtggccgcgcggcgcatctgggcctgccggcgggactgggttctggggagggcccctctgtcagcaaggcgccccgccactctgtcaagatccacaaccactacgccgatcaggaggtggaagtggaggtgccggaggacaggtgcggcggcggccaggggcgcatgaggggaaggccagcgtgcgatgctagcggcgtgcatctctttttgggaagaggctgcatcgttcagaccccactgctgtgctccacgttccctcccccgcccccaacagatacatcctgtacgaggccgagagtcaggggctggagctgccctacgcatgccgcatgggctgctgcaccgcgtgtgcggtcaaggtggagagcggggagctgtaccagccccagtcgctgggcatcagccagggcctgaaggaccaggcgaggccgggtggtggcggggcgcctgtgcactctgggcttgcaggcgttgtgtgtgtaattccgggtgcagttggtaccctccatccgaccacccgcccctgccccctcctgcgcacagggctacgcgctcatgtgtgtgggctacccgcgctccgacctggtgctcagcaccgtgcccgaggacgaggtgtacgacctgcagtttggccgcgctttccaggagcaagccaccgacctggactcgggcagcatcctgcgcgacgactttgccatcgagctggccctgggcgacgagtgaggcgtgcacttgacccgggcgggtgattggcaaggaggcatgcgtggggcccctgtgccgctctcccatcctcaacatccttgtgctgaccttgtaccatttctgcgagcttttccaggacgatgcacagtgtgagtggttggaatgtcaaggaaggaccccaggggtctgggtcnnnnnnnnnngttggcaaggaggcatgcgtggggctcctgtgccgctctcccatcctcaacctccttgtgctggccttgtaccatttctgcgagcttttccacgacgatgcacagtgagagtggttggagtgtcaaggaaggaccccaggggtctgggtcaagaaggccttcccccctaggtcccagctgcccactaccatgctggatggcctgccaggctggctgacaataagactcgaacttgctcaggccacagcctgggtcgtggccttcannnnnnnnnngccccctaggtcccagctgcccactaccaggctggatggcctgccaggctgcctgacaatcagacttgaccttcctcaggccacagcctgggtcgtggccttcacgatttccagccagggcagcagctccgccagcacggcctgcggcgtctcgtcgtgggggcaatgtcctgcgcccggcacgcccacgaagcgcgtgcccggtcgcagcgaggggagggcctggaagtacctgcccaccggccccgccagcggggtgaaagggtctgctgtgccccagaacaccagcaaggggcagctgagggcatgggggggagccaggtggtgaggcgagagggcaaggggcaaaatcttcgtgccttgcgacgaggaaggatcgacgcggtgcagtgtcacccaacagtccttgatctcctaccccccctccccccccccccgtttnnnnnnnnnngcggcgcaaatccttcgtgccttgcgacgaggaaagatcgacgcggtgcagtgtcacccgacagtccttgatctcctcaacaccccccctttccccgccgcacccaatgtccgggacaaggtgcttgggctggggccccggcggcccgctcatgatggacacaaaggcctccagcgcccctggctggcaggagggggcgtacagcatctggaccagctcgtcgtccacggaggccgggtctctgtacaccttctgcgcaacaagaaaggggggggaagggggggtaaatttcggggtgagcaccatctgctgaggccctcccccacccccctgcgcagccccgtccgccatcctcccctgaattccatccatgaaaagcaccccggcccaccagcaggatgctccggatgttctccgggctgcggtacttgtcgaacagccagcgggcgacgcggcgccgggccagcagcgcgtcgatcaggaggaagagggggcgcgcggcgcgcgcgcgccagtcctccgacaccgccttgttgttcaggccgccggcgcagttcacgagggccactccgtggacgggtggcgcggccggccccgcctgcgcagccacctgtggaatgaggggaatgggggaagggccagtcgtgcacggaccctggtgcagggcgcgagggtccctcgtccaccctgagatggcggccccgctcatgggaatggcggcccactcttccggatccacctgatcaaaccgccgcgtccccgtgccgtgtccctctttgagtgcacannnnnnnnnngccaccctgagatggaggccccgcccatgggaatggcggcccactcttccggaatgcacctgatcatgccgccgcggccccgtgccgtgtccctctttgagtgcacaccccaccccacccttccggacaagactgaagggggggcacgtcccaggctgccgccccctggcgcaccatcaggctgaccaggctgccgatgctgttgcccaccagcaccgccggcccggccacgacctggccgaggaagtccgccacctgctcgcgccagagctccagggtgtaggccagcggcggcttgtcgctcccgccgtggcccagcaggtccagggcatagacgcggaagccgcgcgccgccagcgccgggatgcaggcccgccagtgcgccgagcaggcaccgaagccgtgcaccagcaggatggcggggccgggggcgtcggtggcgaggtagctcaccttgttgccccgccaggtccaggtgtgggaagcggtgcccgcctgccaggacggcaggggcggcgcaggggcgggctcggcggcggcggcggcgagggccctgcaccgcccaggtgcatgggcatgggagggccttggatgacttgatgcacccggggaggctctggcgtcccggaagccggtggcatgggaacatgccaagtgcagggtgccttgatgtgaggaaagactcggtggcctggcagcccccctcccatgccgggcggggttcggcatcatgnnnnnnnnnntcaagtgcagggtgccatgatgtgagggaagactcggtggcctggcagcccctctcccatgccgggcggggttcggcatcatggctccggagagcttcaatgcttcgagaccggtcatgatcgggccatccttggcgtcagagtggtggtcacgcctgcgaggctgtcctcatgcgagaggcccatggcgagcgactgtcgaccgttgtttccaactttccactgttcgcccggttgctcgcgacatgcccggcctggaacaccagagccatcaagcatgggatgagcatcagcacgacccactcccgagatatcgtctccatcccaactttcagaggcagtgtctagcgcggcgctttgcccggctgcgcactctgcgtctctccacggtgtcgccatgtacggtggctcacatgcagaccccatggacacgagccgatatgcgccgtcttcaggtgctgggacgcgaggtacaggccagagggagaatcaggtgcgttgtcagttgggacgaggtccagtgtgggactttcgtgacgacaacggtgccaggcccaccaactcctgtcaaccctggccccttccaaatttcagttcgttcccggcaaggtgtttctaggcggaatgtcgaatcagaccacttccgagggcttgcgggaatacgcggagcaatggtgagctcctgccttgtcaggacccagcgtggctaggcttgagacttgatcagcccaacctacagcccattttcagcacaccggatccccttgcgaacccgctacaggggacatgtcaaagacgcctacgtcatgaccggcaaaggctacgcctttgtgactttcgaggacgtcgccagcgctcggagcttcctggaggtgggtgaagttgagaagcgaagggtgacatggccgcggtggcaggccctcaactgcagcctcatactccctctataacgcggcaacgtgcagaaacgggagcatgaactggacggcaaggtggcagaggccaaggccgctgtgccaaaannnnnnnnnncaacgcgtcaacgtgcagaagcgggagcatgaactggacggcaaagtggcagaggccaaggccgctgtgccaaaagatcaagggggaagcaagctcacaaagaaaatgtaggtagagaggcttggagatgcgtatgatctgcatcccggaagggagcagacagcagccttgggaggactcgaaaggatgcctggtgtggaagctcttgatccacgtgtgatgtgaggcctcctgctagagccgtgccgggagtggtgctgcagccgtccctctgaagctgtccctacatctgcctcaacccctctctccgctctcctaccaagctgaggctctgcaagccaaccctcccannnnnnnnnngcacgcgtgatgcgaggcctcctgctagagctgtgccgggagtggtgctgcagccgtccctctgaagccgtccctacatctgcctcacccctctctccgatctcctattaagctgaggctctgcaagccaaccctcccacttccacacaccccctctcgcccccgcctgccctttgagccctgcctgctttcgttctcgtatctctgcaggtttgtgggcggcatcggcgacgtctcagatgaagcctttgcctcctatttctcccagtttggcaatgcggtaacctgcacggtacgctcacacctgttacaagctttcctctgctctcctccctgccttcggagggtttggtgcgctgcccttttctgtgggcgcagccgcgcacccaccgccgtgtttgatccacctcccccgccttttgggcgcactctgtttgctgtttgcccagccgatgggaccttcggggtcagctccctgcttcgtcgacactccatcaatgctcggccgggggccccggggggcgcaccacttcctgtcctttccaaaaccccttgctctccgaaacaatgcccctttgccacaggtcctgcgnnnnnnnnnngtttgggcgcgctctgtttgttgtctgcccagccgacgggaccttcagggtcagctccctgctttgtcgctactacatcaatgctcggccggggggccccgggggcgcaccacttcctgtcctttccaacaacccttgctctccaaaacaatgcccctttgccacaggtcctgcgcaggcctgatgggtccagcaagaactatggctttgttacctttgatgacgagatgagcgtggagaagtgcctgctgggccaacacaccctcaatgggcgccaggtacaggtgcgccgcgcccacccccgcgacagcggcgggggcgagcgcggcggcgaaggccgcgccggtgaccagggacgaggtgagcgcgctcttgaactggggagtgcaggctgtggagggtggaaagggcggcggggggattgggagaggcccgagaggtcgacgcaccggaagggggcgagtgtggctcctaggaggtgccaaacattggggagctacacagagagacggaagtggggtggtgcgtccggaaccccttggcgctggtgcatggagccttcaaggcacacccctcccttctgacgacgaaacacaggacctggaggccctccgccgnnnnnnnnnngcacatcggggagctacacagagaggcggaagtgggtggtgcgtccggaaccccttggcgcgggtgcttggagccttcgaggcacacccctccctcctgacgccgaaacacaggacctggaggccctccgccggggccactcatgtttgctggtcaggctggtccccagtcccagggccagatgcccatgggcatgcctgacccatcaggtgggtggggcccctcctggactgctgccgggtggtgggcatgtggccagggttggatggtaccgcgtgccctctccttgcttggatgaggggtggggcggnnnnnnnnnnnnnnnnnnnnnnnnnnnnnnnnccagatgcacccagcggcgttcatgggaatgccaggcatgggcatgtacggcatgatgcccggcatgatgggcatgttccctggcatgggcggtggccagggcggcatgatgccgggcgccatgatgcctggcgcaatgctgccgggccagggcggcatgnnnnnnnnnnaggctggatggccctgaagtccgcccacatgcccccctcgccctcccccttcctgcagccatgctggcaatggcnnnnnnnnnngggctggatggcccgaagtccgcccacctgcccccctcgccccccccccttcctgcagccatgctggcaatggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncggccagggcggcatgatgccgggcggcatgatgccgggcgccatgctgccgggccagggcggcatgatgccgggcgccatgctgccgggccagggcggcatgatgcctggcgcaatgatgccgggccagggcggcatgatgcccgggcatcccatgatgatgggagggtttggccctggacccatgatgtccacggcgggaggtgaggaggggagttttctgtgcatcgccgctcatgcaacgtgccagaggaggatgccctggatccataccatggagctgttccccacactgaatgaacggagactcaggggttccttccttccgactcagcnnnnnnnnnnttgccagaggaggatgccctggatccatgccatggagctgttccccacactgactgaacagggactcaggggttccttccttccgactcagcaggcacggaagcggcaaaccccggcggctcggggcgcggggccggcgaggcctccccggcggcactgaaccgaggcggtggcggcgcggccggccagggctacgatggtccctgggcggggggtccctcctcgtccaactggggcgggcaggggcagcctcagggacggaggggcgagggcggggaccgacagccgcgccagggcggcggccgggaggggcggcaggactcgcgcggacccagcgggtatggacgggcaaacatcggagggggcccctcccagagggggggcggcaatccctcttcccagcgtttcaggccgtactgagcgggtcagagaggaggatcaccagccaatgcattgggcggaccgcctggcgatgccggcccatggacccagatgcttgccccagatcttccccgctcatggaaagcatgcagggacccttcctgctgcgactgnnnnnnnnnngcgcctggcgatgccggcccatggacccaggggcttgccagatcttccccgctcatgcagagcatgcagggacccttcctgctgcgactgcgtgctgcctgctgttgattgcccgtcattgaacatgtttgcttttttctccccacccatggtgactttgggctcatgctgggggcctcaggtgccgcgagtgtcatgcgcgtacccaccatcttcgggatcgcgagatgagagatcccctgatcaatcacccgagatcggcgcggcggcgaagctcgagggtggtgaatccaggacaacgggaaatattctagaaaggtagtaaagcatgatgaagtcggacaagtccctcggctctcgccggaaagtcctgcgcctcgcggtccgacccgcgttcctccgggcatctcaagcgtgccctgacagggaggcccattgagcgacacattccagctttcctggctaattgggctgtgttcaaatcttcctggaggcttgtgggcacacccagacctggctacatgctcgttctgccagacgggctgggggcttccctgggagggttacacatgggccacacgacaggcgtgcgctgaacccttggcaggatgccctacttgatctgcgggacgatggacagatgacctatccacaaacaatcaagctggaatcgtggtgcacccggcacgatggcgctccggatctggacgcccattgctctgcaatgctcggcatccgctgccctgatcgccatgtgcgtgggcctcctaaccagatggctgaaagttcccaccgcctggacagcggccctggcggttccctatacctacggaaaggggcaaaacgtcgcagcatggactggtgccaactctcagcgaacaatactgctctgggggccattgctgctcggggccctggcgatgctagccagcgcctgcatcagagcagaacccgcgccccagtggtggcggcgctcgatgctcaaggcacgtattcccatgcatatgattatgcgtgacggttgtctcttcaggtttcgatgtccaatggcacttgatgcgcaccagagagtcggcgtgttgacggccgagcattccggcattcttacacaggtccggagatcgctccagtaccagcttggaccttccaagatctggctgagactgacagacggtctcagcgtgcttgatctcatgcttttctgtgctctcttcgcactcaacgtcgcctactttgcgagagctctggtgctggagagcaacgacttggatgcatgtgagctggtgtcttctcttgtatgttgctgctgatgggaccttgccctttccagaggcttcctgcatccccannnnnnnnnngcttctcttgtacgttgctgctgatgggaccctgccctttccagaggcttcctgcatccccatgaccacgctccagcacaagctccccagcttcctgcattgctcccgtgctcaaccatatcaatgaaatgaacctctcacatctattccctgcacataacctttgcagcaatcgccaaaggagaggtacaggagcagtcaaagtccatgctcatgctgaaagagtgagtgctggaacaccacaatcacaagggttgcatgctcctgccggtccctggctgacagctcgagctgttccatgaatcttaatctgcactcaagggcagctcctgagctcagctgcatccttgaagaagatggcactgctttcctttcccccaaggacctcatcgannnnnnnnnngatcttaatctgtactcaagggcagctccgagctcagctgcatccttgaagaagatgggcatgctttcctttcccccaaggacctcatcgatgtagcccttgccccgtcccccacgcagggcttccacacagtttggccagctcatgttcatcgacctctggctcctcttcctgcccattccgcgttcctcctttcttaaagacctcaccggcctggaccagcaggccatgatccgctaccacaagtgtgcctgtctgttctggatccgtgcgcgcgcacgaggctgttcccccggctcctgggatgcatccattataaggaccatccggcgtacagaccctacgtcccacaccacccgctcaggttcctgggtctgtggtgcttnnnnnnnnnnttgaggaccatccggcgtgcagaccctgcgtcccacaccgcccgctcaggttcctgggtctgtggtgcttctgggtgctggccctgcatggcggcatgttttatatctactggggagtgagccacgagtgagtgatgttggacagggcgtgcggagcttcgtacggtggggagaacaagaagccagcccctggagcatgggatcgctggtgtggaggcgatgcnnnnnnnnnntttggaccagactgggaagtggggcccttgttccggcggcgccacgggtgtgggattttcccgtcgtgtcccactggctcgacatgtcctcatgcatgggggaccccacaggttctgggtggagtggaaggattggggcaccctggacagcatcaacaaccttgcagggaccctcagcttcctctgtatgtgcgggctagtcctcactgcgcgggaatctttccgtcgcaagagctacgaggtgtgggggacaaggtctgaggttcgaggggagggtagaggggacagggatggctaattctcaggggagaggagctgtgcagccggctgtactgcttctctcatgtccaaccccgcctctcgtgcatcttgggaatggtgaggttcttgtgccagcggccgtgccgttcaaccctcctcgttctcatttgggacatcttccctccacctgcgcagtggttttacaggttccacctggtctgcttcctgggcttcatggtgttggcctgcatgcactactccggatcgtggcgctacttcacccctggtgagcgacatgactcggaatgtgggacatgacccggccaccgagagacacatccctccaggtctgcttgcggaattgctcccccagcgggaggacccattcacagccccctccctccccacataggnnnnnnnnnntggaatgtgggacatgacccggctaccgagagacacatcgctccaggtctgcttgcggaattgctccccaagtgggaggacacattcacagccccctccctccccacataggcctcctcctctggggcgtggacctgctgcagcgcgcctcgaccagctccgccaatgtcgccatccactccgttcacctggatgaggagaaggacgtgaccactctggtcctccaacacgcacgggtgggtctcacctggtggagaggggcggttgctggaaagggcggccttttctcttgggaggcgcatgtgcagggagtgggggggcggcggcaccccacctctcttaagtgcatgtctgaactgttcaaccccccgctgtgctttggatgaccacatctctcccctccctcacgcccttgcctacaccagcctggctgccccctgggcgacatccacctcctcgtccccgccatctcccgctgggcctggcacccattcaccatcgccgcctcgaccccggcccagccctccgcgccagggactctcaccctgcacgtgaagaatgaggggacatggaccaaggtatgagctgagtggggcgacatggtgtgagtgggagtcacatggactggcaagggggaaacaaggatggtacaggatggaagcagcgccggatcgcgcctgccttgggaggtcaccgggtctaccaagcgcggtcaagcttctaccagcctggattccgcaagtcctcaccagctccctgccgccctgacatccccatccccacccacttctattcacaaccaaccatgtcatcccgcagaggctggcggacctgctgctggcccggccggacgccgccatccgcgccaccctgccccagcaggtgttccctcctcacgagccctggaccggggacgaagccgtggctgtggtggtgggcggcatcggggtcacggccgtcatgctctccctgcgccggatggtagagaggagggcggcgggggcgctggccacccgccgcgtcgctgtcctctgggctgcccgccacgcctcggagttcctgaccctggacgccgcggtcgccgctgctgcaacgtgggtgccgaggaaggacggcggggaatgggttccaggtcggctgagggcagtcgtggaggccctggccaccggtgcagcctcacatctgctgcatggggctcgggacccgcacccctgcacgctgcccgcggccgggtatcaagggagccagccgggctccacgttgcgctcttcccattcctggccccagtcaatnnnnnnnnnnagtcgccgctgctgcaatgtgggtgccgaggaaggacggcggggaacgggttccaagtcggctgagggcagtcgtggaggccctcgccaccggtgcagcctcacatctgctgcatggggcttgggacccgcacccctgcacgctgcccgggccgggtatcaagggagccagccgggcaccacgtcgcgctcttcccattcctggccccagtcaatnnnnnnnnnncgctcacaccctctctctataaacctacacaggtctggcgacccgtggctgaccctggagctctttcagacgcagcccagtcccgtccaggagtgcaagctggaggcggggctggagtccggcagccgggtgtccagcctgggcaagggcctgagcaaggcgggggacggcgacgacgacagcacggagggttcaggggcgctccagcagcgcacgccgccggcgccccccaagtccggtgcctggaccctggcaggaccccgcgcgccccgacccttggcccccgcccacatgggccccctgtacctggcggccctccacattctcactttctttggcggcttcgtcggactgatgctgggctggagctggctgcccgaggcgcagaccgcgctggccaccaagcaggtcaccaagccctttgtgaccaccatcagctggagggtgagaggggttgcctctggtgtacttcgcccatgagcagggcgtcccgacctcccaggcgtgccccggagtgtccaggccctcggcaagtttgtgaccgcatgcaccttctcaaaccaccctcctcccttgctcccctcaggctggctcgctgggcatcacggggttctgcgtcgtggggctgggcctgccctacatcctcctggttgcgcccatgatgctgtggaggtgcgctggccatggaaaggggaacgcagtgggcctggggtcttctgcagtctcacccactctcgcatcgaggctgcctgcatgccaggacaggcatgctgccacataaccatgcgacccctcacaaccctgcgccgcccagccaccattgcaggtcctgggcatcccggcctggacgcaggtctgacacacctcggatgcaggacctcgagctcaccgtgctggggcccagacgcagcctgtcccacgacatgggctctccccacgaggctgcgacccctttccagccctgcctactggtgtgtccgggatctcgtgggaaagggcatgcctccaagccaaaccctgtgattgagaggccgctgaccatccaacaactgtctcgtcgacgcacacacatccctctactcccgtgcaggagggcggcaagcttgtcgtgcccaatggcaaggccagccagctcagcgtggacatcctcccaggccgtccccccatcctcgccgcgctttccaccctgggagccgcccacgagagcgtcagtgtcctggtgtcaggtgcggccggcgtgggaggtggtgaaggccccgctcacacgcccctgggcctgccagcaaaaggagactgccgccgcttgcgaaacgagggtggacccacgatgcagtgtctgggcagcagcgactgtgtgccgttgcctgccgtggtttttccagatcctttcatgactcgcaaaacagacacatcctcctccggcaaaccnnnnnnnnnngaggccccgctcacgtgcccctgggcctgccagcaaaaggagaccgtcgccgcttgcgaaacgagggtggacccacgatgcagtttctgcgcagcagtgactgtgtgccgttgcctgccctggtttttccagatcctttcatgactcacaaaacagacacatcctcctccggcaaaccccaacccccctccctcaggtcctgatggcatgttcagatctgtgttccaggcggtggccgagctgaacaggggccgacccaagtcagggagcggctacttctccctgcacaagcaggctggtgtcctttgatccagaggctcatctcacgagctcaaacactggctggccatggaagactccgtggcataccggcgaccaatggcggaaacccgaagtaatgttcgcattattcaatctcgcatcatcacgccctaccacggaatccacattgacattccctcagaaacttgataagtcaaagcttgcagcatccttcccattgtctcaagacccttgcccagccaatctgttgaaataggatcatactactgtgcaaacgaggtannnnnnnnnncttccctcagaaagttgataagtcaaagcttgcagcatcccttcccattgtctcaagactcttgcccagccaatctcttgacataggatcatactactgtgcaaacgaggtatactatctcatactggtatgactgcgtactccatgaaaagcttcctcaaggttatcgttattgcagcatggtagggttgtcatggcgtgcaggacccccaaacactgatggagccgtgacccgacagatgatgcacgcgaaagcaatgtggcgaataacgacctctgaagtatccgataacatgcaatgtgctgcattttttctagatatggggggtcgggacgctggcatacctccatgacgtctaggactattgccagagtggcccctccctcagcttctccgggtgaggccgacggcacgcgatttgcgcacgcccatccaagaaaagttgcatgttgagagcgcgcaagacacttactggggccaagcgtggagatcaatcccttccgagatgactcatctgcgagacgtgcccgcatgtcgatgtnnnnnnnnnnagcgcaagacacttactggggccatgagtggaggtcaatcccttccgagatgacgcatctgcgagacgtgcccgcatgtcgatgtttcgggtgtgggcccctgtcgggctgagggccctggcatggctcgccttgacggtgtcactcgccagccttgccaagtacgtgtacattccagcttcttggtataccacgcttggaatccggtacccttatggctttgagtttggagtttgggcatggactggtcggaacagcggaaggctggtcctcggctggggaccactcctcctggccgcactcctcaccatcgccagctcggcattcgcaccagtggaccgacccaagtggtggaccaataacacttacaaggtaaggatgcgttggccagcttgccagacgatatgactcgcaaaacttgtccgtgtgcaaagcccgttccacgcagcagctgggcccactctctggcacctgcaggttcgctctttcctgcaacgccagctccccccgacgaggctctggctggcggtgtccgatggactcacgatcctggacgtcatcctctgcatgggactactggccctgcatgccaagtactttcttccgccaatgatctcccagcatgcccgaattgtgaagtgtaggttggtggtgggtggcagggggtggagggattgcatgaggtcctgggccgtcttgctgccgtctcagtcagcttggggaatgaagcttctgagactctttgcccacctgcccccatccgctcgctctcatcctgttcaaaccaccaaaatcaccagtgcgagaatctggccaggtcttccgagacccgctatggtacatgtacttcaaagtgtgagtggggaaatgcgggacctgccttccacccatgaggggccgcaagacgatgatccctgcctggaatccggagttgacaagtcacacacccctcccccannnnnnnnnncgccttccacccatggagggccgcgggacgatgatccccgcctggaatgtggagttgacaagtcacacacccctcccccaaacagcgccgggaggcagtttggcgtgctcatgttcatcgacgtctacctgctcctgctgcccatcccccggagctccttcctccaggacctcgccggactcgaccacgcagccatgattcgataccacaagtgagctggcgcagctttgtatgtggcatggatccgaggggacaccctgcccggctgccatgctacgaggcgccccttcagcacagcagaggcacccctcgcatcccctgccacttgcaggtttttggggttggtgactttctacatgctgacgctgcatgccctggtgacatacgcgtactggggctttgtcggcaggtgcgaggggtgagactctgccgtcccttcccctcaggaccctggcttggctgcatgtttggggccaggtggccatgggttcctatactgggcctgtcctgcatcgactgccgccctnnnnnnnnnntttcccctcaggatcctggcttggctgcatgtttgcggccagggcgccatgggttcctgtgctgggcctgtcctgcatcgactgccgccctcatcaatgcaaacccatcttcacctctgtgttttagattttggagggagttctgggactgggggaccatccgcaccatcaacaacctggcaggcaccctttcctggctctgcttcatcctgctggcctgggcttccaaggacttcatccgacgcagctcttaccaggtgtgtctgggctccggagcttggcactcgtggcagtgagtaggactaggagtcgtgccatggaggggcgttgaatggcatgggacctgatgatatctctatccagaatgctgtggcaagatgcacagtgttggaaaggccggttgttnnnnnnnnnnaggaggggcgttgaatggcatggacctgatgatatctctattcagaatgctgtgggtagatgcacagtgttggaaaggccggttgttgcagggcggccagacagctgatccacctacagcatcccatacgtcatgtcttacaactccgccaattgttgctccttaccttccccccagtttttttaccgcattcannnnnnnnnncggagtaaagcttgcagagggggagtcacgaggaaatgagaaggccacggtcccaccgcccaccctccaccaactctccatgccctcaccctatttctccaaacaggcctgctgctctggggcgtggacctggtnnnnnnnnnntcatacgttatgtctcacaactccgccaattgttgctcctcaccttccccccagtttttttaccgcattcacatcctgggcttcctcggcttcatggtcttgggctgcatccactattcgggcgcatggcgctttttcaccccaggtgcgccggcgtcgggtttggtgaggggctgggagcacggcaggatgcatgctgtgtggagtaaagcttgcagagggggagtcacaaggaaatgagaaggcctcggtcccaccgcccaccctgcaccaactctccatgccctcacccttattctccgaaaaggcctgctgctctggggcgtggacctggtacagagggccggcatgggcatgaccccggtgcctgtcctgtctgctgacgtggatagcgagaaggatgtgacgaccctggtcctgcagcactcccaggtgtggccaaggggccctgcggtgtggtgtgatggcggcggggacgatggtggactgtcagggacccctccacgctgggtgggtcacaatctcgggctccccctctctgtgacctccaacactctgaacgccagggacgagcgacgggccactcagcacaccttgcaccctgtcagctttcctgccctgtacatttccccagcatgacctcccaccctgctgatttcaatcccccaccaaaacatgtagtccacctgcccgctgggtgacatccacctgctggtccccgccatctcacgctgggcctggcaccccttcnnnnnnnnnntcaagggccctgcggcgtggtgtggtggcggcggggacgatggtggactgtcaggnnnnnnnnnnatcgcctttcccgccatgtacatttccccagcacgacctcccaccctccagatttcgattccccaccaaaaaatgcagtccacctgcccgttgggtgacatccacctgctggtccctgccatctcacgctgggcctggcaccccttcaccattgcccgcgccacgcctgcagcggggctgacgcccggggcgctgacgctgcacgtcaagggcgaggggcagtggacacgcgcgctgcgccggctggcggccgccggcgtcggccgccggctggaggtccgtgccagccttccggcgcgctcgctgccggcgccggagccctgggcggcggccgaggccgtggccgtggtggtgggcggcatcgccgccaccgcggccatgcccgccctgcgctccctggtggaggcccggcgctctgggcaccagggcccacgccgtgtgctcgtgctctgggcagcccgccacgccaccgagttcctcgccctggaccccgtcgtcggcgccgctgccctgtgagttgcaaggggtggttcttgttggtcttggccccgcactcgaagcgcggggcgcgagttgcagtacggcgccagtagcaattgggcacgggcttgttggtgggccnnnnnnnnnngaggggtggctcttgttggtcctggccccgcactcggagcgcgaggcgcgagttgccgtacggcgccagcagcaattgggcacgggcttgttggtgggcctttcactgtccctgtactgcaactcccaccctgttcgacctccaactgatcatcactcaccgacccacccacccacaacaacacacaccacactgctcacaccagggcgggggacgggtggcnnnnnnnnnngccctgttcgacctcccactgatcatcactcaccgacctacccacccacaacaacacacaccacgctgctcacaccagggcgggggacgggtggctgaccctggagctgcacctgacgcggcgccctggctgtcgccactgcggcgccgacccgcagggggtgcggcgctcccccagcgccggctcttcccaggacgaggagctggtggcgctgcaggccggccaagaccccgaccccgaccccgagccggggccggagccggcgcgagggcgcgggcgaggccagtcgggcgaggccgccgcgggctacagggcggtgcgcaagcctcaaaccgggctggtcgcggtgtcggcctcgcccctgggcaccaggaacccctggtgaggaggaatccagggtggggaggagaggaggaaggggtctccgggagggttgccattggggaactgtgtgagagagaatgggaggagcgtcgaaaggtcttctagggcccctctccttctccccctacccatccacccatgctttgctttgagaatgccaggcttgctctgcatgcggcaggcctcctcatcactgctgagcctccgcccannnnnnnnnnaaaaggtcgtttggggcccctctcctttcccccctacccatccacccattcttggttttgagaatgccaggcttgctctgcacaccgcaagcctcctcatcactgctgagcctccgcccaccacccactctgtagaggcttgcccccctatcctcatccaccaccaagttccctcctctcacaccctgcgcagcccgctgccgcctgcccaccagggccgcctgcacctcatggcccttcacctgataaccttcctggggggcttcacgggcttgatcctggggtggagctggatggcggaggcccagacggcgcgcgaaagtggcgccctgccccgctcccacgtcacccagctgtacggcaccgtgagtggcggcgaggggatgtaggggttggggggcgctgggtcgcgagggagcgatgggagagctggagtggagggggaggatgcagcgttgcgcggggaacccaccatccaagtcttggtcatccctgcctcgcccgtgaagcggctgcnnnnnnnnnntggcagcgtgagtggcggcgactggatgtggggggttggggggcgctgggtcgggagggagcgatgggagaactggagtggagggggaggatggagcgttgcgcggggggcccaccatccaagtcttgttcatccctgcctcgcccgtgaagcggctgctggctaccggccccccaccccatcgcctcacctggccaccgctgccccatcctcgcccaggtcggcgcgacggccatcgcctgcttctgcgtcgtgggcctggggctgccctttgcggtcctcattgcgccccccatgctcgtcaggtgggcggtgccggcacggcgccaccgcagtgggtctgggcaggcctgcgcggcccgccggggcgatggcaggaacccacgagagcgctgtggtgtcctacctggagggaattttgagggatcccagacctccgctcccatcacaggctgtggcaagggggggcctggcggcgcatcacaccacctgatgccgatccgggcgaggaggaggcccgggacctggctcgagtgccggtgctggccggggggtacgactccagcgaaggctgttcagtggtgagccggcggtttgggctttgggggcatgttcccaagaaccgcttgcgcagttctcggcatcaagtcgacgtggggggcttctcctcccatgtcgggggggggatgcaactcaggcgggaatcagccccatgccgcccttccccacctcgtgtctcgcaggacatgggtaccctgacnnnnnnnnnnaactctagcgaaggctgttcagtggtgagccggcgctttgggctttgggggcatgtccccaagggccgcgtgcacagttctcagcatcaagtcgaggtgggggccttctcctcccctggcgggggggggatgcaactcaggcacgaatcagccccatgccgcccttccccacatcgtgtctcgcaggacatgggtaccctgacggtgcccgggcacggttcgatccccatcctcccacgccggccgggcatggaggaggcctttgcggagctgggcctgctgcactcccggattgatgtgctgctggcaggtgcaggaggcatggggattgcaagggatgctgtgacgtaatggcgagtggttctgagggggcacggtgagtgcagcgaacagccgcaggtgccactgcatccctgcccctgccatgatcacacccgtgnnnnnnnnnntcacggtgggtgcagcgaacagccggaggtgccactgaatccctgcccctgccatgatcacacccgtgagctccctccctccctggtgcggcagggccggagggcatgtaccgcgccggggtcaaagccgtggcggccctgaatggtcacagggtgctccccagcagcaaacccatgtacgaggtgcacaagctggcggggatgctgtgagtctggtggttcaaggctactgctgcccaggcatgtggagctagtacagcagctcgctagtcgagcagacaccgggtgagcgccgtgcgggccgcactgggattggtcctcttgcgcctcgcgaagtcgatctgacggaggtgagggcccatcaatcccgtattgggagtactatggtcgatgaacggtccagccaagcacagggcctagcctccccctctggacgtgttgcaagcgggctccagttggcctgaagcgaggccatactgtggagcgacaaggccctccccctgctaggaatgctcgcagcggagggtgcaatcatgttggtgcggccgcctagaacatggtatctgggtgtgttcttgcccatgtttttgctgtaacagctcatgacaactggttactgtaagccgcagcgcatcagtaaagaggttgaatgacgagtgtcccccaccactccccagcgatactggcctgtctgcaccctgcacgcccggcaaggttgcttacttgagcggaccgccacaagagcctacaacacccaacctgctagggtgcaatcccagttccgatcgaggacacacgctgagtcggcacacagctctcccctgtctgcgcggcggacgacccggctccggtcctgaccagccacgttccggctcggactctccccaccttggattccaggacgcgggccctcagcgtgacgnnnnnnnnnnatcggcacacagctcgcccctgtctgggcggcggacgacccggctccgatcctgaccagccacgttccgactcggattctccccccccttagattccaggacgcgggccctcagcgtgacgctcaacatgcaccttcaggatacaaattcaagcacaaagtggtatgttgccaggtgagtagcttccaaataccttggggtgtcagtccaccatccggatgtggggacgcgtcccggnnnnnnnnnngaacttccaaatgccttggggtgtcagcccaccatccggatgtggggacgcgtcccggagcagtgtgctatcttcgcgacaggtggtggaaagttccttgccaatcctgcgcagtacagtgataaatattcgtcagcctttcagcttctctccagagtcaagaaagcttcgtaattcttcacaagtcccctgacagctccctgttggcgcggctaaagccctccagctcgagcagttacacccggcacagggacagagccgggctcggtaacaggcaggctggcaacttcgccctcaagatccactgatcatgctcttcgctcgccaggaatgacagccactcggctcgcgcccacctgggtggccagcctgtcgttcctcttgttgctcctccccgccgtgcaggcagaggtacgtgtgctggagctctccacggatttcctcctccgaccaccctctccccaccgagactcaccgcgctccctcaccgccccaatctttgcgcagggcaacccaatcattcggctgaacttcatccaatgcataaatcccagccatgacatctacatcaccaatgtcatccagtgcactgccagcgtgaccctgtcggccctgcctgccaccggctaccacgtgacatacagcctggctggcgcccagggcacggccgacgccgtccccacccagctcacctccttcctcagctggagcacgcccggcaactacgacacggggtgggcctacgcctggtttgtggctgccgacggcagcatcgtgcaatccccatccagggccatcatccccttccccagccccccgccctctcccccacc

SEQ ID NO: 44355 - DNA, 61 bp, Chlorella protothecoides
ccccgaagcgtggcatatagaatggcaggggggtatctggtctttcccccccgacctgctg

SEQ ID NO: 44356 - DNA, 61 bp, Chlorella protothecoides
cattccgcgcctgcctgtcgagtggcagggggagccatgcactcccggactgcatgctgac

SEQ ID NO: 44357 - DNA, 61 bp, Chlorella protothecoides
gcagcacgtgccgaggggcgcgctcgcctctgcgttcgtcgcactcctgcccatcagcgcc

SEQ ID NO: 44358 - DNA, 3215 bp, Chlorella protothecoides
  modified_base (116)..(125): a, c, t, g, unknown or other
  modified_base (950)..(959): a, c, t, g, unknown or other
  modified_base (1087)..(1096): a, c, t, g, unknown or other
  modified_base (1307)..(1316): a, c, t, g, unknown or other
ccggcgcaggatgcgctccaccgcgccgcgccgggcggcgagaaggacgcgcagcagctcttgcccgtccacgggcttgagcagggccagcgccgccagcgtggcggcgacgtcgnnnnnnnnnncgtcgggcggcgaggagggtgcgcagcagctcctgcccgtccacgggcttgagcagagccagcgccgccagcgtggcggcgacgtcgcgcgccggtgcgtcccccgcgccggcgccgtcccgcagccactcccccgcccggccctgcacctcgccccggaacttgcgcaccagcggccactggtgctggagcagggggaactgggccgcgacgccgtgcttcccgcgccccgtcagcgcgcggtgcgcgtcggacgcggccaggaagcggcacgccgcgccgaggaagtcgcaggcgtccaggcagccccagacgtgctcgggggtgtccagcaggaatttgacgcggatgccgacgtctggtgggggggggtgggaggatgtgggaggtccttatagaggagcaaccagtcagaagctcgggctcagggggaaagctgtctggtgattggcttaggctgacacgagagagctgaaggtgggaggtggtaattcctcgcacactctttgcgctcagataaaagcaagccccatatgtagagctgaaacaccagagggcagtcttccccaccatagaggcgctcggtagagctcttggaggtggggctggcgaggcgattgtcggcgttgctctttcccactgcctcagcgacagcctgcatctgggactggatgcgggagaccaggcccaccacctgcttggcagactcgtggatgtcgatgaccgcatcggaggtggccagcagctccctgcggggtggagggagatacactttttgtcggtgccgatctggtaagctggtgctgaatgccgcgtcgccagagnnnnnnnnnntggagacacactttttttgtcgttgccgatctggcaagctggtgctgaatgccgcgtcgccagagctgaaccatttggactaaatggaacaataaacctgccctcacctgtacgagccgccgatgagnnnnnnnnnntcatttggactgaatggagcaaaaaaactgccctcacctgtacgagccgccgatgagctgcctcagctgctccctcttctcttctacttcatgtcgagcctggacctccacctgaaccaggtgcgaaaggcaggtcgcaaggggttccatattcccattcctggatggccaccagcccagtcagcagcacaagtgcatctctatcgacttnnnnnnnnnntccgcgccgccggtggcggccgcctgccgcgcgcgctcctcctccatggacacgcgcagcgccagcgccagctccgggtccagggtggggtccacgcccagctcaccgtagtcaaagccgtccaccacgttgcctgggatttgtgatgaggatggggtggatttaggggtgggacgagggggccaaagagcagattgaaggattcaacggggtgtgaaaagtatcaaggcggaatggcaggctgaagccatcgaagccttgggtggggtcctcagccctctcatcccctcccacctctcgtttacacaggccttgacaacctctccaaccctagaccactcactccttggaggcgcggggccgccgccgtcgctggacgccccctcctccatgaatatcggggtggcgaagagctggtctgacaggatggtgcctggcggcaccgtcaccaggtggctgttgccgttgctgttcaccgccgcctggaaagcctccagcttctccacattggcctcctctgcagtttccaaggagggggggaaagagaattaggtgtgggactgctgcgtagggcaggggagtattcgagcttgctctgagcacttcaggctggtgcatctgggcccaaggttgctggccacacactcagaggctgccgctgtctatcagtagtgaagcagcagtccatccaccgaccaacacccgtcaacagcacccaccagagccgaagctgacgatgtccactgcaatgttgttcttcttcagcttccgtgcgatcttcaccatggagtcctgggagggagtttgcatgcggaacgtgagctgtgccgtgtctggcagtgagggtgcagtcaagccagccctctgcaacaggtgccagccccgccccctttgcccacgtcccccacccaacacaccacagcacaccttgtcctcttggatggggctgccgataaagatgacaatgcgctgcctctggttcttgttctcgcggtgcttcagggccagctgggctatctgcacggccgtggccaggtgcacatccccctcaatgtccatcttcatcatggcgttcagcacctttcccagctcggtggtgggggtgacgagcacccgggggctgcgccccgccatgctcatcactcccaccgtgttctcggggtggtgctgggtcttggccccggccagcaggttcacggcatccgcctgggcctggaaccgggtaggtgcgtagtccccattccgcgtgaactcgctgttgtccacgcacaccaccgtggactcctggaggggcgatgcggaccgatgaattgggatgggagaagaagtgcgacggccgtccagtcccctaggaagactcaccatgtcccttggctttcctccctggcccaagatcactccgtcttcaagaacgcagagcgggatgcgtcactatgcacgtagccgcgtcagtcatgccaaagtaggtttgatcactctgatgtggtctctgcggacgggagggacatctggaaggcaggggtctggggcgcttgggcctccccgatcaccctggctgccaggtcacccttgcagtccaggcgcgagtgatcaccctgtgctacaagccagctcttcgagcaagtaccgcaccggatctgctctgtataagagaattgtactcgatggactgatgcggtgtcggggcctggccaggtgagcactctgcactcgcacgatggcagagtcggtggagcagcaggtggaggagctcttccgcgccaggactgtggaccagatccgggaggcaagtcgatagagatgcacttgtgctgctgagtgggctggtgcccatccaggaatgggaatatggagccccttgcgacccggctttcgcacctggttcaggtggaggtccag

SEQ ID NO: 44359 - DNA, 61 bp, Chlorella protothecoides
aagttccctggaaagggacgtcggagagggagagaaccccgtgggccccgagtgtcgtcac

SEQ ID NO: 44360 - DNA, 61 bp, Chlorella protothecoides
cggcaggggtcagagggcgcgcgtggcagggcgccacacatgagtcacgtgttccacgcat

SEQ ID NO: 44361 - DNA, 61 bp, Chlorella protothecoides
gtgaggagcctgatggatgtcacgggcgggggcaccggtctcgaacgggcggggatgcagc

SEQ ID NO: 44362 - DNA, 61 bp, Chlorella protothecoides
acgtccacgcccgtcaccgccccacactcccccagccatgccaggcagctggcgagcccgc

SEQ ID NO: 44363 - DNA, 61 bp, Chlorella protothecoides
ccaggatccaatgccgcaatcgcggcagggggacgatcagactcatgcagccgctctgtgt

SEQ ID NO: 44364 - DNA, 5865 bp, Chlorella protothecoides
  modified_base (105)..(332): a, c, t, g, unknown or other
  modified_base (930)..(939): a, c, t, g, unknown or other
  modified_base (1288)..(1297): a, c, t, g, unknown or other
  modified_base (1724)..(1733): a, c, t, g, unknown or other
  modified_base (1961)..(1970): a, c, t, g, unknown or other
  modified_base (2840)..(2849): a, c, t, g, unknown or other
  modified_base (4803)..(4812): a, c, t, g, unknown or other
  modified_base (5553)..(5562): a, c, t, g, unknown or other
cgagcgcgcagccgtggagagcttcgtcgagtcggtcctggacgcaggtgtgcgggaggtgtcggtgccgggtgggcaaggcgggggggggggggaaggggggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacgggcaagacggccacggtgctcgaggtcatgcgctcggctcgccagcgcgtggagtcgggcgaggtccccgccttccgcttcgtggagatcaacggcctacgcctcgcctcgccccagcacgcctactgcgccctgcacgaggtgggacgaccggggaggggcctcgcgtgtgatgtggagggggcggagggctggtgcgctgtgttgagcgacaccaggacggtgggcagattcctggctgactgggtgtccagcccctgtgaagtcattggcccgcacactttcaccccttctccacacctgcaggcgctgacgggggagcgcctggggcccagctcggccgcggcggcgctggagcgcatgttttgcggcggcgcggcggccacgtgccggtccaagtcagcgccccccaagcgccccgtcatagttctggtcgacgagctggacctgctcgtgaacagggctcaggcatgtgttgtgtgtgggggtcatgttggaaagtggtgaagcagggtatcacctggtataggaccgcaggcatgctcccctgtgtgttttgacttcgttcgtcgactcggcggctcagggtgtggannnnnnnnnnccagggtatcacctggtgtaggaccgctggcatgctcccctgtgtgttttgactttgttcgtcgactcggcggctcagggtgtggacgctcaagtaccaggacacacatcccccgggccagcctttccagctcatcggaaccccccctctcccaccaccatcccagacggtgctgtacaatttgttcgactggccctcccgccccggctcccgcctgtccatcatcggcatcgccaacaccatggacctgcccgagcgcctgcaccccaggatcgggaggtgtgtgctgggatggacagggggtcatggagcagggtttcctgggccgcgcctgcgagattcggagaannnnnnnnnntgggaggtgtgtgctgggaaggacagggggtcatggagcaaggtctcctgggccgcgcctgcgagattcggagaagggggtgatccctgcaacagctgggcctggaaaagggccctgtgaatggcctcggaccccactcgacggctggagtgcgggctggcgcaccctttcccggtggcaattcccacatcacatcccccgctcacccctcacccgcctcctccacacagccggctggcggggcggcgcatcaccttccagccctacaaccgcgagcagctggagatcatcctccgcgccaggctggaaggcatcgacgcctttgaccccaacgccctggtctttgtttctcgcaaggtggccaactgctcgggcgacatccgcctggcactggagatctgcaggaggtgtggggggggaggcgggnnnnnnnnnnccacagggacgcctggacggcgcatgctgtggcgaggtcgaggacactcgccactccgagtcatgtgtgcgctgcccatgcgtacctgcgcactggtccacctctggccccctgggactcactcatgcctgcatgggtccactgccccctcgcccagagcggcggagatcacggagctggactccctggagggcaaggagaacagccaggccgacgccaacgccgagnnnnnnnnnngcctctggccccctgggaactcactcatgcctgcatgggtccactggcccctcgcccagagcggcggagataacggagctggactccctggagggcaacgagaacagccaggccgacgccaacgccgagtcctctgtggcccccggcgcggcaagccccaccacgacgaagccggcgcgggtgagcatggcgcacgtagaccgcggcatccgcgccgcgctgagcggcagcgcggcgcagcgcgcccagcagggcacccccctggagcgcctcctcctggcggcggtgcacctggagacgcggttcgggggccgggcggaggtgggcgtgggcgcggtgctggcgcgcctgcgctccatgctctccgccgcggggcaggagccggtggcgaccggcgcggcgctggaggcgggccaggcgctggcggcggcgcgcctcctgctctgcgacgcgccggcgcgccgcctgaaggccagggtggtgctcaacatgcccgccccggagctgctctacgtgctgactgcggacgaggagatgccctggctggcggcactgctgggggccggcggcgcgtgagctctctgtctcagaaggggtgagaaagactggggtgcgccgtcggaccctggacccgccgctcactccccggcaccgcctgggatgatactttaggcttccggcgcctggatcaggactcaaccctcccacacatctgtacaacacgcctgactcggccatgcgccccttgttgacacttaccctatgacacccaccgcgggccaaccgattgaatgctcccctgaggcctgacgaaatgcaggcagcatccgactcactgtgccctcagcgcaccagagtgagcctagggtnnnnnnnnnngtctgtacaacacgcctgactggcccatgcgccccttgttgacacttaccctctgacacccaccgcgggccaagcgattgaatgctcccctgaggcccgacgaaatgcaggcagcatccgactcactgcgccctcagcgcaccagagtgagcctagggtgggcaaaatgggaccagcaggggcacaggggtttctgcttcttgcctgcagtgttccagggtctacccgagggcgcgggggagcgatttgcgcgcgcctgctgctgaccaccattcctgaaaggcgatgccgagagggcctcggcaccccatcgcgcaacctcatcccgacaaatgccgtccgctggggtcgtagaccctgttaagtcacaggatcattgaggacagtggcgatcttgcaccgcagtgccggaggggacgatccagaatgggccactccgctggttagggaggcgggctgccctcatactgcgcttgcgcaagcagcaatctagcatcatccaaagagcaacccatgtcgaggccctgaccctgctcgcgcgcgcatgctgcccctactcggcgctgcacattgaaacccccgcaccggagctgcaggagcgctcacgctctcgcacgccatctacctgctggtgaggcatgctaccctttgtttgtcccatgcagcatggcgagctcgcggatgggccacgccgtccatcgagatgcatcccgcagctccctggcatctgggcagatggtgccacatcactgcttcatgccgcttcctcccctcagcgaacccaccagccccgtcctccccctcccagacccgtcccaggccagtatatttccacgatgaggggccgggcatcccgggaggcagcgtcctcgccctccacccgccggattctgaccaaaccctacgaggcggtggaggggaagccgcatgacaatgtgaattcagacctcatcgtggcagtggatgacgagctccgatcacagcacactcggtgaggagtagctgcgtgcatgagactggctgtctggctcgagaacttggggtgctgcagagtgggaacagggaagagcttgcatggtgttctgcggggggtggggtgggatggtatcgcgcaactggctctagggtttccaaatcctctggtgccctataaacagaaggcagagctctcttcccccgggctctagctctaacatctgcgtgccggcaccctccccctcttaccttacaggtatgtcgtgcaagacctcctgggccagggcacctttggccaggtctttcggtgccttgagatgcccgacgtcgggagcggcaggggtggcgaggtggtggcggtcaaggtgatcaaggcgcagccggcctacttccagcaggcccgcgtggaggtgggcatcctgcagtacctcaacaccaaggcggacccagagaacaagcaccacatcgtgcgcatgaaggtgtgcctgtttgatcggcctgtgttttgtgtttggcagggactgcgggggttgcggtggcgccatgtcgggctggtgggcggtcccacggtcccagggcgcgcccagcgccatgccctcattctgccggcctccttgcgccatcgcgagcttccccgcccacatggcctccctcctcccctcacccccaggactttttcgtgcatcacaaccacctctgcctggtgttcgaactgctcagcctgaacctgtacgaggtcatccggcgcaacaagttccgcggcttcggcctgcccctcgttcgggtcctgatcctgcaggtctgcgcaggggtggcggacagggtgtggcttcacctggggtcgcttgacgtgtgccggatggggcaagccaggggtaaatgggtgcactggctcgccgttccatgcactggagtgctgattccaggtgtcttccatgaccagatgcgctcgtccatcagcctgcaccccctcccgttnnnnnnnnnntacctggggtcgcttgacgcgtgccggatggggcaagccaggggtaactgggtgcaccggctcgccgttccatgcactggagcgctgattccaggtgtctttcatgagcagatgcactcgtccatcagcctgcaccccctcccgttggtcctccattccaaacatccccaaatccccttctcttctccactccccaccccaccccaaagatcctggatgctctggaagtgctgcacgactctgagatcatccactgcgacctgaagccggagaacgtgctgctccgtgccggcccctccggcgaggtcaaggtcatcgactttggcagcgcctgcttccagacgcgcaccgtctactcctacatccagtcccgcttctaccgcagccccgaggtgatcctgggctgcccctacacccccgccatcgacatgtggagcctgggctgcctggccgccgagctgttcctgggcctgcccctcttccccggcgcctgcgagcacgacatgctaacccgtatcacctccacgctgggcccgctgccggagggcctgcttggcgcggggcgcaacacgcacaagcactacgatgcgcgtgcggggggccaggggcggccggaccccggcggcagaggcggcgaggcgcggccggggcagggcctggtcctgcgcacgccggccgagttcgaggcggccaacggcgctgcagcgcccgtgggcaagacctacttcaaggccggcggcnnnnnnnnnntgaggcggccaacggcgcacctgcgcctgtgggcaagacctacttcaaggccggcggcctggcggagattgtggggtcctacccgctggcgccgggcgtgggcgaggccgaggccgtgcgcgagagcgtttcgcgtgccgcattcctcgacctcctgcgcggcgtgctggagccggatccggcgcggcgctggacgccgcgccaggctgcgcgccaccccttcctcacgggccgcgactgggcggggctgggcgcctacatgcccgccccggatgccggcccgcgcgccgcggcggcccccgc

SEQ ID NO: 44365 - DNA, 70 bp, Chlorella protothecoides
gctgtcaaacttgcttcctgcccaaccgaaaacattattgtttgaggggggggggggggggggggggggg

SEQ ID NO: 44366 - DNA, 61 bp, Chlorella protothecoides
cccggcagagggaggtcagaggatcggcggggctggaatttccagagtccgactacgcgat

SEQ ID NO: 44367 - DNA, 61 bp, Chlorella protothecoides
agtggaatgtgatgggttgtttgattggtgggcgacaggcatggctgtggcggagtgagga

SEQ ID NO: 44368 - DNA, 9131 bp, Chlorella protothecoides
  modified_base (95)..(115): a, c, t, g, unknown or other
  modified_base (193)..(202): a, c, t, g, unknown or other
  modified_base (323)..(332): a, c, t, g, unknown or other
  modified_base (875)..(884): a, c, t, g, unknown or other
  modified_base (2092)..(2101): a, c, t, g, unknown or other
  modified_base (3419)..(3428): a, c, t, g, unknown or other
  modified_base (5565)..(5574): a, c, t, g, unknown or other
  modified_base (5892)..(5963): a, c, t, g, unknown or other
  modified_base (6046)..(6055): a, c, t, g, unknown or other
  modified_base (6441)..(6450): a, c, t, g, unknown or other
  modified_base (7218)..(7227): a, c, t, g, unknown or other
  modified_base (8110)..(8119): a, c, t, g, unknown or other
  modified_base (8787)..(8796): a, c, t, g, unknown or other
  modified_base (8867)..(8876): a, c, t, g, unknown or other
ggctggagggggggaggggaggagggggtcaccagggaggcgggccatgctgccacgggcacgaagaggaactcgcgcaggggaacagcacgggnnnnnnnnnnnnnnnnnnnnnccgcggcgtgcgcggcgcgcaggccggcggaggaggagccgagggcggtggtgacgagcacggcggctggaggggggnnnnnnnnnncagggtgtgcgccgacgggaatcgcatccggcacccagcatctcagctgcagcacacaatcaccctctgggatcgtcaagaagaggcaagcgcagcacggagcggcgtcacctgcgggatnnnnnnnnnnacgagggaggcgggccatgctgccacggacatgcagaggaactcgcgcaggggaacagcacgggccgagcgcagacaccgtcgcccggctctcaggacccagcacgcacgcacgcacccaacatgaggcgcaggaggagggtggcggcccagggcgtcacggccagccacagccgggcgtgcgccgtgccggccagggagaggagctcgcagagctgggggtgcagcttgaagcctgagtgacgatttggtgagggtggggagggtgaggcagggtgtgtcccgacggtaatcgcatccggcacctagcatctcagctgcagcacacaatccccctctgagatcgtcaagaagaggcaatcgcagcacggagcggcgtcacctgcgggatgtgcgtcgccgagccaggccatcagcgacacaaccatgagcgcggcagggccggggtcgacccgggtccagcgcgggcggcgggccaggcacaccgcggcggccatgcaggccagcaccctgagagccgtggggcgtcgacccttggacccannnnnnnnnntggcgggccaggcacaccacggtggccatgcaggccagcaccctcagagccgtggggcgtcgacccttggacccaggcccaacccgtgccagccccgcctcgctcagcatccagcgtggcagcgcgggcaggcccgagtagacctccacccgcgcctcgggcgggggcccggcggccgactgggcggggtatacccaggctgcggggatccagtccgtgtcggggcggtacaccagctgcacctccagctcccaggatcccacctgggccgaccacagggtgggatctggaccctcaaccggctggagagggagcagcccaggggacagccagcgcgccacggaggggggggcaatgacgatgtgcgcgtgttggtagttaatgtaccccagcttgcagctctggaccaggagcgactgcaggcgggagtgctggagggtggccggccaccagaaggtgaccctcccagccgtggactcccccatgccctgccccgccccaggcagtggagaaggcaacagatcgcgcactgggtaataatttgagacagcgagcttgtgatgacaaaatatatagaaatgcgtttgggatcactgatcgccgaagtgatctcgcggtttcagcttaacatcagttctcgcgcgcggaacaggcacgttccgacagcgcccagtctcggacgcctgggacgcacgagtggccctcgtataggggtgaagtcgacgggacggtggacagtgcagccggggctccctttttggatcagaggacgcgggtcacgagggtgggtggtgacaggttggccttccccacccatgcgcccgtaacgaactccgcatcgacatggactccgggaggcacttccagcacagacatgccacccacctgactcccctagagtgagttgttgacgcgcttgtatcaagaaaaggggagtacccggcggatcaagactctcaccgcccaatcccccatacatcttgtgcccctgcctccaggcgccgtatcaatgccgtcggggaggccctgcgccccctggtcccatacgccatccagacggctgtgaccatgggcgcatactccgccggcctggccgcagcgcaggttgaggcggcgggtggtcggaagtggtccccctgtatgcaccgtgcgcccatagcccacccctccttcccccccaccctcgcagaccctgggcatggcagcgnnnnnnnnnngacccctgtgtgcaccgtgcgccccgggcccacccctccttccccaccaccctcgcagaccctgggcatggcagcgcgcgtgtcgtgcgccacgccggtgctgggccccgtgggcggcctgctgggggtgggcctggcctcggcgctggccgggcaggcatccctgctctgccgcgagtcgctgcacggaggcggccgggccggcacgcccggcccggccgccgcccgcccggcccgccgcggctggagcgcggagacgctgctggtggacgccgcgctgggcatcgcgctgttcaagctcatgggcggcaggttccgcagcgtcatgcccagcgacctcagccgcgtgggcgccattgccctggagtccatgcccacgcgcggcatcgagtacgccagccgagggaagcggcgcgagctgttccgcttcttcaagaggcacgctgtgggggggttgatccttggctcgaggcggaggttggggtgggatggggcatttgccagggggacactctcactggccggacaggcgatttgcagatgcaggcgggccgacgtttgcgggggtgccatcaggtggcttgcagatccaggtccagtgcccccggctgtgggcatccagcgctccctctgaccactccaccgggttccgcgcgcctcacagggacgggtgccatcactgcggaacgcgccgcggcgacgtcatcggcgatcacatgccccccaacaagctggtcctggaccgggtggaggccatgcccgccgcgctgcgcacgctgcggcgcctgcccttcgtcaaggaggccagcgaggcgctgggcgtgcacctggggcccacaccgcagcggtactacccgcaggtgggcgggtggagagctgaggggggttggcggggtggactggtgggcgtgcaccgatgatcctggcggccacaatcgctgcaagaacgagggcccacccttgctccgggctcctgctgtgcctgctcggaccgcagactgcgcgctgtcgctcgaccctgcgcactccgcagctcacctccagaacccccaccttgcctgctcgcagtgccagccctgcgccctgaagcaggcatcggcagtgaagcacgggaagacgaggctggtgttccaccagatactgcattcgggggggaggtccagtgcctggcactgggcaggcgtggtgaccgggctgcggcaccacagcagcgaggctggtacgagagggcagcgacgggctggatcctggaagggggggccatgctgagctgaccctgcgattatatggtttctgataccgttaggccaccaactcnnnnnnnnnngtgagctgaccctgcgatgacgtggtttctgataccgttaggccaccaactcaacgtgcgctgtgcgcctgatagcagcacattgtacccctggcaaaggacctgttcagagacctctgccagatgttggcgctgctacccccttgactgatgcatccacagagtaacaattggacttgtagtagagctcgggctgctgtgcagttaccaatacttgaattgaagacccacacagcaacaaaactgagctagactatccccttgcagagggcgtgcgcaagttcattgccagggcagattgaatggtcaaatacctcgcagagacagggggccttgggtgggcaggcgcagcatggacgaatcttcccacaaacaaactgaacccggaaatcttctggcccatcccgacgccgtgaacattgcctgaacggtgtcggaggccacgtcatcacttgcatgacagtcttggggtacgaacatggctgataggaggggaattgaggcactgtggggccgactctccgtcgcaccggaccggtctgctttggaaaggatggcgctcgggagatgctgaggcgggggagcaccctggcctcccagggatgtggaggaggcccacgcaggggattcgccatcttaggcggatttgccaccgagctcatcaagaggtacggagatccaacagcaaccaagatggcgggactccaaggcgtgctgttgggcatgggcaaccccctgctagacatttctgccgtcgtcgatcaggccctgttggacaaatacaaggtacgtgagagctgacctaaagcgggtaagagtaaattggttggcgccgcttggccgatcgtggcccagagcgatcctgatcgctgcgcggtgtggcggcatcaaccccctaaatctccccgccgcacccctccacagctgaagctgggcaaccagattctggcagaggaggagcacctccccctcttcaaggtgagaacttgaaaagttgaggaactctcattggtatcagggggttcaagcccaggtggccaatggtggtcatgatcttggaccagcgtgagctcgccatcggatcccctgcataacatcttcgcgtgtgctcaggagcccatcctcccaatccatccaggagctgaccgatgagcacaagcccgagttcatcgccggcggtgccacccagaacagcatccgcatcgcccagtggatgctgcaggtgtgcctattggattggaggttgtttcggtttcatagtgggtcgtgggagtagcagtgcattcgcccctcctcaacaccccatccaccacttaacgatcatccacggcccaccctcggcgcaccaggttcctggcgccaccacctacatgggctcagtggggaaggacgagtacggcagcatcctggccgcggccgccgccaaggatggcgtgcaggtgcggtaccatgtcgacccggaggtgcccaccggcacctgcgccgcctgcattgttggcggggagcgctccctggtggccaacctggccgccgccaacaactacaaggtgggtagttgggtggagaagggggagagaggggggcggggggggacacccgcccacgcatccagccgactggactgtgcccctcgatcgccactcacccatcccaccatcccgcccccacctaccgccagatcgaccacctgctcaagccggagaattgggcggtggtggaggctgcccgtgtcatctactccgccggcttcttcatcaccgtgtccccagactcgatgctgaaggtggcccagcacgccgccgccaacgacaagcagtacgcgctcaacatctccgcgcccttcatcgtggaggtgccgcccttccgcgccgccctcaaccagctcctgccctacgtcgacttcctggtgtgtgcggggggggcgtgatcgttgttggggaggtggggaggtggaggagcctgtgttgggttgccactgggcaccaggcgaccctgcagggcggggcgggggctggccacagcaacatggattcccctcgcgtcccaccgggaatcttgctaccatcgcataaggctgccgacaaccatccccctccccgctccttgaaccagtttggcaacgagaccgaggcccgcnnnnnnnnnntgggcggggcggggactggccacagcaacatggattcccctcacgtgccaccgggaatcttgctgccatcgcatgaggctgccgacaaccattcccctccccgctccttcaaccagtttggcaacgagaccgaggcccgcgcctacgccgcagcggccgagtggggcacggaggatgtggaggagatagcgctgcgcatctcccgcctgcccaaggagaatggcgcgcggccccgcacggtgatcttcacccagggtgccgatcccacggtggtggcggtgcacggcaaggtcgcgctcttccccgtgagtgggcccnnnnnnnnnnnnnnnnnnnnnnnnnnnnnnnnnnnnnnnnnnnnnnnnnnnnnnnnnnnnnnnnnnnnnnnntgctgtgcttgcgtggaatgctttacagttcccgccctccgtcccttcaacgatcattccctcccaaacacaaaggtggtgcnnnnnnnnnncgctgtgcttgcgtggactgctttacagttcccgccctccgtccctccaacaatcattccctcccaaacacaaaggtggtgcggttgcccgccgagaagctggtggacaccaatggcgccggcgactccttcgtgggcggcttcttgtcgcagctggtgaggatcacgggggtgggcacagggggccagcggtggttctagctcacccactgcatcgaggcacaaagctgttgtgcgagccttccctgcccttggggctgctcagtcctgccaacagatcatcgtgtgctcagatacccccccctcccccgccgtccatcccacaaccccccctgccctcacccccccaatctgtaggtggccggcaagggcgtggaggagggcgnnnnnnnnnntgccgtccattctacaaccccccctgccctccaccccccaacctgcaggtggccggcaagggcgtggaggagggcgtgcgcgccgggcactacgccgcctccatcgtggtgcagcgctccggctgcaccttcccagacctgccctacaacttctcctgggcctgagccggggtcggggtggcacgaggtggacttgggtcctgtacctgtgcgcgcccgccctccgcgcctcactgactccaaggcttgaaaaacctcgtccccatcaccatgtcgggttgcttgtcccttctcgctgcttcccaccttgtctgacattcgtgtaaagtcggcccaatgcatccgttccatcaaggggaatgtgtgtgggtgtgtcacagcgagacagtgcgcagagcagggcatcaggggcccggcggttgcaggatcgggagtgccggcatgcacagcgcccaggacagggctccagcgctgcacatgcagagttggagctgcagggaggacagtggccaagcggtgcaggggcctcgctatgcgtcttgcccgttctccctgcgtgaggagggggcgagcacgccatgggcgacatgggcccctcgaacacagcgacctggttcttgctagtgcttgaccacaagcgttctgagctcacatgttcgcacggcgctcttctccttccagagtctgagacaagaagagcaagcacacccctcccgcccctcctccccctccccccccacacacgtacagcaggtagtttgcagccannnnnnnnnncaaagcgttctgagttcacatggtcgcacggcgctcttctccttccagagcccgagacaagaagagcaagcacacacacacacacccctcctccccccctccccacacacacgtacagcaggtagtttgcagccagggtctcgttcttgtcgcagatgaggaacgcctccaaacacacctgtggcgatgcaaggcaaagttggtaccgagagatgcacactgggccttgctgagaggtcgccccacgtcacacagaatgcagacccagggagcagaccgcactcgtggacaggggatccccttcccccccttttcccccacttgcaacccccacctggcggtcgaagccgaggcccacgagccgctcgacggcctccacctcctccggcgagaggtggacctccaccacgttggccccagggggcacatccccctcgtccatggcctcgccgccgccctcaccgccctcgtactcgcccgccagctgctgcaccagggtctccaggtccgcgccccccgccgcgctgggctcgttgatcatggcgaggaaggcggcctggttggcgttgatctgctccagcagcgccgggttgttccggcccagctcctgagcggtgaggggggtggggcgagggtggggcgaggtggaaatgatggacagcgggcgacccgacgcgctgccctgttgtcagggcgggcgcagcgatggggtcggcctctttgggccgtcacgatccagccagtaccatcatgctttcgccctcctcgtaccggcctgccccttctggccacactttgcacatcccttctctctttttcacctccactcaagctcccactcccaacaacaagccctcaacaagcacacagcgccggccccccnnnnnnnnnnctaccgtcatgctttcgccctcctcgcaccggcctgccccttctggccacattctgcacatcccctctctattttccccctccgctcaagctcccactcccaacaacaaaccctcaacaagcacacagcgccggcccccccccacgaacctgtagcatgggctggaggagggcggggttctgctgcaccatggccttcagcatctggaactgctggttggagcggaggaaatccaaggggcccgccgcccccggcgccgcctcggcggcgccgggggcaaacatgtcgaagggtgcagcgggggcgggggcgggggtggccgaccccggggcgggtgagctggtgggggccgccggccgctcctcatcctgcagaaataggtgggagaggcaactgtgccggatgccccgctgtgcagctcagaacatcagccaggtgcagggactccaagggaggctgtagagcccccgagaccctggacggggctgtggcagtgcttgccaaggccccaactgctcccttcgccagccccggcgctcgagcgcagggactgttcccagcacccgcccccatgacacaccctccaacatccaaactccccccccccacacacacatgactcacccccaggccggcggggatgccggacatgaggtactccacggcgnnnnnnnnnngggtgggagaggcaactgtgatggatgccccgctgtgcaactcagaacatcagccaggtgcagggactccnnnnnnnnnntcaccctcaaacatccaaactcccccccccacacacatatgactcacccccaggccggcagggatgccggacatgaggtactccacggcgcgctcggggttgttgaaggcggcgcgcatggcacgttgcacctcctcgcgcgggaagcccatgtccacgatggcggccaccttggcctccagctccgagcccctggcaagctgggaggcggcctcctcgtagcctccagcggaggcgccagccgcggcggacccc

SEQ ID NO: 44369 - DNA, 61 bp, Chlorella protothecoides
tgcgccggcgtccggcgcggcgcccagcacggcgaagcccacggtgccgtggaaggggagc

SEQ ID NO: 44370 - DNA, 61 bp, Chlorella protothecoides
gtgccatggcagcacagcatcagcggctggggcaccatatgcccagaccttgtcgatgata

SEQ ID NO: 44371 - DNA, 61 bp, Chlorella protothecoides
tccatgggtgaacttcgtttgcggcaggggggctctgcatcaatgtgtttcatggtgactc

SEQ ID NO: 44372 - DNA, 61 bp, Chlorella protothecoides
tctgcgcggggaggggggaggctcgcaggggacacaggctgtcgattggaatggacctgct

SEQ ID NO: 44373 - DNA, 61 bp, Chlorella protothecoides
aggaggtctgtatctgcgcggcgggcggggggtgagtggggtttttgtggcgaagagcggg

SEQ ID NO: 44374 - DNA, 87 bp, Chlorella protothecoides
aattagttaatttgaaagttaaacttcaaaattaactaagtaaaattaacgttttgagtattgtggggcttttcgcgctttttttaa

SEQ ID NO: 44375 - DNA, 61 bp, Chlorella protothecoides
ggcattcccagcaagcggcggggcctgggccagcaacggcgcgcggcgctggccaagcgca

SEQ ID NO: 44376 - DNA, 61 bp, Chlorella protothecoides
tacgtcgtcatggagcactgcaccggcgggggggctgagcattgtttggcatttcctcggc

SEQ ID NO: 44377 - DNA, 61 bp, Chlorella protothecoides
ggatcgctgcgaatttgttcccaaaaaccccctccatgcgcttccactccccgttttagcg

SEQ ID NO: 44378 - DNA, 61 bp, Chlorella protothecoides
aagctctggcggtggatagtggcggacagggcaggaatggcactgatgcatttggcgagca

SEQ ID NO: 44379 - DNA, 61 bp, Chlorella protothecoides
cgccgcctgctccgactttgatggggagagaggaccccgacagtgagcaaaccggggttgt

SEQ ID NO: 44380 - DNA, 61 bp, Chlorella protothecoides
ggccaaggatggcaattgattgggggggggggctggggatcagagcgcagaggtgtcgcat

SEQ ID NO: 44381 - DNA, 61 bp, Chlorella protothecoides
tgcctttggcaatggatgggttggatcgggggtgatgggaatcgcacgcattcccgctcga

SEQ ID NO: 44382 - DNA, 395 bp, Chlorella protothecoides
  modified_base (113)..(304): a, c, t, g, unknown or other
cctgggcgcagtgcgcccgcgcgccccgcctccccgcccgtgaacgcctggggcggggcgctgccggcctatgccgcgccccagacgctcgcggaggcaaagcacgcggcggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgatgcggagggggagggggagggggagggggctgactcgctgtgggacatgcccgccccgacccccgcgcgcgaccagcccgccgcgggt

SEQ ID NO: 44383 - DNA, 63 bp, Chlorella protothecoides
ataaaaatgcattgatatgtcttgtatattaacacatatcaatgcatttttatataattaatt

SEQ ID NO: 44384 - DNA, 116 bp, Chlorella protothecoides
gggggggggatcccgggggtgaaggggtgtgaggggaggttgggggttgcagactagtagactgggatgcaaggccgaggcgggggagggcctgcctgcatctgccacggtcagcg

SEQ ID NO: 44385 - DNA, 61 bp, Chlorella protothecoides
cctggggtgatgaacggcggcagatgcggggcttcgactgcagctctggccatcgatcaca

SEQ ID NO: 44386 - DNA, 26658 bp, Chlorella protothecoides
  modified_base (145)..(260): a, c, t, g, unknown or other
  modified_base (368)..(377): a, c, t, g, unknown or other
  modified_base (1305)..(1391): a, c, t, g, unknown or other
  modified_base (1905)..(1914): a, c, t, g, unknown or other
  modified_base (2728)..(2737): a, c, t, g, unknown or other
  modified_base (2970)..(2979): a, c, t, g, unknown or other
  modified_base (3287)..(3296): a, c, t, g, unknown or other
  modified_base (3387)..(3396): a, c, t, g, unknown or other
  modified_base (3531)..(3610): a, c, t, g, unknown or other
  modified_base (4369)..(4378): a, c, t, g, unknown or other
  modified_base (4672)..(4681): a, c, t, g, unknown or other
  modified_base (5494)..(5503): a, c, t, g, unknown or other
  modified_base (5600)..(5609): a, c, t, g, unknown or other
  modified_base (5759)..(5768): a, c, t, g, unknown or other
  modified_base (6042)..(6051): a, c, t, g, unknown or other
  modified_base (6485)..(6494): a, c, t, g, unknown or other
  modified_base (7319)..(7328): a, c, t, g, unknown or other
  modified_base (8950)..(8959): a, c, t, g, unknown or other
  modified_base (10496)..(10505): a, c, t, g, unknown or other
  modified_base (10950)..(10959): a, c, t, g, unknown or other
  modified_base (11578)..(11587): a, c, t, g, unknown or other
  modified_base (12076)..(12085): a, c, t, g, unknown or other
  modified_base (12259)..(12268): a, c, t, g, unknown or other
  modified_base (13137)..(13146): a, c, t, g, unknown or other
  modified_base (13323)..(13332): a, c, t, g, unknown or other
  modified_base (14993)..(15002): a, c, t, g, unknown or other
  modified_base (16197)..(16206): a, c, t, g, unknown or other
  modified_base (17137)..(17146): a, c, t, g, unknown or other
  modified_base (17891)..(17900): a, c, t, g, unknown or other
  modified_base (18305)..(18314): a, c, t, g, unknown or other
  modified_base (18649)..(18658): a, c, t, g, unknown or other
  modified_base (18890)..(18899): a, c, t, g, unknown or other
  modified_base (19999)..(20008): a, c, t, g, unknown or other
  modified_base (20458)..(20467): a, c, t, g, unknown or other
  modified_base (20845)..(20854): a, c, t, g, unknown or other
  modified_base (21521)..(21530): a, c, t, g, unknown or other
  modified_base (22130)..(22139): a, c, t, g, unknown or other
  modified_base (22465)..(22474): a, c, t, g, unknown or other
  modified_base (22686)..(22695): a, c, t, g, unknown or other
  modified_base (22957)..(22966): a, c, t, g, unknown or other
  modified_base (24278)..(24287): a, c, t, g, unknown or other
  modified_base (24529)..(24538): a, c, t, g, unknown or other
  modified_base (24707)..(24716): a, c, t, g, unknown or other
  modified_base (25115)..(25124): a, c, t, g, unknown or other
  modified_base (25579)..(25588): a, c, t, g, unknown or other
  modified_base (25822)..(25831): a, c, t, g, unknown or other
  modified_base (26076)..(26085): a, c, t, g, unknown or other
  modified_base (26372)..(26571): a, c, t, g, unknown or other
gggcgcagggctggtgctccggcccagcccgtctgtcctggcatgagggattcgcgcccggccacgtgaccgagccgcctggcgacccgcgagaaaactgacggggcacggcttggcagacgcgggggccggccccgctcccaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaccgtgcctcgttgtaatcacccccttcccatgttgggagtctgctagtgtcacccggggttgatgagggtgccacccgcagcaccagccctcccacaaccctggcnnnnnnnnnngtcctggcatgcgggattcccacccggccacgtgaccgagccgcctggcaacccgcgagaaaccgacggggcacggctcggcagacgcgggggccggccccgctcccaaccagacctgcacacctccccccgctgtctgtgctgcgccctggcgatgtcccggaccctagctctttagctctctgtcgttcaccgtgcctcgttgtaatcacccccctcccgtgttcggagtctgctagcgtcaccaggggttgatgaggatgccatccgcagcaccagccctcccacaaccctggcatggcccccctccgcactgctggcgatcgtgtgcctgatttgacacctgcgctgtgacacacaaagcccccgagtaaggtcaggttaggctggcgaggcgcagcgcggcttctcggtggcccggctccaggaccaggacgtgctccaggtcggcgcgcgcggcggcgtgctcgcccagcgcctgcgccgcagcagcgcggcgcagtagcgccttggcgttgtcgggctgcgccgccagtaccacctccgcgtcggcgcccgcctcccgccagcgctggaggtggagcagcgcctgcgcccggttgttccgcgcggccaccaggccggactcggcctccagtgcctgggtgtacagccgcaccgctgtctcccactcacaccgcttgaaggctgtggtcatgggaggagagcgtgaaagggcgtgtgtgtacaggattggtagggagcgtggcaggacatgagaggccagtagcgaggatgacgctcgacatgcacgtcaaaaactcctttcatgatgtaggggatcgtagaatggggcacagtaagtgcagccaaagccatgactcgcaccccctgccaggcggccttgctccattccattgagccatgcgcctcatgcctcccttatacnnnnnnnnnnnnnnnnnnnnnnnnnnnnnnnnnnnnnnnnnnnnnnnnnnnnnnnnnnnnnnnnnnnnnnnnnnnnnnnnnnnnnnnccctcctaccccatccccccccaacacacacctgcattgccctgctgcttgagcgcatcggcgggcgaggggctggaggcgggccccggaccggccccctccgcctgcatgcgttgcaagatggcctgcgcgccctccccccgccgcgcctcggcattcttggcccgcgcggccgccacccagggcgcggaggaggacaggtcgttggcgccaaagtccaggcggcggaaggcctcgccgtcgtccaggacgcgcgataagaaagcgtcgccgcgcacctgcagtggcttgccgcagagggtggccagctcgctggcccgcgcgttgaagggcgcctcgcggatggacccctcgtcgtccacgtacatgttcacgcccacgaagccgtggaccggcaggttgggcagcagcgcgatgctctccaccatgttcagcgaggtggccgctaccagcaggcggtcgtcgggcgccgcggcgcccgccggcagcttggcgcgcagctgcgcgacctgcnnnnnnnnnncgccagcaggcggttgtcgggcgccgcggcgcccgctggcagcttggcgcgcagctgcgcgacctgcgcggcctgctgggcgggggttttgaccgggctggtgcgcgcaaagtgggcctggagagtggtgatgggattggagtaatcaggtttgggggcattgagatgcgagcagaggggctcacatgctggtgggtgaaatggtgggggctggagcctgggcaggtcacagggtatgccctgcaccccacatgcatcttactgctgctccttcacttctgtaacacctaaacattcagagggagcatcttgttctccttgccacaccttgatctcatctaagaggcactctacctccttgccctccttccacacgagcgtcttctcctcgggaggctgcgacctgagtgaagttgaaatcgagtatgtacacttatacaggtatatgtatatattcacattaccaatccagcaggctgaatgtttctacaccatcgagcacgcaggcccgctccacgccactgctcacgggtctgctggaatgtagacgtactgaaagctaggcatggtgctcccgctacggcactgcctatgtgcaaacgtttactggctgatgcaattaggatatgttacatctcatctttgctaggttgcagatgggagcgtatatgcattcccaagacgtttccaggcgggcaggaaatctatacaggcgcgggcgcgcgatgcgccgagacacgtccgaaccgcctctgtgtgcctcttcccactatttactcggtacaaagtgaagccattacaggacacagctgannnnnnnnnngcgcctctgcgtgcctcttcccaccatttactcggtgcaaagtgaagccattacaggacacagctgaaaagacctaaacccaaacctcgtagaccaggaactcctgacgaaataagtacactgacagcattggtacctcttctcactgtccatccacaccctgttcagagtctcttcgccacttcttggctcggccgtcattgtcagccaccccgtccactggccgcttgcgnnnnnnnnnncgggagtggacagcgaggtgagagatgctgcacgccatagtactaactcgggaccgtgtgcagatggcaagccttcaatcctgacggaaatacctccaattgcaatatcctgggcaacaggcccacctcatacctccaaccacccacctgctgcagttttgctgggcagggccgtgccctcctccacgatctcaaagccctcctcctcgacttcactgccatcgtcaggctggggacccgcaccctccttcccaaaagtgctggcaggcagctcgccccggatctcccacctcagcggttctgcatcnnnnnnnnnnttagctcttcggagcggcaagcaggctatgcttgcacaccgcatatttctcaccttatgctgcacgaggatgcggaagctggtctgctgcnnnnnnnnnnttcatcccaagtgtcctgcaatggaggatgtacatgacggagatgaaccctagaactcacagcgcgcctcagcacggttgctgcctgtcagctggaggtgcacagaccatggcaccccttcacccatgaggatgnnnnnnnnnnnnnnnnnnnnnnnnnnnnnnnnnnnnnnnnnnnnnnnnnnnnnnnnnnnnnnnnnnnnnnnnnnnnnnnngcctgatctgtgacctcgaccagcgtacccgtggcaaacccgccgcccggcagctgactgaggggctttgtcaagttctgcgagtggaacgccacctggcaatgcgcgggggaggcaggggattggcttgagcagaggctgcaccaacgattccctgagggcacatgagtagctcgaagtcttcgggggcgcccaccaagcctcaaccagcaccaaccgtttccccatgtgggcagcaaagtccctcctcgcacctcatcctcctccaggtcctcgccctcctcgtacatgaagctccccgccacgagcgtcggctccaccagtgccattcgtcccctaaggacctgtacgagggggacacgggaacgggggtctgcacaggtgatgcagactattgacgcctgggccgtgaaagcaaagccatacttccggccagacaacatgacgggcccacaccaatcatgtccagcatccccacctgtgtgatgaggtcccccagggtcagggcatgcaggtcggcgtgcagcagcagctgcgccttgccgcagatgacgcagttggggttgggttccggcgactgcatgggcgtcagcagcttcttgttactcgcctccgcaagcaagaaagtggtgtggcacgcctttgactggcctgcggtgggaatatggggccaaggagagcagcattggaagggtgcatccacatgcaagctactgccgctggcattctttggccagaacgccatcactgaagtctcannnnnnnnnnctgcatccacatgcgagatactgccgctggcattgtttggccagaacgccatcactgaagtctcagtgaactgcgatcgccaccccactattcccacctgccagaagcttcatggcctccaccacgatgagccctgaggcaatggcgttggtcgtcgccacggcgtggatgatgttgcccgccattccctggcaggtggcggacaggtgggcaaggtgtacatttggggagtggacctgagccctgcggccagttcttagccacccaaggaatgaacgaggttgcagagtcggnnnnnnnnnngcatttggggagtggacctgagccttgcggccagttcctagccgcccaaggaatgaacgaggttgcagagtcggcccacccttcaagcttcccaatcgtccaccgaccacgctgctccccatgcagtcccttccagccgccgaaaataccctgggaggctccctacgccccaacagcctctttccctatccacccagccacacgcccacaaaccttggcctcgaagagggtctggggggggatgccgtagcagtgtgaacgcaggttggcggcggccgccacaaactccgtcgccagtgcgtcgtctttatcgaagcgcagcgcgcccacctcttcggcccggtgggtgaggaaagcgcggacgctggccaggaacacggccgcgctgtcctctggcgcccaggcgcgctgggcgtcgggcaggcccagcgcggaagacatgcccgaggctgcgacgcctggcccacgccccgccgcgctttcctcggccagccgcacacgctcgcccaccgctgctaaatccagggcgcagggcgtcgggggctcccgccccttccacatctcctccaccccggccaggcgctccatgtcggcgacaaacaccgcctggaagacgcggagggcgtactcttccgccggctcgccgctgcggcgcaggagcgcagggcctgccgtcgttgctgcctctgctgaggcatcccctgcgcggccggggccagggtgtcgtgcttctccctctcgccgcactgagaatgtcacaggacaatcggcacagggctctcatgcacacacgaccccccccccccccccccnnnnnnnnnngtagggtgtcgtgcttctccctctcgccccactgagaacgtcacaggacaatcggcacggggctctcatgcgcacacgatccccccccccccccccnnnnnnnnnncccacaccatgcctgggtcctcgccggtgtcgtccaggtcggtggcggcttctggcggcccaaagagcctggcgaagaggaggtccttggcccacacgatgcagtggatgggcttgtcgggggtgttgcggatggtgcacaccgggtagnnnnnnnnnnaaagaggaggtccttggcccacacaatgcaatggatgggcttgtccggggtgttgcggatggtgcacaccgggtaggtcttgggcacgggtttgggctggcactcgaagcactcggtgacgccgcccaggtgcacgctgacctggcaagagatggggttgggcgaggcagccgctgagttcgagcgtgaggatgcgggtcaggtcgaccccgcgggtctcctccactcgtgcccgcgccatgtgcgctggtgcctgatcccctgcccctagccnnnnnnnnnntttgggcgaggcaaccgttgagttcgagcgtgaggatgcgggtcgggtcgaccccgcgggtttcctccactcgtgcccgcgccatgggcgctggtgcctgatcccctgcccctagccccacactctgtgtgccactgcatcccacaccgccccccccccctcaaggcctcatgtggcctcgtccaccacccgcaccctcctccgacacacctggcccaggtaccctgcagtaccgctctccacgaggggcacgcgcgccgccaggcacagccggttgacgtggcgccgtgcctccaggttgtccagtccgttcaggaccaggtcgaagccggagacgaagtctgcgctgaaccgcgcctccttcacgttggctgggtgtgcggtgatgctgaccccggggacaatcgcctgcaccgccgccgcagcgaccgagnnnnnnnnnnagttgtccagcccgttcaagaccaggtcgaagccggaaacaaagtctgcgctgaaccgcgcctccttaacgttggctcggtgcgcggtgatgctgaccccggggacgatcgcctgcaccgccgccgcagcgaccgaggccttgctctgccccacgtgctgttgcctgaacaggaactgcctgttcaggttgctggtttcgattgtgtccaggtcgatctgacagaggtgggggggggttggtggggggggacatgatgatcaagacctcagaagtgggacggacagggccacagagctggggaatgcgtctcatctcttccaagaaccggaatctgcaccaccaagatgagcgtaccactactaaattcttgaatccactcattgccaaggttttgagtagctcacagccgattcctcccgccccgacaacaagcaccttggcctccccgatctgggacacgggaagtgaacaatgcgcgttggatacaaatttttgaaccaaccccaatgaggtgtgcgttccacaccagatcagcgcccatgcgcaccctggttcgcatggcgtagctggtggcacccagaggccaggggatggcaccaccctcgctcggggccaccatggccatcctacgtggaataaatatatatttgaaggagcgagactctgcattgatgtgtattcacacatgcgtattcataactctaccctctggtcgtcgaatacgcgcgcgcgcgtaatggtttcatatcaagggtgcgccttcacttacagggagaggtgttacaaagttccttggggcttgggtacacttgggagttgacgnnnnnnnnnngatggtttcatgtcaagggtgcgccttcacctacagggagaggtgttacaaagttctttggggcttgggtacacttgggagttgacggtattatcagggtacagttcaactgtgcagtgtgcatggaaggcacagccaagctccaggcaaagaaacaaatgggaaggtgatggcacaggtctcaagcctggacagctaccatgcatggctcctgctcaggcgcttggacctccgccctcctcttctgcagtgctaagaatctgcaccgtgagaaggaggatcggtgtcaatatgttcggcaggcttccgccgcccaccctcgcacccaagccactgcacagtggccctgcaccgactcagtcccacaagacgcaaatggagccctgggaatcactcactgtgcgtgtgtgagactggccgcagtgctctggtatctgaccagagacagtccagcacggatggagcgaaggctggcctgcccgcccctggcccccgccttggaaatgagctggtcaatggtctgcacccgggtccagccctcctgctgggcaatctcgggcaggaacgtggcactgcgggtgcccccggtgagggggcacgcaaactcgatgatgatgccatgcactcccgggacccagtcctcccaggaaccgcccgtctcaaatgaatgcaggagggacacggtgcactccagcgctggcagctcatgggcctcgacgggtgggaaacggcggtcgtgcagcgcactgcagcgtgggaagtgagacgctcttattcgtctggagcgcattggtctctggttgggatcggccaggcaggtctggacattgctggtgtgtcccagagtccaggtcgcatcccccagacctggtcagggcatagtcgtggagggcctgatgcagacggcggggctccagaatgccgatgcagccccgcaggcgtcgctcaccattcctgctagctttcttccaggtcacgaataaggggctgcgggtgggtggcgtgggtgcatcgtgttgcccaggcctccccagcatattcgcctggtgcatacctcgggccctgcctcgccgaggtctcaactgctcgcatccataacgtaccagttccaattctcaaagtttggtgtttctcgatagtggtcgtgcctcgaaaaatggttgatcagggcttggaacgcgtatcggacgtgctcctccgacacggtgagctcgccggtgggaagactggacccctgcatcgcaggggacccaataaaaaaatacgccgcggagatttaggcttcaaagctaccagtctctggcttgaatctaaccttctcgaatggcatcccccggagccatcgtcgagcatgatttcttcccacattccaaaatacttcctaatgtactgattcgcctgaggttgaatagctctgtgataagtacgtgtaccatgcaaagtaatgtaaacatactcatttcctagtcccagaatgtaagaggctgagttttgccaatcagatggcaaaatcccaaccctttgccgactcagggtccttcaaggaggccacacgccagtggctttcgagttgggtgttattacgcaacgaatcgaaaagggaatggactaggaagtaacgnnnnnnnnnnccccaatgggctgattcgcctgaggttgaaaagctctgcgataagtgcgtgtaccatgcaaagtaatgtaaaaatactcatttcccagtcctagaatgtaagaagctgagttttgccaatcagatggcgaaatctgaaccccttgccgactcagggtccttcaaggaggccacacgccaggggctttcgagttgggtattatcacgcaacgcatcgaaaagggaatggactaggaagtaacgggagtaacagtgcggcattcgccaggcactccaaagccttgcgttgtcgtgggagcttcgccgatcggattatgcgagactacaaccagtcgcagatgattaacaggtatgaagcttgcccaaatggtagaaattggctgcttgtgcattgttcgataaacatgtcacgctcaggctcgctgcagacctcgaagccctacagcgctccgggcggcagggaatcttaacaaatttcggcgggaaggctcggatggggcacggagagcccgttgtgccgacccgagagcgccactcccgcctcgcccagcggtcctcgcgggtcctgaagtcgaggaaacacggcgattgcacggataccggggcgtgatcgtgtgtggcgcacgatagggttctttcccccttgtgtgacctaggcatggtgcaagtcaccggcaccatgaactccggctcaagcaacagcgatgagcagctcatagacagacgactcaccattagatggggccccacagaggaggaactgatcgagcggcaggacacattcaatggcagcgtcccggatgagactgcagccgaaattgcgtcgctgcacggcaactcggtgagaggctctgccggtacctgctttgcccctccttctccctccctcgtggtcattcctatcttcccaaatcctgcgcaggccgcacaacgtcgagccatcacagagttgctgtttttcgcctgcgtcggcgacctcaaacggtgccaacgtatcgtgcgcctgtggaacctgaaggtgcggctggcacgcgatgttcacctgccagactggcaaccgcgcgatctgcttagcttgtccaacctggaactgctcgttccaaagtttgagcaattccaccctccctcatccccacctgcaacccatcgacaggtggccgcacctgattgctgcgactatgacaagcgaacccccttgtgagagcggtggtgtagccagcttgcaacgctttccatgagagatcacgtgcgtttattagggcttcagctctctcaggagtcatctctccaacacatctcaggcacctagctgccagcgaaggggcttacagcgtcactgaatggctccttgccgagggtgtgaatgtcaatgcgctcgaccgtttcaaccgcacccccttggaggtgagatctgttgtacaacgatgcgtgttgcgctcagcacacgggtcaggagctcctggcgccttgtgactcttgaatcgaccacacacggcagctgcctcgttgtggttataccttcttcccggcctccaagnnnnnnnnnngacgatgcgtgttgtgctcagcacacgggtcaggagctcctgacgccttgtgactcttgaatcgaccacccacggcagctgcctcgatgtggttataccttcttcccggcctccaaggggacccatgccccacagcaagtagcgatctcaccccccgacatgcgccatttgttccctcaggatgctgtgcgtggcgacttcaacctggtggcctccctcctgatgaaggctggcggcaaggttcacgcctctggcaaggtgtggtgaggaggaaacttgtgaggagacgcagggcaatggtgtgctttgaaatgtaccactatggctgggatgcctatcgccagcaggttgccgaaaggaataggctccgtgtgtgtatggcagatcatccctacagcaagcatacgcttccactcttactgcagttgataccgctggaggactnnnnnnnnnnttgtgtgtgtatggcagatcatccctgcagcaagcatacacttccattcttactgcagttgataccgctggaggactccgagctggtcaatggcctcggcttccgtgcgccccagcaaaaggcgtcgggctttgccctcgagtgggagctggacccctccaccatcaacatccgggagaagctgggcgagggagagtttggcgtcgtgcaccgagccaagtggtgagtggggctgctgcagggtctgcttggtggtctggctcgggtcctggcagctgctgctcctgactgcgctggcatctgctctttatggcaagtgcgcagcctgctagcactcctggcagtcccctttcccaactccatgcccctgcctaacccttctgcaagtccattcaccgtcactccccctccccgcaccgccaggtttggcacggtagtggccgccaaggtgctcaaggcctcctctgagatcgcggtgaatgacttccgggcagagatcgagatcctgcagcgtgtccaccatcccaactgcgtgcaggtatggggcagtggggtagggggcaggggtggttaggaggacgcctgtaaaggtgtgtgtgtgtgtgtggggggggggggnnnnnnnnnnccccaactgcgtccaggtatggggcggtggggtagggggcaggggtggtgaggtggacgcctgtagaggtgtgtttgtgtggggggagggggggtgggggtgacccttgtgcatcgcagcagcgccgtctcagacctgcggcaatgcacgctgtgtgggtgtgggcaccacctcgcagatgcgaagtcatctgaccgagtgcaggtacggcgacagcccatccacctcgcttacctcacccctcctgcccagttcctgggagcctgcacggcaaaggagccgtacattctggtgaccgaattgatgagcggcggctcgctggcagacgccttccgtatgccgcaggtgtggatgaggcggggcagggtgggtgaggccggtctgctcgagggatccagacgtggcgccctcgcgcgtgggagtgggttgcagcgcgcacatggagccgcgtcgatccgcgccttctggctgccctgccccccgccgccnnnnnnnnnntcttgcgcgcgggagtgggttgcagcgggcgcatggggccgcgtcgatccacgccttctggctgccctgccccccgccgcccgctcgagtcccccgacgtccgcgaatgcacgtccccaccctccctgcacccccaggcctttcccatgcggcgcgctctggagatcgcactgnnnnnnnnnntcgcccccaccctccccacacccccaggccttccccatgcggcgcgctctggagatcgcactggacgcggcgcgcggcctggcgtacctgcacaatcgcaagcctacccctgtcatccaccgcgacctgaagcccggcaacctgatgctgtctgggtcgcagtaccaggaccgcgcgcaggtggtgttcaacacgggcgtggtgaagctggccgactttgggctgtccaagacgctgcccaccaaccgccacgccaacttccacttggacgagcggttcaagctgacgggcgagacggggtcgtaccgctacatggcgcccgaggtgttccggcacgagccatacaactcccgcgtcgacgtctactccttttccatgatcgtgtaccagctgttcgagtaccagcccccctacgccgacatggaccccgtggaggcagcgcgcctggccgcgctggagaacgcgcgccccaacttcatcacactggcgcagccggggccgcacaagaaggagctgcgcgagctgatcgagcgctgctgggcgcccaacgccgacgagcggccctccttcccggagatctgcaggatcattgagacgctgctggctcaaattccgcgccaggagtaccagagctcgggggcggtcggcggcgacgccggctgctgcgtcgtggcgtgaggctgtaaccgcagcgcgtgaggctcttgtgtcgtgtggctgccgcgtcgggaggcgggctctgcgcgtcagtggaccccgacatccccacatttccatcaccccttttccctccagagagaagaggggtttttgctcttttccaggccagggtgtatggaggggcctcggcgcggctggatccctcccannnnnnnnnnatctggcccaccgcccttcttctgaccctgcaatcaccatgtgcctgcttgcgagcccggcattggacccctcagaacaggcccggttgacacgaccccccgccccagacgggccaccctggcagtgactttccggcaacgcaatgcccggcatgccctgccccccaccccccaccnnnnnnnnnncccagagagaaaagggggttttgctcttttccaggccagggtgtatgaaaggggcctcggcgcggctggatccctcccatcacccaacagcaccccgacctcacacccacccagaccgctgagcatcgcagcgccttgagcggcggtggtgttttgacgtgcacgcacctgcccctgacttttgggctgtctggcccaccgcccttcttatgaccctgcaatcaccctgtgcctgcttgcgagcccggcattggacctctcaaaacaggcccggttgacacgacacccccgccccagacgggccaccctggcggtgactttctggcaacgcaatccccggcatgccctgccccccaccccccacccggccaatgtgctctgtgtaatgtaacatcacccccgccttcaagcctgtcatttggtcaaagtggccaagtcaaggaggtcaggtcgccaggcgggcgctcacagtgtgccggcgcagcgtcatgctgccgccgcccgacgcctgggggctcgcggctcggcccctgctggcgaggtactcctccgcgtcccgcagctcccacctgccccggccctgggcctccagcacgtgcgtgtgccactggaccagctgcgggcggtggcctgatggcgtaatttggtgggaggtggataagttctgaaggacaggatatgaggttccacaaagcggttgcttctggaacaccgaggcacagacatacgcgcacaatgggcgacggctgctcggcaccacggcgcaaggccgcgtggaagatcctgataccttctgaagagtcaagccagggtactcatgaaagactctcctgctcccctcccagccacccatagccctccttctgtcatcccatccacttctgtcctggcgtccccttcacctccacacaagaccccctacttccccacgcaccgactgaaacaaagcttgcccccgtcgcggcgagtgctgtgtaaagggcatcctcggtggccgcgtccagccccgaggtcgcctcgtccaggaaggccaggcccgggcggtggtacagcaggcgcgcaaaggcgacccgctgctgctcgccgatggacaacgtctgcgcccagtcggcctctgccttccagccgccagacctgggccagcagagagggttgggaggggcacgaggaagggtgtgagggtgggcaggatctgaccatgcgggtctcgaaggaacagagcacaggcgcacaaaggccggcccaatcgcgtctgcgcacatccccctctaaattcccggcctcacctctccagcaggtcggggagctgtgcggcagcgagcagggctgccaggtccgtggcgctgccgcgtgtgtgtacgtggggaaacgtgacctggtcccgcagggtgcccagacacatgaatggcttctggggcaggaagaagagcgagtcgcgtggcagggtgcgcacagtccctgacccttcgtcccacagccctgaggggggaggggggttgggtagaggagcgggtgagggtgggtgatcgagggattagcacatgagctcagcaagtgtattgagacaccaggagactgtgtgctgcctgtatctcaagcgtttcatgcacccagcggccatgctgtcccgcctgttcatccaagaacgcactggggcgccnnnnnnnnnnggcacatgagctcagcaagtgtataaagacactaggagactgtgtgctgcctgtatctcaagagttttatgcacccagcggccatgctgtcccacctgttcatccaagaacgcactggggcgccccctccctggcctgagagcagcggtggcatgctcgctgcaggttccccactccctcgcccggccatacatcccaccctgcacgcatgcagccgctacatcgcccaaccctttcagcacctcaccggcaatgcagcgcaggaggctggacttgccgcagcccgagggccccatcaccagcagcgactgccccgcccccaggctcaggtccaggccgtccgccaggtgctgggccccgcccggagtccacagggacagcccctccagctccagcacggcgccggcgcgggccgcgccgcgcgcaacgctggcgccggggtcgccgcgcggcacaagcgcgcgcagcagctcgtccaggcgctcggtctgggccgccaggccggagagcgcggccaggttgtccacgacgaaggacagcgcggactcgatgcgctggaaggtgaaggagacctgggtgatgtcgccgaagcgcacctggcccgcaaagtaggccggcgccatgagcaaggaggggacctggaggagaggaaggaagagaaggagggggggggggtgttgtcagggggattcgtcttgtgtgccctggtgcgtcaccggtgctgcagtcgagcagtgtcggcggccggccctgcgtggcatccgcccttcttccccctccgatctcaacaccttcaaccacccatgcacacgaactctatggcatctgacacctgacctcccccaatccaagccccccccctcattcccactcacacctaccagcagcgtggtgttgctgtaggcgttcacccacagcgccaggcccgcctcccaggccacccggcgcagcgcagcgtgcacagcggccgccagcctggcgtgcgagacgcccgcctcgcgcgcctcgcccgagtagaaggccaccgactccgcggcttcgcgcacacgcaccagctggaaacggaggtcggcctcgcggcgcaggacctcgtaggtgcggcgcatgaggccgcggccgaagacagcggcggtgactgcggtgccagccgcggcgtaggccagtaggaaccacatcatgcgcggcgcgatgctgnnnnnnnnnncccaaagacagcggcggtgaccgcggtgccggccgcggcgtaggccaggaggaaccacatcatgcgcggcgcgatgctgaagagcaggcccgagaaggcggccaggtagaagagcttgcgactcaggcccaccatgagggccacgctggaggaggcgaaactgcgcgcgtcctcgcacatgcgctgggattgatggaggagacaaaagggggtggttggtgtttggggagggtagggaatggagtcagagtgcaaaaggagtgtgggaagtggggagtgaggctgcaggtacatgatggagtctgacaaacaagtctggagagggatggctccgaggctgaatctcataccaccctcaccagcatcagcccccccaccaccccccccccctcctttgcctgcacctggtcggggttgtccagaccctggagggagcacagcatgatcctgtagtacgcccggtcagcatagtaggcgtccagcatgtgccccgttagccagcgccgccagtggatgaccagcaggccatccacccactctgacagggcaaagaggggggtggcaacggccgccactcccacaaactcccacacggccgagtagaagccggctgggtgattgggtttgggggccgggggtgagccttgagagtataggacggaagctcactcttgcagcaggcaggtcatggaaggcaccgccccggtcctgaatgcccccgcgctcacactcggacttctcagacaggttggaggacaggttgctctgcgtgtagctgagcttgagcaggaggagggtggtggcaatggacagggcggttgaggcgatggccagtcgccaggccatcgcccggttctcccctgtgtattcaacagtatttggaaagaatttggtcaagtggtcttcatgttccgaccagctgcccttcagnnnnnnnnnnatgtgttcaacagtatttggaaagagtttggtcaagtagtcttcatgttccgaccagctgcccttcagcatgacgagtggcgaaaagaataaccgaaaccctgccttaagcacttcctggttgtttaaggccacctacctgtaaaccacagtttcgcgagtcgccaccatttgggcaagacctggatgaagctgggttcactcaaggtctttttcgtattctgatcagtctcaggtgctgatgtggtgtccagggcgatgctgctcggcaggaggccggccttctcgtgcgacattccgacaagctaaagctgagcagtggatcctccttgggccgcatcgcgactataccatcgcgacagcattctcaaaccattttcagatcagatcattgttattcaccatcttctgcctgggaaggagaccctaaaaagccaaacagtttagtgttgaggccgtaccgatgcaaaaccaagcgagtcagagcgcgcgcggaaagaggtgaggcaaatcccatcacgaggattcgatggacgatggtcggctccaacagagggatgacgccccgcattatcgggaagcaagcatctattaaatacacttctacccatacaactcttgacgcccaactggcgtgacgtcgagcgtctcagcaatggcaggcctggcatcccacctcacactgcgacccatgcccgtgcctaccagacacaaattctcggcgcgactcgttccttcgaggagannnnnnnnnntccggctccaacagagggatgactccccgcattatcgggaagcaagcatctgttaaatacacttctacgtatacaacccttggcgcccaactggcgtgacgtcgagcgtctcagcaatggcaggcctggcatcccacctcacagtgcgacccatgctcgtgcctaccagacacaggttctcggcgcgactcgttccttcgaggagacagaaaccttttgtgcgtgctgcctatgcttcaggtgccggcgaggatccctacaaggtgtgctcgggtgttgctggaggcttgctctgggttggtgcattggtggcagagaggtgggaaacatgacaccttcctctgacctcccgccagatactggagcttcctcgctcagcagactccactgccatcctgagggccnnnnnnnnnnagggccttgctctgggttggtgcattggtggcatagaggtgggaaatatgacaccttcctctgacttcccgccagatactggagcttcctcgttcagcagactccactgccatcctgagggcctaccggaacaagctgagggaagccaagggcaacgaaaacgcgaccgccaggatcgaaaatgctcactcccaaatcatgatgtcatccctcagcaccagacttcaggtcggtgcaatgcactggacgtgaggcctttaggggattggaaggttcctgtgagcacagcagccagtgaggatgagacatggacatggagtatagctgaatgcctnnnnnnnnnncaggtctctaggggtttggaaggcccctgtgagcacagtagccagtgaggatgtgacatggacatggagtatagctgaatgcctcgctggcatgtgagcttgatgcccttctcggcgtggcattctacaagtgtatcaggtacaggtgttgttgccctaagcatcatgattgcgacagttgtttatttgcctgagctctttcccgtgctatccccgcagggcaagtctgatnnnnnnnnnntcgtggcagtctacaagtgtatcatgtacaggtgttgctgccctaagcatcatgattgcgacatttatttattaacctaagctcttccccgtgctatccccgcagggcaagtctgatgtgggcaaggagatcctgtatgcggatcgtgccaagatcttcccatggcgcccccgcgtctaccctgccaaccggaagctgctgatgtacagcgccatcgcccaggccctcttcctcgcgtacggggtgttcaacccctccctcacgctgcccatcgtatacggtgcgggaggggggggcatttgtgtggtgtacatggctagactctcatgggaagtcatgcttacagagcagcgctgcgacgtgcagagaggtttggcagtgtccctgccgtcagcgtgacgacgcgtcatcctccctgtcttatatcacgcaggtgcaatgggcggggctgttggccagctgctgaagcagaacgagatcaatccgccgccccctcctggggcagaggccggagcaggaggcggtgggtggagcagggtgtcggggcagggacagcggtggggacagcctgtgcggacatgggattgctgtgctgtccatggcatgatggctgtggcctgatggagtgtgcatgcatgaagaccccaccaccccctctaccaggagcacacaactcttgacactcgctcttccccctgtcctgcaaaacgtcaggcatgaagaacgtcctgcgcggcttcttcctcgctttcctggccacctcgctgggctgcctcttcaccttcaccatccctgacggcatcgccagtgccacagggcgcgtgctgcccttctggttctaccagaaccaggtggggctggggggcgggattgcgcgtgcagggctccgcagtgccatgtctacagaagcacgcagacccatgccatccatactctggtttaaattcccccttgcagaacacactcctgactcttggaacgacggtgctcaacttcttgtcggttgccttcttccgttgagcctgccccatgtctgctcagggctgccatcccgtggtgtgtccggagaaggggttgtacaggcatgccaggcagtcagnnnnnnnnnntgggattgcgcgtgcagggctccggcagtgctctgtctacagaagcacggagacccatcccatccatattctggttagtttctcccttgcagaacacactcctgactcttgggacgacggtgctcaacttcttgtcggttgccttcttccgctgagcctgccccatgtctgcttagggctgccatcccgtggtgtgtctggaggaggggttgtacaggcatgccaggcagtcagtgcgagaaggatttaggaggggtgccagaattttgcatgggagtagaaggacagctccacggcacatacagtgggccggttgggtaaccaaggtcctgcatagagggtcctgctcaaaggtcccatgcaagcgatatcccttcagggcgtgtttgggagcaacacgcggatgaagccctcaccaacagcgtcaagtgaccactcgcatgtcagcannnnnnnnnngtttaagaggggtgccagagttttgcatgggagttgagggacagctccatggcacatacagtgggccggctgggtgaccaaggtcctgcatagagggtcctgctcagaagtcccatgcaagcgatgtcccttcggggcatgtttggcagcaacacgcggacaaagtcctcaccagcagcgtcaagtgaccactcgcatgtcagcaccagacgtcagcgttcgcggagccaggagggcaggtcccgcccacgctgccgctgggacccgcccttgcggtccatgacgggttgctcccccgcccccggccgctgctccgggacgccgcccccgccccctgcaccgcgcctccgcgccgcctgccgcgccgccagtcgggcnnnnnnnnnngtcctccgccccccgccgctgctccgggacaccgcgccggccccccgcaccgcgcccccgcgccgcctgccgcgccgccagtcgggcctcccactcgtcgggctcgtcgcggctggaggtgggcaggggggtgtcggtggcgtacaccacccggtcgcgctggaagctgcgctgctgggcctccacctgggcggcccgcagtttggtggccagctgggggtccggggcccgtaaccggcgggacgctgccaagcgagcctggttccgggcctcgatgcccgcgttccgggcacgcaggctcagcgctcgcagcgcggggatggcgaagaaggagaaggcgtaagcctgtgggacatgggagggtggaggatgtgtgagtgaaggggtgggaccatgtgcgacttgccctcgccccagtccgggcactgccaggtgccctgtgccgatctagcacatcagcggctatcccccacgccacaggtggatcaaggaagagctgagctctgcacccagtcaccccaggtgctcatgcacctcttgcgcgcatgctccccgccccttggagctccccctccccaccccttccccctcaaataaaatcaccctaagcccacctggaggaagggcatggcgttagggatccagcccaggccgttgcgggccagcnnnnnnnnnntcaaataaaatcacccgaagctcacttggaggaagggcatggcgtttgggatccagcccaggccgttgcgggccagcgcatagtagccctggggcgagcccagcatgcccccgagggccaccacgcccaccagattggcggcgcccagagcgatggccaccagcttctggccgccattggcctgcgtgagctgcacgggcctctcctggaccagcttgggctgcaccgccggcagcctctgggcctgcaaacatcaagaaaatgggggcaggggggccgcaaggtgcttggtcccagagccatcgggtagcagggggccgttgtcagggctgcgcagggctgcaatcatgccgagcaccctgcatctcccccctcgatcccagctcaccgcggcggtctgctgcaggttggggaagtggtacaggatctcgccgtcctggccgactaccggcgagccgccgaagcgcgtgagcacggggagcacgtatgattcgtccactgcgatgctggtggtgttgcccacctggccctccagcatgggggccagctcctccgcggccacaacgcctccccggctctggatgtactggccaatctgtnnnnnnnnnnggcgatgctcgtggtattgcccacctggccctcgagcatgggggccagctcctccgcggccacgacgcccccccggctctggatgtactggccaatctgtggagtgagggtggaatgacagggttggcaggttgagggtactggcgagaggggtcaaatgccctaccgcgccagccccgtcaagaaggcaccggcagaggacccgatgaggaaccagtgctacgcaggtgcagccttctgagaacagtgaaaggtacatatggggtgcagactcataatcaacagccaccctgctcccccgacgcctttctttactacccggaacnnnnnnnnnngatgacaggggtggcaggttgagagtactggcgagagggtcaaatgccccaccgcaccagccctgtcaggatggcaccggctgaggacccgatgaggaaccagtgcgacgcaggtgcagctttctgagaacagtgaaaggtacatatggggtacagactcataatcaacagccaccctgcccccccgacgcctttctttactacccggaacnnnnnnnnnnacgagaagatggcctccaggaagttcatgccgccctgcccctttgcagccgaaggctggcgtgcgcgggagtaccgagggttccagtacctgccacgggtgagcaggtgaggggaggtgggaatcatcatacccagtcaatgtgccatggcagaggtgccggaaaaggggaagaatcccacccttccactacccactcaacctgattaaacaccctcaccagaggaggtcagtgatgttgaagtagaactgcggacctccannnnnnnnnnttgggcatcatcatatccagccaatgtgccatggcagaggcgccgggaaaaagaaagaatcccacccttccactccccactcatcctgattaaacaccctcaccagaggaggtcggtgatgttgaagtagaactgcggacctccacggtagtagccgccgttgccccgccgatcccggtcattgctctggttcccgctggaggcaatcaccgtgatagccagggccacggtgaccacgctggccagaagcgcggttccaaaggtcacgcgcgccaggtaggaggcggtgcccttgacggcggcggccgtgctttccagccggatgcgcagcgacttgttccggattctgtccctgaagttggggtcgaagctgtacagaatctcgccctcatcagacacctgtgaggtggaggaggaggaagaatgtgagtgggtaaagggggaggtgggaggcactgaggacaagagccagggagttcctatatggctggcattcctcccctgatgtgcatacgagcggtgtagcccaggcggcatgataaacatgggcccacttcctgtaggtgcatactcaggcacccctcgtggacccttccaaaccacaaaccttcagattggccagggagtcgctggctagggcccgcaaggcatcctcagcctccttcagactgatccctgccacagctgccacgtcgcccacagtgactgccccaccccgcttcaggatggccgtctccgccctctgtcgaacttcagatggcaggccctcactggcgatctcctctgatggcggcttgtagggtgtggccgcggcggtggctggagaccgccgaggcacgcgagaccgaggccccccgagggggtgtaggcccacgaaggcaggccggaatgaccgacaaggccgcagcatcccgggtccttgtgccagtgtactgggcatgtattggctgacaagggaggccgctgccttgtgcccgcctggcatcaccatgttccggcagacggagtggtcaagcggacgcgctcggcagaggagagacactcgagtgtgacttcacgaatagatggctactgcgtcacacaaagccttctcgcaggccctaatgctttgatgatgagctgtatatgatgtcgacaacgtcacatgcgttggccgctacgctggatgtgaggagtcgagatgattctgcaagggcaggaatgtttggtttgcgcgcctcccatttccttccctgtccctccccttccactcccctccagcatgaactgttgagggtcaagtcagcgcactctgcccgccacattactggannnnnnnnnnagtctgcctatcactgcttgggtctgggcctccatcttcagctcagggaccagtgcatgtcatgctggctcggcatgcaggccgcccatcctctgcacagcagattggaggcatcgagctcaccttggccgcagcatcaaatgcagcagtcacaagcatgattctgtaaagagacaggatgctctgataataccctccagctcagcactcaagacattcagcagcgcaccgtttgcaagctnnnnnnnnnngaatgcagcagtcacaagcatgattctgcaaagagataggatgctctgataatacccgccagctcagcactcgagacattcagcagcgcaccgtttgcaagctttgggaggaagctggccacagaaatttcctggccctgcagccggcagatctcaagccaggcgcccnnnnnnnnnntccccaccgccggcgcccttccctccacccccgctcggcgtcatctcggcgacatgcaccttcacctcggagtcgacctgttcctgtgtggtggtcatcagtgggtccttccaacccaatgtaggcatctttgagctcgaatggtcatacggtgggggcaaaatcgtgttcggctcaccctttggaccccagggatccctcaccaccgaaactgagacggtggagagtgctccacactatgtccgtcctagatacattggcaaagacggggtggtgcggttcctgcctggcttggaccccatctacacgaacgcgcccccaccaaccccactcgcctgatctggccccacctccttccccattgctttgccatccaggctaccttgccccttgtagacnnnnnnnnnncatgtccgtccccgatacattggcaaagacggggtggtgcagttcctgcctggcttggacctcatctacaccaacgcgcccccaccacccccgctcgcctgaattggccccacctccttcccctttgcttcgccatccaggctaccttgccccttgtagaccttcagcttgcccacagcgcatgctgcggtgcagcttgcaccctgcactcctcccttgcctcgatgcatgccattagcctgctgggattctgatgagccttgccgcaacccatgtgatactcgatgtgcaaggagcctaggcatgggcgcacgaaggggatacattagttggaaccgatcatgaattggcatctgggtgtactgcagctcgcgcgacttgtgtgctagcacgattcttctgttgctcaattcctgtgccaccgggcttggggtaggacaaaatgcagtcacgcnnnnnnnnnnaccacgaccctccccaccacgtgagctttctatcagtgcttgtcgtgtcctctggaagggcaagccagacggcggggtgtcaaacatgctggggcaccgtccctccaactgcggacagtggatcaccgatcaggtagagttcaagagccatggcttccccaccgaaagggagcaagaggagggcaggaaggtggctggtgtccagcacttgtgctgcgtgactgcattttgtcnnnnnnnnnnagacaccagcccccttcctgcccccttcctgcccccttcttgctctctttcggtggggaagccatggctctagaactccacctgatcggtgatccagtgtccgcagttggagggacggtgctccagcatgcttgacaccccgccgtctggcttgcccttccagaggacacgacaagcactgacagaaagctcacgtggtggggagggtcgtggcgggcgcctggcttgagatctgccggctgcannnnnnnnnntggtggcacaggaattgagcaacagaggaatcgtgctagcacacaagtcccgcgagccgcagtgcacccagatgccaattcataatcggttccaaccaatgtatcccctgcgtgggcccacgcctaggctccttgcacaccgagtatcacatgggttgcggcaaggctcatcaggatcccagcaggctaacggcatgcatcgaggcagcggaggagtgcggggtgcaagttgcactgcagcgtgcgccgtgggcacgctgaaggtctacaaggggcaaggtagcctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcaaagggtgagccgaacgcgttatggcccccaccgtatgaccattcgagctcaaatatgcctacattgggttggaaggacccactg

SEQ ID NO: 44387 - DNA, 72 bp, Chlorella protothecoides
cggttggctggccaggctcgccctgcgctccagccccaggctgctgcaggcggtgcgctggtcgccgcagcg

SEQ ID NO: 44388 - DNA, 2295 bp, Chlorella protothecoides
  modified_base (97)..(106): a, c, t, g, unknown or other
  modified_base (329)..(338): a, c, t, g, unknown or other
  modified_base (487)..(496): a, c, t, g, unknown or other
  modified_base (2212)..(2221): a, c, t, g, unknown or other
ggtcagccccggaggccgagcgcgacacgctgggggtccgccgcggcccgccggcccctgcgccgccccctggttcgccgccgtccccgccgcggcnnnnnnnnnncggggatccgccgcggccctccggcccccgcgccgacccctggttcgccgccgtccccgccgcggcgccagtcctccgccgtgcagcagggccggagggcgcgctccagctggaccagcagcccgcccagctgcgaaggaggggagggacggggagggacggggagggcgctggagtgagtgaggggggctccacatcaccctgtgcgcgacgccgcacgcgnnnnnnnnnngaggaggggagggacgaggagggcgctggagtgagtgaggggggcttcacatcaccctgtgcgcgacgccgcacgcgggagggcgtgcgaccacgccagcggggacagaatgtggtccgtgccgccacatgacagcaacctcatcccannnnnnnnnncgcggggacagaatgtggtcggtgccgccacatgacagcaacctcatcccaccaaaggcaaaccccgccgcaaaggctgccctcaagtcgcacctcctgcacgttggcggcgacgcggacggcggagccccaggcgatgcggtgcaccgcgccctcctccccctcccatggccccccggccagcgcccagaactcgcgctccatcttcagcaggcccgccagcagcacctccagcttggtggtctcgggtccctcccctgcctcgtcgcccttaaccagagggttcaggcaccctttcctcagcgaggggcgcaggcaggtgtagcacttgccgcagcgcacggtctggcggttggtcgcgcgcccctgcgacgcgagcgaaagcgttcgagggtgggtgggttgcaggatctgggtgggcccatgaggaccctgtggcggcggcacgtgccgggcggcggggacccagagaggtccaggccagggcagaatcctccagggcactccggccccagcttcggcactgggctggcccagggtgcatcgacaggtgaccctcgcagctcgatcctgggcgcccgccacaagcgtctcccccccgaagcaccgcatacacacgcacggggggagacccagccaggcgcctcagcagcctacctgcaggaacacccactggtgcttggagacggtgaggggcgcgatgggctcctggatggccacgtgcccgcaggtgcccgtcggcacccacagctgcccgcggcccttgcgccgccgcgcgtcctccatggcggcgcggatggcgccggccgctgcagcccagccgttgcggtacgtgttgttgtacgacgcgacgtctgggattgaatgcgtgtcggtttcgtggatgtgggcacgcgggcaaagggcagcggaaggaggggaggggagacgcgacacgccggccacatgtcgggcgaccgtgcagctggtctgacagtgtgcaccccctgcatctgacgcaggaccgtggggccagatgagccatgtcactgcacccctctccagaccccaatctcgctcggcccacctgccggctcggcatccttgccggcctccaccgcctcgaagctggagggctctgggatctcgtcggcgctccggatgcggtgcgcctgcttcagggcctcccgcgcggccgcgcctcggtacacatacacaggcggctctgcgggatgcgcattggaggtgggggatacaggatgtgttgggaccatcttcccttcgattctacgctttgcacaaagcagcggcgcaaagtgtgcaagtggccaggccgccacaaccccccacccctttgccacgacgcacctggctccggcagctctgccgtcgccgacccccggcccctcagcgtgggcatggcggcccggatcaccgagccctgggcgaggtagtagggctgcttccaggcattcctggcgcccggcgggagcctcacgcccgcagcctcgcctgcagttttggaggtgggaagagagggtcaagggtgcgcgaaaagggcctgccgcttgatgagcatgacgccaggaggcagtggaagagcatcacacatgtcggtccatccaaggtcgcgcccgcagggtccacggcccatccctacaagttccagccccgccatcatcccacgccccctcatgcgcctgtgtcctcccaaaggcaggtccagccaacacatcnnnnnnnnnnctcccagccccgccatcatcccacggcccctcatgcaactgtgccctcccaaaggcaggtccagccaacacatc

SEQ ID NO: 44389 - DNA, 61 bp, Chlorella protothecoides
gatcttgatgcccttgcagcaggcgcgcagggcgggctccatgctctcccccgaccggatg

SEQ ID NO: 44390 - DNA, 61 bp, Chlorella protothecoides
aggccggccttgcggccctggcggggcttggttcgctggcaggcgtcgcaggtgcgcacga

SEQ ID NO: 44391 - DNA, 61 bp, Chlorella protothecoides
gggcgtttgtcgctgattgccggcagcgccccacctcaacgtccgccgacgcacccctccc

SEQ ID NO: 44392 - DNA, 61 bp, Chlorella protothecoides
gtccaacggtgtaccctctggagaggcagggccaagagctgaggggcagtctctgcccccc

SEQ ID NO: 44393 - DNA, 61 bp, Chlorella protothecoides
atttcggattcaaaggctcgaatagcttggggatatgagctccacggtataccagcttggg

SEQ ID NO: 44394 - DNA, 61 bp, Chlorella protothecoides
atttctcaatggagggaaggggggggggagggatgctcatccaatcgcgggggctgggcac

SEQ ID NO: 44395 - DNA, 61 bp, Chlorella protothecoides
ggcccgaattctccttctcggacaggctgggcttggcggcgacccgcgctctcttcccctt

SEQ ID NO: 44396 - DNA, 18498 bp, Chlorella protothecoides
  modified_base (174)..(183): a, c, t, g, unknown or other
  modified_base (626)..(687): a, c, t, g, unknown or other
  modified_base (1238)..(1247): a, c, t, g, unknown or other
  modified_base (1957)..(1966): a, c, t, g, unknown or other
  modified_base (2048)..(2057): a, c, t, g, unknown or other
  modified_base (2806)..(2815): a, c, t, g, unknown or other
  modified_base (3973)..(3982): a, c, t, g, unknown or other
  modified_base (4067)..(4076): a, c, t, g, unknown or other
  modified_base (8065)..(8074): a, c, t, g, unknown or other
  modified_base (8451)..(8460): a, c, t, g, unknown or other
  modified_base (8533)..(8542): a, c, t, g, unknown or other
  modified_base (9773)..(9782): a, c, t, g, unknown or other
  modified_base (10328)..(10337): a, c, t, g, unknown or other
  modified_base (10425)..(10434): a, c, t, g, unknown or other
  modified_base (10792)..(10801): a, c, t, g, unknown or other
  modified_base (11588)..(11597): a, c, t, g, unknown or other
  modified_base (11797)..(11806): a, c, t, g, unknown or other
  modified_base (12413)..(12422): a, c, t, g, unknown or other
  modified_base (12599)..(12608): a, c, t, g, unknown or other
  modified_base (13306)..(13315): a, c, t, g, unknown or other
  modified_base (14241)..(14250): a, c, t, g, unknown or other
  modified_base (15286)..(15295): a, c, t, g, unknown or other
  modified_base (15953)..(15962): a, c, t, g, unknown or other
  modified_base (17425)..(17434): a, c, t, g, unknown or other
ggggaggcttggggatgggggggcttggggcgtcggtcgtggccctgcaaggggccctggaagggcggggcatggccagtatgctggcttaccgctccccgtattcgcttggaaagacctggacagttccaagagcgtgagcctgcgggaggctgcatcggctgcaatctcccnnnnnnnnnnggccctgggagggcggggcatggccagtatgctggccaaccgctccccgtattcgcttggaaagacgtggacagttccaagagcgtgagcatgcgggaggctgcatcggctgcaatctcccccatggcccccctgcagctgatccccgccgccagcccccatccactccctcgactgcttctcagccaaccaccccaatacctccctccccccctccctgctagattgacctgaagcccaggaacgcgggcgaggagctggtgtgcctggcccttacccccagctttgcggccgcggggcggcagaccgacgtggtgctgatggacacccgcacacggcgcggggccatgaccatcatcccctcccccgacgccaccgtggtgtgtggaggggtggatgctggccgcgaaagggacgcggggggggggggggggggggggggnnnnnnnnnnnnnnnnnnnnnnnnnnnnnnnnnnnnnnnnnnnnnnnnnnnnnnnnnnnnnntgagggcgatgggaatgcggcgagaccgtggcgggaccacgtcgtagatctgggtgtacgcccatggtccctcccctcgatggtctcctgacgggtatcgcccaggtcgaccgacgcgcggcgcgacacgcctcaccccaggccccgatcccctgcccaccacctctcaccgccagggtgtgcgctccgtgtcggtccaggacgacctggtgtcctttggcaccggcgcgggcaagctctgcttctttgacgtgcgggcggggaagctgctggaccgcgccgcgcggcgcgaggcggcggtgggccagtaccacacccccgcgctgcttgcccccctcccctttgccctggagacggggcccgggtggctggaccagaaccagacctactggtgggtgggcgtgtggcgtgggcgcaggactcccccggggcaaggcgtggagggggcgagggcgggagtggagggggggtggggcgagacggggccgtgagaggatgatggaatgagcatgccgccgggcatgctcttcatcggaggggaggtggagcgnnnnnnnnnntgcaggacgcccccggggcaaggcgtggatggggggagggcaggagtggagggcgggggagggcaggagtggaggggggttggggcgagacggggccgtgagagggtgatggaatgagcatgccgccggccatgctcttcatcggaggggaggtggagcgaggacatggcatgttaccacgccggccattccactttcgtccacctcagcgtcagacaggcagcagggccccccgctgacccacccttggcccatcccccccgtccaacatggctcacaaggctcgcaccatgtgcagggaccactttgccaacacgcgggtgcagcacgcctgctacgcccacgcctgggacccggccgcccagcgcgtgtttgcctgcggcgggcccctggcctttggcatgcggggctgctacatgggcctgtggcggtgagggcgccggcgaacgtccgcgcacggccgtagagcaagggagggcccaggtgccttggctgcgcgggcggtgggccagcctcgtcagctgctgccgggcaacgcagtgctggtgaaaggcgcgccgtgcgcaggaacccttcccgccgcaagcgcgccccccctcctcctcgtgggaccctggggcgggtcccagaccacacccgcaccgccatccctggtctggaagtgcgtcatggaggcccaccataccttcctcgctttcactcactgcttnnnnnnnnnntttcactgctaaactgggcaagcataacagtacagggcaacagcgggccgtaggggcacgctctgtgacgtctggaggtcgnnnnnnnnnncgacaacacccgcaccgccatccctggtccagaagtgcgtcatggaggccccccataccttcctcgctttcactcactgcttccattcgtcgactttcatcccccccctcccctttgtactcctctcttcctgtaaacttctgtcctgccaaagcagcgtcgggcacctcatggcaaggggttacaaggcggagttcactgtgggaggaagggggggtttcactgctgaactgggcaagcatggcagtacagggcaacagcgggccacaggggcacgctctgtgacgtctggaggtcgagtcaggggtaatggtggtgcagcaggggccgacaaggtcctaggggtggtttgatcgggccggcgatgcctggacctgcgggactccccggcgcccctgtcagcacacctccacagcggggaaggagaagcgggactgggcgtcgatggcgaagcgggcgatgccctccggcaggcccacgtacaggctctggcctgagggcgagaaggccaggcccgagatctccgggtcgtggccggggccggaccccaggtgcagcacctggtgccggccccacatgcgcatgtccaccaggtgggttcggccccggtgctcggtgaaggccatgaggtccaggggcgccggcgcaaacttgacgttgcggcatgcctgcgagcgtgtttagatcgaggtgcaggtggtggtggggaggggtgtgcgcactgcagggatgcgggacagcctcacgannnnnnnnnnacatgcctgcgagcgtgtttggattgaggtgcatgtggtggtggggaggggtgtgtgcactgcagggatgcgggacagcctcacgaaaggcatgtgacgggacggcaggggcggggcctttggtgtttcttcactgcacagcatcccctagacacatgtgcatgtgagacctcttctcaaagcaggcgacgctcggccggttcaacccggcatgcactcaccaggggcgtcatgtagcgaacgacgacgccctgcgacctgtggtcccatacgcagcacagtccgtcctgtgaggacaagggaagacagggataggggacatttgggggccgataatggtctttactcaagacaagggtctgcattgtatgagggtggaccccctccccctcagagtgaactcataccgacaaacggaggttaaagtgaagcagggcaggcctggcaaactccacaccttgaatctccacaaacatgtagaaaagtcagacccccatggacccacctggctgacagcggcaaacagggaccccgagggcgaccaggcgcagcccatgcccgcgtccccggcctccacccagctcttggcctgccagtagcccgaggggcgggcggcgtagaggtaggtcccgcggttgtcgcccaccgccagcaggtgccgcgcgcaggggctgagcgcgcagtagttgatcgaggtggggcaatccacggaggccagcaggcggccgtggggcaggccgaagatcttgatgctctcgtcgttgttggccacgaacagccgcacctggccgctggcgtcccgcgcaaagtgcagcgcgttgttcaccgaaccgccgcagtcgcccttgtacgcaatctcgccgctgcccagcgcccgcacgtccagctggctggtctggccccccgccgcgatgtagccgtaccgcaccgccagggaggtgggctcgaagtgcaggtcctgcaccagcaccctctggggtgtttgatgggaagaaaagaaggatgggggggggtgtgagaaattattctggagtggggcagtgtgtccactgcacagccagaggcgctgagcctgggctgcagatgtcaagagatgcagtgggatctgagcgatgcctaagaaccctactatcccccccccccccccccccccccccnnnnnnnnnnttttcgtcaggggtacacttgagcgtgtagtgcctgttggtgcagtacagctcatgctcacgctcggggcagtgcagcaggtccnnnnnnnnnngtcaggggtgcacttgagcgtatagtgcctgttggtgcagtacagctcgtgctcacgctcggggcagtgcagcaggtcccgcagctgccaatgctggatggtagacgggaacgctggagggggaggggggacggggggttcaggggcacatgcgaggcctcccaaggttgacattcacgcgatgtacttccccatgcaacacgcattacatccataaaattcatacacacgcagcagggtacagcgcatgcgccctccggtcacccagccgcgaaggtcctcacctatggtgcggtccggggtgcacagctcccccgcgggggccatgtcccgagtaatcgtcatgcgcgaccgccctcctccccactcgagggtatggtggtatctcaattgaagcgggtgccttcgagacgcaggggcgtggcctatgccgggccttccttcccctcgggttcccctgccctcggaccagggcgacaggttcacctccgcgtcgggaacaaatcccctccaagacaaaaacccatcagcgcttggtgcaaactcgaccatcggggagggtttcaggctgctcgagacgacatcggggggaccgcctctccgagaaaacatcatgggtgttgacatggcagcagatcctgacacgatcatcgctgtgaagggctccttgattcccttgaagagagtggcaagtcctccctcaccggcatttgttctatcaagatttacacaccgtatgatgtttagtccagattcggaaggaaaacacctagctgggggccaaacactggaggcagggacagaccagtctagtgcgatcggtaccccttcttcgctgtcttcctggtggccttgagcgcgaggggcgccgcctgtcctgttccctcggccttgggacccccaccggcggccttcctgggtggtgcaagctggtcctccctcacccgctccaccaccccgtgccggaactccactggctggatgtccacacccagccgcttgccaaagcgctggaccacgtaggattggcctccagacacgagagacaccaccacgcccgagcgcccggctctgtgagggatgattggggggggagagggtatgggtcagacatgggagggtgttgctggggaggtgggctacttgatggctgggacacaaggacatgagcttgtgaagcattaggctcctggatcctcaaaaccaaaccaagaccaaaagcacagcaggccccctggtcaccgcctctggtcccagaactcctctctcggctaccctcctttcaaaatctgaacccccaaatttcaccagcgcctcaccgcgcggtgcgccccgcgcggtgcgcgtagtggctggcgtcggtgggcagctccaggttgaagaccgcgtcgcagtccgggatgtccaggccgcgcgccgcgacatcggacaccagcagcgcgcggaagcgccccgcggtgaaggcggccagcgtggcctggcgctcctgcttgctcagctcgccgtgcagcgaggcggcgggcatgccgcgcgcctccagcttgccctgcacgtcgcgcagccggtcctggaagttcatgaagaccagcgcgcgctgcgcgtccagcgcgtggatgccgcggcgcagcgtgtcggccgcgtggtgcggcgcggtgcccgccacgaggtgcaccagccccggcggcagcgcgggtgcgggcgcgcccaggcccgtgcccacgccgcccgcgctgctgcccgggctggcggccgcagcgcgccgcccccagccccagccgggcgccggggaggctgtggcctcgcggtgcccgacgtctgaggatgattcgccgatcacgtcatcctccggcacctgggtccggccttggcccgtgagcaggggcaccgggtcgcggcaccaggtggccgccagggccaggttggtggggttgagcgtcgccgacaccagcaccgtctgccgcccagcggccaggccccggcccacgtggtccgccaggcggcccacgtcctggctgaactggggggccagcagctggtcggcctcgtccagcaccaggatgcccgtgctgcgtggggtcggaaagggtgagcaggaattgcagatgagggggggggggtggagcggatgggactttaaaggatagtgggaggctacagggacatgtttgaatcttgatgtcctgggccagcaccattgcacaccacacatggtgtcgtgcattcaatggctgcagtgcagcgcccttgcttggagacaactggaacaggaactcctggctcatccatttgttaagcttgctttcaaccatttgacaccccctccctttacgcgccaccccctttcccccccaaaggggccttactgatgtgtctggagggcgcccgcgcgcgagagctccgccaggcggcccggcgtgcccaccacgagccagggacggtgctccttcagcgcctcctgctgccgccacgtgctggcgccgcctaagaggaaagcagagtgcgaaggggcggagcgggaggggatgcttttacgaaaacatgcggtctgccaggcgcgaaatctactggagcttactcataccaagccccacccaaccctcaaccccgtcccacctatgcactgctgcacccggcgccgctggtcggggtcaaagaaggactgtgcgacgcgcacgatctgcatggcgagctcgtgcgagggcgcgaccacgatggcagcggggccgtcggtagccttgcttccccgcgcccgggagccaggcgcccgtgaaccctcggcctgccgccgcgagatcagggtcaagatggggagcaggtaggccagagtcttcccgctcccagtgtagctctggatggccgcattgcgaccggagaggaggacggggatggccgaggtctgcacttcgctgggctcagagatgcggcaagcctccagccccggctgtgaagtggcgcaagcgagaaagggcggtcaggggggttcccagagcgtgacatcctagatgtgttgcagatgcaaatggaatgcgacgcatcccctggggttggaggagcaggggctgtggccgtatgacagccatggagcagcgatgttccactgaaacagtcaagtaccacctgaagtcccaagcccactccacacagaaagcgagtattgcccaccaggaatgaaggttcgatcccgagggcggtgaaagggttggcaggacgctcaggctgccctgcagaggtgggtttggatccaccgtccagtgccctggtggcaagagcccgggcccggggtgggatccgcgcctcatagctatgggctcgggggaggggcttctggaaactgagatttctcaggtacctgcctccatgcggggctgagaatgggacggaaaggcaacgcactttcgccaggagttggtgaggggacgccatgcccgtcacgactgagtggaaaaggacgctcaaatggaacaacttgtcatgctaatgaccttgtatatgtataaatatacttcctggcgaactgcatcggaatgatgttctattggaggacttttcagcagttatatcttcagggtccgaccatcgcgcgcgcaggggcaaggttgcatggccaaacctgcagatcacttgaagtaactcgagaaggtacagcgtgcaccgcctccaatgtttttggacgatcatcatggccgcacccatgtctcaacgcgtatcaagtcagggttgttccagtgagattcaccgtggtcgttcgaccttcgctcaagctggcactgtcaatgcacacaggtcttacatagttgatagacatcgcaatacccaatgctctgccaaaatacaaagaaaagaagtggcattgtacgactactgggaccggatcgttccatatgagcaggtacgtttgtagggggtgctagtgccgattccgtgctttgggagttgcatggccctgtcattgcccaatcccggccccactcagcccccctttgcacgcnnnnnnnnnnggtaccgatcccgtgctttgagagttgcatggccctgtcattgccaaacccccggccccactcagcccccctttgcacgctcatcaggcctggagtctccagcatcggctcctagaggaagtacaggcaggcatgcacggcgtgggtgcggtcatcctacttcagcatagtccagtctacaccctaggcgccggatccacgatagaccacctgaggtttgacccttccaaccctcctcatcccctcttccgaaccgaaaggggcggtgaggtgcgctgacattgggtcgtgtttcatggtttgcgcttgtgctgtggatttgctgtgactgtctggtttgcgaggcatgggtgaaccttgagaggcgcaaaggcttnnnnnnnnnngtgccctgtaaagcggcaaaatgtattgcattgctgaccaccctcgttgtgcagagtcttgcacatcgtcagnnnnnnnnnngaccgagaggggtggtgaggtgcgctgacattgggtcgtgtgtcatggtttgtgcttgtgctgtgggtttgctgtgactgtctggtttgcgaggtatgggtgaaccttgagaggcgcaaaggcttgtgtgatcaccccagtctccaacgctggtcacttctccttacggcccaggtgacataccacggccccggtcagctcgtcatgtaccccatcctggacctgaagcagctgacccaggatctgcactggtacctgcgcagcctggaggaggtagccatcaggtgggttgcaggaagaaccacatgtgcgatgccctataaagtggcaaaatttattgcattgctgaccacactcgttgtgcagagtcttgcacatcgtcagtaccgaggagaaccccacgttcggccccataccagggccctggaggcggtctctggcatagagggcaagcgggagcctggacgcacaggggtctgggtggatggccggaagctggcagccataggtgtgcgagcgcggcgctgggtgacgtgccatggactcgccctcaatgtggcgccggaccttgggcccttcagctccatcgttccctgtggcatcgctggccgggaggtgggatcggtatgggaagccagccgagaggcggaggacgaccgccaggacagcagcatccaagcacagcaggcccagctgctgcgagagtatgctgtggcccttctggaggcagcagaagatgtttttgtgatgcgactcgtgccgggagaggagcccttgaaggcccttaatgcccctgtttggttggaggaatgccggatgggaaaactctgactaatcaaatcagtgtcggaggcgagatcgggccgcgcagcggctttgctctgcacaggccgcgtctaggtagtgtttggcatgccattcccgtatccgaaaagggtctacgcctctcgcacatctgatcgaagttaggccaggatattgatcgaggtctacttcccactcaggtgatcttgatggcgggtctgctgcggcagtgtctccgacacaccccaaaggccctgcctcgatccctggccctgggatactggcataagcacgtacttcatgtgccgagccaagctgcatgtgctggcgcaggtcggagtctgtcgggtcctggccgccttgacaagggtgttgtcagggggcacagcatcatgtcctcccaaccggcggtcgatgaaggctgggnnnnnnnnnnatctgtcgggtcctggccggcttgacaaaggtgttgtcagggggcacagcatcatgccctcccaaccggcggtcgatgaaggctgggatgccctactgggatccttctccaaccttctcggagaggttgatgaggccggtgtggtgaccctgaccctcaatcggcccaagcagctgaatgccctgaactcagaggtgaccttgaggtggtgaaggtgggatggtggtctactactcagtcgtgtccaggctacccagccagcccatttacatgtgagcaaggctacctacagttcccatttctccatgccacaatcttgcagctcatgggagagcttgtcgcggcctgccagtacctggatcgcaagcacccctccgcacgcgtcatcattgtgactgggtcaggctccaaggcgttcgccgctggcgccgacatcaaggagatgtccagcgtcacatacagcgaggtagggcggaattgatggctgaaagagcaaatagtgggctgggatcaaacatttaagcaatctgtgcatcgtcacccctnnnnnnnnnnggcccatttacatgtgagcaaagctacctacaattcccatttctccctgccacgatattgcagctcatgggagagcttgtcgcggccnnnnnnnnnnggttgatggctgaaagagcaaattgtgggctgggatcaatcatttaagcaatctgtgcatcgtcacccctagcaattcttccccggtgtgaccctactttcccccgctgcccaccccaacccctccatcccaggcgtacaacaagggcctgctggacggctgggagaccttgcgcaccatccgcaagcccatcattgccgcagtgaacggctttgccctgggcggcggttgcgagctggccatgctggccgacatcatcattgccgcagactcagcatcttttggccaggtgggtgtcggcgtggcccgcctgctttgacccatcgcgggccagattttacctcccctccccgctgcnnnnnnnnnnatgtcggcgtggtccgcctgctttgacccatcatgggccagattttacctcccctccccgctgcgcgctgctcacgtctcccccctccccctgttgcccgctgccgcagccggagatcaacctcggggtcctgccgggaatggggggcacccagcgtttgacccgggccgtgggcaagagccgggccatggagctcgtgttgaccggggaccggctgagtgcggcagaggcggtctccctggggctggccagccgggccgtgcctgccgcggagctaatggaaaccacgcagaagctggcgaggcgcatcgcagcggccagcctgcctgtggccgcaaaggccaaggagtgtgtgaaccaggcgtacgaaatgacgctcgcaggtaattaggtgggactgggaaaggcatgaggatgtcttgattgagcaatgccttattctgtgaggcttggcttttgcctttacttgattggttaaagtgataaccaccccttcgccgccagattcgaccctcaccatcatgccaccccgacgcagagggcgtaagatttgagaagcgggaattctggagctgctttgccttggcagaccagaaggagggcatggcggcgttcatcgagaagcgcaccccggtctttggcgactcttgaatgcgacccggacctcattggaaggacatctagagtggtcctgagcccagtttgacggcccatgctgtgctggcaaagccgcatcgaatgaactaactttgacaccctgcacagcttttcaccatggctgtaaagnnnnnnnnnnatttgacggcccacgctgtgctggcaaagcagcatcgaatgaactcactttgaaatcctgcacagcttttcaccatggctgtaaagcaaaccgctgtttcaccattcagattcactcactgcgtctcctttaaaaacttcagcagaaattcgttccaatggacccccccgtgactctggtgttcatctgaactgatgatnnnnnnnnnnattcagcagaaactccttccaatggaccccccggtgactctggtgttcatctgaactgatgatgtctccatccagggctcacagatgccgccggcagatctgtgaatatacaagtacaatgagcctgttccaaggtgtcgaaatccccaaagggaaaggacatacacatcacttggccagccgcccctggctcatcctcccccccacgacgttgttgaccggcatcttggcagcgcgcttaggcgccgcggccgccgcagccgctgcgtcgggcgtgtaccgcagtggctcgatgacgacgcccgcgtccttgaccacggcggggcgcgtgagatcgcggaaggaggcgtcggtgttgtactccttgcccaggggttggcggcgcgcgcgctcgtaggtctccttggagtcgtagggaaagggcagcgtggcggtgcggtacttggccgccgccttgtcccagcgctcggagaggatgacgtactgcatcttggcgtccttgcgcgcggccgccgccgcggcgcgctgcctgcaattcaggggttgaaggttggggttagggactgctcgatgagggagagtgcagtccagggctcagctcccgcannnnnnnnnnctcaggggttgaaggttggggttggggagtgctcgatgagagagagtgcagtccagggctcagctcccgcaggcccctcccttgcccttgcatctcgaagcctggaccagggacaggcacacactcaggtcgcagacccagagcacacactcccacccacccagacgcccactcacnnnnnnnnnntttgtatcttgaagcctggaccagggacaggcacacgcttaggtcgcagacccagagcaaacactcccacccacccagacgcccactcactgttctgccttgcgccgggcggcagccatccacgcgggctcgcgctgggcccccgcccagttgccccagccgggcagggtcccgactccttccactttaggcagctcggcctccacctccgaggccttttccgcggcaaactccgccgccacgtcatcgttggcaaaggccatgcggatgaggtcgtcctgggtgtaggcggccgcgctctgcaatccacataggaagcgggtgaggaaggggtgggcgagcgggtccagcaacgccaggtgctcccctccgacaacccacctgacactccagccctccccgcgctacgcacctcagcaggcttcaagctgtcatcccccagctctgcttcttgcgccgccctccctgcatcgccgctcctcgctttcttcgtgggcccagtctgctgcccctgctgccgcttctgctgcacctggccctttgctttgggtgccggcacctctcctgctgcgtcgatgtagtagcccacgccctgcgggcccttcttgaaggtgtaccccttcctggcgccggcaaaggaccccgacggcaggaaagtctcggccgtcgcagacgtgctgggggcaaagaggtcgtcnnnnnnnnnnagcaaaagaccccgacggcaggaaagtcttggccgccgcagacgtgctgggggcaaagaggtcgtcgcgctccaccgcggggcgcgtggatgcccggccggcgcccgcggccacggccacaaaccccgcggaggagtgttgcctgggctgtgccgacccagcggcgggcgggtcgccgccgccgccccctgcccgtccctggaccgtcgccggctcccgcacatccgcggcctccgccgcagcctgggccactccctcctcgcgtcgctcggcgctgaggtggcgggccaggcgcgccgccttggcctccacgtcctcatcctcgtcagactccaggtcgctgtcctccccggcggcgatcgctgccaccgggcgcacggaagccgccgccgcgccgccgtcgccgctgaactgcaggcggccggaggtgcgcgcccggccctcggccttgcgtccctcctcctccgccagcacgcgctcggcggcctgtaacgcggcggcgcgctgcttctcccgcgcccgcttcatgaagggcagggccagcaggccgcccgcctcggcgcccgcctcgtccccgccgccctccaggatgtccagcgccgtacggtgcagcttggaccgccgtgccggccgaccctccccgccttcctcctcgctgtcctcctcctcgtcgctggcagaggtggagacatcgctgccgtcggcgccgccgcggtcggggcgctccaccttgcgccgcagctcctggcccagctggagctgttcggccagcgccgcgcgcgtcgcgtcgtcggtcaggttggcgccgcgcttgagcgcgcgccgcgcccagcgcgaggtgttccgatgcttcagcgtcagccgctcctgcgggtgagggatcagaggggggggattaccgactgtgcatttatgagaggatgggnnnnnnnnnngtgcttcagcgtcagccgctcctgtgggtgagggatcggagagggggggttaccgactgtgcatttatgagaggatggggaagctttgggagggtatgcacgacatagtgctcaaacatgacggggccattctcggctcacaaccatgatcaagcgtaggatgaaaggtagaggagggcatgcaacgagcacagcagcgcaatgcaggacagtgcaccactcaagacacttgcgcgtgggtcatcacccgttctcacacattctcatgcgccttcgcatgcacacaccacccttgccactgccaccaagcccgccaccgaccttggcacgggcaaattcggcctcctcggcagcgaccagcgcctcggcggcgtcgccgccctcctccgcccccaacttgtcggccttgcgccggtcggcgcgtttcatctggcgccggtactccttgctcttgatcttcttcagccgtttggccttggcctcgtggtagtacagcagcgcccgggtcttggccagccggttctggcgctccctcagctcctcgatggtcagctcctgtggggtggctcggtaggaatgtatggatcagtcagggggccaggcatcttgccaggaccgcatcccagccgccccacgccaccataatctggtacaacaaccgccgcgcccctcacccgcgccgccagcgcctgctccgactcggccagcgcgcggtccgagtgggcgccggcgcgcgccagcatcgccgccacctcggcctccataccggtctcgggcgcgtgcttgtccaccagcccggcaacggtggtggtggtgtgcactgcggccttgtccgacgtgaagtggatggtgggggccgcggcgttggccttcaccagcgggcgccacttgctgacgtccttgctggccgcctcatacctgggagcgggtaaggttggggggggcatcagaccgcggcggataggtttcccttggggcctgggcctcaaactgctgtcagcaaggcttcaactcacaccaggagccaacttctccnnnnnnnnnngggttggagggcgcatcagaccgcagcggataggtttcccttggggcctgtgcctcaaactgctgtcagcaagccttcaactcacaccaggagccaacttctcctctcctcctcctgagaccgatttcaccccagctgctcattctagggccagcatggaccctgtccagcctactgatacttcttcctactcccacttgtccctcaccccgccttgcgctccagacgctgccggatgagacccggcagcggcggcgccacggccgactccttggcctccatgcgcagcagggtcttgcgggccttgcccagcttggtctgggcgttgcctaggccctgtagcaggtcgctgacagagagatcacctacataaatgaatggaggggggccatgggtggaggccgtgagtgtcccattgcatcgcaggggtagcgatgtaaggcagttgggcggggtccgacaatgctgtttgggttatgtggaaaggaaggcatgcacatcaagccttcctcgcatgcccaaagaaacatccaatgcagacagcagcgcatggagagatggctgtgaatggcacgttgccctgtatcctaaattacccccagcgcacactcctgtcctgtcacacaatcacctgcattgggcatgttgtgctcggccnnnnnnnnnnaagagagggccgcgaatggcacgttgccctgtatcctaaatcatccccagcgcacactcctgtcctgtcacacagtcacctgcattgggcatgttgtgctcggcctccgggtaggcctcagtcacgacggcgcggcgctccttcctccctttcttgccgggggcgccctcggtgactgctgccaggagggcggcgtgggcggtgtcatcctcctcatcctcttgcccgctcccagacccactgccgcgggcagtgccagcttctacgtcgtcatcagactccttgccctcctcctgaaaaggggatggagagcactggggtaatgatttacacgaccccagtcactccttctggaaattgccattgcaggcaccaagggcttcgtggggtgtaccttgatacacaaagataccaacactgaatcacgagacccagggatgtacacattaccaagagcaatccccacacgtaacaaattcctccagttccagtccatgacaagccctcaccaactccacccacctcggaggaagacgcatcaaacacatcgtcgagctcgtgcccgctctgagcatcctcttcgtcgctgtcaagattgatgtcggcgtcagagccatcggcatctgagccctcgtcagtcgtctccccctcctccccctcctcgccactgggaccatcctcgaacatgtgcccatacagtgcgttatcctcggctgcaggagggtgggcgaggatggcgtgtcatgcggcatgctgccaaagggccagtgcccaaacgcctctctctactccctcaaccatgggcagaggcgggcatgaagcatgcatacccacctgtaaaagctgtgtcctcgtcaatctcctcatcctcaaagtcggatggcatttcgtactcatacttatccacgcgctgcacatcaagaggaggggaacccgacgttggagggtgccaccagagtggccaagcagagcagcaaaactactgtgaccatctctggccctcacgtaggtattccctcacatcgtatttgttcttgagcctctcctcttcaggctcgctatcctcagcctcgaagacgtcattctcaacctccctttcacggttggacttgggcggggcgcgaggcccacgccaattcccagcctttgccatcctcaacgagccgtggtgccggactgcatgcacagtttgagaggtaatggatgcagagctacgccagggggaccgactcccaggtcattgtgccgaacatatggtagcatgcgggatggtgctccggggtgttgcgcgcactctgctttctggcgggaaacaatactgcccgaaactctctccgcgacagctctgctggctggcaatgtcccctctcatgtgctccagaattccacggcatgaggcaacggcgaagatcgacgctttgatctgtaccgtcccgtgggaataggagtatcccgcctcttcnnnnnnnnnnggaggcaacggcgaagattgacgctgtgatctttaccgccccgtgggaataggagtatcccgcctcttctcgcagcagcgtcgtacttttcaaagtgaccatggctgtcagcggagtcggtgcttgacgggacgttttgccactcgttcgaccgccagcatggcatctcacacctcgcctctcacggtgagtggattattttgattacacttgctaccgctcatcgtgcactgtcctccgcgcccaaactagggaccgagcatctacgccggcccctctccacatacactccccaggcgctggtcgtgccagagccctcggatgcgggcacaccgggcttcggctggtcctccccctccccctcccaatcttccggcgggaatcacatcgagtccagggcccagagggccgccagcaagcggagggccgccagcgagtggatcgggatggcactgggcgtcagcgtcccacacgagaccgaccaggccttccgccgcgcactggccgacggcgtcaccctgtgccgcctggtcaactggctgcgcccggggtccattcccaaggtacctcagggctgctgttggtgttgtggctgggtgaggggatgatggtgggtcctgcagcctggtcctgcccatgcagacgccagcaccgggatgcggatcctatgtctgtcataaagggctctattttgggtatacatccttatcttggtgccaacccccttcaccacccccatctccccaacacacaccctcccaaggtcgtggaggccacgcccgacggctccggcaccccctcacatgccaccggggatgtgatccagaccttcgagaacgtgaccaacttcatccgcgtcgcgcgcgacctgacgggggagaccttcagcgcgcgtgacttggaggagggcggggaggagcgccccggcgtggccggctgcatcctgggactgcgggacctggccgcggggcgcacgccccccggaccccggtcctcccccggcccctggagcacgccgggggggcagggcctgccacccctgccctcccccgcctcgggcgccc

SEQ ID NO: 44397 - DNA, 61 bp, Chlorella protothecoides
cgccaccgtgcccaggtacttgagcgccgcgtcctccagctcggcggggtcgaagtcgccg

SEQ ID NO: 44398 - DNA, 61 bp, Chlorella protothecoides
ctccaggggggcccaggcttccatagtaccgccagacatgcacagaaggtgatactatcat

SEQ ID NO: 44399 - DNA, 61 bp, Chlorella protothecoides
gctcgtttaccgtacgcagaggcttggagggaacctaggccggcagtctcgaccaatcgcg

SEQ ID NO: 44400 - DNA, 61 bp, Chlorella protothecoides
gcttgggactgcctttgctgagctggctggggtcggggccgggggcggcctggtctgggct

SEQ ID NO: 44401 - DNA, 61 bp, Chlorella protothecoides
cggcggagaaggaggtggagggcttgggggggatggggccggcagactaggtggggaaggg

SEQ ID NO: 44402 - DNA, 61 bp, Chlorella protothecoides
caggggaggggagggttagggggaggggggcgtattggtgcacaaacatccacattgcatt

SEQ ID NO: 44403 - DNA, 61 bp, Chlorella protothecoides
tcctggccaggaagggtctggcttggagggggcctccaggtaaacacgggacactcccctc

SEQ ID NO: 44404 - DNA, 61 bp, Chlorella protothecoides
gagggatgatgtgcagccgtgcatctgctcccgctttgatgccttgagcgggtgaatgtga

SEQ ID NO: 44405 - DNA, 61 bp, Chlorella protothecoides
taccacctgcacctgcacgtcatcggcgggggccagctggcgtggcctcctgggtaggctc

SEQ ID NO: 44406 - DNA, 61 bp, Chlorella protothecoides
ccctcgccggcctcctccggcccggcctccatgcaggcttcggcgacgggcacatcgtccg

SEQ ID NO: 44407 - DNA, 61 bp, Chlorella protothecoides
gcaacatggtaggctgggaggctgtcgagggggtatttgacggtgtgatgttttgctctcc

SEQ ID NO: 44408 - DNA, 12242 bp, Chlorella protothecoides
  modified_base (176)..(185): a, c, t, g, unknown or other
  modified_base (413)..(422): a, c, t, g, unknown or other
  modified_base (976)..(985): a, c, t, g, unknown or other
  modified_base (1377)..(1386): a, c, t, g, unknown or other
  modified_base (4475)..(4484): a, c, t, g, unknown or other
  modified_base (4800)..(4809): a, c, t, g, unknown or other
  modified_base (5428)..(5437): a, c, t, g, unknown or other
  modified_base (5607)..(5616): a, c, t, g, unknown or other
  modified_base (5914)..(5923): a, c, t, g, unknown or other
  modified_base (6157)..(6166): a, c, t, g, unknown or other
  modified_base (6350)..(6359): a, c, t, g, unknown or other
  modified_base (7067)..(7076): a, c, t, g, unknown or other
  modified_base (8172)..(8181): a, c, t, g, unknown or other
  modified_base (8301)..(8384): a, c, t, g, unknown or other
  modified_base (8604)..(8613): a, c, t, g, unknown or other
  modified_base (8896)..(8905): a, c, t, g, unknown or other
  modified_base (9642)..(9651): a, c, t, g, unknown or other
  modified_base (10143)..(10152): a, c, t, g, unknown or other
  modified_base (11270)..(11279): a, c, t, g, unknown or other
  modified_base (11654)..(11663): a, c, t, g, unknown or other
ggcggaccacagctcctcgcacagcacgcacagcgtggcgctgcgcccgcgcagcaggcgctgctgcgtcagcgcggcgcggccggcccaccacgcccagctggcgtgggcgcggccggccgccggcgaggccgagccagggggccctaccaggcagtaccgcgccaggaggaggnnnnnnnnnntggtgaggccgagccgggggggcctaccaggcagtaccgcgccaggaggaggtactgagggcccaccacgacgccctccacgtcctcgccgtcctcggacagctgggagatggcccacctgttggtgtgcgggaggtggaggggggaagtcttgacggctgatgcaggatcatgatgaggcgggggcagtgggaggatgttgacctctccaaggaggaccgatgcggnnnnnnnnnntgccctccacatcctcgccgtcctcggacagctgggagacggcccacctgttggtgtgcgggagggggaggggggaagtcttgacggatgatgtaggatcatgatgaggcgatggcagtgggagggtgttgacctctccaaggaggaccgatgcgggctatcaggagcatgccctgcaagatctcaatgtagagccagagatattgtggtgggagtgcctatgctcaggacgagcggacgctgtgccaaatacaatggccacaccatttaacgaagcagatcccgggtgcaaagccgatcctgtggccctcctccgacccaccacccctacctatctccatgagggtggttttctgtcttctgtctgtcctcatggacatcaatctcggtctgggctgagctgctggcagggctgcagctgctgccgcctggtaggcaggggccggtcacgttctgcctcacgaattcgcagagggctgcggcgcccatcaccagcaccgagtcgtccccgatactaccaagagccggtcccagggctgcaaaccagtcaggcnnnnnnnnnnttggcagggctgcagctgctgccgcctggtgggcaggggccggtcacgttctgccttacgaattcgcagagggctgcggcgcccattaccagcaccgagtcatccccaatactaccaagggccggtcccagggctgcaaaccagtcaggcacgctctccgcagtggccagagcctctgtgggggccaggtcgagcaccgaggccacagcagctgcgaactgcccctgcctgaagctgactacctcaggccggacagatacctcgggtacctcttcatcgtatggaacagtgagctccagaagctgtagttccaggtctgaaatcgcggtgccggaagtaaactgcggcatggcgcgagcacgcccagtgggctcgaggacgggtgggccaannnnnnnnnncgtgccgggggtaaactgcggcatggcgcgagcaagcccagtgggctcgaggacgggtgggccaatcaacgggtgttcattgtgtgaaatgtccctttgtttctggactgaacgctgaagcctcacatttggcagttgtatgctgatgtaagtgccgcatgcatgacccgactttccgcgcgcgcgaacaacattcgtcaggattgtgtcccggatcccacttcccagcacactgtgactcggatctcaggacccatgccacttctacatggtatgcataatgcaattctcaatttatatgccagcatccccagatgccggtgatgcctaggaaacaggccgacatcctgggtgggcgggtgtagcacctagagcagacggaggacgatgacaatcgctgaaggaaatctatgtatgttcaagatgctaatctcagccctgtagcagtcgagcgtgcgggggagtcctgttcaattcgctccgacactttgtaggtgatcagtctgaatgcttaggtgatcgaactgccggaacggcagtgtgggtctcttgcgatgtcggggaggcgtgccatcatcatcactacgtgtctgcatagctggttgaacattacttgcctcagaccgcggcggtccgcgatctcctgctcggcagcgcttctcgaaaaagtgtcggacccaccgctaccgtcgctgccctcgtctggcttggcgtccataccatggcgaaccccctcacccgcctgccgaccgtttttgtggcacatggcagccccatggctgccctggagaccggccagagcagccaggtctgggcgcgactcggcaaggagcttccccggccacgggccatcctctgcatctccgcacactgggagacccagggcacgcgcgtgacctccatggcccaccccccgaccatccacgacttccggggcttccccccggccctgtacgacatgcagtaccccgccccgggggatcccgccctggccagggagattgctcgggaaacaggtgcccagctggacgacggctggggcctggaccacggctgctggacgctgctacaccacatgtacccagaggccggcatccccgtcctccagctgagcctggacaccgctaagaccgcggcggagcacctggccatgggccggcgcctgcgcccgctgcgcgaccggggggtcctggtgctcggatccggcaacgtggtgcacaacctgaggcagggactgggcgcacacccgcccccagcctgggccacggctgtcaactcccaggtgcggagctgggtgagggaggggcgggagggggagctggtgcgctggcgggagaaagggccggacttccggctggccatcaactccggcgagcacttcctgccgctgctgtatgtcctgggggcggcccaggagggcgagcaggtggaggtcttcaacgaccgcctcgagatgggcagcatagccatgacctcctacaagtttggctgacatgagcattgatttgcgaccatggcgtaggcccgtgtcgggcacaagctgctggcatgtgctgtctattccctctgtgaaatgcatgtatgtttgctgcgccgtattgcgccgtattccttccagaacccaaggccgagcccagtgagacaaggagggttgcagcgggcaacactgtactgcggcgttgccattcgcaccaggcttctcaggttacaataagaggtttcgaaaggagaagagggatgttcttgccagaggcctgggtggccgagcaggcgatggacatactccgaggtcactactcgtgacaatggaccatgtccctcatgcagtggtactgaaggcagcttgcaagttcaagggggggaacttgttgagtcaaccgggctcaaccaaagcaccagccatggcggtgcatcctgaaagtacttggggacattgcaacgatcaaagggcagccactgcattgtgcatcagcagaatggggccaatgacgagtggaggctggtttaatgcatggatgccagggtggaaatgcacaatgtcatacagcagtcattacaatgcatggtggaaggcagtgattggattcctggacagtcatctgagtgggagcaggaatggtattcccatgggcgacctgattcaagtggccgtcccccattgcagccccagccctgcattcacttgcgacgaccatggccagagtggtgccctcctatgccttcgaacccgggatcgatgcccttggaggagccagaagcatgagagggtggtgcctggtcgctcccgcttgcgagtgattcgtggatgctctccttgcccaggagggatccctctcccagaacgacggacccgggctctgtgtcagattgaaagaggcgccctccgatcatggcctccgtgctgccgtcagagcggtgagagtggactccagtggatgcggcgccctgcagtggtgtcgagggagatggcgcggtgacggccagtggctttcgacaagctctattcgtgagggtacggagcagtcaagacgtgctccgatattcagcaccacgataccatcatgttttcaactactcctggaaaggcatgcgtaaagaggcggtgatccaaggccccacattcaccacaaagacgcacctgtgaactcattacgacaccggttgacaggtcgacagtggggttgcgaccgtgtaagagtacgtaaattattcgcttgggcaatatataaatgaaactgaggatttatatagtttttgtggtgcagtgcaacggtgacgtgacataattgtttcaagaaggtagagtacatacaaatctgcatggctacgcaacgtcgatggcgggagctatggagaatccagtgtgatgattgtgatggttgggcaaaacatcgtcggggacaggtgtagggttgatttgtggaaatgtaaaatatcagaagtatgattgtgttatctaaattcaacaattataattgatcaacccacactatgtgattaataccttcactgtttacacatcacccatgcatacaatggtgaaacattggggaggagtttactcatccaaacacagattggggaaacannnnnnnnnngacgttacataattgtttcaagaaggtagagtacaaacaaatctgcatggctacgcaacgttgatggcgggagccatgaaaaatccagtgtgatgattgtgatggtcgggcaaaatatcgtcggtgacaggtgtagggttgattagaggaaatgtaatatatcagaagtgtgattatattatctaaatttagtaattataattgattaaccaaccctatgtgtctagtatgtgcactgtttacacatcacccatgcatacaaatggtgcaacattggggagtagattactcatccaaacacagattggggaaacannnnnnnnnnaagacccagacacaatatgttcagtacttggtggaggtgtggtggccagtgccggtggtatgtgtctcggaagtcttgccatcgaaaacacgctcagctccctcaataacgcgctcgcgcgtgccgaggtgctcggtggagcgctggtcaaccaggtcacgctcattgccggtggcgcgggtctccaccacaaactccttctccacggggcggtgctcacggatttgctccacacgctccttcaccagagaacggtcctcggtgttggtgtagtagtcctggccaaggacctgctccttgccctgcctggcagcagactcgatgtgggtcttggtgtcaccagaggtgtgactgtggccatggccagagtggtggctggtaacaccctcggtgccgtaggcgcccgcagtaccgccggtggagccataggtctcggtggtcttggagtagttggtgtcgctgccagtgagaccggtggttccggtggttccagcagtgccggtggttccgtaaccggcgccagtgccagcgagcccggtggtgttgccagtggtgccgtggccggtggtacccttctcggtgtaggtgccggtgccggtgccggtggtggagtcctggnnnnnnnnnnactgccggtgagaccagtggttccagtggttccggtggttccagcagtgccggtggtgccgtaaccggcgccagtgccggcgagcccggtggtgttgccggtggtgccgtagccggtggtacccttctcggtgtaggtaccggtgccggtgccggtggtggagtcctggnnnnnnnnnnatgcgtcctgcacgtgtaatgatataggaagatgagtttaagtacgcgtgagggaagttactgtccaagccgcgggcgatcgactcgcggcgatcgacaccctccgagatacgtttcggcattggcatcggaagctgctcgccaaagccgatcgaggcaccgcgcaagccctccgtctactaaaacagtgatctaacaacgctaacacggcaatgcccgacccctcgccctcaaacgcggaaccgagcggggctccgacataccttaatgttggcgccgacattcttgatcttatcgnnnnnnnnnngtgcgtcctgcacgtgcaatggtataggaagatgagttcaactacacgtgacgggagttactgaccaagccgcgggcgatcgactcgtggcgatcgacaccctccgagatatgtttcggcactggcatcggaagctgctcgctaaagcccgatcgaggcaccgcgcaagccctccgtctaccaacacagagatctaacaacggtaacacggcaatgcccgacccctcgccctcnnnnnnnnnnacggggttccgacataccttgatgttggcgccgacattcttgatcttatcgccgataggcatgatgaagaggtttggggagtgtgatccggggttgggagagaggagttaatgtggaaatggggcaggagttgatgtagatgtgtgagatgtggtcaaaatatacgggttcatgtactttggannnnnnnnnncgagttgatgaggaaatgggcaggacttgatgtagatgtgtgagatgttgtcaaaatatacgggttcatgtactttggagcgcgtggaactgacatttcccctgaagcttgcttgcagctaccgaatctttgctggcaggtacacagccggttccatgccgttgccggtgtgcgatgctcccgggccacgggacgcccagcctttcccctcgtgacctagacacttacctggcaggcatctacatcctcgaatcaccaccttgaatgttccgatgggcttccacgggctctggggctccattcttcatcgccggatcgacatgcgatatccgatcggcgtcaaaacgtgttgatccgatccggaaatttgggtatccggccctgtatcttttcggaacgcagctgctccctggttgatgatcacgcatggtaccaaacatatccctatccatgccaaaccctttattgttgtactgtgctgtctgagataggttgcaggaagctatttcagggtgtgggtgcatcatgaatcaatattgagggtgccaacgctcaacacacttggcagctcaagggtggtggcggcaatgagggtgagaaatgatgtgtcacataccagacgaaatatattagtgagacttccgagtggtttcagttccagcggcaacaggagccaaatcgctggtggtggtgaaggctgacttcacnnnnnnnnnnatcacataccaggcgatatatcttagtgagacttccgagtggtttcagttccggcgccgacaggagccacatcgctggtggtggtgaaggctgacttcacaatatgttcctcctcccccagatgctccgcataccgcttctccacagcctcccgctccctgccagtcgtacgcgtttcagtctgtattgagagtatgggagtcaaccgttacgaacagggttccatgcacaggttggcaagcttggtaggaacaagctggataccactgactctgcacagcacaatccaacaacctcccattcagattgccagaagattgaacaacacaatgcatgctatataaactgctcaccaggatctccttctccacgggccggtgctcaacataggtgtatgtcacctcacggatcacaggacggtcctccacctggatgggataggaaggatgctcattcaaggataacatcctatcaacgttgcaccatgttcgagagcaaactagtaatagcttaaatgcaattaaccatgcacacttccacgagataccattcaaccgctctccacctgggtagagtagagctggtcctcgacctttccctcagattcctgagagagttccgtcgtttgtgagggggctgtcaccgtctctttcctccccacactcttttccgcagaggtagtcccagcggtggtggtggtcctggtggtggcggtggtgcctgctgttttcgcagagggcacgtctgcgacgacattgctcgcggcagctggctccgtccgaatcgccttcttgccgaccacgccatcgggctggagcacgcccagcccggcgcctcccgccgtcccatagctcgccccgacattctggtaagtggcgttgctcgcgtctcccagaggacgcccctccttgtccttggggttgaaacagttgctgaagaatgtcttgatgcccattttcgaagcaaagtctacggcctacggtaccagacacacgctgtcactctatactgcttgtgaggcaccaaaatggtctgaatatatccaatgtaggccggagacgcaactggtgggcctgcatcaaattcgcgaatgtannnnnnnnnncccaatgttggccagagacgtaattggtgggcctgcatcaaattcgcgaatgtaagtgtggaacctccgaggcattgacatcgaaggtgcctcagctggtgacttccatgcaacaagcannnnnnnnnnnnnnnnnnnnnnnnnnnnnnnnnnnnnnnnnnnnnnnnnnnnnnnnnnnnnnnnnnnnnnnnnnnnnnnnnnnnctcaggggagccatgcttcggagatggggggagaggcacagcgggagtcgcgctggcctacaccccggcgacgaatatgcatctcgcgagcagtggagcagggaaagcgaggcgttgcatactccagaagccgaggtaatatacaatgtgcagacaatgcagcgtcgtgctcttgagaatgactcattctggccaaagtgtgatggtctgtggcggctgnnnnnnnnnnaatgcatctcgcgagcagtaaagcagggaaagcgaggcgttgcatgctccagaagccgaggtaatatataatgtgcagacaatgcagcgttgtgctcttgagaatgactcattatggccaaagtgtgatggtctgtggcggctgatcactcggataggcggtatctgctccaggggaccaccgtttgcaaacttcataacgtgaagaaggccacggtcctgagatataacgcgatgatatgttaccaacaagatcacgcctgccaaaattgtcgcaaccaacnnnnnnnnnnatgaagcaggctagggtcctaagatacaacgcgatgatatgttcccaacaatatcacgcctgccaaaattgtcgcaaccaacacaaacggtgcttgcgccagccggacgggcactgcttgaggcagcactcttgatggtctggaccaaagggaacatgacgcttcaccactccattggttatgtcgatttacaatgccccataagattggaaataatgttctctaagcaaggtcacgcaactgtctagatagataactcttcgtccaccagttggcctttcggcggtgcccgcgccttgacaatgctcccgccacgctgagagaatccctcgatgggggttctgaccaaccccttccatgcgtccagcagcctggatcgcactccgatacgtgtcaggaccagtagagatcgagtatgcgcttgcggcatccttcctgatcactcaaaggctctgcccacgggacctctctaccccttcctgctaatacgacggagcacgtaacgccatggcgaagcagcggaagctgcagggcgagatggaggccgcgctcaaaaagatcgcggagggtgtggacgagtgggaggacttgtggaacaagtacgaacgatcccacgacatggtgagtgctgaggtgacgctgtgcggtggggtcgagtcccgcgggcgtacccgagtagtctcacaatgcatcgatgtccatctgtcaggacgccgcgcagcgggagcggttggtcnnnnnnnnnnttctcacaatgcaccgatgtccatctgacaggacgccgcgcagcgggagcggttggtcgccgagatgaagcgcgatctgaagaagctccaggtagtacacgcgatacatgggaagggtgtgcagacctgcgagctgcacaaccaagcatctgaccacctgaagcacaccatcgccaatgcatgtgcgagctgctgggcactcacacctgctctgccccgctctcctctcaacagcggctgcgagaagctgtccgtggctggctagccaacaacgaggtccgggtggccaaggatacgctggagaaggcgcggagaagcatcgagatccagatggtgggtcctgagagcctttggaggggcctggggtgcaagatttgccggggtctcgttctccgctcgagcttttggcggcgcagcaggggagtggtatacgcagcatgcgagtgtgtgccagttgccggtcggcactgatgcaatcagcagcctttgggnnnnnnnnnnctctccgcacgagcttttagcgccgcagtaggggagtggtgtgcagcatgcgagtgtgtgccagttgccgctcggcactgatgcaatcagcagcctttgggaaactctgaacgcaagacattgcttcacatctgccgtccctcccccctctcccgccaatcatttacaggagcgcttccgggtggtggaaaaggatgtcaagggcaaggcccatatggggctcggccgggacgccctagaccctgcggcaggtgactggagggttgcctggggagtgtgttacgtgcctgcaaggctgggcagggcttggtgcggcagccctgggccaggcctcaggtgccctcctccttgcccccccttctttacacagctgccaagcagcagtgcgccgactggctcacagacgtcatggaccgtctgcagaccgaggtgggtgggggtttctgagcttgcctggtccagattggtccccagtcggccggccccgcgtcgcatgctctgtggcgcaactgccggtgtgcctgtcctccctgtgtcagattgaggcatgcgaggcggatgtagagaacctgggccccgccggcaacaaggccaagaagacacggtgagtggatgaagtgagaaaggccgggaggagcccggggggggggggggggcccgggccgtcgccccgcttcctgccggctgcgcctgccgcctgctcgaccgctggagggcacaccccgaccggtccctcccttcccgaacgaaaatgactcggcaggctggccgagctgcagggcctcatcgcgcggcaccagcagcatgtgacgcacctggagcagacgctgcgcctgctgcgcaacgaccaggtggaggcggaggaggtggaggacgcgctgaaggaggggctggaggcctacctggacacgggcggcgaggcgttcgaccccggggaggacgagggcctgtacgcctctctgcccctggaggaggtgggttgtgagaggagggagagggggaggggtggtggggatgcaggggggtgacctgccttgggtagtggtgagtggagcaggcttgccccccggggcaggcgctcaaactgtgctgtgtgaggagtcgggggcagactgcgnnnnnnnnnngggtgggtggagcaggctggcctccccgggcaggcgctcaaactatgctgtgtgaggagtcgggggcagactgcgtgtcggtgcagatgcatggcccttctcatggcattcttgttgcaggccgggcatcagctgcaggcccagaccaccccaaacccacctccccccaggtggacgccaatgtggggaagctggccgacccggtgacgcccaaggtcgcgcccgtcgccctgcccgaggtgtgttgcccggaggcctgtggttgggagcagccctgcggatggaggcgtgcagggacgagggactggctcgggccctgggagctgccgccgcgggctcgcagtgcgcacgctgcgtgcgctgcgtgcgctgcgnnnnnnnnnntgagggactggctcgggctctgggagctgcccccgcgggctcgcagtgcgcacgcagcgcacgctgcgtgcgctgcgtgcgctgcgtgccaggcaagggtgtgtgagcgccgccgtggtcccctccatcgtgcaggagcctgcgaagaaggcgaagccgggcaagccgacgcccatcaagaccaagcccgtcaaaggttggctggtgtgaggatggctggcacggcggtcgttgcatgatgctgcggcgcctggaaccaagcaggcaaccccatggaaccggtgctggctcctcggccctgctgcacacccgactctggccgtgcctgtgggagaccctcatgccacctgcccccgagcagcctgccacacctgtttggggggcgccccccacccccccccaacccccctcacacaccggctccctgtgctccctggctcgccccgcagaggcgcccaagatcgtgcccgtgcccatcgccgcagcgccgcctcgcaccagccccctggtgacggccgcccaggtggtcgccgccggccccggcgcggccgcggtggccgccaaggcgcagcccgcggg

SEQ ID NO: 44409 - DNA, 93 bp, Chlorella protothecoides
ggaccccgggctggcggccgacctggcgcccgctcgcgccgagctggcgaaggcggccacccaggccgcaaggcgtgcgctgtgctgcggcca

SEQ ID NO: 44410 - DNA, 61 bp, Chlorella protothecoides
cactgcagagcaaaagtaatggctgcttggggtggggcacgaagatcgaggagactgccac

SEQ ID NO: 44411 - DNA, 61 bp, Chlorella protothecoides
ttgcccgctcaaggggagttgtaggcaggggggagacctggcgatcattccaacatggccc

SEQ ID NO: 44412 - DNA, 73 bp, Chlorella protothecoides
agcgcgccggccaggcgcgccgccatgccgaggccggggtccgccctttccacagccgcgtgaagagcggcgc

SEQ ID NO: 44413 - DNA, 61 bp, Chlorella protothecoides
ttcctcgtatcggatctcaaactggccacgcgcggaatctgccctctgaaacccctgattt

SEQ ID NO: 44414 - DNA, 405 bp, Chlorella protothecoides
  modified_base (138)..(276): a, c, t, g, unknown or other
ggcctcgggcacgggcgcggacccggcgctgctggaggccctggcctcgcgcgtcgtggtcggcccgcgcctggagcagtacgagcggctgggcctgcgcgcggcggtgctgggcgcggcggagcgcgcggtgcgcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtcaccggccaggccctggtgctcaaggactacgcggaggagccggacgcggaggtggtgcgccgcgccgcggcgctggcggtgcgcggcctggccagcgcgctggcgctggtcacggcgcgcgagccg

SEQ ID NO: 44415 - DNA, 61 bp, Chlorella protothecoides
gggagttgcgggtgacagaggctgcaaggggtgctggcataggacactaggcgatgtattg

SEQ ID NO: 44416 - DNA, 62 bp, Chlorella protothecoides
ttcagtatcgtagctaacgcattaagtttcccgcctggggagtatgctcgcaagagtgaaac

SEQ ID NO: 44417 - DNA, 61 bp, Chlorella protothecoides
tcacctcaaagacaaggaggttatcggctggagcgagcgattcagacctgacaagatgtgt

SEQ ID NO: 44418 - DNA, 61 bp, Chlorella protothecoides
tggtttggaatttgaattccgggcgcaaggggcagttgacgtggcattcgcctcacgccat

SEQ ID NO: 44419 - DNA, 488 bp, Chlorella protothecoides
  modified_base (157)..(316): a, c, t, g, unknown or other
  modified_base (381)..(390): a, c, t, g, unknown or other
catcaccctggaccaggcccaatgctggcgagcggatggcgactgggtctcctgccaggcccaggtctcctccagcagcctcctggccctcatcctcctcacctacgaggtcgggggccactcggtgaccgaggcctacccgcccgaaggcctcatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttcctgtcggcaaaaatccccgtccaggctgtccccggcccacccccgccgcccctgcccccannnnnnnnnnattcctgtcggcaacaatccccgtccaggccgtccccggcccacccccgccgcccctgccctcaccgcccccctcacccgacatgccacccccagccc

SEQ ID NO: 44420 - DNA, 771 bp, Chlorella protothecoides
  modified_base (114)..(123): a, c, t, g, unknown or other
  modified_base (331)..(340): a, c, t, g, unknown or other
  modified_base (433)..(442): a, c, t, g, unknown or other
gggggtgctgccgccctgcgtcagcctgccggacctcaccagtctggagtatgtcaaggtgggatgcgcattggattggctttggggggcaggggggggggggggggggggggnnnnnnnnnncccgatggcgacggcccggacgccgtggccgcctacgcgcgcgtggaggagctgtgccgcgccgtggccaacgagctgcgcgccgacgacgacgtgagggacgcgggggtgctgccgccctgcgtcagcctgccagatctcaccagcctggagtatgtcaaggtgggatgagccttggattggcttttgggggggggggggggggggnnnnnnnnnngagggcgaccgcctgccgcacatcctatgccacttgctgtccttcccaatgttccttcctcaccctccccggcccctccccctcgctcagggnnnnnnnnnncagggcgaccgcctgccgcacatcctacgccacttgctgtccttcccgatgttcctgcttcacccctccccggcccctccccctcgctcagggcatcatctcgcacgtgaagcgggtgctggcgcggtatccgccgcccgcgcccaccgaggcggcggtgcgcctggtggaggcagtgggcaagctgcaggactttgtgtaccggcacggctaccgcgaggcatgcgcgcgcctgaactcgcgcgacatcttcggccggttcgtgcaggagtggatcggcgcgagcggcgccgcgctgcgcgcgctgtgccgctccttggagcccgccg

SEQ ID NO: 44421 - DNA, 97 bp, Chlorella protothecoides
ggcggtgagcagcagggcgcggcgcaggcgtgcagcctcgtcgggcccgctgccgccgcgcttctcgcccggcaggagcagccgagcccgcgccgcg

SEQ ID NO: 44422 - DNA, 61 bp, Chlorella protothecoides
tgaatatcagttattttaactggggataagggactgagtggctgaaagtcccggtcttgaa

SEQ ID NO: 44423 - DNA, 61 bp, Chlorella protothecoides
ttcccatgcagcggttctgccggctcgggggccaggcaccccagaacaccacggagcacac

SEQ ID NO: 44424 - DNA, 538 bp, Chlorella protothecoides
  modified_base (185)..(276): a, c, t, g, unknown or other
  modified_base (365)..(375): a, c, t, g, unknown or other
gaggcgacgtgggagcgcgcgcggccgtcgccgccgccggcgtccacgctcgcctcgcgcccgcggccaggcgctgcgtcggccccgccatgggaggggcctaccactgctcgtgcatgggcggggcccacctccgacacatcccctcccaggagatcgtcggggcgggtgcccagcacgctcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggatcgggggcgactcgcggggcgcggggtcgagcacagccccgcccagtcgtcccgcgccttccgcaaacacggcccgcgccagccnnnnnnnnnnngctgcgccgccggcccaccgccggcctccacgtcgctcccgctgccgtcttgcgcggcccccggcgccgagctccatgtgccctcggcctcctgaggccgcggcggggccctgcccgtcgaggttcggggccaggcggccctgcccgcggcctctcccggccc

SEQ ID NO: 44425 - DNA, 65 bp, Chlorella protothecoides
aggctgggaacgcccactgttctcagatttggggggggggggttggataccatcttttcattctc

SEQ ID NO: 44426 - DNA, 64 bp, Chlorella protothecoides
ctgtggaggcgcaggcccgacgccatggacccccccccccacgcacgacccacagctgatgggc

SEQ ID NO: 44427 - DNA, 61 bp, Chlorella protothecoides
catcaatcagtacattgacacgagtggcggggaggaggaggcaccctctgttgagggcacc

SEQ ID NO: 44428 - DNA, 61 bp, Chlorella protothecoides
ccgcgatggccgtacagggatatggcaggggacttcccagcccacctctcctcagatctca

SEQ ID NO: 44429 - DNA, 62 bp, Chlorella protothecoides
gggggggatggtgagggttgtgtctggtgggtgggggggatggtgagggttgtgtctggtgg

SEQ ID NO: 44430 - DNA, 670 bp, Chlorella protothecoides
  modified_base (112)..(161): a, c, t, g, unknown or other
cgccgcggcgcgccgccgcgaacgcctcggcgatgccggcctcgccggcggccgacacgcccgcgcgccaccactgggcgggcgccttgtggaaggggggcacccccccccnnnnnnnnnnnnnnnnnnnnnnnnnnnnnnnnnnnnnnnnnnnnnnnnnngtcaccgcccccaggttgagctgcaccaggcccttgacccagccgaacagcgcggtgaccaggtagtagaacacctgggcgtcggtggccatgatgaccagcgccggcagcgcgcgcgcgatgcacagcaccaggtcgccgtccaggcggccgtccgaggagaggggcagccagccgcggttccacagccccaggatggaggtgtccagggtgcggaagaccgcgtaccagtcgaacgcgcccttcatgcccagcaccagggcccagaacacgacgttgctcagccaggtgccccagctcacctggggccagaggagggggggtggaggggagggatggacgtgggggtctggggcgaagaggcacggctggagtcacggtgggtggacgcgactccggggccaggggctcgcgattccgatttcgtgcagcctcggacatgcttcccgccgggccctctacccctggccggacccctcatcccacccaccctcccccagccacctttc

SEQ ID NO: 44431 - DNA, 61 bp, Chlorella protothecoides
ccggggcaggggcatctgagtgagtggctcccctcttccttgcaactccctccatgtcccg

SEQ ID NO: 44432 - DNA, 71 bp, Chlorella protothecoides
cctcctttccctgcgtaacgcacacctggcaccaacctcccccccccccttcctccaatgtatcaacacat

SEQ ID NO: 44433 - DNA, 70 bp, Chlorella protothecoides
agtggggggggacctgagcgccccgcctggacgctggtccccgggaggtgggagggcgggccccgccgca

SEQ ID NO: 44434 - DNA, 61 bp, Chlorella protothecoides
gagcaggaattgcagatgagggggggggggggtggagcggatgggactttaaaggatagtg

SEQ ID NO: 44435 - DNA, 61 bp, Chlorella protothecoides
ggcgcgcggcgtggaggtggagatccgcgggcgcatctggccgttggactttttggttgtt

SEQ ID NO: 44436 - DNA, 61 bp, Chlorella protothecoides
gcatcctcgtcctgtccgccagctgcgacgtggccgcgcgcccggcggcgctggcctacct

SEQ ID NO: 44437 - DNA, 154 bp, Chlorella protothecoides
cacccaccgcgtcggaggcctcgccgtccgactccccgaagcgccgcctgggcttgcgcacccggcgtgaggggcgtgccgcggcggcgggggcctcgccaaccgaggccgaggcactgcgcgccggggcccctgcagagcggtagggtgggtg

SEQ ID NO: 44438 - DNA, 61 bp, Chlorella protothecoides
ccgcttttgactctgcagtagccagggagggggccgcgcccactcttaccaactacacgtg

SEQ ID NO: 44439 - DNA, 61 bp, Chlorella protothecoides
tcaaagcaggtatggtgatggccggggggggggggaggccggggccaggtggtcggcggcg

SEQ ID NO: 44440 - DNA, 61 bp, Chlorella protothecoides
gcgcccagcgcgtgccctcgtcgcacagcatgcgcagcgtggccacgtggccccccagcgc

SEQ ID NO: 44441 - DNA, 71 bp, Chlorella protothecoides
atttttaaatatttaaaaattctcaataaatagtataatcaattttattttattatacaatttttacataa

SEQ ID NO: 44442 - DNA, 423 bp, Chlorella protothecoides
  modified_base (114)..(292): a, c, t, g, unknown or other
ccggtgctgcggcggcctgcgcggcgcacgcggggtccgcccccgccacgccccccgcggcgcacgtgtccgggtcggacgcggtgggagcgcgcgtggcgctgctgtggcgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgcgcgagagcttccgcgtgctcacgccgcgcggagccagcgcggcggccccggggtccaagcactgggcggcgctggcggcgctgggcgccgagggcaggccccggcccggcgccggctccagcaggggc

SEQ ID NO: 44443 - DNA, 61 bp, Chlorella protothecoides
ccactggtcccagtgtgctgacagtggctggttgaaatgtactcggagcacctgcttgcag

SEQ ID NO: 44444 - DNA, 61 bp, Chlorella protothecoides
aacagttcgtcacggggacttcccacgtgggcacccaccgcagtactattcccgcccaatc

SEQ ID NO: 44445 - DNA, 61 bp, Chlorella protothecoides
tgtctgctagagtctgcacgttgcaggcggggggacgccagtgtgtggggatggggcgcat

SEQ ID NO: 44446 - DNA, 80 bp, Chlorella protothecoides
gcagggtcccagactcggcaccctcccgcgcccccccctcctcctccgatctccgccagctccggggcgtgggtcgcacc

SEQ ID NO: 44447 - DNA, 61 bp, Chlorella protothecoides
tgtgagtgggacgggtgagtggtggagggggggggcagtagtttcctttatgacacaatct

SEQ ID NO: 44448 - DNA, 61 bp, Chlorella protothecoides
caacagcctgcaatctaataacggataggggatcttcaccaattgttcctcggaggacaaa

SEQ ID NO: 44449 - DNA, 61 bp, Chlorella protothecoides
atgtcatcggactggctgtggcagaggaggggggcaacgcgtgctgcgctgccgccctggc

SEQ ID NO: 44450 - DNA, 61 bp, Chlorella protothecoides
atcggcaaccccttccccctcaccggcagggagaaggcgccgccggggcccagcgcatttg

SEQ ID NO: 44451 - DNA, 61 bp, Chlorella protothecoides
ggaggccgccaccaccgtcctgcgcgtggatcagatcatcatggccaagacggcgggtggg

SEQ ID NO: 44452 - DNA, 61 bp, Chlorella protothecoides
ctcctgcgtaacgagctggtgagcggcggggctgtgctgcgcgccgcgcctgatcggactc

SEQ ID NO: 44453 - DNA, 61 bp, Chlorella protothecoides
ggtagtatcacctcaaaaagagggaaagagagaaatgtgaaaggagcatgaactaggggca

SEQ ID NO: 44454 - DNA, 61 bp, Chlorella protothecoides
gaagtggtgctccttggtgttatggctcccccacaccaggcactcgggatatgcctcgttg

SEQ ID NO: 44455 - DNA, 61 bp, Chlorella protothecoides
gactttttatgtataccctgaatatttaaacccatttctttattttttacgcgatcatatg

SEQ ID NO: 44456 - DNA, 61 bp, Chlorella protothecoides
ggtgggcggccccgccaccgagggggggggggtgctgcgcgcgctccggctgctgaacagc

SEQ ID NO: 44457 - DNA, 61 bp, Chlorella protothecoides
ctcctcagccgacgagcagccgacggcagggctccaccatggacaacaaatgagcactaca

SEQ ID NO: 44458 - DNA, 66 bp, Chlorella protothecoides
cgctgtgaagggcgccaggagagggcggggtaggggcgctgtgaagggcgccaggagagggcgggg

SEQ ID NO: 44459 - DNA, 2098 bp, Chlorella protothecoides
  modified_base (792)..(801): a, c, t, g, unknown or other
  modified_base (1496)..(1505): a, c, t, g, unknown or other
  modified_base (1835)..(1933): a, c, t, g, unknown or other
gtacggcggcggcagccgcccccgtggcaattgggagctccgcggcgacgtggagaaggacccctttgcggaggcggaggccaccaacaaggatgctgacgagctgtttgccggcgagaacactggcatcaactttgacgcgtacgaggacatccccgtggaggccacggggtccaacgtgccggagcccatctccaccttccaggacatcgacatgggcaaggagctgatggagaacgtgcgtcggtgcaagtacaccaagcccacccccgtccagcgctactccatccccatcggcatggcggggcgcgacctgatggcctgcgcacagaccggctccggcaagaccgccgccttctgcttccccatcatcgcacacgctctgcatggcgggttccagcccggcgcccgcgggcgcaaggccttccccctggccctggtgctgtcccccacccgcgagctgtcctcccagatctacgacgaggcgcgcaagttctgctaccagaccggggtgcgccccgtggtcgtctacggcggcgcgccgcaggtccagcagctgcgcgagctggaacgtggctgcgacttcctggtggccacccccggccgcctaattgacattatggaccgcggtcgtgtgtccctcgccaaggtgggtgggtgtgggtgtgcttgctctgagaacggtttcctggtggtatgtgtgtgtgtgtgtgaggggtgtgcatgctggaggctgggtgaaggaggtgtgagacttgtcgctgccgcctggagtctccttcatcgcccaannnnnnnnnngcggtttcctgggggtatgtgtgtgtgtgtgcgtgtgtgaggggtgtgcatgctggagcctgggtgaaggaggtgtgagacttgtccctgccgcctggagtctccttcatcgcccaacctcaaaagacgcgataaacttatcgagcactcacacacagatacaaacacgcacaccaacatcaccagccccccccccccacgggcgcagatccggtacctggccctggatgaggcggaccgcatgctggatatgggattcgagccccagatccggcgcattgtgcagggtgaggacatgccccctgtgggccgtcgccagaccctgctcttctccgccaccttccccaaggagattcagcgtctggccgccgacttcctgcacgactacgttttcctggcggtgggccgcgtcggctcctccaccgagctcatcgtgcagcacatcgagtttgtccccgggcacgagaagcgccagatggtgctggacctggtgcagtcgctggcggagggcctgaccctggtgtttgtggagaccaagaagggcgctgacgcgctggaggacttcctggtgcgcaacggcatccccgccacctccatccacggcgaccgtagtcaggcggagcgcgaggccgcgctgcgcagcttccgctccggccgcacgcccgtgctggtggccaccgacgtcgcggcgcgcnnnnnnnnnnccacgtcacccatgtcatcaacttcgacctccccgctgacgtagacgactacgtgcaccgcatcgggcgcacagggcgcgctgggaagaaggggctggccaccgccttcttctctgacaaggacgcgggcatggcggggaagctggtggagctgctgcaggagaccaatcaggaggtccccggctggctccagaacaccgccgcgcgcgcgggcagctacggcgggggcggcggcaaggggcgccgcggcggctcgcgcttcggaggccgcgacttccgccaggaccgcggatgtgagtgtcttgtgtgtgtgggggggggggggggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgcgaggttccgagtcgctgaggagcggtatcgcagggggcccggtggcttgggccacgagtcacgagaggcagactgacgttttatgggccaaagcagtgccggggagtgggagtgcgatcggctctcaagcctcgccgatgcgtgttatctcatcatggcgct

SEQ ID NO: 44460 - DNA, 61 bp, Chlorella protothecoides
ggcggcgggcgccctgtcgcagctggcgggccccggctgccgcgacctggtcctgtgtgtg

SEQ ID NO: 44461 - DNA, 61 bp, Chlorella protothecoides
ggagagtcctgagggctgggtgagggagaggcctcggggctgggtgagggagagtcctcgg

SEQ ID NO: 44462 - DNA, 71 bp, Chlorella protothecoides
cagggcggcacgggcaaggccagcatgcccgggctggccattgtggcgcctggcgcagcgccacagtcctc

SEQ ID NO: 44463 - DNA, 61 bp, Chlorella protothecoides
gctgagaactcattgaggactggcggggtgggtcttgctcgcagacatgtcattgaaccag

SEQ ID NO: 44464 - DNA, 402 bp, Chlorella protothecoides
  modified_base (119)..(220): a, c, t, g, unknown or other
gcgtccacgtacgactgcagcgcccagagcgtggcgcgatccagcgagtcgatgtccagctcatactcctcatcgtcggcgagggcggggcggctgggcccctccgcgatgatgcccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacgcgctccaggcgctcgcccggaagcgtgcccagcgcgtgcgacaggcgccgcttctcctcgaaggacatgtcgcggtgggggccgggcgcaggcgcggggccggggccgccgtcgggcgcacgccctgcgccctccgccttgcgcgccagcgccgccagctcctcgctggccgcgcgcag

SEQ ID NO: 44465 - DNA, 61 bp, Chlorella protothecoides
ggaccccaggtccttgtcctcgcgcgcgtccgggcccgccgccgtggccacagccgccgcc

SEQ ID NO: 44466 - DNA, 61 bp, Chlorella protothecoides
cctctgagcctcaaaaacaggagtggcaggggcgttgagaccactgcgtggggcatggaga

SEQ ID NO: 44467 - DNA, 169 bp, Chlorella protothecoides
ctgcgccgcgcccgccaccgcccccgccgcggcgtcgtgcaggaagagcgcggcggcgacacggcgccaggcgtagagcgcgcaggtgcggcgctcgaccagcgcgcggcctgcggcgacgcagacgccgccggccacgcccgcggccaggccctcctggatctccgcg

SEQ ID NO: 44468 - DNA, 61 bp, Chlorella protothecoides
atatgccctcaggcagccacatggacaccccacacccctgattccccagatccgtcgacaa

SEQ ID NO: 44469 - DNA, 61 bp, Chlorella protothecoides
tagtgaagaagtcccagcagttatcggctgggtcgagcagtcctgatgccttgacctcagc

SEQ ID NO: 44470 - DNA, 61 bp, Chlorella protothecoides
tgttggctctgcatcgggagaggcggggggggggcatgcagcgtaggtgctggaccctgcc

SEQ ID NO: 44471 - DNA, 91 bp, Chlorella protothecoides
aaaaaaacgatctgttcgtgaattaactggctatgcaataacaaacataccaacaactaaagtttattatccaacaggtaacaataaacca

SEQ ID NO: 44472 - DNA, 61 bp, Chlorella protothecoides
tttttgggataataaagctgaagaggtaatccttcccacaaatactggccaaaggggagta

SEQ ID NO: 44473 - DNA, 61 bp, Chlorella protothecoides
gtgtacgacgaggtgtgtgagagggggggggggagggggggggagatgttgttttcgagca

SEQ ID NO: 44474 - DNA, 74 bp, Chlorella protothecoides
gtgctttgcagtgtccgtgggcgcacgacccatcctcatgctcgagcctctccagccagggctctccagctcca

SEQ ID NO: 44475 - DNA, 5631 bp, Chlorella protothecoides
  modified_base (127)..(208): a, c, t, g, unknown or other
  modified_base (372)..(381): a, c, t, g, unknown or other
  modified_base (581)..(590): a, c, t, g, unknown or other
  modified_base (824)..(833): a, c, t, g, unknown or other
  modified_base (984)..(1075): a, c, t, g, unknown or other
  modified_base (1611)..(1620): a, c, t, g, unknown or other
  modified_base (1907)..(1916): a, c, t, g, unknown or other
  modified_base (2371)..(2380): a, c, t, g, unknown or other
  modified_base (2538)..(2547): a, c, t, g, unknown or other
  modified_base (2606)..(2615): a, c, t, g, unknown or other
  modified_base (3505)..(3514): a, c, t, g, unknown or other
  modified_base (3739)..(3748): a, c, t, g, unknown or other
  modified_base (4037)..(4046): a, c, t, g, unknown or other
  modified_base (4664)..(4673): a, c, t, g, unknown or other
  modified_base (4765)..(4774): a, c, t, g, unknown or other
  modified_base (4881)..(4890): a, c, t, g, unknown or other
gcgaggccggggacggcgtcgcctgcccggccgcaccctcgctcaggaccgaccgggcagcatccagggctcccacccaggcgtccagcaggccgcttgccccgccccggcccgctgcccgcgggtnnnnnnnnnnnnnnnnnnnnnnnnnnnnnnnnnnnnnnnnnnnnnnnnnnnnnnnnnnnnnnnnnnnnnnnnnnnnnnnnnngcggcggagcctgcgtgccgaggtctgcgcgatgccgccggcggccgacagcgaggtcaccgccagctccggcgccagcagggcggccaccgtgaggatgagcaggtgcgtgaggatgcgcctcgacctcccccctgaaatttgagggcgagagagggtgatgnnnnnnnnnngccgtgaggatcagcaggtgcgtgaagatgcgcctcgccctcccacctgaaatttgagggcgagagagggtgatgcagaggcatcgctgtcgggctggggaacgccaccgagagttgcctgcacgagcacgatgtgttgccccccacatccacactgcgacccccccacccccacctgtgcgtccacgtctggccacagnnnnnnnnnntcctgcacgagcacaatgtgttgccccccacatccacactgcgacgcccccaaccccacctgtgcgtccacgtctggccacaggcgtgcccgtcggccccggtcctactccctgcccgccgctcgcctgggatccccgcgcgcccaggcccggctcgggcgcgcctgacgccgcccccgcgggcgcaggcggcgcgaagagcatgggccccggctgcgcggccagggatgagcnnnnnnnnnnagggcctggcgccgcccccgtgggcgcaggcggcgcgaagagcgtgggccccggctgcgcggccagggatgagcccggcgacggcgacccgccctgcaggccagacagggggcccggcggcggagggaggaggccgggcggcgcccccatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggggagcccactggggcggggcgaagccggcgctgggcggcggcgggattcgtgacgcggcctcggccggcgccgcggcagccaccgccctggcctcggactcgccgggcccctttgcctgccccgccggcctggggatacgggaggcgccggagggccccagcagggaggggcccgcgccgccttgcccccgggcaaaatgcgcgcggatgggggactccgtgctcgtgggcggggggggaagggggaccccgggcgggggagggcatgccgcagagtcgcgcgtctcgcccgtgcccggcagctccggcgtccagggcggtcgggccccctcgccctccacgccgtccatggcggcaaagctgccaaagccagctgccctcgccggccccgacgaggcgctgggcggcgtgtcgcccacggccccagcccagccgccagggctgtacccgggcggtgccgcgccccactcgccctcggcggcgccgaccacctcctcgccctcgccagccacgtcgtagggctgcggaacgannnnnnnnnntcgggcggtgccgcgccccagccgccctcggcggcgccgaccacctcttcgcccacgccagccacgtcgtagggctgcggaacgacatcctttccgaacaagccctcagagggagccgcgggcgagccccagggctcggccgtctgccctgccgtgggccagtggttcgccccttcatactgctgtggagccgcacccggcggcgcccagtgctcctccccgccggccgcagagggcgagagaggggccgcccacacgcccacctggcgctcatcctcctggtgccnnnnnnnnnntgccgcggagggcgagaggggggccgcccacgcgcccacctggcgctcatcctcctggtgccgcgacggcggcgcccagccctggcccggattcccggaccaggggctaccagggtgggacccatggtcggggggcggcgcgccgaagggcgcgggctgcctgcccggcacagcgtgcttgggcggggagggcagcaggctcggcagctggccacgcaggtgctgctgctcgtcggcagacttgaactggaaggagggggcggaggtgtacacgcccatggtgccacctgaggggttggggaaagtgcgggtgctgggtgtgctggcggaggggaagctcctcgcagaacagcactgtgactggcacatctcccgcatgcctatggcaggcacggtatgcagcgcactcgccagtgataacccggcgcaaagtcccgggagcaatcgtccgcctnnnnnnnnnntcttgcctatggcaagcacggtatgcagcgcactcgctagtgataacccagcgcaaagtcccgggagcaatcgtccgcctgcccgtcacccacctgccaagcctgcagactcctcgtcaaagtgacgtgtgtcgtccacaggggatcctgctgttcgnnnnnnnnnntggctggcccccagcgaagggctggaacagggtggggcctgcactcccagcggaatcannnnnnnnnncatgtgttctggggctggcggggactgggctgggtgccactggcgttggagtgcgtgcggctcaagccgggctggcccccagcgaagggctggaagagggtggggcctgcactcccagcggaatcatcgccaccatactgcctggccggctggaagacggctgggggagggtaactcgacattgggcctggctgcgtcggggagaggggtggccgggttgacgacggtgatctcaggccaagaggaccagccttggcgagaccaacgccccgctcggattacccccatcacctggatttcagatcatgagaagaccccacttcagcatccaagcatcccactcgcgccgagagcagctgggatagggggtccggccccccgtcgccgcggagtattcccgatgcaaccaatgggattcgtgcagggtgccggcaatgtttcacgccaacatgcactcctggagtaagttgcaatgcctcgctgcagggatccggctctgggaaggggcgagggtggccggaggagcgcgccgatcacgtgtgttcttggtatttgaactgaagaggttcctatgcaaagtcaagagcaaggtttcagatgtgtgcagagggtgggcaggatggtggtgcgaccaatccaattcctcaagcaatctttacagcttggagggagaaactcttggtcaatctggagtactgtgatcctctgggactcctgcactctgctcgccgcccccaccaaccagacggaggtactcagcttccatctgcaggagagtgtgccgtgtgagtctgtggcccaagactatgtgccagggagcgctgcggccctgccgcgcttgtggtgttagtcaggaaggtttcttggcaggattgctgggcagcgcagcnnnnnnnnnncgtgagtctgtggcccaagacaatgagccagggagcgctgtggccctgccgcgcttgtgatgttagtcaggaagttttcttggcaggattgctgggcagcgcagcccagcaaaccgcctcaaagactcacctcttggaactcgctggccgcaaggccgtcgtcgctgcctgccgctgtagggagtgactggtcacccacatcctcccctacagccctcctccccnnnnnnnnnngccgcctcaaaaactcacctctcggaactcgctggccgcaaggctgtcgttcctgcccgtcgctgcagggagtgactggtcgcccacatcctcccctacagccctcctccccctcagcttggcatctcgtgcagccttctcgaggtgcttctcccggttgttgccacggtccaggacctggcgaggttgggtggtgggaggtgtgatggtgggggtccttgtgagccatcctcctcgaccggagtcaggcgcattctccagcactgtggcctgcctggcaaccatccannnnnnnnnnagtcgtcctcgaccggagtcaggtgcattcttcagcactgtggcctgcctggcaaccatccagagctgcatgcccgtctgaagattggatctgacccacccaccgcgcccatggctgccttctcgccgctgccctgcgtgaccagtccctcgcagagctggagcaggtgggtgcagccgtcggcggccgccaccgccacaaggctggggtgccccgtgccgggtgggaaggctagcgcagtgaggccgtgcttgctcaccggcacctggcgacgagggcgcagtgggcggccacttcagtgagggtcagcagtcgtccctcttggaggcgtatgccgagctggaaactcctccagccccagaaatcgtgcatgtgcatgcctgctagagcctggacctcagggatgcgctccagaaatcatcaggcaggcatgtaggcaggcagcctgccacagtccctgccaaggctgtccaccgttccctgaccccattcctttcttcccacccacccacctccagggctggcgcgtcctggcggtgcacccagtcccaggccgcgagcctgccgcctccgtccagggtgagggccatgccggcgcgggtggggctccaggccccnnnnnnnnnncaggcaggcagcctgccacagtccctgccgaggttgtccaccgttccctggccccactcccttcttcccacccacccacctccagggctggnnnnnnnnnngaaggcggggtggcgctggagggcggttatgtggtcgtggtgacctgatcgggagggggtgttccggaggagggggaagtaagggtgaccacaggtcgacgctggannnnnnnnnntggcccacgtcctcgctccacactcgcgcgctccagtcgccgcaggagaggaagaacttgggaaaggcggggtggcgctggagggcagtgatgtggccgtggtgacctgatggggacggggtgtttcggaggaggggaaagtaagggtgaccacaggtcgacgctggagagtggagggctggggacgggagcgcacggtggcccctcgctcgggcatgtgcgcctctgaatcaagcagggaggcacggggctggggatgcttggcaccactcccccttcacagctgcgcacgcatcaaggcgagttggttcagcagctccagtggtccacgatcccaccaaagctcgcaatggcctctcccccctacccaggcaatcagccccttgcgcctcgcccacccgcaaaggaggccgtgatcttgtcgtcctggctcttggcccgccggttgcccgccaggatggtgccctgccccgtgcccaccatgaagcgcgtgggccccgcagcggcgctgtactccagcaccgtggccgaagggcgggcgccaaacccagggtcacgcagaggctgcaacggggtggaggggaggggggaggggagtggtggcccacacgtctcccacttggtttactgcacgccgcatgcttggatgccccttcccccctcccctcgcaaccaatccccgacaaccaccatccaccctactctgtctcagcccctcccccaggtcacacatgccccccc

SEQ ID NO: 44476 - DNA, 11843 bp, Chlorella protothecoides
  modified_base (103)..(184): a, c, t, g, unknown or other
  modified_base (931)..(940): a, c, t, g, unknown or other
  modified_base (1342)..(1351): a, c, t, g, unknown or other
  modified_base (1719)..(1728): a, c, t, g, unknown or other
  modified_base (2150)..(2159): a, c, t, g, unknown or other
  modified_base (2397)..(2406): a, c, t, g, unknown or other
  modified_base (4117)..(4126): a, c, t, g, unknown or other
  modified_base (4304)..(4313): a, c, t, g, unknown or other
  modified_base (4424)..(4433): a, c, t, g, unknown or other
  modified_base (4999)..(5083): a, c, t, g, unknown or other
  modified_base (5388)..(5397): a, c, t, g, unknown or other
  modified_base (5562)..(5571): a, c, t, g, unknown or other
  modified_base (5875)..(5884): a, c, t, g, unknown or other
  modified_base (6386)..(6395): a, c, t, g, unknown or other
  modified_base (6851)..(6860): a, c, t, g, unknown or other
  modified_base (7422)..(7431): a, c, t, g, unknown or other
  modified_base (8033)..(8042): a, c, t, g, unknown or other
  modified_base (8319)..(8328): a, c, t, g, unknown or other
cactcaacctcccccgccccccaaccccctcctcgctcgcactcacgcatgatgccaaaggcaaagacgtccgaggccgtggtggcgggcccgccggcgatcnnnnnnnnnnnnnnnnnnnnnnnnnnnnnnnnnnnnnnnnnnnnnnnnnnnnnnnnnnnnnnnnnnnnnnnnnnnnnnnnnngtaggccacggtgcccagcgccaccccaccgcccgcgcgcccggcctggctgcccgggagcccggccaggccgccagcccccgccgctccacagccgcctgcgttgcgcaccagcccaaagtcggcgaccttggccacgtagcccctgcggtccacacggtgcgtggtcagcaggacattggcgggcttcaggtccctgcaggtgatgggcggcgggagggggaggcgtgagtctcaggaggagaacccacgccaagtccaggctgcaaagcaggcacatcgtgcgcggcaaggccagcgccagtcgccctcccctagctctccaggattggggccccgaaccatgtccagacagggtcattcccaagctcgcaacccctgggactgcccaaggaagatcagtcccctgcctccctcctcttcatcacccctccctacccaggcccgcacccgtggacgatgtcgtggctgtgaatgtaggccatgcccttggcgacctcctgcgccgtccgcagcagtgctctctgcaagtgtgtgtgtgtgtgtgtgtgtgtgtgtgtgtgggtgggatcgctctggcatcgcagcggcctggcggccttgcggtgaagcacagacagccagtcggtggcgtggtcgcgtctgccctcctggtccacacacctcgaggcgaaatctcctcccccatctccccgcccttgaataaaacagcaaccatgcgccccgctcacgtgtgtgacgtcggcnnnnnnnnnncgtcgcgcctgccctcctggtccacacacctcgaggcaaaatctcctcccccatctccccgccctcgaataaaacagcaactatgcgccccgctcacgtgtgtgacgtcggcgctccacttggcactgggcaggtaggcgcccttgctcagcgcccggcccaggctgcccacgtcgcagaactccatcacgactgccagcacggcgtcgtgggggcccagctcccagccctccagctcgaagatgggctggcgggggtgctgggccacactccgcgccgccactgccggggtgcggcgggggggtgaggggaggggaaggggtgaggtggggtgcctggggagggcagtggctcgatcatgccaacatgcaccagcgtgcctgccgccaataccctcgagcnnnnnnnnnncaggtggggcgcctggggagggcagtggctcgatcgtgccaacatgcgccagcgtgcctgccgccaataccctcgagcagcagcagcgggtgctgcgatatcagatggccaccactcgtgagcacccctaccatcccagcctctgtcccacccacccagccacgcccacctccccccgcagtgcccccagcaccctcgactcacatttgtgtttcaggggggagccaaaccccgcgtcgctgttgaatgactcggccggggagacaggctggcgcggggggccatggcccggcagaccggcggcgtccacctgctcccccgatggcaaggaggcggagcctgcctgctcggcagtgggggaccccgcnnnnnnnnnnggactcggcgggggagacaggctggcgcggggggtcatggcccggcagaccggcggggcctgcctgctcccccaatggcaaggaggcggggcctgcctgctcggcagtgggggaccccgcgcgccgcggcgacaccccctccactgcagccgctgctagcgccgccccgcccctccaccaagcctcctcccctagggcgccgcaggcctgctcccggcccgaggagtgggaggccagccgcggccgcacgtcctgggcggtgggggccgcgcccttgcgtcccaggtgcaggggcgacggggtgcccagcttccgcgcccccgccgtcgaggccgagcgcagacggtccagcagcaggccggtggggcccgtggcgtctgcggcgaggggaccatgatggtttggggagggtgggtgagggnnnnnnnnnnctggggccagtggcatctgcggtgaggggtccatgatggtttggggagggtgggtgagggcgtgccgggaggggcagtgtggggatgctggggagggtcctcccccaggcgctctccgcggcatcgtggcgctgctcacggtgaagcacccgccccgacgggcacctcagtcctgctgaagcaggggcccccggccctgcccacgcctgcacacccgagaaggagctgcaggagggcnnnnnnnnnnagcatcgtggcgctgctcatggtgaagtacccgccccgacgggcacctcagttctgctgaagcaaggccccccggccccgcccacgcatgcacacccgagaaggagctgcaggagggctgggtcgcgaggggcgacccccggtcgtgcggctgcagcatcgccctccacgtcggcgtcgccacccgcagcgcggcgccgtgcagggctgggatggcggggctggagggcgcgctgcccggggacaaaccgtccggcccgggcgtggcgggcaggcagggcgaggggctggagggcgtggccgggcgcggcctgccaggccctctccgcagcgtcagcgccgctggctggccaccggcgtcggcctcggccgggctcacctttggggagcggggggtgcaggaagggtcagggcagtctcctggaggggtgtctggcggcgaggaggaggcggggtcgcatctgtcaggcgtcggccgggagggcgtggggacggggaggacagcccaatcgtagcactgcacctgcgagggagcaaaggggagggaatgcttgatcggaaggctgagactcgggtggcacacggcactcgcaccatgcgctgctctgggacggagcctggactgggtccccgccacctggccctcaaactccgcagcccgccccaccacttttccacccacccaccacgtgcggatggcccagctgcttggagaggaccacctcgcgcacagcggccctcaggcctcgggcgtcgtcggcgcggcaggggatgtacttgactgcgacgggggccccgtgccagctggccttgtacacagatctgcacgtagtacgtgtgtgtgctgggaggtggcggcgtgcacgggcagggtctcggcacctgggacaacggcccggcctgacacaacacccgcacccccttccttgttatttgcggcaatcaggttccattgcctcatgccgcgaaaaacaacagcccagcgccggagctcacccgctggcgcctcggccgacgcgctggagggggtccacggaggtcaggtgcaactcgctggccgactcatccaggaggacagagtcgaggtgggcgctcatgtcggggtcgctggcgccctccgagcccccgtcccagagttcctggcccagcagaggcctgtgccggctcttgctaggggacaggtgctggctgattgcgcgagccaggcgggcgtggggaggggtcagggcgccagggtcgaccgtgttgtcagacgcaatccgtgaggtccttccatccactttacactcctcggtgtccgaagctgcggcgtctgctgctgcccgagagcgctgccaggacagggcagccaggagggcgagcactccaccgactcccaaggcaagcatccagcaggatgtggcttgtcccgagctgcgtctcctactccggagtatctgtattgcaccgtttcgcattcatttttgctgatgttaaaagtgcgatcgcggatctggattccggtcgttgtgcggggcgggtttacgaaagggtggttagccaaggcaggccggtcgcgagtgaggtccgagcatcacgacgagggcgttctaggtgcaatatgtacggcataaagtttctacatcactacaggcaaggcaatcgtgtcctggtgcccttctcggcatctgtcgcaatctgacgattatttgcagttcccgcgctcttgtcannnnnnnnnnaagcactccaccgactccccaggcaagcatccagcagtatgtggcttgtcgcgggctgcgtatgctactctgtaatatctgtactgcaccgttttgcattcatttttgctgatgttgaaagtgcgatcgcggatctggatcccggttgttgtgcggggcgggtttacgaaagggtggnnnnnnnnnnccacaagccttgaagtaagatcttggctgcgaaagtgtgcccatcgtgagcgataccagttgatgacaaactgaagtattaattgtcctccaaaagagtacatggcttcgnnnnnnnnnntcagtcacactggcgaggaggttattgccgccggacgagccagggttcatgaatgagtatcggagtacacaaggagcacgtagatgaagtatttttgcgatttacacaagccttgaagtaagatcttcgctgcgaatgtgtgcccatcgtgagcgataccagctgatgacaaactgaagtatgaattgtcctccaaaagagtacatggcttcggatctcaggatgtggcgcaaggggcatggcatgcaagttactttggcagaactgtcgtagacgatgaatccatcagtacctataagctgtcttttctgcaccatgctggcacctttggcatcgcctcgacgcctgcgcctgcatgggcgcctcgtaatgagaatttctattgcaatcccttgaaagaattgatctttgctgtcctgcttctcgtcgggcctgcactggaaatagcaggcactccccgaataatgatctctcacgtggcgaggacggaccactcgtccgactggcaaaatccccttgcccagattcgttgtcgctgcccaaacgcgtggatgtccaagataaannnnnnnnnnnnnnnnnnnnnnnnnnnnnnnnnnnnnnnnnnnnnnnnnnnnnnnnnnnnnnnnnnnnnnnnnnnnnnnnnnnnnattcgcaacatttgaacgcacccagttcccttatcgcctcttcgaaaccagagtcactgattcgacagcatgtcggggtacggacgcaacgatgacaacaccggtgtgggtggctacaaccaagtccacaccgagacctacgacaagggtgagagcatgccggaactattggattccagcgcgttgacgggtgcgaggttgtgccagcacgcacatttgctggattgccgaggtcgactggggttccggaaatccgtcggaagtgatcttgccgtcgcctgtccaaggccgtccgccgacgcgtnnnnnnnnnnaacaggggttccggaaatccgtcggaagtgatctcgccatcgcctgtccaaggccgtccgccgacgcgtgcagcggacagatcatcgcacgggtgaagtccctgcacctgattgtgaaaaaaagcatcaccaagatttcttcttcgtccctctcctcagagcacnnnnnnnnnnaaagtccctgcacctaattgtgaaacaaagcatcaccaatatttcttcttcgtccctctcctcagagcaccggagctcgggcggcagcggcctcgacaacctgaaggagaaggtcagttccggtccggcatgaatggagtggtggagatgcagagcagctgggctgtcatgacctgcccctcatcagcatgacatgccctctcatacctccatcaatacagtttgtcttgagagtggtgaagccatctcaaaaagttccaccccgcccctccttgccccctgtcctcgcagatccctggtactnnnnnnnnnntatcaatacagtttgtcttaagagtggtgaagccatctcaaaaagctccaccccgcccctccgtgccccctgtcctcgcagatccctggtactgaggcgtacaaggcgacccacggacacgagcaccacacccacaccgagcagggttacgtccgtgacacggacgccggctacggcgcgggccagggctacagcgcgggccagggctacggcgcgggccagggctatggcttggggcagggccatgtcggcggccaggagcacggccaccagcgcgccagccacgtcgcctccgacccggtctacggcgccaccgacgcgcacaagagcggcgtgggcgccaaggccgagtcggccctgcacggcgtcaaggccaagatccccggcacccaggagcacaagctgacgcaggagggtggccgcccctacgagggcatccgcggcgaggctgacctcgccgccggcaccggcggcgccggctaccagcgcaacgaagcccccnnnnnnnnnntcgccccttcgagggcatccgcggcgaggccgacctcgccgccggcaccggtggcgccggctaccagcgcaacgaagcccccgtgcacggcggccacctgcaccacgagggtgccggcagcggggcggggtacacccgtaccgccgcaacccacggccatgatgacctaggcgctgggtcgggcaaccgcgaagccgggtaccacggcgccggcgccgggtatgacaatgaggttacccgcggatccgccggggagaggggtcatgacgagggtggccagtccaagctgggccaggtgtttgagaaggtgaaggctgccatccctggcacggccgagaacaaggaaaagaaggccttcgagggtcggtactgagcgtgtgcgatgcgtgacactgatcctgagcaacgttgctgggagtgtatcactcctcgccacctaccccctgtgaaatggtnnnnnnnnnnccggtactgagcgtgtgcgattgcgtgacactgatcctgagcaatgttgctgggagtgtatcgctcctcgccacctaccccctgtgaaatggtacctccaccctgcatgatgatgatgctgcgattttgtgcaatgagatgcagcacatgacatctgacctcctgcatgtctatcaacccacactttggaggtggttggatgagagtgagggaagcattgggaggctgggagaagtggggggtaaacttgatatttgaagaatggggtgtgggaataattactttggcatcgaaattgatgcttttgatcgatacccagctccactgtagctcatctcccttagcacaagcaccggatatctggattgctgagtctctaataccagtaatgcacctgaagctcacgatgctgtgcacacacggtgtagcacacgaaccgccattcgaacagaaaaacttttactatcaagtcaccacactgtattttacaaccgtggaggctgcatcgcaaagaagtcaagcagacatggggactagctatcacgaaagctcgattcttggnnnnnnnnnnggtggggggtaaacttcacattggaagaatggggtgtggggataggtgctttggcatcgaaattgatgctttgatcgatacccagctccactgtagctcatctcccttggcacaagcactggatatctagatcgctgagtctctaataccagtcatacacctgaagctcatgatgctgtgcacacagtgtattacacgaaccgccattcgaacagaagaacttttactatcaagtcaccacactgtatattttacaaccgtagaggctgcagcgcaaagaagtcaagcagacatggcgactagctatcacgaaagctcgattcttgggcctgcatggaagctccccacctcatgagcttactgagttttcctggtagaggatgcatgtagtcgggggttgtcagggacaatccctgctgtgaaactgccacagccaagcaaaacctccggacaacgccatgttcaggtgattgtcacacaaagtcgcataccatggggcatcatacattcccagaactattatccacaagccaaagatcttgtgtcctcccccatacaccccatcaacccccttgctagcaattcaaacgcaccctgtgctnnnnnnnnnntccatacaccccatcaaccctcttgctagcaattcaaacgcaccctgtgctccttcgttccagggatagccttctcaacagtgtgaactgcctttgcaacctcctgggggatgagttgagtgtgagaggattatgtggtcgtgtagcgagcaaacaccaaatatgatcacatatgctcctgcccacacaagatcgaggaccctcgtatcctagaacctcactattgcgagcattcctcctaaaatatactcgacataatgcccattgagctgattcnnnnnnnnnnaatgctcctgtccacacatgatcggggaccctcgtatcctagatcctcattattgcaagcattcctcctgaaatctactcgacataatgcccattgagctgattccaactcttcccctaccttcttgatcttctcaccgaccccctccttctcgtcattggcgtcctgtccagcggcttccttcatcatctcgaactttgggtcgtcgtctctgcaggcgtgcatgaggattgcgtcgattcccgtgaagatgcctgtctgacacgatccgacatgggtatacctgccagcaattgctgcatccatgtcgcatcgaaagcaaggtgcccttcgatgcacacgcaccctccggcaggggtgatgaggtttaagccctcctttgtggggtgcacgttcataatggcagcgctcgccagggggtcatggtccctctcctctgtctcggctggttgggcactggcgggggtgccgcctaccttgggcggcccatcgcgcacatctacaattgaagttgggtttttgaaggtaagaagcggtgtcggctcatccgattggaaggcgcaatcctctttcttacctacttgaagtctggcagggtccgtggggacgggcgcggcaggagtcgtgttctgtgacatggcgatcagagacttctttgatgtgtacagatcaggctcagaaatgcgaattaggttgagctttcggcaagcggatgacatttaacctagatactcggggttcgacacaaaggccagctgccgtgcagattcacgctcgatcaagatcctcattcttgcacagtagattgcactccatgtcgcacttgcatgagaggtcgtacagccggcggtgtgcctcattccacctcatgtttatattccaacaagaaatgagcgtcatttgggtgcactgctcggcaagtataccccttctgctgccatccatttagctgcagatttcttggctttggcggcatacacctccgtgtgcccgtgaatgggacgctggaactgctggccattggaagacaacgcaaagccggtatccacatgcgtgagactgatcacgtggaaatgggatgggaagacaagtggtgagagtaaagtcgcacacagccatctgaatgaatccatggatgagctcaacaatcagccataccatttcagaatcaattaaatgaattgatcatgtcacaggatcccgttgacccttccagctgatggggacaaaggatcagctgggtgctgtatccccacaaccgagcagccatgcacagcttggaaagacctcccacccccgcctcggttcacctgacagggagatcctggatccaggaggatgccttcttgctgctgtcccactcgaccagccacacatcgcccgtgtctgtctctgtgtctgacccaaagcagctcacctgggagagcaatgcgtgtagggattgtggtgagtgttgacctggatggtgatcttcaggccaagcaacctcttgggcgagcagcttgagatgatcaccgacggtcccttacaaacttctatggaggaccaatcaaacggtaaagacggcagtgcaacaaggacagcgattcctcacaccataccatacctcctgattgccggagaggggggagatgaagtggtggctgtgcagccactttcttgtgtggccatgctgaagtcgcacccttcgaccactgacgatggcctctccctgcttcccagctccctgtgatattttaaatgcacgtcgggagctctggtgtctgtggacatactgggggcccccaagcagccggctctgtcagctccctagaccatatcaaacatcgcacctcacacgccacacgccagtagctctccccactgtcgctgtcgggatagcatgtcactgattgctgcccagaccctcttccgtagccgtagggtatatcatgggagtgcagtcggcatgacgtggccacgtgttgcagcttgatcaagctcccgcaggtcacctacaggcagaattcgacgcaatgttgagcttgttggacatcgagaaccatatgaagtgaacatacttggagcgtgcggcgtaccagcgctgcatcgttagtcgcgagggacagacacgctccgaccagagtgagcagtgctagagggagtggggggagtgccatggacgtggcaacaagctcctgcacttcgagagataaagtacttttactcactatgctattcaatgattggttttatggtggatggtttgcggagtggacttcaccttgcaatgccaaagccagggtgctattacgtaaggctgtggacctgtccttgtcgcagaataactttattggacaaaagctgtactgagggaacagatgcacgtgtctcggtcttgagacgaggtgtgcttccttgaccctcttggaggatggtcgcaggtgctcctgcatgcaagacaggaagcctttgatcccctacctgatgcacataacagaatcaagacttactctacacgtaatcaacctggttccagcctaaatcacattgggagaaagaaagaaaacaagggactgaccatcctggcatggcaatgcacaccgcactcggtgtgcagggaaagggagtggcacacagatcgccccacaagctgaaactgaaagggctgaggggccacgaatcaccgcaaggcgctacttcctcgcatgaggcccgtcgatcgctggggaaaacttcagattggacccgtggcaggggctgctgaggaagctgctgagtgctgaacaatatacacctgagggccgtatgtcaaggtcctgggaagtctcaccctgggcgcccgccctatggatgctcccttcacctcccagggcgtgggatcctggtttttggagccacagcggggaacgatgtactgtccccggccttcttgccagcaggcgggaacgatctggggatcttggtggagactgggttcgagcctgatgagctcgctggggccaagcctgggaggtggtggtgggggcccagtttggatgagccctgcctgcacatgatgccatgggcctggcagagcaggcgtgagcatggctgctgcacgcagcagcgacatgcaaaccgcttccccgccccgacgccgctccctgtgaacatacacaccactcgcctgcgggccggggctcccgccttgcgatgggcgaggcgatggtgggcgccaggcgcagcccctgcggcctgtgcgccgcgatccggaggccgggcgatgctgggctgggcccgggcgaggcgggccgcgccgccacctcccgctgcgcctgctgcggcgtgacaggacccagcccccgcccctgatgaaccccgccctttcccggcaccgccagccggtccagctcgaggcggcgggaggccggcgccgcgccggcggccttgccgcggtgctgggcgggggagaggggcatccacgtggccgcgaactcggccgcagcgcgcgccaggcggccggggtcggaggccgccccggggtccggcgaccc

SEQ ID NO: 44477 - DNA, 61 bp, Chlorella protothecoides
cccaacccccacccccaataatgtggcagggggaagggggacacagcagcaggatattggg

SEQ ID NO: 44478 - DNA, 71 bp, Chlorella protothecoides
attgcctgccctccatcccgccggaccaaacgcacaacgagcccccccgcaggcgcttccagccggtgtgg

SEQ ID NO: 44479 - DNA, 61 bp, Chlorella protothecoides
cgccaaggctgggcggccggaactcggccaggggcgccaggctgtcgagcctcagccacat

SEQ ID NO: 44480 - DNA, 61 bp, Chlorella protothecoides
ctcggtctgcgcgctgtggacgccggagacatacctgacgcaggagggcgtggtggcgggg

SEQ ID NO: 44481 - DNA, 74 bp, Chlorella protothecoides
ggagaaggggtgcatggttgcagtcggcgaggcgtcgacggggagaggtggactcggggaggagatggtgggcg

SEQ ID NO: 44482 - DNA, 26131 bp, Chlorella protothecoides
  modified_base (253)..(262): a, c, t, g, unknown or other
  modified_base (628)..(637): a, c, t, g, unknown or other
  modified_base (794)..(803): a, c, t, g, unknown or other
  modified_base (859)..(868): a, c, t, g, unknown or other
  modified_base (1658)..(1667): a, c, t, g, unknown or other
  modified_base (1753)..(1762): a, c, t, g, unknown or other
  modified_base (2652)..(2661): a, c, t, g, unknown or other
  modified_base (3585)..(3594): a, c, t, g, unknown or other
  modified_base (3853)..(3921): a, c, t, g, unknown or other
  modified_base (6521)..(6530): a, c, t, g, unknown or other
  modified_base (7388)..(7397): a, c, t, g, unknown or other
  modified_base (7593)..(7602): a, c, t, g, unknown or other
  modified_base (7739)..(7748): a, c, t, g, unknown or other
  modified_base (7855)..(7864): a, c, t, g, unknown or other
  modified_base (9939)..(9948): a, c, t, g, unknown or other
  modified_base (10002)..(10011): a, c, t, g, unknown or other
  modified_base (10214)..(10223): a, c, t, g, unknown or other
  modified_base (10287)..(10296): a, c, t, g, unknown or other
  modified_base (10718)..(10727): a, c, t, g, unknown or other
  modified_base (10931)..(10940): a, c, t, g, unknown or other
  modified_base (11016)..(11025): a, c, t, g, unknown or other
  modified_base (11685)..(11694): a, c, t, g, unknown or other
  modified_base (11789)..(11798): a, c, t, g, unknown or other
  modified_base (12555)..(12564): a, c, t, g, unknown or other
  modified_base (13326)..(13335): a, c, t, g, unknown or other
  modified_base (13913)..(13922): a, c, t, g, unknown or other
  modified_base (14441)..(14450): a, c, t, g, unknown or other
  modified_base (14617)..(14626): a, c, t, g, unknown or other
  modified_base (15301)..(15310): a, c, t, g, unknown or other
  modified_base (16201)..(16210): a, c, t, g, unknown or other
  modified_base (17371)..(17380): a, c, t, g, unknown or other
  modified_base (17901)..(17910): a, c, t, g, unknown or other
  modified_base (18434)..(18473): a, c, t, g, unknown or other
ggcggcgagtgcgagcgcggcgcgggcggtgcaggcacgggcgcggcgccgcgcgagacggtcgcgcggcgggccacgctgcgcgcgctgtgctcccccgacgccgccatgcacgtggtggtgcaggagccggtgcagtgcgagtacctgatcgagctgtacgtgccggagctgtgccccgtgtttgaggacgggacgggcgacggcggcgaggaggtggtcgaggaggagggcggcgtggtggtgatcctgnnnnnnnnnncgagggggcgggcgacggcggcgaggaggtggttgaggaggagggcggcgtggtggtgatcctgggggaggacggggctctcccgcagcgcgaggggggtgccgagcccgagcaggcggcagaagcggaggaggcagaggatgtcatggacgcagcagcatgggacgagctgtaggccagcgcatctgtgtaatgagtatatatgcacacagagccgcccctgtgagatttgaaatgatggtgctgcgtggtgcccctgtccccgctggcttccacaccccatcccgtacgtctccttgcctgaatgccatcaaggcccacccgacccatatcacccggctctcagaggagatcagggacagttgnnnnnnnnnntcaacagcatgggacgagctgtaggccagcgcatttgtgtaatgagtatatgcacacacagagccgcccctgtgaaatttgaaatgatgttgctgcggggtgcccctgtccccgctggcttccactccccatcccgtacgtctccttgcctgaatgnnnnnnnnnntaagaactctgtttcaggaactacacatctgttcccaatgcggtggcatacagcannnnnnnnnncaagaactctatttcagcaagtacgcatctgttcccaatgcggtggcatacagcatgccccgcagcagttgctgtcggaaaccggtcaccgaactcaccggttactccacatccttcggtccctaccatacggacccgaagcggagtcatggacggaaacgagtccttttgggacttctgcaccagggtgaatcagcagtcgatgtcgtggccagccttggccaaagactcggacatcctagtgacgaggtcccgaaaggactcgttctcgtccattaccaggtttcagctccgcatggtggaaccaaagggtgtgggataaccggtatgatcggtgaccggtttccgacagcaattgctgcggggtaggctatgtgggggcagcctatgtgcacagaagtgtcacttcctgaaacagagttcttacaactgtcgccgatctcctctgagagccgggtaatgtaggtcgggtgtgccttccaggcaaggagacgtgagggatgaaaaaagggaattggcagggacaggggaaccctgcaacagatggtcaggatgatatgggactccagagggatgagcatcgcctttgggattgttacaagaggttattctccctggagctgctaccaagtggttggggacttcaggtggaatcctgagcagtgcacgcagaagagagggacctcctctccgtcagcaggaacagtcaaatatcgatctcgtgtcgatctccgaaagaaatgcggcttcgccacatgattacgcaaacaaaaccttcaccactttccgnnnnnnnnnngggcggagacaggggaaccccgcaacagatggtcaggatgacatgggactccagaggatgagcatcgcctttgggattgttacaannnnnnnnnnccaggaacagtcaaatctcgatctcgtgtcgatctcctagagaaatgcggcttcgccacatggttacgcaaacaaaaccttcaccactttccgacccacttcgggatgcagataccgcccgtccccacaaggacgatgcggtaaagctcacgagataatcagggagatggggggtcctggggcccagtccagccagttcatcgctgatgtcccttccggagcctggcccaccacacccctggtggtacgtgcaggatcaagggggcgcacggtttgtttcatgtgtcttgagacttcttcatgaactgcgtacttgttgtgatatgctctgtcaagcaggaagacccgggcgaggaggtcagccccctccccaacctccacttcgtccccaggtgctgatgggctgggtgggggccagtgaccgagcccttggcaagtacgcccgcgtgctggcggactggggctaccccagcgtgcgctcggtggtccccacagcctacgttctctgcggccaggcaggcgcgtgcaatgcatgggcccagagcatgctggatttcatgcatgaccagggactggtccagggccgcccgctggtgctgtacgccttcagcaacggcggtgccgccatcgtcgcatccatggcgcgcatctgcagatccgaggataggtgtgcaaaccatgtttgtggtgtgccgtctgcccctgccgtgaaggaagggatgcttggcctctggaaaccttcagcgagtgttgcgcccttgatggatgctcagcatggacacacgccatcccccgcatcaggtacaaatcgctgtggccccgggtggtagcgtgcatctttgacagcgcccccgcccacgggtccccggccatgcggcaccgggtgctgnnnnnnnnnncccatcccccgcattaggtacaaatcgctgtggccccgggtggcagcgtgcatctttgacagcgcccccgcccaagggtccccggccatgcggcaccgggtgctgaacaccatcgtgccgccgggcctctcgcgcacggcatgggccctacggctgcactggcagaatctgaaggacatgatgtcctccagatccttccaggatgacttctggtgggtggtttggggggaaagggggggttaaagaagctcccttcggtgggcagtcccatggcgccttctgctacccttccagcatcaccgtccctgttgcatccgcacgtgagacctgatgctgtggcggcgcgtaccaccgccagagtatgttgttggtgcttggctgggttgccagccagcctgctccagcaccccattccaccccccctcatccatccaccgccgtcctcaacctcaggacggagatgctgaacctcgggtccgcccccccgcacatgccgctcctgtacctgtatagtgccgacgaccccctgaccgacgccaccaagctggacgcgctgctggcgcagaagcgggcgctgggccacgacgtgaccgccaggcgctgggcctcctccccccatgtcatgcatttcaaaaatcatccggaggagtacctagcacggctgtcggccttcctgcaaagagtggcgccggcccgcggaggcaccgtacgcatcgtcgcccgcctttgaagatgcatctgggcgagcgaggggtcttgcaaaccctgtgcagagtgggtgctgcccgacatactttgcagtagcaacagtggtccttgccaaccccccagatgaccctggtgacagtattctgcactagaaagaaggcctggaccatgcagttcccccctcgaatgagctccatccctgttcctgacctgcgnnnnnnnnnnaggtcttgcgaaccctgtgcagagtgggtgctgccgacatactttgcagtagcacaagtggtccttgccaacgccccagatgaccctggcgacagtattctgcactagaaggaaggcctggaccatgcagttccccgctcaaatgagctccatccctgttcctgaccttcgtcccctggcaccctctcagcgctcgagcaggccttgcatcacgcatgggattggacgctggatcacaagggaagggggtggcaaaaannnnnnnnnnnnnnnnnnnnnnnnnnnnnnnnnnnnnnnnnnnnnnnnnnnnnnnnnnnnnnnnnnnnncacagctccttgtgcggccgcgcctctggtgctgcggccggctttgccgcggcgctgccccagaggtagccccctgccagcgtgacggccacgctgagcgcgctgcgctggctcaggcacagccagggcttgtctggggagcagaagagggaggcggtggcaagggtcagtgccgcgccccgcagcgcattggccagggccacgcccagggcaccgcggctgccaaagacgtgggcctggcaggccatgtgcaggttcatgcccacggcaaagaggccgacgaggcccagtgtccggccaggctggtcgaaagacaacagggcggacgcccgcggcagggtgtatacgagcatgtaggcactggtgagcgcaaagccttgcagagggagtttttttgggggggagggggtggaaggggtattttgtgaatgtgtacatgtgtaaggaggggtagcatcgaacagtcagaagagcggtcgagtcgaggacatcacatgcacgtcgcagctctgccatcgcgcactgggaggcataggcatcccctccccccctcaccgagcttggaggagtgccaggagacgtcggcatagctgggccgggcggagcccgaggcggccaggagggcctcgtaggcgacgcccatggccgtgtacatggccgccgcggccaccaggaagagggtgccccacagctgcgtggcgccctccgcggcgggctggccggaacggcccccgccggcgcgaatgcccaggccgaggaggatgaccatgacggcgagcccctggcgcgggctcaggcgtttgcccagcagccagtggctggaggccgcggtgagcacctgggacaccgcggccagcagcaggcttgcggtggccgggccacaggcatagaagcccagggtgaagagggtgtaggccacggtctccaggaacccgatcagggtcagcagggagcgctggcgaggggagagggaggtgtgcaccgtgcgccgggcccgcacgaggccggcgtaagccagggtggcgccataccggatccagggtatggcctgggccgagggcgcggcgaagcccgtggcggtcaggtactggccgaccacgttcaggacggtgccggtgagcaccaggagcaggatgtcggcatgcatggagggtgattcgggaggaacaccggcggcgagagctcgtccgggaggtaagaggaccgggcgagacagctgggactggtttcggaagtaatcgggcgcgcgcgacgatcacccgatgggacacccctcgatcaggaggaagccggtctgggtgggtcctgcaagacgtacagtcgatgggtcaacgctctacatcgcctatggtgactcggactggatagaggtctactgggagcaggcaggcatggaggcccggctcgcagccatcaccgccgagtccgacgccaaagccaagggcgatcagtaccgggcggtgctggaggacatcatagcatctggccaacaagaccaggccatcgcattcatcgatcatggtgtgatgggtgggattgcatggctttctcacccaggcatgcatgcttgttactccaggacgaacaaccctcgctgtactcatccagagcacctcctccccgtggcagtgctatcggactctgtgcccctcctcctcagccggcagctgctctccctgctggcctccagcatctccaggctcccctctgactgccaggaggacgtggcccggcagtgagcggctggtgttacggagtggttgagggggacgcggggctgcacaggccattactaggatatgttcacccactcttctttacgctgcctgcttgtcggtgtaccacgcgtgctcatggcgcagcgacttgccactgtgtcgatataacgtggggcccatgtccattacccctcatcgtgttgaactactgtaatgaacaacttcccgaccctgaccctccctcccaaaccccacagcgccctggaccggctgcagccgcgcgcagtgagccacgaggagcagatcactgccctgcgggagcagctggcgctggtgtacgagcgacgcgagctttggtcccaggccgcccaggccctggctggcatcgacctggacagcggcgtgcgcctgctggacggcgagtaccggctggagaagaatgtgaggatagcgcggctgtatctagaggacgacgacccagtggcggcggagacctacatcaaaaaggcctcatccctcgtggcggccatcaaggtgagacgatggggggtgcgggtgtgggggcgtgggcatgctggtcggtagatgtctgtttctggtgttgcgaggggaggaggatggcgtgtttctttgtagaacacagaagacacacctgggtcagctcgtggcaggagttcatactcgtcacagtccctgctgggctccatacgtcggacccctcctgatcccacctccatacagaacgaggcgctggagctgcagtaccgcacctgctacgcccgcatcctggactccaagcgccgcttcctggaggccggcacccgctactacgagctgtcgctggcgggcgggggcggcccctcgcgaccccgggtcagcgannnnnnnnnngcgtcggacccctcccgatcccgcctccatacagaatgaggctctggagctgcagtaccgcacctgctatgcccgcatcctggactccaagcgtcgcttcctggaggccggcacccgctactatgagctgtcgctggcgggagcgggcggcccctcgcgaccccgggtcagcgaagaggacctgggccaggccctgtccgccgccatcacctgcgccatcctggcagcggcgggcagccagcgcagccgcctgctggccacgctgatcaaggacgagcgcaccgtgccctcacccctgcgccccatcttggagaaggtctacatggagcggatcctgggcgccgaggaggtagtgtatatcttgaggggagagtggatgagtgggtggagctgggtgtgtttcagcgcggcgaggggcgagtctaatctgcctgctgaggacacctacatgcagggtagggctacttgaacgggtcctccaagccttgccggatcacaatcggtccgatccctttttggtggccctcagcaccgcgtaccctcgacatcctccacatccaccaggtgagcgcctttgctgctgggctggcgcctcaccagctggcaaccttgccagacggctcgacagtcctggaccgggccgtcatggagcacaacctggagagcgtgtcaaagctctacacctccatcaaggcaagcagagaggtgttgagaaagatgtggctggccgatttctgcctggatctgaaatgttctgtctcgcaaagactgcaccaaaacattcaccttgaatctcatgccgattctgccggcgattcccatgctcctgatcacattccacatcctcgaatcttctcnnnnnnnnnncccccctttcctcccaaaccaccacttgccactttgcagatagaagaactggggcggctgctgggcgtcacgcccaaggctgctgagaaggcggcggcccgcatgatcctggagaatcggctgtctgccaccctagaccaggtttcggacctcgtcaggtttgggggggggccggacgcctcctctgcccgggatnnnnnnnnnntctgggcgtcacgcccaaggctgccgagaaggcggcagcccgcatgatcctggaaaatcggctgtctgccaccctggaccaggtttcggacctcgtcaggtttggaggggggccggacgcctcctctgcccgggatnnnnnnnnnnccaattcaacagggtttccacttcctcaggagcgcttcaaatatgcccacctcagcccaactccagggcaggcctggtgatggcctccagagtggcccccggcgagnnnnnnnnnngccgccctgcgctcggcgtgcctggctgcagacaagctcgtgatgctcatggctgccaggggactctgtgccacgcccaccagctgagcgtgtgagcaggcatgcccgaatgagttcggcctggaagtcgagcgtcgaatccttgtgcgcgccgaaagtgttgtgtaccatatcgctgcgatgtctggctgtaaacagtgcgcccatttacttacaggcgcgctgcatgcagactctgaccatgtcgcgacgggcatcaatccaacaggatttccacttcctcagcagcgcttcaaatatgccaacctcagcccaactccagggcaggcctcgtgatggcctccagagtggcccccggcgagaactctggggtctggttgatcttctccagcaccacgagctcgtggtaaacctgcgaggtggggggcccagaggtggcggagcttcgggagcggctggcggcattaacttagctgatgtggcgctgcagggcccgccctggcagctgaacctgtgactccatgtaattttagttctgctgtttgacggcatctccgacccttgtcccggcaggttgccctcccattcccctcgtcacccattcccccgggcacctgctgcagggctgcggtgtccagaatcagggacccacaatgcgccagcaccatgcgcatgtcttcctcgatgggagggaagcggcgcgacttgacgcgcatcaggaagtcgcgcaccttgttgggggggagggggggagggggggggcatggtggtagggttgggcaatcacaaagtagagcaacaccacacctcccaagggcggagtggaggtcagaaaaggcaaccctccgcaccagcagatggccagagtggcaagctcgagtacggcaggaatctctgtcaagccactatgtcaccacctcaatcagaattattccttcacccccaacccctccaaggctcgcaccaggagttcgcagtagtgcacacgctggacgtgcgggttctccacggacgcgccgcccccccactgctccttccagggcggccgcgcgacctcctcccccacgccctgcctcagcgcaaagttgagcctgctgggctcgcgcctgaccaccacgctcacggtcttgccgggcctcacggccacgcaaaagtccagggtctgcatggcctggccccagtagtgagggggctcggcggccgaggcctcagggtcagcggctgcgtcctttggcgccgcctcggcgcaggcccgggactcggcgggggcagcagcctgggagctgcttgctgcacctccatcatcccgctcctctgttgtggcaacagaatcccgctcgcgatagtagcccgttcccattttggcagtgccatagatccagcctgggcgacgtccttggaaggtcggcgcaggctcaaagtccgaaggaggctggtcctctcctgatcgcggctctgtgggctggaccgactctgaacctgccttatcaagtacaccaggaggcgctgtaaaagaggagggtgagggcaaggttgtgttgagtcgtgtgcacaccaggtgctgcaatatagttgaatacagaagagagcgttgctactttccgttgcattctcattgttctccgtggtcctgacggggcattcaacgctgaaacctcccagagacctctttcccaggtgtggggacccacaaagtaccatggcaaagcaccacaaacacaccgttcgagagagtctccacatcatccaggtgaagatcaaaccagtagacgatggcattcatgttcccaggggcgacgacctcaagcttcaacatcgtgtccctgcatgcggcaggaggggcatggtggtgaaatccgcatcatgtgtgcaacacgcaattggtcaaagcgggtggaacgcacgtgttgaatagtaggcagttggcgaatttcaatcctcctgcatatcctcgagaggctctctgaaggagctgcacctcctgacttcctcatctccagcttgggaacccccatctcaacaaggcccctaaaagcgtgtgcgcacctgacacggcccctcttctcgccgtcgannnnnnnnnnggtagagggacgtatcatgtgagaggcatggcacaccgatggggcaattccggnnnnnnnnnntacgcagttggtcaaagcgggtgggacgcacgtgttgaattatacgcagttggcgaatttcaatcctactgcatgtcctcgagaggctctctgaaggagctgcacctcctgaattcctcatctccagcttgggaaccccccttctcaaaaaggcccctaaaagcgtgtgcgtacctgacacggcccctcttctcgccgtcgannnnnnnnnnaagtacccaccctgactatcttcaccctttccgattgcagacagtggctgccaactgcgtgtcnnnnnnnnnngtacttgttgatgagcgagacatcgaagccgcccgcagaggcaatgcaggcctcgatgccaatgcagtacaccgtggcggcggcggggaccgtgatcgcgccgggctgcatcaccctctttctcgccatgtctagaaggtactgcacgccgtcgcccaacaggcctggatgggtttgggatgagggagagcagggggtgaagaaagctgtactcgcaggtggggcgcagcgcaggcgcgaggggcgggccctgtcggtggttgaacagggcggccaatgtcccaggctgggcaggtgctcgttgatggtctcatgcaaatcgagatgcgcaggacctgcaagcaactttctgtcctccctggccataactcatggcactcaacctcctctgaaacacaactccccaggtccctcccactctnnnnnnnnnnagccgccgccacggtgtattgcattggcatcgaggcctgcatcgcctctgcgggcggcttcgacgtctcgctcatcaacaagtatcgctgggacgatgcgccccagaacatcaggctttccgactttcctcaccgggtgctcacccggccggccaaggccgcagagttttttttcgacggcgagaagaggggccgtgtcaggtnnnnnnnnnngcccccagcccaccggcatcaaagaggtcggcgaccaccaggttcacccccagcgcccgcacgtcccgccctcgtnnnnnnnnnncccccctgcccaccggcatcgaagaggtcggcgaccaccaggttgacccccagcgcccgcacgtcccgccctcgttgcaggcaggcgatgtcgcgctgcaccaccgacacccggtccgacacgcagttggcagccactgtctgcaattggaaagcgtgaagatggtcagggtgggtgctcggtgcggatgcgcaggctgcgcacaccccaccaggaggagattgaatgagcccagccataccccccggaattgccccatcggtgtgccatgcctgtcacatgatacgtccctccaccaagaaagaaagaaagaaagaagcaaccaaacaacacagcccacacctggcgtgccaggtccgccaggggctcgtgcaggtccaccgccaccacggaggtggcccccaccttcgccgccaggatcgcgagcgcgcccgcccctgtccccgcgtccagcgcatgcacctcgccgtcccttgcagccaggcgcgccgccgcgcggcgcagcgcgcgggcgtacgcctcgtacttacccccgtctgccagcatagccaggtggcgcggggggaaggcggcgtcgcgccgcgcggtcgccgcgtacgccgcgtcctccacgtcgaagcgcatgcgcaccgtgttgtgcgtggccagcagcgggtgggnnnnnnnnnntcccgtccccgcgtccagcgcatgcacctcgccatcccttgcggccaggcgcgccgccgcgcgccgcagcgcgcgggcgtacgcctcgtacttannnnnnnnnngaggtactgcaggccgggccccaggcagcgcagcccggcggccgctgcgtcggggccggtggaaagcgtggcgtcgccgtgcaggcgcaggtcaaaccagaagcgcaccgcgttccagcgcccgggtccctcaaactccaggtccagcgtctgcgcggcggtgtgcgtcggcggcgccgccaggtcaaagtgccatgcctcgcgcgggcggctcagcgcgcgcaccgcggcgcctgcttccccgcgccgcccttcggcgaggtacgccggggcccagcgccgcgcgtcggcggcctgcatgttcagccccgccacgcggcccgtcgccacctccacggcctgcacccacaccgtggccgaggcgggcaggaccagagcgtcggcggtggccagagtggaaagcacgtgctggacggaggggatgaggccgctgctcagcaggcctggacggggcgaaggtagagggcagatttgagagtcggggtggggtggagggcggactgctgactgagcgcaagaaaacagcaaagggtgtgggggtgaagtgcgtgctgcatgcggcggaggccagacagggttcaggacatggctgcagtggcaggaaggcaaggcctcggcgcccctgtggcgtgccatgcccacgcccagcaccacagtacttggtgctgctgagcccatgagccccgcagcacgcctcctgtgcttgcccgccgcagacgctgggttccagccctccttccaggtgaccccccccccnnnnnnnnnncacttggtggagctgggcccaggacccccgcagcacgccccctgtgcttgcccgctgcagactctgggttccagccctccttccaggtgacacccccccccctcgcaccttcatccagcaggaggggggccaggatcaggtttgcgcagacgggcacatccttgaccagctgcaggtccgtcggccgcttgtacaccactctcactcggtcctcgtggaactgcaggcgccgtgcggtgggatggctgggacggccacatgcacatcgacgcatgcggggggaggagcccaggctgtgcgagactggcaggtgcaccgttttgtaggtggggcgcccccccaaaacctcgactcaccccattggcgtccaggatctccttggcggtgagcgccaggtagagccatcgctccacggccgtcacgtggcgggcgccggcggcgagggcggtggccgccaggaccccggcgcccgccgccaggtcaatcacgcggacgtcgcgctcgccgccggcggagatggcctccaccgccgaccggacgccggcctggaggcgggacaggcagtacgagtcctccagcagcttgatgtgcctcctcggcatgcggatgtctgtctgtggtgcatgcatgggagggttgcgtgatgagcacccctgcatgaagctccaccagtgcagaacgctgtggttctcggaggaggtgccagcgccacgccttgcccccaccagaccggcgtgaggggggccacccggcgacacaccnnnnnnnnnnggggtcgcgtgatgagcacccctgcatgaagcttcaccagtgcaggacgctgtgggtctcggaggaggtgtgagcaccatgccatgcccccaccagacaggcgtgaggggggccacccggcgacacaccatgtaccaccacacaccttccccacgcaagcccctctttcaccctttccacctggactgtcacgtagttgacggtgtccttgatggcgtggtcgttctcggcctggaagggggtgagcaggcgcagagggagcatgtcgtccgtcttgatgcggtgcagcggcgcggaggccgggtggtaggcgatgcgctgcttgggctctgggtaggtcagggctttgagaacctggcccccgcctgcggtgagggtttgggttggatgagcgcgaggcagattggtggctggtatgtcttgtagaactcgactgtggccctgggaacgcagaggtaccccaaatgtggaggtgctcaggggcattgcagaccctgatcagatccggatatccatccaaggaatacaaggagcccaacgtcaaaaagtgcaagccaggtcccgcacaacccccagcnnnnnnnnnnaatttcttgtaaaactcgactgcggccctgggaacgcagaggtaccccaaatgtgaagatgctctggagcattgcagaccctgatcagatccggatacccacccgagaaatacaaagggcccaacctcaaaacgtgcaagccaggtcccgcacaacccccagcgcacacaccagccagggcctcctctgccaggcgctgctgggcgctctgcaggccggccctcagccctgggtcgagggggtcagccctcaggccggcctcgaaggccgtcaccgcttccctgctccgtcccagacccagcagtgctcgcccctcccgagcaaaggacctgatgtaggcgtcggacgcctttccattcctgcaaggcgtggggcgaaggtatctggggggctccagtgcgcgtctcttggccgagaaatcgtgatgctcgggcggtgagccgggggccctgggctgcgagatgtcagcgttagtgcgctggcttgaccccgctctctgctacaaccagacccagaacnnnnnnnnnncccattcctgcaaggcgtggggcgaaggtatgtgggggcctccagtgcgcgtctctcggccgaggaatcgtgatgctcgggcggtgagccgagggccgtgggctgcgagatgtcagcgtcagtgcgctggcttgatcccgctctctgctacaaccagacccagaacnnnnnnnnnnaccaaccaaacctgcgaagggaggcctcggccagactcctaccacgcctggcgtgctccagggccaggtcccagagctccagatctagtgcagcacccgatgcattcccatgcaccgtgtgcatctctgggtgggtcaggttgccggcacgggccttggcaaagagtgccagccagatccccagggcgcgtggggtttctccagctttgcgcgccgcagcagctcgagaattgatatcctgcagcttcaatgacatgatcagcggatccgcagcagcctgagcttgggcagcaaggatcgcccggcgtacctggggcggggagcatgtcgaagatggtgtgaccggggttgacttctcccaaggaagtcagaactctcatcgaataacggcatgcagatttcgaatgctgcaatgtatcccggtgcatgttacattccctcgactcgcaccaattcctgctcctcgttttcaaaagtgggctcgccatcaccggcccagcccgactcagccttgacagcaacatcacggctgtgctcgggatggggcatgttggagggtatttgcactcccatttgggtgaaccacgcgatcaggaaggcaaacagttgctccgggtgcgaggttcagcagcccttggtcactagtttgacttggagagaacccattgtcgtgtnnnnnnnnnntactcccatttgggtgagccacgcaatcaggaaggcaaacagttgctaggggtgcgaggttcagcagcccttggtcactggtttgacttggagagaacccattgtcgtgtctcaatcagatgatcacatccaacttgggtgcatcactgcaattgcattgcatccgtggtggcataagcgggtctagcgtgccagggtatccatgagatgcaccgaattgcagccatgccccccgcgttgacttgcctgacgtggcagtggagcaaggccccacctcggacccctgttcttccacccccttccactatcggaccacaaaccttctgtccaaggctctcaccccaaacaaagacttcaatgatcctgtctggcaatgcacaccacattgcatcccatgtggagtgctggggttttacaaggcctttacttgggcctgatcgtgcagtgggtctatgttcattaggagtacgggggaagagtcgagaatgaccacgagccacctcatcggcgcagacagcactgcacgcacacatcaataagcgcaacttgaactggaccacccaaatcatctgataagtgcttgtaagcagagatcagagggatgagcgtccctcatcgtgaggggtcctctatgtcagggaactcgtgaaagtataactccgagtatcgcttgatggcctggaaccagtaacatgagaggccctgcgatgtgggagagcaggcagttgctcgacgaaatgatgatacagactggcgctgagaagctgacaatctctcaagccctggtggatgtcaaaatcttggtccctccaagtgcaacatgacccacacccctgcgacgcacgccacccggacaccaaccccacacctcctcttgcagattcttgaggnnnnnnnnnnttggtggatgtcaaaatcttggtccctccatgtgcaacatgacccacacccctgcgacgcatgccatccggacaccacccccacacctcctcttgcagattcttgaggatccattctttccccgcctttgcgactgcaggagcttctgccttgccttcactctcctgcactgccttcttcaggatgggccctgcacaaggcaggtgggtcaccaggagggtggtggagtagggcagagtgaaattactcgatgtcttgcagcgcccacggctggagcttggtcatgccttgcactgtgcagtttagtgcctggagcttctggatcaatccctgcatggacaggccttgtccagagaccatgagctgatcgcattgtcccctccgtctttcccccccctcctcgtttcggtccccagcgtcagggccctcacccatctccttgatgtacttttccgcgtcgccgccctcgtgctcgtaggggggcagggccacgtagtggacccccggcagcagtcccggctcgtaaaactccacccacttggactgcaccttgaacaccagcgattcacacgccagccggtactttagcgctggcacggggggaaacgggggatggcgtgttggggcttgggattcagggtgagagaggatcagaagggaagaggagggggctcgacatggcccaggctcactcgcatggtgcaggatgcagggtgtgacatgggagacagccgagtggcggtgtggcgagtgtactcccctgcgcaccgcgccctccacaaccaaactcacacccgccggctccccacctgcagagtagctgaagcccgccgtgtgcaggagatacttgttgttgcaccaggcgtccacccactgaaactggttgccggatgtcgccacgaactttgtgtcccccacgtccactgccacgcccagagtctccaggtcagtcttgttccctgccagcgctgccagggccggcatgaggctgcgccgtggccccacgccccagtgccccctgcgtgcagggaaagggggaccatcgatcttgagttcgcctcctcgcccgccccagcccaagcaccacgccaccacacacgccctcacacacctgctgaacagcgtgttgctccgcgctttccagcccaccatgccggcacnnnnnnnnnnacactcacacacctgctgaacagcatgttggtccgcgctttccagcccaccatgccggcacgttgatccagcagcccgctcatgttgtaccaggaggagttggtgtatcgcgtctccgggtaacacttgaaggtgaagtccgggacggggatgtccttgcagccctcctctgcggcggggtgtgccaggggatgatggggagtgaggcaaggacatttgaccccgggaggctggactcgcatgcgccccgcacagcccccactggcgggacggtgccaccgggaggcacgctgccgcgccgggcgagcccttgcgctctgcgccggcgcctcccgtcccccacccacaccggggcacgctccagcccacccgggtcgcgcctggggcgcggccgggcccccccgtgaccgacgcgaggcacacatgcactcgcagagggcatggcacggcagggtgccgcctgggcccccacccaccctcccccccttgccgggcacgcaccccagaccatggagaaggcnnnnnnnnnnacccccacccaccctcccacgcttggcgggcacgcaccccagaccatggagaaggccggcagcctgatgttccggccggtgatggggaagtcctcggtctccaccaccaggcgaaggtcccgcgtcccgagcaggtcctgcagcgcggtgttgtggcgctgcggggaggaaagagcggagtgtgggtggatgaactcagcgcgcagcccagcccatgccctcgcaggagacaagcacacccacccccacccggcccacgcgctccagcgctggcctccctgcctgcaccaaaccgtcggcccagtctgacctccactgcatcctccagcaccgccaggatgcagggccgcttgtgctcggcattcggcctcgacgtctgtggtgggagggcgagatagaggcgtgagcctggcaaggtgcatggctggactgaaacgattgtcctgcaggagggtaccagctttcgtcattccctgcacatcctcttcacaagcccataccccccccccccccccccccccccnnnnnnnnnnnnnnnnnnnnnnnnnnnnnnnnnnnnnnnnaaaagcactaccccaggtcccatgcctcacattcacgatcctcatctccactctgtccagagtgtcgttgtacctcagggacacctcgtcgtgcccggggtgccaggtgccccacaagatgttgtgcatggcctctatggactcggccgagctctgtctcaggctccctgtcatggccctgggtgccgcaaagaacttctccagagctgcgtccacccagggaaacgtctggaggcacgcatcgccgaccaggctagggggggcctgtggggagtggccgtcggagtctgtcagcgtaggaggtcatagctgctgctgtgtccggccggctggtgccccacccgagatctgcgcccttcgatgccacctgcaccgaaggctcgaggagcgaaggaccttcgacatggcctaatgatgccctaatgtactccttgctcctagaatccctcaggggaagcgccaacgaggcaatcaagagtatggccaagcccaccaccacggcgattttcacgggcccacacgtcattacggaggaggactccgcccatacacttttcctcgctcattagcagtcggcagtaacagatgaccgaaccaggtgggcctgccacctagtgcggatcgctgaactgtcccagaatcacggtcgtcgatgctgggtccccgaagtacgagccccccggtcgtcccggcgggagcttcatccgagcccttcgatcgacagccatgcacaatacttcgggacacccatatcaagttcctttcaagctcatgaatgtatatggagcatctggttggggtattttggttgtggggtacggtgccgagccgcgtgcgggctgctccggtacatggggtcctccttacaaaacagatgaggattcactggtgcaccgccctggtgctggccacacgcatccagggccagtctcaagcatcgtcttgcgctgcaacctcggccttctccgcctcctcccctcgcggatcaaagtagatctccgcataccgcttgatagccgcataccaataacaggacaagccctgtgggtggtgattggggggggggtgaatgccacaatcctgtgtcatgtcgatcaagagacccctccgtaagctttccgtcccctggctggggggggtggggggggctgactcctgccccactcacctcctcgctgagattatgcagcgcccaggcctggccatttgccgcaatctccgggaccttcgtgccgcccagcgtgtccaccaccgcctgcttgatcagcggcgctgcacggcgacaggaagtgtgcgaggggggggattggtggtgggtgcgctgacgctccagtgccagacacaaggtgtggggtgggagagccccgcctccctggcaccccagcgtgccgcgcctgccacccaacccctggcctccacccatcctgcatattctgggagaacaggcggtccgatcatgcccccctctgcgccacgcccaccgcatctccctcccttcgcccctctctgggccgggggccccccctcaatggccccatgccactacatgcacaccctcatctccccacccgctctccgccccacccgcttcctgcacatagcgctttgcatccccgccctcatgctcgtagggcggcagctccacgtagtgcaccccggcctccagccccggctcgtagaactccacccatttggagggcaccttgaagaccagcgccccgcaggccaggcggtacttgagcgctgcagggggtggaggtgcaaggagtcgtggtcgccgggcgggcggggcaaggaagcctggccgcatcggcccatgtgccgggctgcagagcaggggtttgcgcgtcgccaggccgcctgagctcgctcgcgccacgccgagtgaaggcatgagctggcgggagggtctgaatcggcggcaccaccctcccaggggccccccccccacacatcaccaccccagacacacaccatcgcctccacacacacacacacacacacacacacacacctccccccccttccccctgcattccccctctcaatgcgcacccgccgagtagctgaagccggcggtgtgcagcatgtatttgctgttgcaccatgtgtccacccactcgaaccgcgcggcgttggaggccacaaactctgtgtcctccacgtctagcctggcgcccagttcggcctcgtcacgcccctctttcctcagctggaccagggcggggaggaggctgcgccggggacccaccccccagttgctcctggggcgatggggcggagggggccgtatcagggcggcgacgagtgcgggggcgagcggggtctccgctgctgcacgggcctctcgcgccatccgcgagcatggcagtgatcccgcggcaagcacccccccccccaaccgtgcatgcccgcccgtcaacacagagacctgcccatcacgatgcacgcagcgccctgcctcggagccctggaccccccctcgccaccacctctggaagatggcgtttgtgcggcggtcccagcccaccatctgggagcggtggtcgatgagggcggccatcgccgcccaagtcgtgttggtgtacttggcctccgggtagcacttgaaggtgaagtcggggatggggatgtcgatgctgtgctgctctgcggcaaggggcagccggccggcggtgcatgaggaggggcggtgcggggggagcccgaggtgaggcggcgcgcggggcgcgtgcaacgcgacccagcgcccgctcccgtcccctgggtctcgtccgccctcccaacccctcccatcacccccccccgggggatgcctgcaggggtcccagtgctcccaggctcaccccagcacatggcaaaggctggcaggcgtttgccctgcgacgtcatgggaaagtcctccgtctcaatcactagcctcagctcccggccgcccagcagggcatgcagggcggcattgtgccgctggtggtgggcgggagacgggtgcatgtgaggggggttgtgtgtgcaggtgggagcaaggaggggtggggagcgggttgtcggcggaagcaggggatggcggggtctccccgcgacgccctcgccaccgccggggcacggcccatcgggcctgcaggcctgccacacacatttacaggtctcctgaaccccccttgccccccccccccactaagcacctgcactgcgtccctcaggacgtccaggatgcagggccgcttgtgcgctgcgttgggcttgaacgtctgcaccggtggggggtggggccggcgtcacgcggggccgacgcaactcgcaaccgggcgcagcggggcgcaggggctcgcatctctccgcacggcatggaacagaccgggcacaaccggaggccggtaagggctgggcaatggatgtggtgggcgccagccggccagtggtggcaggcaccgcatggccagcacatgttgatggccaacagacgaggagtgtgcgtgcatgtacactcagcaaccgctccggacgcgacccaaccctgactggggggaggggccggggcgggcacgggggccccgccgccctgctcacatgtgagcgccacgatgctcaccttgacaatctccatttccacgcgtgcagtgctggcattgtaaagcagagagacctcatcatgtccgggggggtacttcccccaccggatcttgtgcagcgcctggagcccctcgctggcagtgaggttggactccctggctgaagaacgcgccttctcaaagaatttattcaacgcagagtccatccaggggaaggactggaggcacgcgtctccaaccagcgcctcctcctgtggagaccgcaccgaagggagtttggttgagtggtattggccaggctcggcgcgggatgctccgagagggtggtgcacagggcaggcgcggcacacctcggcatgcaggaatggccctgcgccgctgatcttcgccgcggcctccccgaggtgggagcggaaggggagggcgacggagcagaggcccagcgccacaaccgccaggacgaggacattgtgtcggcgcagcctcggtgcagacattctgcgatcggaaatcacggcctcgggtgtgcgtgctctaagaggttgtcatccaatcaaggcgcagcaacgcagtcctcatcccagccaatctaggcatgttgctccccggtaatcttcaaaggagaaagcggattttattactttttatattcaggaattgaatgccgacagttcggctgcgagtattcgtctcaatagaccagagcgatggcaagcactaatcgtgatatgtcctcctgcatgatcgggacgacaggaatggggtattgagcatgtaaggcacaatctctcgatgttcttcacaagtggacattgatgtgtgctacctttgctttaagtgttacacaggcacggctttgagctttgaggcaggcattataagtgcttgatggaggagctcgtgacctcccgctctcagcctgtcggatcgccccatggtcaatgtgctcctcatagtcatgcagggcgtcagcatatgcaccaagctccctgtgttagctgcccagcaaactcgttcagtggattgaacgccatgggcagttgcaggtttctagctgttggtttgcatggccaacatctgctcccgcgccctccatcaataacagcctactgcttggctcaagacccacacgtatcaatccagtgtcattagaccacaggtagggacgctgaaaccggatgcgcccctccccaaaccgaccttagttgggcagtccacatcacaacctgggaagtgggtacccaaccaaggtgggcgaccagtatgggtgactgtgtaccggaattgctacaacatcctaccacccaactccatgccaaggggacggaaagatgaataacttggggcgaggactctggagtgcgttcagtcagggcatacccgccccgagacgagagcctgtgagccagcgagtcgtgaacccggaatgacactcattagccagagaacttctaggtcatgcaatttcgaaaccagattagtgggtgttgttatgtgtatgagtcttcgtttggagatgcgctgggatgccatgacgggggaaacatggctgggtatgcgcaggggtgggtcgaatcgcggcagggaggtctctctcacaatactcgccaatactttgctgcattggtggggcttccagtattaccaaatgtttgaggattaccggctcctctcaaacagtaatcagcgaagatgcgactgttgccaacctgacgtgggtcgttcacagttcccaagcacgcgcgcatgccaggataagtatgtatgtcgagggtgggctggaatttcatctctctctgcggaagataacatctccatacatctgggagatggatgcgacgcggcaaaagccagctcccatgctgctcatacataggtagccgcgagggaaggccttgaccgaatccagtggcaaagtatgggcaaggggcagatccacgatttgaaatcgcagtaccctcccctacagacctacagttgtgctatttgcaactcgcgtgccccgccacgccacccatgccgatgcaccgtgaatgtgcatggtgggagggcctagttacatatgaagccagctggggtttacactatgagcaagcgaagaagccacgagctttctgtcgtggcaaacagagctctttgagcgtgtagggcaccgcagtggaccctccaaggtagttccctcctcgtcatgaccactccctcagggtcctgctgagtggaagcaacttgcaccactccccgaagttggctcttggcaacgttgatgtttgggtatcgaaagagaacatatgtcaaagttaggacgaggagaaaacgagcttctctatagcttgcccgcagtgctctagacgtgggaggatcaccagaatcctacccatcgcaccctgccatgggtgtgtcgtacaattctcaccgggccggcatatcaggatgtcgccatgtcctcgaggatacaggaagctcgattgcaatacagaagatggaatctgcacatttagcgatgaatccgtacctgcatgaattcgtatatgtggtcatgcacccctgtcagttatgcccatacaggacatggctcatactctaaagcagattgtgtgccacgtgattgactatcaggactgcagggggtcatactggttcataccgggagtatgccgcccatagcctgctcacgagatacatgactctgacctttggaaatgactgctaattacctgttgaatctgcgaggtaacttccaagatggctgcctccggaggtatgatcctcgtgctccttctcgtcataggcggcgcttccgcatcgaccggtaaggaccggtcgggagagccatggggacggaagatgggttctgtagcatatctgcaactcaaaggagcaaaatgggatcactggccctgctagagtagagtaaacaagctgggcggcatgcgaacctgcgtcaagcgtcaccgggcatgagtaggcggtgccggtgctctgccatggccagacccagcccgaccttttacctatcgcttaaccagccatccctatctattctctgatcgatgcccttttattctgatcaaacttaatgtgatcatgcttgctgcgtggtactgctcttgcacatctttctgtgcaggtgagtagcttcatgaacctggcccccactaccttccctccattgcagtctcccaaggccggtctgtgctgcagctttcgctaggtacgtggatgtctgaggtagaagcgttgtggagaatagcagggtgcaagcgctcacacgaggtaaaggctgatccatgtctgtccatctccatactgccgccccgaacgaatgaaatccgtcccgcccgtagatggcatcgacaacaccctgcccacgacgacattcggcagcgacacggtgagtgcgcatcacggatgtgggaatattgcttgatatagtgtgcttccagggcccttcaaacgataaactctccccgacctcattcgcagaccgatacctcattcggggacagctccggagggtctagctccttcgtgagcaatgccgaccccagccccacaacccagtccaacaccgttgacacatccaacaccgattctggatcgggattcggaaccttctctagtgaccgcagctctcccaccactgcatccggggggagtgcgttcaatttgtttgggggggatacctcttcctccgactcgggaggtacctcaggcagccagtttttcaggcaacaggtatcaccagcgcaatcctcgggcggcgattcctcccctctcacgcaggagtccttcagcggtggatttgaagcctctgcaagcccaaactcaaggagcgactctgatgctgccacatctcccgcctcccaatctgggtcacagtccagccccagctcttcatgggtattgactccccccagccccagcgacaacctcaagatagcaggcaccagtcctacacaatcgtcccccagccccaaaaccatatcttctccttccccagcggcctcgcccagcccgagcggcaagagcccatcccccagccccaaggactcacccagccccaagagccccagcccaagccccaag

SEQ ID NO: 44483 - DNA, 937 bp, Chlorella protothecoides
  modified_base (566)..(575): a, c, t, g, unknown or other
  modified_base (631)..(834): a, c, t, g, unknown or other
ggcggccgccaacccccgcgcgctggagaagctgcgccactcacacgtgctggtgacggggcgggcgggcggcgagcgcggcgcgctgctggtggtggacccgcgcttccgcgaccagttctcgctggggcacccgccgccggcctactccgcgctgctggacagcatgcccgcggagttcgtggggccgccggagcggctgcaggccctggtgcgcctgctgtgcagcgagattgccggcgcgtttgctgtgcagggccagcccctgccgccctggaggaccctgcgctccatgctgggcaagtggtttgacctgggcgcgcccgggcccggcgcccggcactcgcccggcgcggcgccgggggctggcgaggtgcctgcgggggccgagatggcgctggaggcgggtgggagggcgagggctgcggaggggacgggcccagcgggcccgccgagccaaggcccggaccccaggagcagttgcgccggcgaacacccaggcgtggaggcccccgacctgcagaccgcgttcagcacgcggccgagccgggagagcgagtccaccnnnnnnnnnntgagggctgcggaggggacgggccaagcgggcccgccgagccaaggcccggacccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggtcctgcagcggcatggcggggggcatgagcgggctgctggagggcacctttgtcggcagcgacggcgtggggcggtcgacgcgcggcggcgcgcctcccg

SEQ ID NO: 44484 - DNA, 61 bp, Chlorella protothecoides
caccctgatcttcatgaagctgtggcaggggggggtgaaggttcagcaatgcgatggcagc

SEQ ID NO: 44485 - DNA, 61 bp, Chlorella protothecoides
gcccgacctacaagacagcgagcacagcggggctcctgtcgcgggtcgtgaagatcgtccc

SEQ ID NO: 44486 - DNA, 1009 bp, Chlorella protothecoides
  modified_base (294)..(303): a, c, t, g, unknown or other
  modified_base (532)..(541): a, c, t, g, unknown or other
tgggacactttgcgcactccgcacgcgccttttaccaggccgtggccaaggccatccacgtgccggcgcggcgccgcgacgacccgggcgcacagggggcgccggcgccggcggccaagctcgccgcgctgcagctggccctggtgctgcgccgcaacttggacctggtgagtagtgtgtgtgtgcgtgtgtgtgggcggggggggatggggatgagggggtttgagggaacggtggatgccagggatcggtgctctgcctcagggtcggagcgggtgttggcacgcggaatgnnnnnnnnnngggaacggtgggtgccagggattggtgctctgcctctggggtcggagcgggtgttggcacgcggaatgtgtcgggataccacctacgggcgtgcatgttgtcggcccgaggcttggtccgcgggcccagcccctcggcttccacacccagctccagccgctggtccccgtggttgtggccgacgtgccttcaagctcactccttcctccctcacgcacgaacgacccannnnnnnnnncggtcggcgggcccagcccctcggctcccacacccagctccagccgctggtccccatggttgtggccgacgtgccttcaagctcgctccttcctccctcacgcacgaacgacccacctccagggcgtgacttcggcggcggagctgctgcaggggtgcgcgggcggccccggctccaccgccagcaccaccaccccacccaccgaggccctgttcgccgggcggacgggctcctacctgcgcaccctgcagcgtgtcctggacgcgtccttcaacctgcttttcgacgcgcggcgccgcaccgcgcacacccttgtgctcaacttcttcgtggccacgggcgggctggacgccttcctggcccacttccgcatcgcgctggacctgctgcgcgcgctgccggccgggagcggcgacggcggcgggaggcaggaggggccgggcggcagcggcgcgggcggggcggcgg

SEQ ID NO: 44487 - DNA, 61 bp, Chlorella protothecoides
gcaaactcttccaaaagccacggcggcggggggagggaatgtcatccagaatcatccccct

SEQ ID NO: 44488 - DNA, 76 bp, Chlorella protothecoides
gagggccagcgtgggcggcggcgtgcgcgcccgcgccggctcggcgcggtgccgggcgtgggtcagcatggtggcc

SEQ ID NO: 44489 - DNA, 61 bp, Chlorella protothecoides
acctatgcagcctgatacctgctcagaggggtacgccgccatttgtgtgcatttgtggcac

SEQ ID NO: 44490 - DNA, 2225 bp, Chlorella protothecoides
  modified_base (94)..(154): a, c, t, g, unknown or other
  modified_base (512)..(521): a, c, t, g, unknown or other
  modified_base (916)..(1014): a, c, t, g, unknown or other
  modified_base (1419)..(1428): a, c, t, g, unknown or other
  modified_base (1731)..(1740): a, c, t, g, unknown or other
  modified_base (1905)..(1914): a, c, t, g, unknown or other
agtcgcacgtccacctcttcgtcgtaaggatccagcaggtcgccatcttcctcgtcgccgcccttccccccatccccctcctccatcccctccnnnnnnnnnnnnnnnnnnnnnnnnnnnnnnnnnnnnnnnnnnnnnnnnnnnnnnnnnnnnnctcctcctcctcctccgcgccgcgctccagccggcgcaccagcgcctccagcgcctccaggtccagccgcgcgccgttcgacaggcgcagcacttcctgcagcgcgtgcgcggcggcctgccactcgcgcgcgcgcgccgccaccgcgccgtagttctcccaggcctgccagctgtcgcgcttgtggcgcagcgcctcggtcagcgcggcgaaggccgggcgccaggcgcgcagcgcgatgtgcgccgcgcccaggttgttccaggcctcgccgttgtccggctgctgctgcgcggcgcgggtgaaagccgcgcgcgcgcccgcgtagtcgcgctccttcaggcacgcgtagcccagnnnnnnnnnnagtgaaagccgcgcgcgcgcccgcgtggtcgcgctccttcaggcacgcgtagcccaggctgaaccagccctcggggtgcagcgggctgagcgcgagcgcggcgcgccagtgccccgcggcctcggcgtggcgccccgcgcccgccgccaggcgtgccagcgaccgctgcgcgcgcgcgctgcgcccgccgctggcctcccacgcgcggcggtagtggcccgggtccaggctgaggtcgcccagagcgcaccagaggcgtgggtcgctggggcgcacctccagccggcggcgcaccagcgcctccgccgcgccgcgcttgcccagcagctggtagcacacgatcacgctgtcccacagctccacgccctcgaacaatggcagcgcggaggccaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccagctcgcggcgcagcggcgtgcgcagcggcagcgcgccgaagaaagcgcagcgcaggcgcgcggcggcggggggccctggcgcgcgcccggcctcctccacgccctccaacgaggccaggccacgaacgcgggtgcggggccgctccagctccagccgcgcgagctgcagcctcgccgccgtcgccagcacccactgtgtgggggtgggggtgtcttttgagaggagaatctgtgtctcttgtgagctcacggcccggagatacagcgtggcattttccttgttttgaccacaagcgcaggggattccccccctccacccccctgctgagtccccggtccaaccccgcacctggctcaggtcctgggccacgacggcctcggcgtaggccgccagctggcccnnnnnnnnnncgtgagctcacggcccggagatgcagcgtggcatttccttgttttgacgacaagcgcaggggatcacccccctccaccccccctgctgagtccccggtccacccccgcacctggctcaggtcctgggccacaacggcctcggcgtaggccgccagctggcccgcacgcacggcgtcgcccgcgctgcccttccgcagcagcgccgcgcgcgccagcagcagcgcctgctccagggagtgcaggtcccgcggagcggcggccgctgggggcctgccacccgcgccctccaccagccgcgggccnnnnnnnnnntgcggcggccgctggggggccgccacccgcgccctccaccagccgcgggccgggcagaacgtcgtcggcgccatccggggtctgcgtgggcctgccccccgccgcggcaacgtccgggggcaggaggtcgtcggctcgcgccgcgccacggtcccggacccaggnnnnnnnnnngcccccgccgcggcgacgtccgggggcaggaggtcgtcgactcgcgccgcgccacggtcccggacccaggccccccgccgtgagacggagaccaccagctgcgccttggcttccgtctggtgagcggtgcgggtgcccagcacgcccgccagctcggcgccgaaccccgcaagcccgtctgcgacgtccagcccggcgcgcgcgtcggccacgcgactgtacgccaggtggcgggccgcgctttccagggccagcgcgacgcgcagggcgcggggccaggcgggcgccgcggcggcagcggcggaccacag

SEQ ID NO: 44491 - DNA, 80 bp, Chlorella protothecoides
ccgctgcgatatcgcggcgtagcggcggtggcaccactctcgcggcagagagcgcagcggcctgcaatgtcagcgctggc

SEQ ID NO: 44492 - DNA, 61 bp, Chlorella protothecoides
ggcgcccgaggcgctgccctacctggactcgcacgccgccggcggcgccgcgctgggctcg

SEQ ID NO: 44493 - DNA, 131 bp, Chlorella protothecoides
ggcctcgtcctcgcacgaaataaaacagctacggtgatggagatggggattgcgggcaggcgccaaagggggggcgtggccgccgggggggtcagcacacaaagcgcgccttgccgcgcgacacctggttg

SEQ ID NO: 44494 - DNA, 61 bp, Chlorella protothecoides
ctctcatctcgcgatcccgacgatggcggggacgcgcatgacactcgcggcacctgatgcc

SEQ ID NO: 44495 - DNA, 61 bp, Chlorella protothecoides
ttgtgcgaagggctgtggcagcaggcgcgggccagcgacgcgccgctgctctcctacctgg

SEQ ID NO: 44496 - DNA, 61 bp, Chlorella protothecoides
ggacgcggtgcctgtgggggcaaggggggggggggaacgttgaacgaggcaagccgctctc

SEQ ID NO: 44497 - DNA, 61 bp, Chlorella protothecoides
tcagcgactggctggaggaggagctgcaggggggcagacgtttatgtccagcctatagcca

SEQ ID NO: 44498 - DNA, 61 bp, Chlorella protothecoides
gggggtggggggaggaggcacgctggagggtggcgtcttgggggaggggctggggctggcc

SEQ ID NO: 44499 - DNA, 61 bp, Chlorella protothecoides
agcgtcgccaaggctgctgaaactggcgggggctccatccgtgtaatttccgtcttattga

SEQ ID NO: 44500 - DNA, 61 bp, Chlorella protothecoides
ctttccagggtgaggcaggctggcaggaggggtcaaggggccatgccatgatgaaaggaca

SEQ ID NO: 44501 - DNA, 61 bp, Chlorella protothecoides
tgtcgcgcgcgcagttgatctgctggcaggggaactggaccactacgcagggcgcctcctc

SEQ ID NO: 44502 - DNA, 63 bp, Chlorella protothecoides
gggttggggaggacgggacgcccgaccgcccgcccgccagactcctgcaccgttcctcccgcc

SEQ ID NO: 44503 - DNA, 61 bp, Chlorella protothecoides
atgggtgtcggctctgcttcccatggcagggggccatccccgaaccacggcctcagccccc

SEQ ID NO: 44504 - DNA, 1141 bp, Chlorella protothecoides
  modified_base (136)..(227): a, c, t, g, unknown or other
cggccgtctgggtcgggcgcaaccgcttcgcgacgctggaccgcggcgccaacgcgctgctggtgcgcgacctggcgggcgaggtgaccaagcgcctggcctccccgctggcggccaccgacggcctgttccccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcgcccccgggcaggtgctcctgcgcggcgacgaccgcgtggcgctgtttgacgtcgcgcggcgcgcggtggtggcggagctggccgcccccggcgtgcgctacgtggcgtggtcggaggacggcacgcgcgtggcgctgctggccaagcactgcgtgaccctggcgggcgggcgcgacctggccgacccggccagcgtgcacgagacgctgcgcgtcaagtcggcggcctgggacgggtcgcgcgtgctggtgtactccacgctcaaccacctcaagtacgcgctgccggggggcgacggcggcacgctgcgcacgctgcccgacccggtgtacctggtgcgcgcggagggcggcgccgtgcactgcctggaccgcgaggcgcggccgcgcgcgctgcgcgtggacacctcggaggtcgagttcaagctggcgctggccgcgcggcgctacgacgcggtgctggcgctgatccggcgcggtgcgctggcggggcaggccatcatcgcctacctgcaggagaaggggtaccccgaggtggccctgcactttgtgcgcgacgagcgcatccgcttcggcctggcggtggagtgcgggaacgtggaggtggccctggcctccgcccaggccctggacgaccgcgacacctggtaccgcctgggcgtggaggcgctgcgcgcgggcaacgctgccatcgcggagtttgcgtaccagaagacccactcctacgaccgcctggccttcctctacctcgtcaccggcgcggccgacaagctggccaagatggccaagatcgcggagcggcgcggcgacgcgcgcgcgcgcctgcaggccgccctctacctgggcgacgcgggcgagcaggcgcgcgtgctggaggccggcggccagccggcgctggcctacctggccgc

SEQ ID NO: 44505 - DNA, 61 bp, Chlorella protothecoides
cctccccctaaccctcccctccctgttgaggggtgtagtgtcgtgtgcacccccctccccc

SEQ ID NO: 44506 - DNA, 74 bp, Chlorella protothecoides
tatatcaattactatcatgaaaatatacgttctattatttacgttttcctgttcgtgtcgttatattttcatta

SEQ ID NO: 44507 - DNA, 61 bp, Chlorella protothecoides
caacgctggtgtgagagaggctggggccgggggcgttcgtaggatctcaaaggctgggccc

SEQ ID NO: 44508 - DNA, 61 bp, Chlorella protothecoides
tgattttgcaatattttactggattcctggcatattttggtttagtttaaaagtagtgttc

SEQ ID NO: 44509 - DNA, 9945 bp, Chlorella protothecoides
  modified_base (95)..(118): a, c, t, g, unknown or other
  modified_base (390)..(432): a, c, t, g, unknown or other
  modified_base (503)..(512): a, c, t, g, unknown or other
  modified_base (691)..(700): a, c, t, g, unknown or other
  modified_base (923)..(932): a, c, t, g, unknown or other
  modified_base (1188)..(1197): a, c, t, g, unknown or other
  modified_base (1781)..(1790): a, c, t, g, unknown or other
  modified_base (2424)..(2433): a, c, t, g, unknown or other
  modified_base (2568)..(2647): a, c, t, g, unknown or other
  modified_base (2850)..(2859): a, c, t, g, unknown or other
  modified_base (2939)..(2948): a, c, t, g, unknown or other
  modified_base (3028)..(3130): a, c, t, g, unknown or other
  modified_base (3625)..(3634): a, c, t, g, unknown or other
  modified_base (8558)..(8567): a, c, t, g, unknown or other
aggccccccgcagtgccccctgtcgcccacccccgcccccttcccccacagtcccggcaaccacccaccccggtagtcggcgtgcatgtcggcgnnnnnnnnnnnnnnnnnnnnnnnncacgcccccttcccccacagtcccggcacccacccaccccggtagtcggcgtgcatgccggcgtaggccgcgccaaagtggcgccactggaagccgtacaccggacccaggtcgccctcctcgcggtgtcccaggccgcgcgcgtccaggaactcgcgcgacccgttgccgtcccagatgtgcacgccgcggtcggccagcaggcgcgcgttggtcgcgccggagacaaaccagagcagctcctcagccacgcctgtttttgggggggggcnnnnnnnnnnnnnnnnnnnnnnnnnnnnnnnnnnnnnnnnnnncgcgggtgcaccggaggggcggatgcaccgggtggcagcatgctgctgtcgaccctgagcctggggatgannnnnnnnnnggcagggcccgggcgcgccggaggggcgggtgcaccgggtggcagcgtgctgctgtcgaccctgagcctggggatgatggggggctgggcggggaggcgagcggccgctcagcctggccatccattcccccggtcctctcctcatccgagcctcggcaggggagctgcttgttggaccnnnnnnnnnnacaatccattcccccgatcctctcctcatccaagcctcggcaggggagctgcttgttggaccgcggcgctggcatcgacgacctttccccccaacagcccgacacacacgctcctcggcccccctctcccgcaacagaaaacaacaacaaaacagagccgaaaacagcgccgctccgcgggctgcgcggcgtcccgcgcacccctccagaagacgcgcttggnnnnnnnnnncccaccctcccccgcaacagaagacaacaaaacagagccgaaaacagcgccgcgcagcccgcggcgccggcgccccgcgcacccctccagaagacgcgcttggtggtgagcagggggaaggtgtggcgcaggttgaagcgcatgccctccccgaacagcgccagggttcccgtgccggtgcggtcggcgcggcacgcgccgtgcgccagcacgcgtcgcaccaggcccaggtactgctgctcctcgtggggcgcgnnnnnnnnnnagccagggttcccgtgccggtgcggtcgccgcggcgcgcgccgtgcgccagcacgcgtcgcaccagccccaggtactgctgctcctcgtggggcgcggccagcgcggggggcaggcgcgggggcgccgccgcgccgcgccgcgtgtagcagaggaaggcgtagcgcgtgccggcgtcgcggcgcggcgcgcccgcggaccacagccgccactcgtcggcggggagcggggggaggtgggtgtcgcagggcgtgtcgacctccacgcgcgtcaggtgcaccgcgtccagcgcgggcgagcgcagggcctcggcgtacacctcgccgccgccgatgacgaagaccgactccaggcgcggcgcgtaggcgggcgaggcgagcagggacagcgccgcggacaggctgggctgctgcagcgcctcgcaggcagggggggcgggggcgccgggctggccgcctgggggagtggaggagggtgggaggaggggcctggacgggaggcctgcacgtccacggcgagtgcaggggaggggaggaccatgcagctcccccactgcaaggcaccggcccacagcccagtgcaatnnnnnnnnnntggaggggaggaccacgcagcacccccaccgcaaggcaccggcccacagcccagtgcaatgcagacctgcatgctcaccattccccaggatgctggtgttctcccccgaggcggagcgggtgaggatcacgttgaggcgccccggcagaggacggaacttggcggggatgctctcccacgtcttccgccccatgatcaccgcgttccgcttggcggggtccgctgtgcggcaggtgagctccttaaagtaagccatgtcgccagggagtttccagggcagggtgcctcctgtcggggaggggtgtgcgtcacggagttcagggggccagcggtccgacacgcagcctcctggtccacttcagcccgacgatgcggtcggccgctctgccttcgtacctttgccgatgccgagttggcgggtggcagcgaccacgatctggaacgtggctttggcaggctcccccatcccgtggtttcacgacgctgcaccgcaagcaaatgagcgtggcagccgcactgccgcctgcctcgccgttgcacacttctcagaaagggtggtatatcgaatgcgatgaagacgcagttgtaagagtggggtaacgcgcgcgtccggggacctgcacccactcgattnnnnnnnnnnggaagacgcaggtgtaagagtgggataacgtgcgcgtccggggacctgcacccactcgatttgaaagtcgcgcgccacttatggggtacttccccaggcagggctctcgagggtccctgcattgtgggtctgttnnnnnnnnnnnnnnnnnnnnnnnnnnnnnnnnnnnnnnnnnnnnnnnnnnnnnnnnnnnnnnnnnnnnnnnnnnnnnnnngttagatttaccgcgagtactgctgactccgtgtggctgtgagtttacttcacatcgtggctgcatgaggcagtagccgtatgtggacagctccaggggaagtcatcgactccttggggaacaagttgattggagcatcacattgctcagcacatgaacttcctggtagattagcgtcaccttgcggcttgagatatggtacnnnnnnnnnnttgggtgatagtggattggagtgcaccttcagcatgtcgttccttgaaatatgaatcacagctcggatgagattacagtnnnnnnnnnnctgggtgatagtggatttgagtgcacctccagcatgtcgttccttgatttatgaatcacagctcggatgagattacagtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntagctccagggaaagtcatcgactctttggggaacaagttaattcgagcatcacattgctcagtacatgaacttcctggtagatgagcgtcaccttgcggcttgagatatggtacatgtcattggcgtctgaagatgcgagcggagaatgaacatggaccctcctcacatcccatgtacttctgaatgtcgatcacgagaccaagacgctgctcccaagcacattttactgccgctcggaggaggacaacttcaaagtgggcgggaggggggagagcctgcatttgtactgtggccgtgctccgcctgctatgctacggtctcccgtggggggccatggccaaaaattggagaaccttcgaatcgcaacacctgtccgcaacgcccacatatcttcgccccataggctcagatctaaccgctacacctcgattttcttttcagaaagagccattaccaaggaaatctcgacgccggacttcgagatctgccctgnnnnnnnnnnggcctacatatcttcgccccgtaggctcagatctaccgctacacctcgattttctttttcaggaagggccattaccaaggaagtctcgacgccggacttcgagatctgccctgagctatcgcacacccacaccgctcctggccatcgaccatggctgaccagctcagcaagctcgtggaggtgattcatggggaaatcgtgaccctttgcctgcctagacagctggcgtgccggcctggtaagctcctgtgttttccccctacaggagggtctgcattccaacaagaaccaggcggagcgcgaattcctcctgaagaatgtgaaggtgcgacggcaagctgtgtggagcatgttagcgagctgatctcggtgcgtccaggctctttcccaagacatcccgttgacagcctaggtcccctcccacattcctgcagtcactgccaggtgtgtactctgccccatcccggcctcgctactgcaaggccctcttttgcacggcagtgattgccactatattcctggcagctgccgtcttgtacaaccgacccgaatacattggcctggaaggtagatgtgggcgcctggttgctggggggggtgggactccctgcagagcctctcatggtttgcatgtggatctatgtactcaagtgcacaggatgactgacaatagatctgtctccgaaagagcctcaccgtaagatttattgggtgtcaaacagtgatctcctgtccaaagttcagctggtaatgttttacatcaccttttcactcacccattgacagatacacccaaggctctggaagccagcaatactccagccaatgctgcggcggcatcagaagatgccaaatctgccagccaagacacggagagcgagcccacattggttgaagatgctggtacagagagtgaggaaggtgagctcgggaaggaaaaggctgaagccacatctgagaccactctcgagtcaaaggaggaatccactgcagtcgaggacgccacaactcaagcaagtgttgacgctaacctcaaagagttgaagaaagaggctgcgaagaccaacgaggaagcagccgctgctgtgcgagaggccgaggctgaagcggtggaagagcaagctaccactgaagaagcaactgagggagaggcagcgaccgcccaatcggagactaccaccgctgaggctgacacatctgctgctacggcggagactaccgccgctgaggctgacacatctgctgctatggcggagactatcgccgctgaggctgaagcgtcggatgctactgttgagggtaccgctaccgaggatgagagcacggctgctgaggccgagaccacccctgccgcaacagaccccactgatgctgaggccgagaccacccctgccgaaacagaccccaccgatgctgaggcgacgaccacctctgctgaggcaacgaccacctctgctgcggcaggagagagcggggctggcacggagcaggctgggggtgaggcaggtgacactgctgtcggtgccgagcaatctacctccactgtagaggccgaggctgctgctgctgcagcgaccgaggccgcgagtgcggccacagagacagctgcggaggcgacgacaaccgcgcaggaggccgggaagagtgctggtgaggcagcggaggacgctgcaggcgtcagccaaaaggctgcaaaggatgcgacgggggtggcggagctggctgctgatgcacagaaagctgctggcaaggtctagcagggtgctgctgatcgagagggaggatctgtggacggcggcaagtccaaagcaagggacgctgtagaagaaggatcagagacctgacagcatgtccgggccctttgggtgcacagggcatcctgagctcaggctctcaaagccgctaagatcgcacaacattccagccccaacatgcagcgatgatgcgcggtcacagaggaacgcggatgtggagctgcagactgcatgcctttgctggggcccctgccatgcacgggattgctccgaatattcccgaccaccaccttgattttatctcagcatgtctacatctgtatgctgctcaattccatgtgtttggttgtatgtgcagctcaattccatgtgtgataagattcggttgtattgtggggaccacaccttggcagtcactgtccatgatctccaatgaaggaaaaggtggagtgtgagaatttgatcaaggtagacatcctggtaggccaccgccacagagaaatgaaaactggattgccatgtggagtattaactccgccggatgcaagagcaaacgtgcggggttgtgacatgctcagaatcagacggccccaaatgaagaggatactttgtgacccttgggcagagatccacacttcgcaacccttcagaaatgcggtgagggagaagtgtgggtcctttccgagggggcacccaagagaagcacaatcaacgattgcctgtgataacacggctggcggccaggcgtcgactcataactaacctgcaaatgacagcgggcagcaacaaagcgtgttgaattcgatggtgatactgaactggcatccgcttctcggcctggtgcgcaggcgcctatggattccagaatgcttgcgtctgggcggtgtccacatgcactacggcttcaaaacaagtttcagctgagcccaagacaagaattcgttgccgcgtggtggatgattctgtctgtcgcgcggggctgcgtgaatcctgactgaggggctgttcatgacctgcacccattcagtgacttgccataacactggcgatcaacacctgatcgccaaagatgtgtgcgccgggttcatgcaatgatcctctgaatataaacatcgctatgccacattgtgccaggcccatttgtgattgatcaagcaacgcgcttcttcgggcatttgaaatatgacacgaggtgtcccaattcattcaaaaagggcatccgtacaccccgtggaaaacctccacatttccgcgtggcactcagcgagctgcgcgggcacgtgagctcatgggagccgccaagaaagcgcatataatgccgaattcccgggaaaggttacctacagacaacttaccattaccgatacaaacttcctcagcaaaacaatcactttcttatccggcatcttccactctttgtgagagtgtcttatacgaccatggctgggaagatgtccgccctgtttgttgtatgtgtggcgctactcgcgctgagccctacccaggctgccagagacatcgtggacctgcaggagtttggtttgggtgagtacatgctcacatggaggtcgcggaggtggttcgtggttctgaccggcatcaacaccccgcgaaccgccatgcttcatgcaagacccatcctgcgcgaaatgcacctccatggggccaatcgaggggcgtggttcaatgctcaacatcctgcattgctttatcccatccaggacgcgtggacatgggggccctgcggaagctgacgcagtttaacttcgggtcggactcgccctcgggcaccgacggctcgggtttcgacttccctgggaacaacccatcttcccccccggaggcgtcgtcccctgcttccgtgcccagccccccttccagcccttcccctagccccgcctccgctcccaccggtgtgtccgcttctgacaacggtgatggcaccgtcaccgtgtccttctccagctccggcagcagctttgtggccgaggcagtgcccgcgggcagcagccagggcagtgccagcaacccctctaagtcgggtgagtcaacagttggttttggcatagtgagagtggtgtactgatgaggcagatttgtgacagggttgttactggctcggctgtaagctgtttctgagttgggcacctctgggtccacgattcagagttgttctcccccattggaccgcaaacctgtagcatcagcaattttcttcactcaccccctccctgccacaccctgcttgaacaggaagctccagcccaatcaccctgtccacctctgacggtctggagtccggcaccacctacaccttttacgtcaccctgaactccgacggccagtccctggtcagctcgcccagcagccccgtggccttcaccaccggctccgatgcctcgcccgccgccgccaatgcctcgcccgccgccgccgatgcctcgcccgtgtccggatccggcgcctccccagtctccagccgcctggccgttggccccgcggttgagaccggcgcctcccccgccaccacccagactggcggtgcagcccccgcggccgagggcgacgtctccgccatcgccgatgcggaggccaacctgggcatcgcctccaacctgggaggcgacgacaccgatggcgaggtggacaaggcctttgttggcagcgtgtccgaggccagcacccctgccgacgtggcggctctcgtctctgggaagtccggctccgtcaagtcctgcggcgtggcctttgccgcgggcatcaagtccggcaagagcgtgaccaccctgtgccacgggtggggcacggccgtgatcgaggccgtgaaggagggcaagaccaaggacgcgctgaacatctgctcctcctccgtcattggcatcgtgctggtctccgtcaacgtcagcgtcactgtggccacccaggcctgcagtgagctggtcatcttcatcatctcctccggcagctgcaccgtcatcgtcaagcagttcatcctcaacctgttcagcatcatcatctccatctccaccaagagcacggcctttgtcatcgcctgattcggtactatggccctttgtatcgcgtgtgtgttatgaagtttcgctcccccctcccagctctccattcttcctgcacttccccctgctgctgcgggggcattcgtggtcaannnnnnnnnnacccctcccagctctccattcttcattcacttcgccctgctgctgcgggggcattcgtggtcaaccctcaggaacatgcctgaacgtgcacctacttgtagatgagcgacacttcaccacggaagagcgtgcaagcgatatggtcggggtacttgcagagtatgcatagtactatgacgtctgccatagttaattcatcgcaattggcgggcaatcacagcaaaactccagacacgtggagaataaactcacagccacatcccctttttgagtagagttggtaaacaacaagttcattagggagtacacgaagcacgtcacacttgaatgtgagatggtcggaagcactcggagcgcaacttcatggcgttcctggtcggacgagtcgtacgcatgcaggggaaaatggcgcatgggacagctgcccgtccgtacacgatcggaggtggggaagctggctccataccatcgaacaaaccttggaagtcaccctcgagtgcgggctgcattcccgtgcaggtggcttggcccgggggcagagcaaccccgaccccgcacgctgcccttccatcgtgggcgacatggcaggccccgtgcacaagcacagatggacaacccgatcacttctagctcattactcggtgggcgccggcatagtcgtccgtcggtcaaatccaggatgctgcatccagggtttgccagcacgagcctaattcagactgtctaggggccgggaagctggctgctgccgaaaatcgatgcgccgcccacgctgccgatcacgcaaagtacccttcagggcgtcggggctgcgattgcagagtatgcatgtctctttcaagcacttttaccgtcacagagggagagcgatcagggggagagcctcaatcgtaccatccaagacttctgatcactggcaggccttttgccgcgtagcagtcgaccccggtcatcattgaaggtttgcgcgttgtgataccctttaagacgtgaactcgatcgcctatctcttcaaacccaaagtaaagacacgaatcacacattatatcaccatggcgcgcttcaacaccgcaattctgctgctggcagtgatggcttttgccgccgttcaaggtacgaggtgctcatgggcggggcggctgatactggcgtgatcaggtcaatacgcataccgctgacgcgttcgatcatgcactgcaggccacccggacaggtacctgctgcaggactcgccggtgccggcgccgtcccccgaaaccgtgacggagagcccgtctgacagcccctctccctcaccggacgcttcctcttcccccgggacaagcagctcccccgcccccacgccctcccccgaggcatccacccccaccccctcccc

SEQ ID NO: 44510 - DNA, 95 bp, Chlorella protothecoides
ctcgatggtctcctgacgggtatcgcccagatcgaccgaggcgcggcgcggcacgcctcacccccggccccgatcccctgcccaccacctctcac

SEQ ID NO: 44511 - DNA, 61 bp, Chlorella protothecoides
ggctgagaggggttcgtggctgggcagggggccgagctgggccacagcatgccggcctgac

SEQ ID NO: 44512 - DNA, 446 bp, Chlorella protothecoides
  modified_base (124)..(264): a, c, t, g, unknown or other
cggcctgcggcgggggcctggccccggggacgcgcctggccgcggcgcagacctgtttcgagctgctgaggtattcggcgtcgggcgaggcggggggcggggatgtggagggtgcggccgcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctggaggggcacggacgctggaggcctcgcgctcgcttgcgaggaggcgctcgacgccgtgcacgcgctgctgagcgccgcgcctgcaccggcggggggcgcgctcgtcgtgctgcagaggacggagcccgggcccgagcctgccgccgcacacgcgccggccgcgagcgcgtcgggcgtg

SEQ ID NO: 44513 - DNA, 61 bp, Chlorella protothecoides
cagacccacccagcagacgtagagcggcggggccagccgccagacctgcgcccatcaccga

SEQ ID NO: 44514 - DNA, 3411 bp, Chlorella protothecoides
  modified_base (144)..(198): a, c, t, g, unknown or other
  modified_base (626)..(635): a, c, t, g, unknown or other
  modified_base (1657)..(1666): a, c, t, g, unknown or other
  modified_base (1914)..(1923): a, c, t, g, unknown or other
  modified_base (2649)..(2658): a, c, t, g, unknown or other
  modified_base (2764)..(2950): a, c, t, g, unknown or other
  modified_base (3095)..(3327): a, c, t, g, unknown or other
gccgacgcgctggccgcggcggggcgcgcgcccgcgctggcggcgctcaccgcctacgcctcggccctggcgccgcgcttctcgcaggccgacttccggcacctcagcctgcttgcggcggggctggagtgagcatactgtgtnnnnnnnnnnnnnnnnnnnnnnnnnnnnnnnnnnnnnnnnnnnnnnnnnnnnnnnggttgtgtgtggggggttactcctgggagggcttgcctgccgactgcctccccttggcgcccccccctgctgtcgtgctcgtgggttgtaatggcgatacagggaaccccggggtcgaagcgcgactcccgacatcgccccagcacagccttgggaacggatgatttgcaccgcgccggggcgtgctcgcgatctttcctgcagtgtcacgaggctgtgactcaaagcccagccggagtgaaaggggggcacacggaccccgggggctcccgagccgtggtaccgctgactggtgcacaagcgacgagcttcgggggcatgcagagcctgcttgattgagctgtcgacggtgaacaggctcacatcgacaaaaggtgcgctggtccgtgtggggggtgaaaggggaatcggagtgtgggaggcaacannnnnnnnnnccgacggtgaacaggatcaaatcgactaaaggtgcgctggtccgtgtgggggggaaaggggaatcggagtgtgggaggcaacaccccttgcccgggccgctgggaaggcaccctgggatggcctgggttgcgccgtggggcacgcaccggcgtcgggctggcatggtggccggcatgatgacacatgttgcaagcccttgcatccaacatggtgatgtcgcttcccctgcacacgcgctgcggccctggtgctcgcccagggcgatcccaggccagcttgacccctccaaccgccccccttcctccgccgtgcgacaggcggagcttgcttcgatgtcagagatatccaaagccgacgaaattgcagtcacatccccgccgctgggggtgccaacggagggctcgcagactttgcctgctgatcacggcctgccctcgagcctcttcctgcccgtcgggcctagccccgccgcttctgctgcggggacgccgcgcacgggcagtctggcagggtccatcgacctgctggggcccagcacgtatgcaggctcacctgcaccctcgctgactgggcaggtgcacctgcctggcacccagagctttgatgcgagcatgcgccagaatccttctcccagcctgaccccgcacgtgagtctctggtggggcaatgtactgttgaagcttgggggtgaggaggtagtcggcgattgggtggctgtaccgcgggcgcactgaggactctggtgaagattctgtgatctcgagccacagtacccgtgcatgaaccaatctgaaaccctctcctccacgtcaacaggggtatggaaacaccagcaccgcacagcaggctttccggggcgcccatggagccccgcagggcaacggggtttacaccaaccaggctgctgcgctgcagcagcacatcctgcagcagcagcagcagcagtatgcgcagtccggtatggggagtgtggatggcggcatggtggagtcgaaactagaggggttcagagctgcgttcnnnnnnnnnncagcagtatgcgcagtcaggtacggggagtgtggatggcggcatggtggaatcgaaactagaggggttcagagctgcgttctcatggcgcatcctgcctgcttggttcatgctgtcctgctggcttggtgtaaatgtacgggtgcaggagtgtgattcgcctgtactccaaaccctgttaagtcccaatactcctaaccccctggcacctgcccactcccattgcaggcctgggtggacagtacggcnnnnnnnnnncgtacgggtgcaggagtgtgattcgcctgttctccaaaccctgttaagttccaatactcctaaaccctggcacctgcccacccccattgcaggcctgggtggacagtacggcagtgcctatgccgcgcagcagcagcagcaagcggcggcggcgcgcgcctacggcgctcaggccggagctggcggcctgggcagcatgcagtcgctggcggtggcgcagcagcaggccgcgttgcgccagcaggcgctgctgcgctcccaggcccagcaggcgcagcaggcgcagctgggtgcggcgtacagcaaccccgcgctgcttcagcgcctgctggcgatgaacggcggcgcggggcaggctgcggctgcggcgtcccaggcggcggccgccgcgcaggcgcagagccagaaccacctgctggcgcaggcgggcctgctggcgcgcgcgggcctgctgtcccccgcccagcaggccacgctgatggcgcagatgggcctcaccggcgccggcgccggcggtggtcagcagtaccagggcggccagcagcagtacggcgccgtcggtggtcagcagtaccagggcggccagcagcagtacggcgccggcggccagcagtacggcgccggccagcagcagcagtatggtgccggccagcagcagtatggcggccagggcgcggggcagtatggcctgggcggcggccagtacggcggccagggcgctggctnnnnnnnnnnggcgccggtggccagcagcagtacggcgcggttggccagcagtacggcacgggtggccagcagtacggcgcgggtggccagcagtacggcgccggccagcagcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgggcgccgccagctccaccatggtccagcagctggcgctggcgcaggccatgcgcggcgccggcggtgcaggcctcaacggccgcggcacgggcgcggcgcagcaggccgacgggctggcggcgctgcagcggcagggcgcgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagcctgggcgccggcatgcgtggcggcgccccatatgccgctcagggccgggccgcagccggcggcccgacgggcccgacgggc

SEQ ID NO: 44515 - DNA, 61 bp, Chlorella protothecoides
gcgggaatagtactgcggtgggtgaccacgggggaagtccccgtgacgaactgtttttgtg

SEQ ID NO: 44516 - DNA, 412 bp, Chlorella protothecoides
  modified_base (131)..(287): a, c, t, g, unknown or other
ggttgagagggagggggctgggaagaaggggttaaatttgggggggggctagcaagggaggctctgggggcccgacagcgacgaaagtccgcacgtgaggctttcccaccacggggcactgggagctcctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacaggtccagcatcgcgccggcgcgtaccgcgctgcgcgctctgcgctcgcgcctggaggccgcgcaggcggcggccgccgcgcagctgcgcgccgtggccgaggtgcgcgccacctgcgcggag

SEQ ID NO: 44517 - DNA, 61 bp, Chlorella protothecoides
gcagggggaaagagtatgtgtcacggctgggggggacctgggcttgtgatcaccaattttc

SEQ ID NO: 44518 - DNA, 61 bp, Chlorella protothecoides
ccatggctcaagtcgccgcggagcggatgggtcctatgcagccgtgtgaggcgtcctacgg

SEQ ID NO: 44519 - DNA, 61 bp, Chlorella protothecoides
agatgtgttgatgaaggtggggttgggggggggggggaggaattgagcggcttggggggga

SEQ ID NO: 44520 - DNA, 61 bp, Chlorella protothecoides
ccatgtctgagacacgcccctcggtggtcttgcgcgcaggtagacgccgcagtgccccatc

SEQ ID NO: 44521 - DNA, 61 bp, Chlorella protothecoides
gaagggtgtgctgtacaggctaggagggggggatggacacgctgccttctttctgaggaga

SEQ ID NO: 44522 - DNA, 61 bp, Chlorella protothecoides
ggcagctcaattgccgtgtcaatgggggggggcttaggcaccaaagtctgagggctagtgc

SEQ ID NO: 44523 - DNA, 61 bp, Chlorella protothecoides
gaagaagcggcgctggcggggatcgcgcagcaccttgtccgacaggaactgcttgtacacc

SEQ ID NO: 44524 - DNA, 71 bp, Chlorella protothecoides
ccggccgggccctggcagcaagctgcacgctctccagcccagcccccatgcccgtcctcgccaggaggaag

SEQ ID NO: 44525 - DNA, 101 bp, Chlorella protothecoides
ggagggtcgaggtcgtgcttcattgagccgggcatgcccggccccggatccggccctggagccgcccgtgcagcgacgtcggccgccagcgccgtcagcgc

SEQ ID NO: 44526 - DNA, 33162 bp, Chlorella protothecoides
  modified_base (162)..(241): a, c, t, g, unknown or other
  modified_base (676)..(685): a, c, t, g, unknown or other
  modified_base (760)..(769): a, c, t, g, unknown or other
  modified_base (844)..(853): a, c, t, g, unknown or other
  modified_base (1046)..(1076): a, c, t, g, unknown or other
  modified_base (2391)..(2400): a, c, t, g, unknown or other
  modified_base (2954)..(2963): a, c, t, g, unknown or other
  modified_base (3501)..(3510): a, c, t, g, unknown or other
  modified_base (3960)..(3969): a, c, t, g, unknown or other
  modified_base (4239)..(4248): a, c, t, g, unknown or other
  modified_base (4876)..(4951): a, c, t, g, unknown or other
  modified_base (5033)..(5042): a, c, t, g, unknown or other
  modified_base (5708)..(5717): a, c, t, g, unknown or other
  modified_base (6113)..(6122): a, c, t, g, unknown or other
  modified_base (6489)..(6498): a, c, t, g, unknown or other
  modified_base (8179)..(8188): a, c, t, g, unknown or other
  modified_base (8513)..(8522): a, c, t, g, unknown or other
  modified_base (10162)..(10171): a, c, t, g, unknown or other
  modified_base (10628)..(10637): a, c, t, g, unknown or other
  modified_base (12060)..(12211): a, c, t, g, unknown or other
  modified_base (12292)..(12301): a, c, t, g, unknown or other
  modified_base (13051)..(13060): a, c, t, g, unknown or other
  modified_base (13318)..(13327): a, c, t, g, unknown or other
  modified_base (13567)..(13576): a, c, t, g, unknown or other
  modified_base (13662)..(13671): a, c, t, g, unknown or other
  modified_base (13742)..(13751): a, c, t, g, unknown or other
  modified_base (14081)..(14090): a, c, t, g, unknown or other
  modified_base (14309)..(14318): a, c, t, g, unknown or other
  modified_base (15160)..(15169): a, c, t, g, unknown or other
  modified_base (15724)..(15733): a, c, t, g, unknown or other
  modified_base (16236)..(16245): a, c, t, g, unknown or other
  modified_base (16985)..(16994): a, c, t, g, unknown or other
  modified_base (17851)..(17860): a, c, t, g, unknown or other
  modified_base (18292)..(18301): a, c, t, g, unknown or other
  modified_base (18466)..(18475): a, c, t, g, unknown or other
  modified_base (18687)..(18696): a, c, t, g, unknown or other
  modified_base (19023)..(19032): a, c, t, g, unknown or other
  modified_base (19509)..(19518): a, c, t, g, unknown or other
  modified_base (20276)..(20285): a, c, t, g, unknown or other
  modified_base (21117)..(21126): a, c, t, g, unknown or other
  modified_base (21519)..(21528): a, c, t, g, unknown or other
  modified_base (22288)..(22297): a, c, t, g, unknown or other
  modified_base (22505)..(22514): a, c, t, g, unknown or other
  modified_base (23557)..(23588): a, c, t, g, unknown or other
  modified_base (23784)..(23793): a, c, t, g, unknown or other
  modified_base (23849)..(23858): a, c, t, g, unknown or other
  modified_base (23914)..(24017): a, c, t, g, unknown or other
  modified_base (24598)..(24607): a, c, t, g, unknown or other
  modified_base (24675)..(24684): a, c, t, g, unknown or other
  modified_base (26370)..(26379): a, c, t, g, unknown or other
  modified_base (27194)..(27203): a, c, t, g, unknown or other
  modified_base (27412)..(27421): a, c, t, g, unknown or other
  modified_base (28530)..(28539): a, c, t, g, unknown or other
  modified_base (28841)..(28850): a, c, t, g, unknown or other
  modified_base (29649)..(29658): a, c, t, g, unknown or other
  modified_base (29732)..(29741): a, c, t, g, unknown or other
  modified_base (29885)..(29938): a, c, t, g, unknown or other
  modified_base (31015)..(31024): a, c, t, g, unknown or other
  modified_base (31198)..(31207): a, c, t, g, unknown or other
  modified_base (31819)..(31886): a, c, t, g, unknown or other
ccgggggcggctgtgcagcgagcggcgctggcgacagatgcaggtgacggcgctcggatgatgcaggccctcgagcggtggcccgcgcaggaggccgcgcaggaggccgtgtgccaggcgcagacctctccacgagcagtcgccgccaagcggcggccgggnnnnnnnnnnnnnnnnnnnnnnnnnnnnnnnnnnnnnnnnnnnnnnnnnnnnnnnnnnnnnnnnnnnnnnnnnnnnnnnnggcccaagggctcgaagaacaagcccaagccggatgcaaagggtgggcgcggcgccgcagtttccacaccacgaggcgcccaggggcatggaacaggcgaggcgccggggctggcggcgctggcggccgcctccggcgccatggccgccgcgggagggcgcggggggctgcgggagcgcggcgtgccgtcggcgccctcgaccctccccgcggcacccgggggcctggcacggccgccctcccagatcgggacggtgcagctggaccggcccgagcgctgcgggacgtgcatagcgtgcacgggcggggaggaaagcggggagtgcgtcaccctgcaggccctgcgcatcatgctgggcggcgggcagcagcgggagacggctgccccgcccgcggtgcccgtagccaaggggcggaagcggcccgcaaaagccnnnnnnnnnnacctcgtgctcgccgcaggccccgggggatgagggccccccccccgccgacgaggcctggacgcgggagcaggtnnnnnnnnnntcctcgtgctcgccgcaggccctgggggatgaggggcccccccgcgccgacgaggcctggacgcgggagcaggtnnnnnnnnnngcggctgccccggccgcggtgcccgcggccaaggggcggaagcggcccgcaaaagccacgcgcggcgccggtcctgagccggcggagcggagcaagagggccagggccgcccgtcccgagtccagtcgctccggcagcgaggaggcggcggggggcgacgggtgctcgagaccaggggccccgcctgcgtcannnnnnnnnnnnnnnnnnnnnnnnnnnnnnngcaggccctgcaggccgcatgcctgcaggtggaccccgccaccacaaacttctggagcgtcgtggcggcaaaggtgggcggagctgtgggggccgggctggcgaaggctggggggcggggtgggcctggccagggaaccagaggccgcatgccggctggctcggcgacgtggcggccaggcgcctctggggttcgagctcggcttgagggcacagcaactcgacaaggaacccaccccccacgctgcatgaccacacgcaggtcgggcgctcggcggcggagtgctcccagcgctggtacgacgcgtgccccacgccggggaccaagaggaggccgccggcccccgccccacgacggccgccgcgtctggggcccagcggggcgccctccaaggcagccatgcgtcgcgtggtgcgcctggcccagcgcgaggcgcggtgggagggcgaggcggcggaggccagccccggcacgctggagcgagtggcggagcgccgcgcggagcaggcggccagggacaagctgattgaccagatcttcagaaagcgcggcgggcaggcctggggcggcgtgctggcccagggcctggcagggccgcgggcgagggaggctggcgcggcccagctggaggccggcgatgcgcagcgggcggtgagggggttgctggcccaggagccggcgcccgccctgtccgacgactcggaggaggaggtggactactactggagcgacgcctgaggcgatactgtccttgggttgtggcccggccgaccgtgtccctcaaggtatccatgctgggacactcgccctccccaaccgcacgcgcagcgtgcccgtcaccgtttcgggcacgggggttgtagcccggatccccgcacttgttgcactctctgccccatgcacacgcatgcatgctacccctgcattgaaatcctcatgtttaatggtgccagcagctctggtcatgtaagctgatcacgtcgagccaccattcgatgctgcggtcggggtccggcaggagccgtgcgtgcctggcccttgcccggcagtttgcttgctgtgcaggcagtggcgaggcagtgggtggcctgcagttcctcccgccccgtccaggcacggtcaccccgtacgaccagcacctgctcatcagcctgcccggtctgcatggggggaggaatccaggcagtgcctggccctccctcgtggagaggtgagccctgcctgccctgcctggagagtttgaggagtgcgacatcttcatgaatcgatgatagggcttatcttgacatgctgttcagcggggcaggcacctctnnnnnnnnnnggcctgccctgcctggagagtttgcggagtgcgacatcttcatgaaccgatggcagggcttatctcgacatgctgttcagcggggcaggcacctctggctcttcccgactcgggccacacagctcaccctccgctcaatcagtggcctcatcaacgattcgcacaggcacccggcggccttgctggtgttctctgccctggcgcgacacaaggaactcatcagctccaaggtgaaggtcaccgccatggagggcggcggcctgcccgccccggccgccggcacctgccacctcctcgccttcccggcgggcctgctctacacctcgctgcccctgcccaagctgggccaggcggcggtgcacgccgtggctgacgacgcccgggcgctgccttcgctggaccgcgccgtccgcatgtgccaggtgagggagagcccggtggagggggaggcctgggggcgattgcctctgtggcggggtgaaccctcctggagaatgggaggtatacggtcggccacggtgggtgccaacctgcgccgcaggttgtggatgccnnnnnnnnnncgtgggaggtatacgatcggccacggtggctgccaacctgcgccgcaggttgtggatgcctcagaccatggcatgtactcacttcttgcaccgctcatccggcccacccccctcccatctggggtgagcatgtgcgcacgccacaccgcccactccccgtccgctgcaggccagcccggccccaaagctgcacctcttcgtgtgctgccacggcgcgcgggacgcacgctgcggggcccgggggccctcgctggttgccgcgctgcgccgcgctgtgcacgccgcggggctggaggagagcgtcgctgtggccgccacctcccacatcgggggtcatgagaccgcgggcaacgtggtggcctacggcgcgggccacccctgcgacggcgactggtttggagggctgcacgccggaggggccgcggagttccttcagggactgaggaccatggaggtgggtgcggctgttggggggagatgctgggcccacgccgcttggcctgactctacaaggctgcgtcggcatgaggcagtcccnnnnnnnnnntggagtttcttcagggactgagggccatggaggtgggtgcggctgttgggggaaatgctggggccacgccgcttggcctgactttacaaggctgcgtcggcatgaggcagtcccatgtgtgacgctgcccatccatggccagcttgaatgcatgcccctccatcgcgtcatcaccgacgcttcccttcaaaaccccaattccaggtggggtgtgacgggggcgccgagcacccgttgctgaggccctggtggcgaggacgccggggactgacccgggaggagtgtgtcgcactgtttgatcgggggggcggggtggaggaagtcggcgccctggagctcgagggtgccgaggaagaggacgactggggggcgggacaggactgggatcaggaaggcggggaggggacctcgcctgggggaggcacgcagggcacatgacacgggtggccnnnnnnnnnngagacggggcggggacctcgcctggggcaggcacgcagggcacatgacacgggtggccgcgctgagtgcgacagccttgtggatgtaccacctgacaaaccatgcttcctgccctggacccttgactgtacctgagacgattgtaccatgttcacacctgctgggcgcccactggccccgatgccaagggcaaggttccatcccgacgtctgaatgggattgggtggattctgtgccacaggctccccatcaccaggctgcaactcctgnnnnnnnnnnaaccactggccctgatgccaaggcaggtttccatcccgacgtggaatgggagagggtggattttgtgccagaggctccccatcaccaggctgcaactcctgatgaacaagttacaatgatgtgaatgggtcatgagtgaatagcggcaccaagcttgctatcgggggtgcatgggagagtggcaggaaagggtgacatgctgcttgccttggcaaccatggcctggcgcagccaacagctacaatcctggcgacccggccgccaagggcatgatccgaggccggctgtcagatctggaggtcgctggacaggggccccgccttcgaggccctctcccccagctgagactttgcatggctgggcccaaacaggatgaagaggtactgggcggcggtggcgatgatgaagcctgcgaggttgaccgactcccagctggtctggagcatggggctgaagctggccatccccaggaggttggtgctgacgacggtgttgatcacgcccagcgtagccgagatgaggaggaaggcgggggcgttgctgacccagcgggagcctgtcatggccaccaccatccagatggcctgcatgatctggaagacccaggcccacctgctccaaggggggnnnnnnnnnnnnnnnnnnnnnnnnnnnnnnnnnnnnnnnnnnnnnnnnnnnnnnnnnnnnnnnnnnnnnnnnnnnnactccatcaatcaagaccgatgagcgcatggcaggaatcagccaaaccaaccacgcaccagttcagggagtacagtctggcnnnnnnnnnncttccatcaatcaagaccgacgagcgcatggcaggaatcggccaaatcaagcacgcaccagttcagggagtacagtctggcgcaggtgacgaagctggaagactgcgacatgatcttgaggacctggcggaatccatgggtggtggcattggtcaccgcagcggtaacgttggcggagagtgcagtctggttggatggcgtggccgcggcagcctccctggcaaccatgtcattgtagcgctgcagggcttgctcgttgctgcgatgggaaggggcaggggggtagatcagcattgcgcacgccgcaagggctggccatcatgcgcaagagtcaccgcatcgcgaaggtgctccatgcgcaggccggggagcaggcgaacaacatggccgctcaacctgacatcattacacgcatcccgacgcacagatctttgcatctggcttgcagtccagcctgtccgagcaggatcaacaccagactcgtgaggaggaggaagcctgcgaaaagcaatcctagacgtgccacagccatgatgagacggggtaagaagttcaaccgtcgagtatctgccgtttcgagagacccatgcagggctggggagtgtttcgtggggtgactacgcttagcgcgcgacacaacttcaagcggctccctaccctggaagnnnnnnnnnnaagtgtttcgtagggtgactgcgtttggcgcgcgaaacaacttcaagcggctccctaccctggaagctaacccagctgcgacgcgcatctagcttgcaaatatatcacctaacccacatatccaattcataggatgttgcctagaacgagagataccctgcatcttgagcaagcacacactcagtgcgccggcctcgagactcctagctttgaaaactcgcctccctctctcacagagagctactcatactcaaagctccctgataggcatccgagtcagtcaaaggtttacaagattactgagcattccactgtatgtctactgcccatatcagaatagtcggctgcgtgtgagcggctgagccatgccccaatctcggtgtcgaggactacgannnnnnnnnnatcattcaaacgttcacaagattgctgagcactccactgtatgtctactgcccatataagaatattcggctgcatgcgagcggctgagcaatgccccaatctcggtgtcgaggactacgagtcgccgtgttactttccaagaggagggtatccatcagtggaaggatgtcaacatgatggaaccagaattctactcatctgaatctgtctcggaatctgtaggtcagctgatttgttcctgcagttgggtgatgggtgtagcgctcatctgcagggcgcgcgacgaccacccttcgtctaatacgtagaatgtggaagatgcagactctacaatgaccatggctcagcatacatttctaattcgctnnnnnnnnnnaaattccattcctctgaatctgtctcggagtatgtaggtcagctgctttgttcctgcagttgggtgatgggtggagcgctcatctgcagggcgcgcgacgaccacccttcgtctgatacgtagaatgtggaagatgcagactttacagtggccatggctcagcatacatttctaattcgctgagaacatatccatgtgatgtagtgctcaccactgtgacccaaagaggatgatggtcggcgacgatgccttctccgccgtgcgctctgcactggcgaatgtgtcagacagcagtccatgggacatccatcacatcgatatcacttgcgatgggtgcgaggtagagcccatcgttggcaacaggtgagggtgggattcatgttacgagttcgaggtttgctcgtgggcaggaaacgaaagagacccagctcgagacctgggctcgacgcatacacgccacagacaaatatgccccccaaccaccactataggtataaatgcagcgtgtgcgaggaccgagacctgtgtcaaccctgctttcgtgccctggtggccgctcgagctcgttgcctggaggagacggggaactgcccacccagcacctccacaccgggtcgcacaacagccaaggtaggcatcctttggcttggaccatgccggtaaacgattcagtatgactggtgcaaggttcaatgttggcccagggcacctttattctcctctcaatcccccacacctctccctcctgcctccccttcccccctcagcactcgaggctcaccgactgggcacgctccctgcatgccgcctccgggcctgccgagcgctgggcggagctggcagctgcagtcccttgtctggacccctcgcacgtcctggccgcggtcacagcgggggcagagcgtgccgtggtcctccgtctttcgcccggtgccggcgctgaccaccccgacctcgcgcgcttcctggacgccttccccccctcacgcgcgtcctgcgccgacgtggcttggatcgggctggaggcagcggcggacgccccggccccggccacaccgaggcccgggcccggtgccgggccgcagcggccggagcgccgggtggaggcggccgtgtctgcgtgggagtccctggccgctcggcggccgcccacccacgcggacgcggccgtgctggcggtgcgcttcgacctgcgccgcggcaagtggatgctcttccccagcgcggggcgggaggccgacgccgcgtggcgggcggtggcggccgcggcggccaccggccggctaggcgacgaggtgaagatcagcggggtggcccccgcccgcgccgaccacgtgctctgcgtgtacacccgcgactacctggacgagggcgacgtggggcgtgtgcgcgatgcgctgtgcgcgctgggcctgcgcctgcgccgccggcgcatgttgtacaagccggacatccacacccacctccagctgtacagccgggggcagggcagcctgaggcccagtgtgtatgaggccgagctgccagccgcccgtactgcagcgtggagaagggaggggagggccgcccaggctgatgtccctcgatgatagagaccaaggggtgtgatcatggttcaggctgaagtaacgggtttcggctctcgttcagtgacaggtatgtgtgcatgctggtgcacaannnnnnnnnnggcctgcggcccagtgtatatgaggccgagctgccagccgccggaactgcagcgtggagaaggcaggggagggccgcccaggctgatgtgcctcgatgacagagaccaaggggtgtggtctcggttcaggctgaagcaacgggcttcagctctcgttcgatgacaggtatgtgtgcatgctggtgcacaagcagcatccgataaccaaacttgactgtggcccaacttcatttgccccaggcctacgctgcaccaagcaattcagaaggaggctgaagctgttctctctgtgctgcattggctgtgcgacgtgtataggaatgannnnnnnnnnaataaccaaactcgacagtgacccaacttaatttgccccaggcccgcgctgcaccaagcaattcagaaggaggttagagctgatctctctgtgcagcattggctgtgcgacgtgtataggaatgatccagcctgccccgagtgcagctagcagaggattctaagtcttgtcgctccaaggatgtgccgactccctgcgatcgggcgcccggacggaaaccccaccctgccaacatcaataccagtacagcacttgggcatttacaccaattcatgtgtatatccttcgaagctcagagcattgttgtgccgcagggattgcagtccagtcgcgaagcaggcgtgattggccctcggcgacctctgcaagcccggcgtagccggaatccactgatcacccgtcaggcatgccgatccgaggatttgccagccctgcagtcctgtgtccgtgacagaccccaatcctgatcaaggtggcagctcaccgcaccacccgacatgcgcgatgccgagggagcccagccgctcagccctagggtgctgggcgaggatcgggcgacccgatcctacatcctggcccccgagaccagctgccccgacgtccccgccttgctggaggtgtcctccgagccaggcagtcccctcgcacgttgcaacagcgagccggagctggcagacctggggcaccccttcctgacggccgccgcactgccaggcttggcccgcacgcacacggaggtgggctccaggatggccagcctggcgaccggcgaggcgcggcccacctccctgcccccgccccgccccacctccgcgcagtcgccccgccccgcgcccagccaaccccccgagccgccggaggtcaggctgccgaccgccaacacccgacccccctccgcctccacggcgttctgggcctacgtggggtcggagctgcggcccgccagcgcacagggcctgccggacgacgtctggggtcagacggagcgggacagagtgtacaatgccatcctggcggtgccgtaccagctcgagcgcttccagatggcaggcgtgctggtgtgcctggactccttcctttccatcttcaccctggtccccctgcgcctggccctggccctcggcgcgggggtgcggcgatccgtcgggaaccggcgtggcagagaggctgaggcaaccgcgcgcaggcaccgcggggctggggtggcgccgcttggcgctgggtcacaggggctcggtgtccggccatccaagtccaagcaggccccgcacggcgacaagcccccccaggccccccaccggccgcagccgctcaccgggccccagctctacgacctgctgctgctgggcatgtttgggtgcatgatggctttcatcaccagcctgaacgtgggctccatctactactggctcaaggacctcacccacgagttcctcaagctctccgtcctctacaccgccctggagctcagcgacaaggtgctctgcgcgctggccggggtgcctggtctttcttctgctcaccaatcaggcccctggacactatgtacctggctccctccacttgatgcacattagatcacactccggacctcccccccaccccaaaaaaactctcaagatatgttgctcctttggcgnnnnnnnnnncatcaggcccctggacactatgtacctggcttcctccacttgatgcacatcagatcacactccagacctcccccaccccaccccgaaactctcaagatatgttgctcctttggcgtggatgtgttggaggccctggccgccagctgcacgcgcgccgtggcgggcccggtgcgcgcgcccggcgccgccctggcgctggccgccgacgtggtggtgaccctggcgctgctgctgacgcactgcggcgtgctgctgggccaggccatggtcttctccgtggcgctgaacagcaagaagaacgcgctggtgggcctgctcatcgctgccaactttggcgagatcaagggtggggtgtgaagtcgcagggagacaagagggtggacggtgataccacatgaaggttgcgccgtccgtcaccctacccattcgctcgccagaccgcgagccgcccaggaannnnnnnnnngaggttgcgccgtccgccaccctgcccagtcgctcgccagaccgcgagccgcccaggaaaccgtttgcacctccgaacccctcagtccgcacccaccgagcaggcaccgtgttcaagcgcttcgacgccggcaagctgtacaacctgacctgccaggacgtggtggagcgcttccacctcatcctcatcctcgcctttgtggtggtggaggagatggggaacagcgggcacgccgcgcccaatgcggggctgctggcgcagtgcgccgagatcttcgcggccgaggccgccattgacgtggtcaagcacgccgtgctgggcaagtttaacgagatcaggtaggacgaggaggggggagggagaggttggatggggcagtaggggtggggatggggctggtaagttagggcggttgccagtactatgaagggacgtgggccccaacaagcatgcttctgcgtctctgaacatttgcatggcgtctccaaaatggtaggtacagtcccatccttgtgcctggacccctgccccgaccacttgttatcatcccattcgtcaacaccacaggccgggggtgtatcgcgaattcatgcgtgacctgagcgagggggtgggggcctccgccagcaactccagccaccgcctggtggggtttgagccctttgccgccgccgccctcttcctcaggatatccagtgcgtcccgtgggggcagtgcttgctgtacaatggctgggtctggaaaccgagggcgagttttgagagaggatgacgattgttggtagtgcatgggagtccctactgtctggcagcacgattctaggcgttgcctgccccgtttaatgcctggatcgaacatcaccaccgcccatgcagttgcatgagcgtctggctcccatcttcccctgttcccgctcccacagcaacaacccccgacacacacatacacaacaacaacttcgcagccaccttcctggcgctgcgcttcccggcttctcccgcctcggagcctggccttccagcggcgctgggcaggctcgcgctgcgtgcgctgcgcatcatgccctactgggccgtcctcatggcctgcaagctgctgctggggcacgggctgcgcctggccggccgcgcctacctgcgccactacgaggccacggcggtgcgaccccggggcagcgcccgccgcaacgtcagcgtgctgggccacatgggcgcgcatggagcggcaagaaaggacgactgagcgggctggactggggctgggggagtggcggctgaaaggtgagggggtcacccaaggtgcctgccgtcccagaggagttgccgaggattgaggcacattcgccagcccgggaggagaccccacggaatgcggcatggtcactcgccatgcagtgcaatgagctgccgaggcgtggagccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctctgagaggcaaggccagggccagggacaacacagttctgcggtgaacgggggaagtacagtcccagcctgccggcatnnnnnnnnnntggagtgcggcatggtcactcgcgctggagtgcaatgagctgccgaggcgtggagccggcatgccatgggaggcgcagctgtatgatctccacgtgcgggagcgcaccgactctctggtgccatgcccccaacccagctctgggcatgtaggcaaggatgcagagctcacagaggattgcgcggcgcagtgagagcgcaccttcgaaaggcaaggccagggccagggccaacacagttctgcggtgaatgggggaagtacagtcccagcctgccggcatgggactctaattcaggtcagggcggggcgacgcccaccaggccgagtgggagctccccctgcctgaagagtttgtccaccacggggtgcaggggtagggtgccggcgcacagcccaggcacggggtaccactggaactcgctgtgctcgtggttgagcaccggcgtccacgcctggcgatcctcgggcagcagagtggcgatgaaaacagtgaagtgcttctgtccccgcttgccccgcaccgtcttgatctcgcccgagatggtgaagggcggcaggacgcccacttcctccacagcctcacgcacggctgatgggggagggagggagggaaggaattgaccttggggcagagtcagttggaagaagagcagtgcagctccctgcgccccaccaagattggtcacgcgcagcgtccacccccttcccccagcccccatggccacacctgttgccaagagactctcgtcgnnnnnnnnnncttacgcgcagcattcaacccccttccctagccctcatagccacacctgttgccaagagactctcgtcgccagcctcgacattgcccccaggcagaccccaggcgcccaggttgtgttttgtgttggcgcgcttgagcaagagcacatgctgctccgatctgacaacgcgagagtggtaatgctcagagcacaccctcaattcatcgacactaggttctcagactcggcagcgtccaccctccaagcggaccgcgatnnnnnnnnnngatgctcagagcacaccctcaattcagcaacactaggctctcagactcagcagcgtccaccctccaagcggaccgcgatggagtacacacaacgtacgtgaatagaaggccggctccctgcttctcgatgggacccggaagcggtggcatcccgcccctcggcccccactgggggaccggagtagctttgggtcctaaggaccctgaggtgagtgtgcgcggattgatatgcttaggtcnnnnnnnnnntctcggccccaactgggggaccggagtagcttttgggttcccaagaaccttgagatgagtgtgcgcggattgatatgcttaggtcnnnnnnnnnnggcctggagtattaatcagagatgcagtcgcgttgtccaacgctcgaccagcgaattccccggtcgaatcnnnnnnnnnncgcttgaatccaagctgtaaatccattgaaaggatgccagtgatcctacggcctgcctcagtgatggggtaagcctggagcattaatcagagtcgcgttgtcgagcgctcgaccagcgaattccccggtcgaatcaggtctcatgaagattcgcttggaggacaggggtctggggaaggctacggccgataaagtctcaagaaaagtccaaaagaatccaaaccgatcaaggactattcaatgaaatgtttgcccgccctgatctgctgtttccagccctcatctgatgagttctagccgaagctgctggggtttgcctgggaacatccnnnnnnnnnnccaaagtctcaagaaaactccaaaagaatccaaaccgattaagggctattcaatgaaatgtttgccagccctgatctgctgattctagccctcatctgatgagttctagcagaagctgctggggtttgcctgggaacatcctgtgagccatgccatttctgccaaaacaagaaatgatgcaatgcttttcaagcaacacggccaaatgagacgaattgnnnnnnnnnnaatctctgccaaaacaagaaatgacgcaatgcgtctcaagcaacacggccaaatgagacgaattggtatcccaacaaattcgtctcctagccttagaaaccacgatggttgcattgcgggtcctgctcttttgccattgccgggagcccatgctcagcatgctcgagatcagctagatggcctttctcgactttgagcggatgtgcgatgatttgcatagggaagccgagcagaactcgacgtgtcgttcggcaagggcatagtgcaccaaaatggtttgtacgacggcttgatcagcgatcaggaagttgcaggatgtactcactgccagctcgtgatgagcgctgaataaataatttggtgtacatcaagaatccggcatctcactggcttccaggcaatttgacatgggaagaacgcgtttctcccagcttctcagagacttcccaatataactgatcttgccaggagctttcgccaccgtttacagcacgacacggcgacttgagggaagttcaggcatacccgttctcaggaacacaaattcaagccacggacaaatctgagggtgttgaattgcggctgcgcactctggagtcgaattgagaaacctacgcacacagtttcagaaaagtacttacatctttaccccttaaagaattatgagagaataccattttgtgggttctgttgttgcttggatcttgcagaggttttcgctgtgctgttcactgggcttgtccaatatccgtgccgtcaatatcgcccattgggcacgcttgtgagacctatcgcccttttttttatgaggggttgggtctatattggagtcttaaggggtnnnnnnnnnnatttatagcatgacactgcgacctgagggtaattcaggcatacccattctcaggaatacaagttcaagccacagacaaatctgagagtattgaattgcggctgcgcactctggagtctaattgagaaacctacgcacacagtttcagattacctacatcttcacctcttagagaattatgagagaataccattttgtgggttctgttgttgcttggatcttgcagaggttttcgctgtgctgttcactgggcttgtccaacatccgtgccgtcaatatcgccccttgggcacgcttgtgagacatatcgccccttttttatgagaggttgggtctatattggagtcttaaggggtgagctgttcaggtgaccggtggggaagcggaagccaaggagcagaggtgtgaagaaaccctacagcatgtctcacaggccggggtcgaaggaacgtgcagaagcagccatcgtgatacactcataatccgccatagcgtaagatgctagcatctattgcaaaacaagcttcttcaatatatatatatatatatatatatnnnnnnnnnnagcaggggtgtgaagaaaccctacagcatatctcagaggccggggtcgaagggacgtgcagaagcagccatcgtgacacactcataatccgccacaggctgagatgttagtatctatggcaaaacaaacttcttgaatatatatatatatttaaaagtgatataagatggtctcagaacatcacaaggcggtcctgaagggcgtgagcctgaaggctgccatcgccgagctggttgccacgacgctcttcgtatttatcggatgcgggacggcgtccaccttctccgccacccaaggaccaaagtgagtacatgaagttgtttgggccgccgtacgtggggaacaagacttcctgggccctgtaatgaagttgtggcgacgtgcttgtctgtgattctccagcttccatcaggaccgtcaggcgatgcacgggctgcgctgccgcctgtggtacatcatcgtgccagccccgcctgcatgagacccttgcatgcggcgatggnnnnnnnnnntggtggtgcatcatcgtgccagtcccacctgcatgagacccttgcatgcggcgatggagggggcaggcactagggttcaggtgtgtttgccctccgtcggcccctcccaacgcggtgtcgaaagtgtcggaatcttacccccctcccatccccttgatcctccccccctggcagcggcttcaccctgggaggtgccgaccgatccagcggaaatgttgtgcaggatataactctcctcaccgactccattctgaccaacggcaattggggagtggtgcgttcgatggttccgggtgtgatggggtagccatgacgaaggaggcgggcattccgaaggattccagcacccaggtcgatgagatcgtcggtgggcgactctcacagaccggacccttacctgcccctgcccctgccatttctgcgaaccacagactactgctctggcctttggtcttgccatcaccgtgctggcctatgccaccagccacctgtcaggtagggagtggaactggcctggaaaccaattctttcgtgctgctgagtactggacatgtgagccgggatgccactgcatccccaccccgttttcttccccagatcttttcccccctttcagttccttttccccctccccaattcctcaaacctgcccatgcctggtggtgcctcatgccatgccccccctcccctgcccccctgcctcctctcgtcccaggtgggcagctgaaccctgccgtgannnnnnnnnntagcctgcccatgcctggttgtgcctcatgccatgcccccccttcccctgcccccctgcctcctctcttcccaggcgggcagctgaaccctgccgtgaccctgggcctggtgctctccggcgccctgtccgtggcccagggcatcctgaacgcgatctcccagttcgtaggcgccatcctgggggccgccttcatccgcgccatgctgcccaacggtcggaactcggtgcttggcaccaacgccaccgcccccggggtcagcaccggcaacgccatctgcggcgagatcatcatgaccttcaccctggtcctggtggtgctggagacggccaagaacaagaagtccaccgtgtccaacaatgcgcccctggccatcggcttcgccgtcttctgcgcccacgccgtgctgctgcccattgatggctgctgcattaaccctgcgcgctggttgggccctgccatcgtgtcgggcacctgggctggcaactcctggctcttcgtggtggggccctttgcgggcgccatcctcaccgtccccttccacctcttcttccgctccgactgggacacgggccgtgtgacgggcgaccccctgaacgaggccccctccgccgctctgccctcccacatcggccaggcgccactggccagcaaccctacatacgacaaggtcagcaggggtgtcttctgagctggttcttgggatgggggaaggaggtgtacgatggggggatgattcttgccggagtgggccgggtggggttaaaaccccggcccatctcaagaaacagttctgaaggggaaagacccccgctcagccctgtacgataggtcaccaagcgccccatcgccctctnnnnnnnnnnagaaacagtcctgaaggggaaggacccccacttagccctgtatgataggtcaccaagcgccccatcgccctctctgcctgcctgtgctctgcctgtgcatcacttttgtcagacctcagcgcacacgccctgcccgcggcccctgccccacttcccaatctccctttcccttcttgtccgtccccgtggtgtctgacaccctgctgacagtcgggagggggggatgggtcttggccccgccaggccagcccagccctcagcgaccccctcttgggccccttcaccccacagaacccggagctgacgcagcgccggcccacggaggccagcgtgtgagaaacccgagagcctctccccacccatcaccccctgagaccacccctcacacataaagacgaaaattctttcgttgagtgtactggcgcccgttgnnnnnnnnnnacgctcacacatccagacgaaatttctttcgttgagtgtactggcgcccgttgaagtgcaggcacatgccctccctggcctttttggaggggcagtgagggccgccgcctttgcaagtgccggggaagacatcgggctgtgggcttgagcaccaatgttactggnnnnnnnnnnaggcagtgagggccgtcccctttgcaagtgtcggggaaaacatcaggctgtgggcttgagcaccaatgttactgggtgcatgaagggcgcttgaccgacctactacctgctttctctccctgtctgatccgttgtcctagtggatgcgcgagccgccatatgagctcggtcgaaagttgcccttctagaagctcctgcagcgtgctttgacnnnnnnnnnnttggtggatgtgcgagccgacatatgagctcggtcgaaatttgctcttctagaagctcctgcagcgtgctttgaccctctacagagtagattccattgctgcatgtctttcccgccggtgttgtctttctctctcaacatcacattcagcagaaagtcaggagtgaggatggcagaattaggctgatgtgggacgcagaagtcgaaagggacggtatacgtaatctctgcaacggtagcaaggcctgcctggccggtgcggctgatgggcaggcatgccctgccagccttcttcaaggtgaccaaaggagcaggtatagactgaagnnnnnnnnnngttgctgtatgtctttcccgccagtgttgtgtttctctctcaacatcacattcagcagaaagtcaggagggaggatggcaggatcgggctgatgtgggacgtagaagtcgaaagggacggtatgcgtaatctctgcaacggtagcaaggcctgcctggccggtgtggctgttgcgcaggcatgccctgccagccttcctcagggtgaccaaaggagcaggtatagactgaagtctaggctcgcagcatctacgccagtggcttcaagcccaggctggccctcagggcattggcctcggcgacctctgcatccaatcctgctgcctcagcaccgccacgtgactgatgagggggagggggtgtggctgcgttcctgtgcaagcttggagctgcgacagaatggcgttgagcacccagcaacacgaaccttgagcgtataacgcaaaactctgcccccccacacctcaatccatacctnnnnnnnnnnagagcacccaaaaacacgaaccttgagcatacagctcaaacctctgcccccccacacctcaatccataccttcttcacatggcgtggtggacttgggctgtcccttcttcgatcccttctcctcctctcctccctacgctcccactccctgcgaattgggggcatgcttcatcagtgacaccgatgtggctggagaatcagtggcccatcaggaccggcgggctgggcaaagagtgtggcgagagggtcacatcgccaggcatgtgcacggcacccgactccaccatccccatacctggtgtctctggggtcggggctcctgcgctccctcctatgacgctccctgtgcctgtccctggtgatgcggagagcaggcctgagcatggcatcagggcatggcaggcatcctcgcgatgagggctcctgcttctcatcaatttcttcaccaatccagcctcgccctccacgacgtcagcatcctcacctgctacgactccggggagccggggagcatgatcgactgtccctcccacgccgctctcgtcgcccctgatccacgctgtgcctgctgcgaggggacctactcctcccccgagcctcgcgggctccccagggccctccccgtccctcccggctgggactgtggtcgtcccgcctgcgcctatcgcggctggggctgcgcgtccggctcctcctcctctccctatcagccttcctttctttcttgctaagccgccaagggctagggtcccgcggannnnnnnnnntctatcggccctcctttctttcttactaagccgccaagggctagggtcccgcggacgatcgcgccgctgctctccaccagcggccgggccgatggaagcctcgccatcccgtgctctgaccgcatctgcaggcgcggcaggctctgtgggcgtggcggtctctaaagccgcgctttcctgcagcttcagtgcagctgcggcggacgtggcagcggctgccgcctccgcctgctcctcctgcaacgttggaccagcaagggagcatctgaagctactctagcccaacaatgtgcatcagggatgactgctgggtttgactgtggcagaccaggcaacgaggacctcaatgattgctggtatgcgcattgcttgcactcaaggcaggacctgccctcctacttgcatatgatagcgtggttgaaaccagtggcaatctgtagctgtactcattttggtttcccatccctccacactccgctcgcgcccgcgcgccctttcccccactctctgcctatccccatggctcaccgccagggcctgctcatcaaactcctcgtccagcaccgagacccggggctgcagctgccccgcctcctctaggaccttgcgagccggaagacgaggcagcgcgatgtcgaagcagtagtcgcgggtgagcatgtcgtcgatgacctgccatgggagtgcgatgggtatggcatggcaagtggaaaggctcggctcaaggtagaagtcagtagtctgctgcagcgcagctccttgcccaggacgcccctgctccaactcatccagccctacaagtatccctgcaggccagcccaagaggcccacnnnnnnnnnnttcctgctccaactcatccagccctataaatatccctgcaggccagcccaagaggcccacctggtcgacatagcttagcgcaaaggcgcccttggactctcggacccggaccttccggaagtcgttgtacaggggttccagatactgatatacgtcgacaggacggccgacgagccgcatgtagaatgcgcctgggggagtggggtggccaagactggatgaatcacacaaaggaagcaggcatgatgcaagattacaccaccatgtggtccttgcgtccagaggcaacacagcctctgaagctgccacttggcagcgagctctcccattcctgttgtccatctcacagtatcaaaccacctacaatggcagcaacccggctctgcgcctctnnnnnnnnnntgtccttgcgtccacaggcaacacagtctctgaagctgccacttggcagagagctctcccattccagctatccatctcacagtatcaaaccaccaacaatggcagcaacccggctctgcgcctcttgggcctcccttcctcacccaggagtcgcaggtacttgaaggcatcatccttgatgaactccacgatgatgtccttgtcgggctggatctggagcatcttcaggatgaggcagaggaactctgaaggccgctgcggctcgccgtacatcccaccagcctgcagggggagtgcatacccttgagcattttgaaccctgcatggcgcagcagcattccagagctcaaaagcatcactgagcctgacaacgtacatatcgcaggacggttcccttgtcgaccaggagctctgcggtcaggccgaaacattccgctttccaatacacagagtcatagatcttctgcctgatgatgtactccaccatgttctgagcgggggagtgcgtgggaagggtcaggcgagccaaaggtatgccttgaaagccgtggagacgacatcatcggaacgcaacgccctacggcgatcccgactcggaagcttgggtaccagaacatgcattctcacctgagggttggttccatgcaccgacttcgccatgacatctgtggtgttcgccatggcacccactgacaccctgccgggccctgccggtgctacgagggactgacgttgccgcccagaggcaaagaacgcgaannnnnnnnnngccctgccgggccctgcctatgctacgagagactaacgttgccgcccagaggcaaagaacgcgaagacgctccttacaggaaacaaggggctgctgaagtagatgtcccctttttatgtatgtgatgaacgtgttgctcgcgatactgggctttgtgttttgcccggttgcagatgtgttgaacgggacgcagcatgctggtcatgannnnnnnnnntaaggggctgctgaagtagatgtccccttttctatgtatgtgatgaacatgttgctcgcgatgctcggctttgtgttttgcccggttgcagatgggttgaacgggacgcagcatgctggtcatgagcaccgtgcaagaacgtccgtgaactacgtcactccctcttgataatgggattatttgaaggttaggaaaaaggcgattagaaggactttcatccatacaaatcctcgtgcccgatttctctagccctccctcctgcaaggcacctcccctgatattgacatacagcagggtcgatgacccattcagcttgcatggcaacaccctcctccacccatgagtgatctagaccccacgctcacgaatccagctggggttacagccaggctcgtggaggaggggacgtacgacgccctgcgaactgaatcgcttcaacagctgcgaaagcatgtagggtggggcgactgtgtgcgtggtgcagcccccctgctatgagaccgcaccagtttgtttcctcacacgaccttatctgtcacttcgcgcgcagcctgccctgcggaggcatgtggaggaggccgcaagagctctgcttcctgagcttcagaggcagggtatagagggtcggcgcaagctgttagaggagcttcggcgacgcttagagtgagctgaaggggtgcaagcgacttgctatgccgctcgtaggcagtgaagcatcgatctcctctttcatcgggatggtacaccgcgctgccttccgaaattgcccccggggcagcctcgcagatggtttcaccctccacaccaggcgatccccccaggtcagaagtcttgattaaggccatggagtgctactgggaggtgctgtcttcccaagaccatacatggtcggccaaactagaggctgagctggagtctctgctgtgtcgaatggccgaagagagcttggcctgattccgccctgccctcctgcatgcttgtgcaacgagggcaagcctcttccagagccccgattccccagtcttgtcctggggagggctggnnnnnnnnnnnnnnnnnnnnnnnnnnnnnnnncatgagcacgggagtacagaggcgagacccttgggtccattcattagatgaggggatggggacagggaaacaattttgatcgtaatacaatctcatcatattcaagtgggttgggggacaggggggaggtgactgtactccatatcctgggacagaggtgcagcggtccagaggggtgatgatccatggcgtcagnnnnnnnnnnaggctgcatatgctacttcacaccaccctcaacatgagcaggttgagggctcattnnnnnnnnnngtgctgcatatgctacttcatactgccctcaacatgagcaggttgagggctcattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatggggacagggaaacaattttgatcgcaatacaatctcatcacattcaagtgggttgggggacaggggggaagtgactgtactccatatcctgggacaggtgtgcagcagtccagaggggtgatgatccatggcgtcagcaatccccaagagaccacagagaatggtacagacatggtcccgggaataccgaggagtgagaggctgtgcagcgcaacagtcccacgctgagtggggggggggctcagaagaagggcctcaacagagaagtatctcttatggcgggaatgcaaggccgctcaggctagcctggcgccccacaaccgccctgcggcctgaccctggcgcaggatatggaacaccagagcgacagggtcgggcatgaagggcagagaccagtagctgcatggggcaaggtgtgggcaagggggtttggagttttaacgaaagggcgaggcgcgagcatgcagaggatgggctcgatgcgccacctcccccgcctgtggcaccacacaccagatgtatgcctgccaggagtctgggaaggtggcatagggcccgctggccgcgagctccatgnnnnnnnnnnacatggggattagagctggcgtggagttgcgagggtaggttggcaggggacaggagggtgcacatgcnnnnnnnnnnatttaaagaaagggcgaggcgcgagcatgcgaaggatgggctcgatgcgccacctcctccgcctgtggccccacgcaccatatgtatgcctgccaggagtctgggaaggtcgcatagggcccgctggccgcgagctccatgcttgcctgcgggcaggggagtggcgcagtgggtgtccgtctgtgatgccagagcaggggtggagaggactcaagttggtgctacgagtgggaacccatctcgggttgcctggcctctgcctcacccaaaactcctcttcactggcgtgctgcatcctgcccgtgagattcagcagctgtggagtgacgggaaggagtgcatggggattggggctggcgtggagttgcgggggggggttggcaggggacaggagggtgcacatgctgtgctgcatcgcggtgaccaggacgcgagcagacagctgacgccccactcctcgagccccaccctcccgagaaaaggcttccacaactacctcgtccgtgtccctggagatgcgatgcagggaggtgcccaggtccgaggcggcgagctgcgctatgcgccgcctccagcgaggcacggccgccgctgcgacagtcgtcctctccacatactatgtgtcaaagggggaaatgtgtcccgagggcgtggctcatccatacatggctcattgccaggttgttgcacgcatcctcagtcccaggtccatgggcgggggcaaagcgctcgaagacggcaagaggcccgtaccagacagagaacgctattatggctgggcatgtcgccgactgccgccccacggtatgaccccatcccccgtctgctgcgtttcatggcagcccctctgccagacaaccgccaccggcctgggagccctggcctccatcaccacctactcgcctttttccaggcctgcgccagctgtttcatctcgtcatccgtgagttcgggcaacatcctcgcctgcaatgttccaggctggagggacgtttgagagggacagggccacccacaggggcagagcaggtccacagcgctgcccactggccgaccggagccttgcgcgctggacagtgaggagcttgctccaccacacagcctcggcacccaccttcccgccatccctgggactcgtccctgccctcctccaaacctctccgcctcaaacacacgaactcgcaccgcgatagtaggccaggcgtggtgatgccgggagtcggcgggcaggctggccgtcatgaaaccaatcagcagctcgtgccgcgtctgcgccaggtgccagaaggtctgcgcccacccgtccaccagcgtcgccagcgcggccagcgccggctcagggtacccgccgcccagcgcccgctcgtactggatcttgagctccgcctggaaggctccgtgcagggccagcagctcctcgtgcgagtccgcgcccagcaggcagccgccggccggcaccgccacgcccaggcaccgggggccgcaggcctcagggtcgatgcgggggcccggccgggcgctgcggcggggcaggaccggggccaacggcccctcatgaggcagtgtgggcggccgagaggggcgctgggccccggcggggggcgggccgtgctccgatggctggacaccggccggtcggggatggggggtccggggccggggcggagcggtgggggggggcccgcnnnnnnnnnngtgtgctccgatggctggacaccggctggtcggggatggggggcccggggccggggcggagcggtggggaaggccccgcgggcctccgcaaacgtctgggccatggcgttgcgcatgcagaggatctggtgcatggccaagctctgcgtggtgtgagcgtggtgggtgggaggtgagggcatggttgaaagggggatatgcatccttgagcatcgatgaggcgcttgagatcgtaacatcggtgcgaaggccgggcacaccggagccagggctgaggcagagcctggagcccaggtaagcccaggcatgaaaaggcaaccctgtagatctgctgaactcagccgacatcgccagccccaagcgtctcggttcactatgtgcaaccgcctcgcaccttccttgccagcgccgcacgctccagccgcagcatgcccatctccccttccagctcctccatctgcgcttgaagcgccgctgcacgactcttttgtcgttctcggaaccggcgctgaacctggaggtgcagggacccaaggggttgtcacgaggggggggccggcgtcgcgtggaggccgagctggccctgactctatcttctagagcaacaatcattgaaggatggcaacacgagctgaattgttgctttcctctgcgcacctcgttattcttggatcgtggggagagggtggggccagatcccccatcagatcctgatgccaggggagtctgggtgcgcagatctcccattgcagcctgcggtgcgccctttttacgagcggcatcctccaccctcatcggctgctggttggcgaggnnnnnnnnnncgtcaagatcgcggcaacccgagtgcgcatcagtccaggcagtggtaccgcatgccctcacacaccggcccggccgggccgccagtgagttaggctgcgagggttgcgccttaggggtttagatgccatcctgaggcgagctgccgtgatggggtcggcaggtgtggagcgtatactttggcaacgcccaccttcacgccgcaagatannnnnnnnnnagtcaagatcgaagcaacccgagtgcgcgtccgtccaggcagtggtaccgcatgcccttacacaccgggccgccagtgagctaggctgcgagggttgcgccttaagggtttagatgccatcctgaggcgagctgccgcgatggggtcggcaggtgtggagcgctaaaaagtactctggcaacgcccaccttcacgccgcaagataaaaagaagccagtgaacagcagggcgaattgtcacaacatgtttacccacccgttctgttgatagcagttgtgaaacgtcctgtttttacaggatgcgaccgatgacgtcgcctccgacggtggccgcttgatccctttcgcagggactctgcgcgcctgaaacaggaattctcgagtccgggagcaatccccagggttctttgataaccatacttggggtgattgaagccacaatcgtggtaacgcattctctggcctctaaaatcaatcggggccaacatctcaagatccatggtccgccgggtgaagaattcgtggtcccgcgatcgtgttgatccgggcctggcgagatggttgtggtttgacgcaattggcgtaccacgcaccaaatgcgccgctagatcttgccagccatgatgcctgcagggtccttactgttgctttgatgcttgatgcgcatgcctacctgcatttgggcaatggacgtaacatttattacgggcagtcccaaggctgtccctggcatgcgtggacaacatacctaaggtgatacacagctgctgctctcatgcagccagtgcatgtgggtcgctttgctcacacacatgcatcaacagatcgtcagaaatcgagtgggagtgcactgcgtgggcccagggatatgtcaaggactcatcgtcacaactgcatgcttgtcagcctttcaatggcacccagaggaaggtgggtgggttgtgagtcccggcctgatgagagggcatcgctatcaatctgtggggaaagtcagtgccagcatgagatgtaaggtgcaactcatttgcaacatgtgtatgtcgggaccatgccactctcaatgccctcatcaaggcattcccatgtgctggcaatcccaagaggacactnnnnnnnnnntatgtaaggtgcaactcatttgaaacatgtgtatgtcgggaccatgccattctcaatgccctcatcaaggcatccccatgtgctggcaatcccaagaggacactcctacctatttcacccagccactctccgagcaaggctgctcaggagctgtttgcagtcagacatgtagccagagccaaagaggttgtaatgattctgtggcattcgaagaggatcgagatgaactgatacaccaagtcccctttgatagacacacgctcatacaggtatgctggatcaatgaaaccaaatcagaggannnnnnnnnntctgatacaccatgtcccctttgatagacacacgctcatccaggcatgctggatcaatgaaaccaaatcagaggatcagggagttccacctaatccctttttacatacagttcttcccgcccacaaatgccttctcatatgcaggcttcaacacctcttcttccccattttcagtgcagtgcccatgccatcagcaggacaccgcccacccgtcacgcatgcctgatcactcaccagcttgtggtagagcgtgtagagctcctgtcgtccctcccagccagggtcacgaggcaggacggcatggtagccctcccagaagtccctgccaaagcccgaacaccagaccatcccaaactccgcctctgcatggccgtagtacgtcgccgggtcaaacaccacgggcccctccctggacccggcaacgttgcctgaccagaggtcgccgtgcaggagagcagggcgtggcgtgaccccggcaaagagcctgtccagggactccagcaggggctctgccattcgctgcagctctgcgctgccactggcctccaactgtggccgcaagcggtgctctctgaagaactccggccaactttgagtccaagtgttgcgctgcggggttccccctatgctgttgtccaccgcaaacccaaagaaccctgctgcggctttctcgtcctgtgcagtggattagcctgggggggatactcatcgcattgcaaggtgcagggtcaccttgcggcctgaagcgatcccatcttgtcacatcacgcaagaggttcattgatagggtgtgcaatcnnnnnnnnnntgggtacatttccccagcgcgagcccctcacccgccttaccatgggggtggcttcgtgcatggcggccagattnnnnnnnnnntcttgcggcctgaagcgatcccgttttgtcacatcatgcaagaggttcattgatagggtgtgcaatcatacatggctcccggggcaccttgacggtcccagggatgtgatctgtgcaatgcatggcttcccagcacccgtattnnnnnnnnnnnnnnnnnnnnnnnnnnnnnnnnnnnnnnnnnnnnnnnnnnnnnngacacccagctgtccctgatccacaggcccagccctttcgatgaattccatgatgataaagctgcccattgcctctggtccatcaccccagtgatggacggcagggacacgcagagttttcgtggctgcaggcattggggatgagagggtttgcgatgggcaacatgattcccatgaggggtgatgtgcccctgtacagagctgcacactaaatgtcagactaggagcctcattgccatgcatcttgcatcgtccctgaagcatgtggctcagcataccgcttccgacaaaatttcaccatcccattgcaaggtacatgtcatacattcataactcaccatacatagcctggagacccaaggcctcgccctgaaacatttccgctgcattgctaccactggtcttgacaaaatatttggcgccctgcgatgttgtggcctgcatggcactgctccacccgctgcctcccagggatctccagccggtcacatggcccttcgccatgtgctcctctatccagccacccgccacatccctgcatcatcatgcggcgcactagctggggggactaatattttggggcgagcggtgcgagcactccctcgatgcctgcatggaggggcctcaccgcatggatgctgctgtcctcatggtcctagagcgcctggcactcggccgaccaagggcacatgaaacattcctgtgacttgctgttaacatacagcgagtgctatcctcgaatcttcaaatggttttatgaccggcttgcatcacaagccaaaatgaaggggcgtgacgagttccgttcaaggagtcccagaccgcgcgggatttaaattagtaaaaacccgacgacagatctccgaaaaccccgagattgattttcacatctaagtatctcaaaccacttgcaaacaatgcgcggcgtgcccccattatcggaaaccccccgagggccctttcaccacggccgacatagtggccgcccaggccacagtccactgtacctactataaaaagcttgtgacgcaagtagccattcccacggagcgcgtggatgccttccagcacggcgannnnnnnnnnccagtccacggtacctactataaaatgcttgtgacgcaagtagccattcccatggagcgcgtggatgccttccagcacggcgagggccgcttgttcaggacatccttccatgggatggcccaccccgcaacccaaattcgaactcgaatcacctccaacggaaggcccgtgtgnnnnnnnnnnagtcccaccccgcaacccaggttcgaactcgaatcacctccaacggatggcccgtgtgatcaacatgcagccggtccctttccggctgcactcagtcccagctcttcaacacacccacaagactggttgtcagtcgagaagtacaggtgcgcccgtggtccgggcacacctgagtgggtggagaagaacagcgccagtcagcgggaagggcggaagaggctgtcgcgccaccgctctgagaagaccggctgccagcaaacgttcactaccaagcagctgaggcaagactccaagaagagcattgtcttctaccctgacattgggcattcgggccacagtgacgccacttcccagtgtctgcgcctgtcccggtgggccgttgaccttgtggagtctctgctggccaccaacccggcccttcgcaaccccagcatcgttgcctcggtgcgaggagctgcgctgcgcaaggcagggataagtttggccgtctacaccagtgtggccgaccacttggccttccagcaacaccacccggattttcacagggactactcgatcaccaacaaggagatggcgtgagttgcaaggcagggtcgctcggtgccaatcacnnnnnnnnnnnnnnnnnnnnnnnnnnnnnnnnnnnnnnnnnnnnnnnnnnnnnnnnnnnnnnnnnnnnaccctggtccaacttgtatgcgctctccatcgcaggaacatttgccggtccaagaagtccaatccatggatgctgggcccagacgcagccacaagcctgatgaagtcggtccaggctcggcattcagactctgccgtccttgagcatgacaacgagaggctgacagagcttgtcgagctcaacgataatcaccagcattcgctgggctgagatgatgggttcagcgctccggcgaggagagtaggaaagcagggggattgtggcagcacgtggccattcccccccatgtttggtggtcaagagattgcgacggacggtgcaggaaaactgcggcattgcagtaaatcagggttggcctggttcctaaggtatgcacgtatttctcttgaacatcaatcgtgcctccatccatccgcgacaggagcagggcaggagttaaagctgtggcaatcagtggctatctgcctcctgattctcaggtgtcttggggcagcttactctctctgtgtgcctagtaatctacagaccagcatcaccatcaagtagtccgtatgggaatacacaccctaacgccattcagagcacattggttgaaaggcatgaagtggcaacaatgcgccagatttaccagtgcaaggtcagcacgtttgtgctgcccactccatccttgacggccactgctcgggcgtacgccgcgattgctgtaccggaaggatccaaggtgattgagtcttcgtacgggggcgaattaacgtaattggatgtgcccttgattatggcatcatctgccgtaaaaatggcaaaatacgtatgttgaggttggaagctagtgattgtcaagctgactttgaacgtattgtcaactagggtgatggttccagtgatgtccccatacattggtggtggtggggcagctcccggaggtggtggtgaaggattgagcagagtcagcggcaccacctccttcagggtagtatcgtccgagtacaccaatccggagcctaaggaatatttttccattacttccacatcatcacttttgtcgtagatggttgtggtgggggattcagggttaccttcccacatgaggtctagcctgattaacagggatgaatacaaggcgcatccgacggcgtagggagtgtaccctgcagtggtaacgacacacgtcacggggacataatcaccatcaggaacaccaaactgaagtgtggcggtcgcaggtcgtggtgggggtggaggagaggggggggatggaggtgggggtggaggagag

SEQ ID NO: 44527 - DNA, 61 bp, Chlorella protothecoides
gccgcgaggcctcgtcccgggcttggctgcctgaatgggggacgcatggatggacatgcat

SEQ ID NO: 44528 - DNA, 61 bp, Chlorella protothecoides
ggccagcggccgccacattcactgtggcgggaagaaagtccacccccacttcaatactcgt

SEQ ID NO: 44529 - DNA, 61 bp, Chlorella protothecoides
gcgccgcccgcacctcaggcgcggccaccgatggtgggtttgtggcgcccagatgcagcgc

SEQ ID NO: 44530 - DNA, 61 bp, Chlorella protothecoides
cgcgggcgcgggctgggcaggagtcggcgcaggcgtaggctgggcaggagtcggcgcgggc

SEQ ID NO: 44531 - DNA, 61 bp, Chlorella protothecoides
ctgtcgcggttgggtctgccacataggaggaggtcacccatgaccgcgcccagtgcggggt

SEQ ID NO: 44532 - DNA, 61 bp, Chlorella protothecoides
gatggcggagggtttggtggcggtgatggcagaggggttggtggcggtgatgctggcgggc

SEQ ID NO: 44533 - DNA, 61 bp, Chlorella protothecoides
tttgtgcatgggattggagagcggctgccccggcctgcatgggggcctcatgccagccctg

SEQ ID NO: 44534 - DNA, 61 bp, Chlorella protothecoides
aggatatgtagggaaggaagccagtggctttcttgcaacagcgtatgcaaacattctgttg

SEQ ID NO: 44535 - DNA, 63 bp, Chlorella protothecoides
accttcagccaactcaatctgcactctcattgacccccctcccccccccccccccccccccac

SEQ ID NO: 44536 - DNA, 61 bp, Chlorella protothecoides
gaagaaagcgcagcgcaggcgcgcggcggcggggggccctggcgcgcgcccggcctcctcc

SEQ ID NO: 44537 - DNA, 61 bp, Chlorella protothecoides
cccgatggcacccttggacgagttgatgcgtaggccgtcgtgccctagcaccgcacggatg

SEQ ID NO: 44538 - DNA, 61 bp, Chlorella protothecoides
ggctgaatggcgtggcggaggacggatggggggtggaaagtgtggagggatggggactgga

SEQ ID NO: 44539 - DNA, 61 bp, Chlorella protothecoides
gcaaacccaataagggctcttggttctgcagaaattaaatcacctaacatcgcaaaactcg

SEQ ID NO: 44540 - DNA, 61 bp, Chlorella protothecoides
ttaccaattgatatctcattaactctaggggtattttaatatttattgtaatgtatgtttt

SEQ ID NO: 44541 - DNA, 4916 bp, Chlorella protothecoides
  modified_base (148)..(157): a, c, t, g, unknown or other
  modified_base (263)..(272): a, c, t, g, unknown or other
  modified_base (805)..(814): a, c, t, g, unknown or other
  modified_base (1097)..(1106): a, c, t, g, unknown or other
  modified_base (1678)..(1734): a, c, t, g, unknown or other
  modified_base (2177)..(2216): a, c, t, g, unknown or other
  modified_base (2743)..(2752): a, c, t, g, unknown or other
  modified_base (2823)..(2832): a, c, t, g, unknown or other
  modified_base (3502)..(3511): a, c, t, g, unknown or other
  modified_base (4470)..(4479): a, c, t, g, unknown or other
gcacgcgcgctatctgcgccgcgtgctgctggaggacggtcacatcccggccaccctggcccacatcttctcgctcatcgtgcgcaaccacgatctcttctactcctccaggtgggagagagtggggggaaggggagggaggggggannnnnnnnnngggggagggggaggtctgagtaaagacaagaaggggggggaggggggggattcttgtatgtgcgcagaaccctcactcgattcgctttgcggtgatgggctcgagnnnnnnnnnngtctgagcaaagacaagaggggggggggcattcttgtatgtgcgcagaaccctcgctcgattcgctttgcggtgatgggctcgagcaggtgcacagggaacagcatgcgccgcccgcgcagggaacacattgagcacaccaaacgccccaactcccctccatccgccttggctgcgcgtgcaggacggcgttcatggcgtccatggtgcagaatgcctccaagctgggcctgcccaccaacgccacgctggaggccaggatcctggctacggacatggcggcggtgctgctgagctgggacgcgcgggccgaggctgaggcggcggcggcggcggccgatggggttcctgcggcgaccgagggcgcgacggcgacggccgaaggatctgcggccgccgcgagctcggcggcggtcgccctgctcgcgccgcaggcctcgggggagaaggaggggtccgggactccgcccgagggcatggaggcggcgacgggggacggcagtgcgggccaggcgcctgcgtcccgggcggcgnnnnnnnnnnctccgggaccccgcccgagggcacggaggcggtgacgggggacggcagcgcgggccaggcgcctgcgtcccgggcggcgctggtcgccgccgccgcgagcgccaggtgggggatgtttttgttgcatctcgagaagtctgtgtgccgggtgggggtcgtgtgcagatgcggggaggcgtccctttccctgcaccatccccggcgcccctcaggcggggggtggcacgtcgttccacgcgcccgctcagactgtccgcctccatccaccccatgcagggacgcnnnnnnnnnnttggcacctcgtctcacgcgcccgctcagactatccgcctccatccaccccatgcagggacgccggccgactcacgcccgggtccagcgaggtgctcgtcaacttcctgctgcgcatggcctttgtcaggttggtgttgtagggggggaattcacgcacactgctcttgaaccgctgcctgtcctggcaatgtgtatgtcgggcgtgccccaggaggccctggcgagccctcgacctcgccaaccctgctccctctttcctcccagcgccgggagcgaggggcgcgagcgggacgacgctgggttccgacgcctgcacgcccactgcctggacatcatccgcgacgttggtgcgtggccgcaacaggattgggactctgcgtgatgcatggcgtggactgggcgcctcggggtctggacgtgggaggtacttgacattcctcatgcctccatgtcgtggcctgtgcactccctgctgcccctcctgtgcagcagcacaccgggatgtcaaccatgtttgtcgcgcgtgcctccccacaccatccacagctgattcccgacgccccccccccnnnnnnnnnnnnnnnnnnnnnnnnnnnnnnnnnnnnnnnnnnnnnnnnnnnnnnnnncccccacacacacagccaccttccggccggcggtgacgctgaagctgcagtactttgagaaggtgctgaccggcaacctgcagcagcaccagcaggccatcgccaacgcggctgcggccggcgcgccgccgccgctgcacgaggcgccgcccgtgctgctgacgggcctgcagatcgcggacatctacatgaagacccagccagccaacttcgtggcctgcggcgccaaccagctggccctcatgctggagccggcgctgacctgccgccagagccggaaacctgcgaccctgctcgcgtcgtgcattggggagctggtgcagcggtacccaacgcgggggaccgccccgctggaccccaccgccgagctggcctacaagctgctggcgcgcaccaacgaagtgctacacaggtgggagcggggggggggggggggggggggnnnnnnnnnnnnnnnnnnnnnnnnnnnnnnnnnnnnnnnngcaggcacaccatcgtttgtaagcctcaggcgaggcggtagcatcccgtcctcgttaccttctccttcaaccctttccccaggttcctggcggcgctgtccaactcctcgcaacagctggtgccagagctgtttgtgtacgccagcaactgcctgctggtcatgaaggctgccgtggaggtgaggggatgggagattcagtccccagggcaatgcatgacatacacctgggtgaatcagctgggtagcaccaggtgggttgcctcacgacaggcgcgctggacccccctccccccccacacacaaatccacacaccctcctttccaacaaaccccacaggcgcgacccaacagcatgcagcccctgatcgggccgctgctggctgccatgcaccgcgtcgccaaggaccacaaccagcagccggcggccggcatccttggctccaagtccttcccgccctcgtgagtgattcatcctggtggggttgtggggagcaggggcacggtgttcagatcgaagaagccgtnnnnnnnnnnccagcaggcgcgctggaccccccctcccccccacacacacatccacacaccctcctttccaacaaaccccnnnnnnnnnnaccctcgtgagtgattccttcctggtgtgggtgtggggagcgggggcacggtgttcagatcgaagaagccgtgagctgtgggttgggtgaggtccaggatggtcatgcaggggctccaggcatcatgctggaccacaccacctcccaagcagcctgacatcctgctacatcccatccacccccagcacggagccggctgactcggagtatggcaccggagcctggttcatgtggcacgctctggcaggtgggtggcggtcgggtctcgcaggctctggtccttggggggttggccatggtcctgagtggctcatgtttggatgggcttcctgcagccgggcaagccgtgccacccagcatgcaagtcaaaaccttgccttcctctggttccaaaacatgccgcagtcgccgtgccctctgcactggtgctgtcggcggactacaggaaacacttcctctccacgcttgtcatgctcatcaccggtgagagaaagggtttcgtgtgcggccgcgggaggggcagtcggcagtgccaaaagtgctggcgtgtcctgagcacgcgcggcatgtttggctcatcatctacgccggcatgcatgtgagcctgcctcgaagaattctcatccacccacccatcacgtgatgcagggccatcggtccgcaatggccnnnnnnnnnngacgccggcatgcacgtgagcctgccctgaggaattctcatccacccacccatcatgtgatgcagggccatcggtccgcaatggccagactgctgcctgcatcatctttgcggtggtcaacctcatggagggctggctgctgccaccgcctacgaccggaccggggtctgcggagccccggccccagccccagctcacgtccaaggaaccgctggtgttcctgcagcggctggcgcaggcgagtttgcagcagtgggcgggactgggggttcggggcttcatctgtgcagatgctgtcctcgagcggaggggtctgtgtcatgtcttacatgcgcccctgccctgcaacacccagatggaccggctgcatgccatccccgcctcgctcaagtccaagtgggacaagaagttcctggatctgctgtacacggtcatcaccgacaagaaggtagattggtgctcctggccctttttttggtggtctgcatgctccacttttctccatgcggcatgcagcgtgctgcttgataccaagggccagctggcatcagcgctgtgtgggcctgcacggcaggttggctccatgttggggtcagcaccccctgcatgaatgcccttgcatgcgtattccccacccactcgccccctgcaggacaccagctttgggctggagctctttgtgcgcgtggaacgcaccttctgctgcggcctgcaggcgtcagacccggagacgcgcgagaaggtcggtgctgccggtgtgggggggtggattgggctgggcggccctgattacagcacacttttcgtccaagaacaggcttctgaagcttttgcctgttgccaggtcttggtagaatcaggccagactccgtttctgcatcacactcgtcatcgccaacttgttcccacgtgcctcacccgtctctacaccttgaggcttctcattgcctcaccccccnnnnnnnnnntggattgggctcggcggcactgattacagcacacttttcatccaagaacaggcttctgaagcttttgcctgtcgccaggtcttgctagaatcaggccggactccgtttctgcatcacactcgtcacctccaacttgtccccacgtgcctcacccgtctctagaccttgaggcttctcattgcctcacccccccccttaaaccccccccacatgcagttcttcaggctgtacgccgagcgcgtgccggccgacctctttgagcgcctgcgctacgtcatccaggtgcaggactgggacttcctggcgcacacctactggctcaagcacggcgtggccctgctcttcgactgcgcgcacaaggacgacgccatcacgctggcctacaactcggcccacgttcccagcctgctggagcccaactccacgctgcccggatc

SEQ ID NO: 44542 - DNA, 61 bp, Chlorella protothecoides
aggctgccggcaggctcggcatgtccgtcgcccgccggccgggacgcctgccaggcggtgg

SEQ ID NO: 44543 - DNA, 103 bp, Chlorella protothecoides
agggggggggaagggggtccgaggagggaggggggtaaacgagcactctgccctgcacggaccccgggcgttgcgagcggggggcgtgcgtcgggccgtcccc

SEQ ID NO: 44544 - DNA, 80 bp, Chlorella protothecoides
gcgcggccagcatgcgcgcgtagacgcccagcgcgcggtctgcgtcaccggtgcgggcgcagacctcgatcagcgtggtg

SEQ ID NO: 44545 - DNA, 61 bp, Chlorella protothecoides
cggcacacgtcattggctgtggccgtcagggagtggatgaaaatcttggctgcttcttgaa

SEQ ID NO: 44546 - DNA, 61 bp, Chlorella protothecoides
ggctcgggcggggctggaggtgcagacggggcgcggcacccggtggagcctggtggcccac

SEQ ID NO: 44547 - DNA, 75 bp, Chlorella protothecoides
cctccgggtgccacccgacgcccaccccccgactcatgcacccccccccccaaggtttcccgggcctgggcggca

SEQ ID NO: 44548 - DNA, 61 bp, Chlorella protothecoides
aggaggtgttcacctccgagcactggatgggccgcgtctaccgcgtgctgccggagcccaa

SEQ ID NO: 44549 - DNA, 73 bp, Chlorella protothecoides
cccgctccgccatcgcaccgccgtgcgcggcccgtgcggcggagcgcagcctcctgcccgccgccttggcgga

SEQ ID NO: 44550 - DNA, 61 bp, Chlorella protothecoides
cttcatgtgtgggcttgttggcaggcgcccccccccaccttacacaggtttcatgatagga

SEQ ID NO: 44551 - DNA, 434 bp, Chlorella protothecoides
  modified_base (154)..(326): a, c, t, g, unknown or other
cagggcggcgacgcggcggggcccgccgcgcgcgcgccgcgcgccgtcgacgacggccacgcgcggcgcttcgtggagatgggcttctcgcgcagcgcggcggaggaggcgctgcgccgctttggcaacagcctggacctggccatggagtggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggaggaggagcgggctctggctgacctggtgggcgaggccatggccgtggggcggcccgggtcgggctgcgcggcgccgcgcgacgccgcgccgcgcgccgcgctacc

SEQ ID NO: 44552 - DNA, 61 bp, Chlorella protothecoides
agacgtggctgaggctggagatgcagctgggggcggacgccggcatcattggcgcacccaa

SEQ ID NO: 44553 - DNA, 61 bp, Chlorella protothecoides
aggctgccgagtgcttgctatggcaggggggggcgccctctggctgctgggtccaccaaag

SEQ ID NO: 44554 - DNA, 61 bp, Chlorella protothecoides
cccacgggggcggtggcgcgtgggccggcggcccgggcgccctcgcccggcgtcggcacct

SEQ ID NO: 44555 - DNA, 61 bp, Chlorella protothecoides
gcgacttttacgggaggtccggggggggagggcgcagcctgcatcgtgtcggggctggtaa

SEQ ID NO: 44556 - DNA, 103 bp, Chlorella protothecoides
tctgctggccatccggggcgaggtgaacgcactgcaggagcgcgcgcgctccgcgggcctgatcgggtccagcctggaggcggcggtggatgtgcacgtgagc

SEQ ID NO: 44557 - DNA, 98 bp, Chlorella protothecoides
gtcctccgtgtccttggcagcctcctcgctggcctcggcggccgccgccgtggccgacgtgcggggcggcgactccacccccctgccccaggacctgc

SEQ ID NO: 44558 - DNA, 61 bp, Chlorella protothecoides
tctgcacatgtcctcttcgtataggctcgggactgctttattaaaaaccctagctacttct

SEQ ID NO: 44559 - DNA, 61 bp, Chlorella protothecoides
tctatgcgtggctggggctggatgtggagggggccgtgcagaaagagtctctagattacgc

SEQ ID NO: 44560 - DNA, 64 bp, Chlorella protothecoides
gcgcaagcccggtgggggtgggggtgggggaaaaagaagacgaagcagggggtccaccaaatgc

SEQ ID NO: 44561 - DNA, 61 bp, Chlorella protothecoides
ccgatggggaaggcctcgtagggggggaggccgcccaccacaaggccgccctttcctgaga

SEQ ID NO: 44562 - DNA, 61 bp, Chlorella protothecoides
tggtgagcgttgcatggagggttgcggctggggccttgcgatcgccgctgcgctgcgtccc

SEQ ID NO: 44563 - DNA, 381 bp, Chlorella protothecoides
  modified_base (149)..(311): a, c, t, g, unknown or other
cgtctaggcgccccgccccccacctgcacgctcccgcccggccccagcgtgcgcagcacaagcctgtcctccagcatgcactgcacgctgtggtactgggcctccacccagcacgccagcgccacctggttcagaaagcgctgcagcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaccagggtgggccacagcgaggcctccagcagcgagggtgggggcggggcggggctcgccggggcggcg

SEQ ID NO: 44564 - DNA, 61 bp, Chlorella protothecoides
agcacccttgccaggaggaatgggggggggggaactccagctgcagaaggtggcccgccac

SEQ ID NO: 44565 - DNA, 62 bp, Chlorella protothecoides
cttcctccacccccagcctcctcttcctcccgccccagcctcctcttcctccacccccagcc

SEQ ID NO: 44566 - DNA, 4067 bp, Chlorella protothecoides
  modified_base (1261)..(1270): a, c, t, g, unknown or other
  modified_base (3794)..(4012): a, c, t, g, unknown or other
gaggagaggtgcgaggcaaagtaggctgcgagggcattgggcaggggaggcgggtgggtcgcgtggtgtggggggggtacgtggcaggggcggcgtgaccccgggggcgggctggtggcgaggggtgggtggggtggggcttggcagggctgacaccgaggggtgtgtgagtgggaggagcagctggacagcccgccctgcagcacaggtggctcgccacagctggtacggcggcccctggcacccacgtggcagccccactgggcagacggagctggcatcgtgggcgtacaccctggcgctaccaccccataccccatccacgcagtcccacgaggcagggtgggttgagagggaatgcatcaccagtaccccgccaaggaaacgcccgaaaccaagtggcccagacttgtgcgcgccatcaacctgacatggagcggatgccgtccaggcggcgcgtgctgaacgtgtctgccacgaggtactgcatctccggcgacaggcgggccagccccgcgatggagcggtcgtcgagggcgccgggccccgacagcacccccacctccctcagcttggcctcggccccaggggtcaggcgggaggcggggtcgcggcggtcgtcggggcggtcgtcgcgcctgtctccacggccaggggagtggggggggccgctgtcgcggggcagtctcctcagcaccccagccaggtaggcggccgggttgcgcacccggcccccggccacgctctgctccaatcgatcgatggattctatggcctcggtgggggggagctgggccagggaatcgagggcgcgttcgtcgaggtcgcggcgctggacctggcggagcaaagggggtggagaggactgtgcacgcctggatacgagacaggggcggaaacaacttgaagattatgtctcgttcgtaccgctccattccgataaaggtcttccagtcgatccaggacgcgaggatggaggcgacctggccttccgccgggaggcatcgtgggtcgtggcttgtgctcgagcgcggagaacagaggtgaaaggcactcaacgacgacaattgacagcacctattgcctggaatgcgatccgggaagacaggcgtgctggtgcaccgtgtggtttggctcctctgtggacctgccgacccttcccaagacctggttgatccgctgaggcggccggtatgtcctgcgagaatgcaagccgatcagaaggagaaacaaaacggtgctcctgcgtgtcccgcgctgnnnnnnnnnntttgatccgctgaggccgcaggtatgtcctgcgagaatgcaagtcgatcagaaggagaatcaaaacggtgctcctgcgtgtcccgcgctgcagatgccatgtacacacgcgtttgcacctcccccccttgaacgttgatgtcgtggatacccacgaccgtcatccgtctccttttaaattgtacccccgcctcccccattaggccctcgttatagtttaatattaccatcctaaggtatcttgatgcggttgcacggcttggaatcagttgtacgaccagtcaacgttcagctgcaacaaggtgctcccttggtggcgccaggaacgggcccttcccagccctgagcggccatggagcacatagtggtgtacggcatcctaggtttgacatcccttggctggatcatcatgctggccgggatcggatccgtgcaggccaattgtggcagagacgctctcgaccggggagccgatgccgggtaccttggcccggcagaatgcaacacgattttcggctacacatggtggatagtgagtggagtctccatgcttgtcggtgcggagtgtgcccggcttcccctcgctcaaaaagtcaccccggccagcactgcccaacctgctccagcttccccagcccatgccctcgccccaggtgtggctgcagctggcggttttgctgggcatcaccttctcgattgtcaagggtgtcgagcgctggagggcgcctgccttgggctacttggcgatcgcctcggtcctgacgatggacactgccaacacgtacatctacttcaacagcacgcccgtgaacaaccacagcgcagctcgggccactgcagcgggtgcagtcatatgttccatcggcaagtaagcagaatgttgaagaggagcgatgtgtgggattacggcatgtgaggctcggtgaacgggtcgcttgccccactacgcgacacgcgttgtcctgcagcggtccacatggtgcaggctcccgcaatcggtgcgtgattcgtagccatcggagcactgtaaccccaggcctgccccaccaactgccccacgcatgtagtttggcactcatgacgtgtgtgggcctgctggaggagaaggagatcatcggccccaagcccatggcggtgccaaagtcctccatcccttctgcagtgatttgagagtgacattttgacacagtatcttctcgtacacctttcgacttgggtaccgttgcttgacccgcagcatgcgttgtgcctccatgctgcgctttttatacgggtagaaccctgcttacacaccctagctgagttcttgagcgagctcatgctttgttgcaatagacatcacgaggccatgctgctgcagctcgcccaaggctgagccagggacaggtgcagatgcatgccgatgaaaggacttgcgagaaggaatgaggccacaagacagggaatcatgtgtaccatgcgctcggtcaggacgttgcagcgtcggttctgaggtgcatgcacatgctcgtcgaggcgcactccttgctggcctgctcagggctgttggcatggcgacgcgcccccagggagaacccgttggatgcggatgacggggtcgtgtggagaaaggggcagggtgcaccctccattcaggtcctccatcagcagtgcgagtggcaggcatcatgctgcagtcgcgacccgtcaaccggatccccctggcacagtgctcaaacatgacactggcttggcctcaccacatggcgccaaagagcaaggccagaacgaggtactatatggaggaggcgctgtggtcgaggaggtgagcaattatggtatcgcaatggtgatggcctacatgcatggtttcaagcgttgatatggcgagtggtgccagtcggcgtccattggtaaggacaggtcagggttggacacgctgggccacaagtcctcactacacccaaataatccctggtatgcaaaccaacactgtggtccgcaaggcaagctccagctcaaaaccactcacccagctcgtgctgttgactgtgctgaatgtacacaatcataatgtcaggcatccttgcccaggtctacctcctccagaacactgagattttcagaccagattctgggacccattcacagactgatggttgatgacggcagtagacatgattctggagaagcgaagggtgagccagaagccgctgaatgaggtaatggcgaatgcggccaaggtgtttgccttgccggtcgcattccagtataccagccatgactcagccaagtcaccaccgagagaggtacaccctggatggagctgtagaccggagggtgattgccgaatccttcagccagcctaacacagtgggactggagctagcccgtgacgtttacagaggagcagcatcacgggtgccataccgcacatcgaaactggtggtttgagatggcaaccttctgacctcgtcatctggtggtgcatagagaccacctttgttgttgggggcccatctccggagtcttcccccctttccacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaccaccactcgcccctcccacccacccccccttccttgaagtgtgacagtgacgg

SEQ ID NO: 44567 - DNA, 62 bp, Chlorella protothecoides
atcctggcctcccaaccacttccaggtaccagcctctgccctacaaaaacctcacccaccca

SEQ ID NO: 44568 - DNA, 468 bp, Chlorella protothecoides; identical to SEQ ID NO: 1759
  modified_base (110)..(119): a, c, t, g, unknown or other

SEQ ID NO: 44569 - DNA, 11232 bp, Chlorella protothecoides
  modified_base (103)..(180): a, c, t, g, unknown or other
  modified_base (326)..(335): a, c, t, g, unknown or other
  modified_base (858)..(867): a, c, t, g, unknown or other
  modified_base (1947)..(1956): a, c, t, g, unknown or other
  modified_base (3768)..(3777): a, c, t, g, unknown or other
  modified_base (3863)..(3872): a, c, t, g, unknown or other
  modified_base (4572)..(4581): a, c, t, g, unknown or other
  modified_base (5563)..(5572): a, c, t, g, unknown or other
  modified_base (5726)..(5735): a, c, t, g, unknown or other
  modified_base (6311)..(6320): a, c, t, g, unknown or other
  modified_base (7377)..(7386): a, c, t, g, unknown or other
  modified_base (9023)..(9032): a, c, t, g, unknown or other
  modified_base (9415)..(9424): a, c, t, g, unknown or other
  modified_base (9952)..(10122): a, c, t, g, unknown or other
  modified_base (10175)..(10184): a, c, t, g, unknown or other
  modified_base (10741)..(10750): a, c, t, g, unknown or other
  modified_base (11124)..(11133): a, c, t, g, unknown or other
cggggcgtcgccggcgccgcacgacgcgcgcgccgcggccaggctggcgcgcagcatggtcgcacgcagcagcgcgccgctcagcgcccggcccgtgtcgtcnnnnnnnnnnnnnnnnnnnnnnnnnnnnnnnnnnnnnnnnnnnnnnnnnnnnnnnnnnnnnnnnnnnnnnnnnnnnnncgagcgctgccacgtgtcgcggccgccgtgcggcgccaggtcccgggtcgggggcgggctgtgggtgccagtgtgaggcccgatctcacaccgctgcgacgatgcagggtcgcggcggatgtcttcgctgccgctgcgattgttgnnnnnnnnnngcgccgggcccgcttcccccgccgcccgcgtggcgctgcgccacctggcgcgcggcgcccagcagggccgacacccgcgccatgtcgatgcccgccagggctgcggcgctggagcgctgccatgtgtcgcggccgccgtgcggcgccgggtcccgggtcgggggcgggctgtgggcgccagtttgagccccggtctcacaccgctgcgacgatgcaggctcgcgacggatgtcttcgctgccgctgcgattgttgttcaaagcactgggctccggcagagggtcctctggatcctggggttcacaggggtggacctcggatggcgatgatcccgacatagccggtgggtgcaggcctctgctttcggcgcccacttcgcgtcctgacagcggctcctgggccgccgtggccagatgcccgtcgggcgtgcggctgccactcggcgcaatcccaccgtacgtgcggcagggtggcgtgttcctggctgaacccctgcttgcggcttcgtcgcagctgccgcgcnnnnnnnnnngcttcgcgtcctggcagcggctccggggccgccgtggccagatgcccgttgggcgtgcggctgccactcggcgcaatcccaccgtacgtgtggcagggtggcgtgctcctggctgaatctctgcttgcggcttcgtcgcagctgccgcgcagggagtagccaggcgccaggaaggagatgtccggggaagggcggcctgggcggccgtgcccaggggacgccgtgcgccccggctccttgctcggcccggcgtcgatggggcgggtgccgtcgccgggtctgctggtaggctgggtggcgtggatggaccccatcgcctgactgcgcatcacatctcgatcaatcgcctgcctgccagtcgggcaatctcgctcctcctcctcggtctccccacctcggccccccagcgagaagcggagcaggcggtccgactccgccagtagcgcggcgacatggggcgacagcgtggccgaccccggggctgagtgtggggggccgccagacgatgcggcgccagtgagcgccgcaacagctgaccctgtctgtcccacggcaccgtcatcgccagggcccccgatgcccccctccagggacacgctggcgctgggcgtgctgaggtcgcgcgaggcgggccgcttgcgcgagccgcggctggcgccgccggaccgcgcggcgctggctgccgaggagacgacgccgcgcgatgcccagaccgtctgacggagcgaggcagcgctggacgcggcggaggccttgccggagcccctggagccggcctgggaggcccccgccaggcactcggccagcgcggcgtccgcctcgcccgcgaattccaacagggcagggaagaaggaggccggcgcgggcggggcagacgcggaggcgccccccgcaatcgtctcgcacgcgtccctgtgcatggaaatgtgtggtttgtttgtgtgcggaagttgggggattttccggtggagcacaggcaaagagtcttggggcagtgcagggcttcccacacagggccagagcccttgagcactccacccacaacacaaccccatgctacccacctgtatgccaggaggnnnnnnnnnnatccctgtgcacagaaatatgtggtttgtttgtgtgcggaacctgggggattttccggtggagcatggggaaagagtcttggggcagtgcagggcttcccacacagggacagggcccttgagcactccacccaaaacacccccccatgctacccacctgtatgccaggagggccttggcgacgctggcctccagctcagccagcgcctcgctggcatccgatcggaaagcgcgccactcctcgcgcgctcgcgagcccggctgggcggcatgcagggccgcgaccacctggtccggtgtgggggaagggaggaaaggttcggggagtgggagctccgtggggccgcagggcgttggcgtgtgggttgccggatgggtacaccagccgctgtcgtcagcccccgtctcgttcctacagaagttaggaacccctccagcccctccgctgtgatcccacacaaagcaacatgcaccatctccagccggcttccttcctccccctcccccacacacctcctcctcgagcaagtcgcgaagagcctgcacgccagccttgaggtgggccgggtcgacgcctgcggcctcgcggcagtgccccagctggccgaccagcgtgcggggttcggcgccactcgcgctggccgcctcgcgtgccaggaagtgcaggagggtggagcacctgggcgtggtttggggggtaatgtgagtgcacaagatctggcgggcgacctctgccaggcgtcaggggcgtggcgcacgggcgtgtcgagtgcccaccgtcccccttcccatgtgccggcagccctccctccagggcctcaccctgggcgcgtggacttgatggcgcggagctggagcagggccgccacagcctccgctgcgccggcgccgccctgtcggaagagaaacccggcggcgccgcgagccgcgcccgcgatccaggccagacccgtgcagtcctgcacctcgcgcccggccctgaccagggccgacgcgccgcgcgccacgtctgcggcgcgcgtctcgaagtggcgccaggccctgtccaggcgtgcgtcgtgggcctgctgctcatcgggcgccccagccgtccctggcgcggaccgcgccgaggcctcctccaacagctccggatcgccccactctgcggcgccctgcatccgacgctccccgcggtcctcgccctccggctcctcggccagcacgcgctgcgccacgccacccccagattcggtcccgcggcccgccgcatggtgcgccctgggcaggggggatccggtcagcacgctgtcgtcgtcctcctggccgccctcggtcccagaggccgccgctggcgtgcccgggggctctttgccatggtcgcgcgccgccgcgcgcggcgtccccaccacgctcgcctcatcgcgcgagcgctgactcagcgcagaggtgggcccggcggtggggccggcgcaggagaagaaggagggggcgtcgtcggaggcgcgcgcctgggcctgcaggggcacgatgcccgcttccccggtcgctgggccggggctgtcgatgctgcggcccgtcaccaggaggttggtgatcctgtgcgccggcaggccccctgcagccagcggggatgcagggttcctggtgggtcggagcgctgccggaaacgcgactcacagcagcccctcggaattgttgctccggtacccgccaaactaccccctcacctttggtcccggggacgccgctcaggcctgaagcggatgctcgcaccccgcccgcgccccgccccgccgcgccttcctcctggtgtcccaccaggtccagcctnnnnnnnnnnaggcttgggcgcggtggagagcaggacacggcgcggcacgctggcgccctccgctgccgtcaggcgcaccagcaggtcggtgctgnnnnnnnnnnagcgccgctcaggcctgaagcggatgcgcgcaccccgcccgcgccccgccccgccatgcattcctcctggtgtcccaccaggtccagcctcaggcaccgccccgcgatcgtccccggcgccaggcggaagacgtggcgcaggtgccgtgcggagcccgcggcaagctccacctcccccagcacctcgaaccgggccgagggcttgggggcggtggagagcaggacacggcgcggcacactggcgccctccgccgccgtcaggcgcaccagcaggtcggtgctggcggcgtgcttgagcagcagggtgcaggagctgcggggcgtgcctccgcggctcgtcctgagggcattgggaatatgaaacggggacaggagtggtgtgggcagatggtggcagagctgtgggagggcagtcccgcccaagtcggacacaggcttcagctcagtagccatgcactggcactgttccatgtcactccctgacacctccagcccgcactcgcacctggtggtccagcagacgccggggatgggctggcaggacaggtccggcgccaggattgcctggcacccctggcccgtcgccgtgacgagccgcttcacaagggaggtgtcggtgggggcgggcgccactgcaatcttcttattcgcggcagctgcggacttgcggggggacagcgcgggcaggggctgggtccgnnnnnnnnnngagggaggtgtcggtgggggcgggcgcgactgcaatcgttttattcgcggcagctgcggacttgccgggggacagcgcgggcaggggctgggtccggctggaggccgcggcgtactgcgttgaggcgctggaggcgcggagggcgggcgacgatgatgtgccccttgtagaggcggccatcttggagccgcggattagttgattcaggctgatgtcgcacagctgcagctccgactccagctgctctgcgagctcgtccagggtggagtgggtgggcccctgggagcggggcgaaggagcctgtcccttgggcgccacggtctgagcgcccggcgcttgggtgctcggtgctgagcgggtctcgctgtaggggaaagggcatgcaggggctcagcgggacttcaaccacgcccggtgcggtacttgcgaagccagctcatctcgtccttgcccgtgaagccggtgcatcacctgaggggcgatgggctgtcaggcgcatgctggattgcgggtgggccactctttcgggtcccgcccagctgctgcagcatcttcagccgctccatgtactgtggccaacgtggggtagtcaagtgttaagacgcgatgttacatcgccgatgaggaatcgtttacaccaaggacctcaccgtccgagtgccgtgcgaggagttaagcatggccgaagtattctccggatcttgggcgcctggcgccatctcagggtccggagcacgcgagatgaacgttcattgagggatcgtgagctaggatgatgcccttcaaacgcattgcatcgcgtcttcgtccgacctcccggtgtttcgaaatgggcatctgtccgtagctgccggggtttcccgccaaaagaccatcggcgctccaagactcctatgacgaattgccagcgtgggccatgagaaacacttgcgctcatcacgccacagctttatattttattgagaggtaaggggcggtcctnnnnnnnnnngaacacttgtgctcatcacaccactgcttgatattttattgagaggtaaggggcggtcctgtcactttttttagggaaatggggctatgggaacaggcattggactgtgggccgataatgggcaccagtgattgagcaggacatatccacattnnnnnnnnnngtttaaggaaatggtgttatgggaacaggctttggactgtgggcccatgatggataccagtgattgagcaggacatatccacattcgcacatgtgtaatcaagtcgcttgattctgaacctcactcagtcaacgtgaactgctaatatacaggtctgctggcacattatagcttggatcgctctgggaggagtatgagcaatgcgccaatatgatctgtagcaccacgcccggttacatctgaagaagtggaactacagcgtcacaatgacgaaggtaataaactgcgcgatgcagatcagcgcaaaagtgggcgcgaggggcaccccgggaaattgacaatttggggagggcgcacgtggtagggcatcccgaattcaatccgcacgcatggttgcaccataaaatgttagacacccctggagcatactgtggaatatatgacatccattcacaactaagtgaacacccaatacgcaatggatgcgagcatggcttagtcgactgccaatcctgaccgaccaacctgtacgccccttgtcgacttctactgctccggagccggcgtgcagcacannnnnnnnnnccagacacccctggaggcatactgtgaaatatatgacatccattcacaactaaatgcacacccaatacgcaatggatgcgagcatggcttagtcgacggccaatcctgtccgaccacccaatacgccccttgtcgacgtctactgctccggagccggcgtgcagcacatgtccattgttgtgcggacatgattggtagcttgcgctgctcggtggtggtccaacatcgagcggtgtggtccggtctccagagcctgggtgtccgcgcgccatgcctcgtgacacccaccctcctggccagcacctcccggaggtgtcagagcaacgatgcggcgcctgcgccgagtgcggtccaggcagaacatcccacccagcaggtggtgttaaggagcatgttgtatcatgcgacggcgggcctccatgtggtgtgcatggtgcatgaacccctgggctggctggcctggccggctcatgctgggcacgccatgccaccgcacacgcaggggaggaggagtgttgccgccgcccatcagcccacagcccaaaaggaggtcatagacctgaggcctcccagaggtaaaaggttgggggttgttgatggctccttgaaggttcaacatgtgaaggctgggctcgtgcaagagcatgcgaacccacatcaagcccagcggatgggcctttgggggcgtcaccaaccccatgcacacccgtccacaggcacgcgtgacttcccccccgaggacaagcggttgcaggcctggcttttcgaccacttcgccgccgtcacccagagcttcggcttcgagatggtggactaccccgtcctggagtctgaggcgctcttcatccgcaaggccggcgaggagattgtggaccagctgtacaactttgaggcatgctataagggggggcccggggttgtttttttgtttcaagtgggtgggggcttaggctccccaatgggttctcacgtgtggccagtcccttggagacctgccctacacatacacctgatctacattcccactgccactcccacccagccccccattcctccnnnnnnnnnncgtggaccagctgtacaactttgaggcatgttataagggggggggggccggggttgttttgtttgttttaagtgggtggggggttaggcttcccaatgggttctcacgtgtggccagcccctcggagacccgccctacgcatacacctgatctacattcccattgccactcccacccagccccccattcctcctccatgcccttcaatgcacaggacaagggtgggcggcgggtggccctgcgccccgagctgacgccctccctggcgcggctggtgctctcggccggcgccgggcgcccgctccccctcaagtgggccgcggtggggcagtgctggcggtacgagcgcagtacgcgcggccgtcggcgcgagcactaccagtggaacctggacgtggtgggcgtggccggcgtggaggccgaggccgagctcctggccgcgctggtggccttcttccgccgcgtcggcctcggccccgccgacgtcggcatccgcgtgtccacgcgcgcgctgctgggcgcggtgctggagggcgcgggcgtgccggcggcggcgcacccagccatctacgtggccgtggaccgcgccgacaagctccccatcgcggcggtagaggcggagctgggcgcgctgcgcgtgcccccagccgcgatcgacgcgctgctgcgcacgctacgcattcgcgacgtgggcgccctgtccgaggtcctgcccccggactcgcccgcggcgcgcgacctggtggtcctcttcgacctggcagccgcctacggcatcgccgactggctgcactttgacgcgggcgtggtccgcggcctggcctactacacgggcatcgtgttcgaagggttcgaccgcgcgggcgcgctgcgcgccgtctgcggcggcggccgctacgatcgtctgctctcctcgctgggcggcgccgacctgccctgcgccgggttcggcttcggcgacgcagtgatcgtggagctcctgcgcgaccgcggcctgctcccggacctgggacggcgggtggacgacgtggtgcacgcgctggaagaatcgctgcggccccaggcctgcgccgccgccgccgcgctgagggccaagggcaggagcgtggagctggtgctggagcccaagcgcatgaagtgggtgctcaaggtaagggggaacggggtgacggagtgtggtggtggcagagatgggtgcgattctggggacgctgcattgaagcagccactggggattgggtggcccgggtcctgcatggcgtgtgtgcatgcccgtgagtctggcgctgtgccagcgctggtgcccagcggagctccccccttccctcttcatgactcagcatgcggagcggtgcggggcagcgaggctggtcctgctggcgcccgaggagtgggccaggggggaaatcaaggtcaaggacctgtccagccgggaggagaggacggtggtgggggtggaggggctgtgccagctggactgagtggtgcgtgcctgcctccgtgttacccctggatatcttctagtctgtttagagaggattcaccgttgaatgaagcgaggcagagaccgaacattgcatggaagggagtttcccgactttgtcatttcgaggttcgctcttggtaatactgactgnnnnnnnnnntggtagtgggggtggaggggctgtgccagctggagtgagtggtgcgtgcctgcctccttgttgcctctggatatcttctagtttgttaagaaggagatttaccgttgaatgaagcgaggcagagatcgaacagttcatggaagggagtttccagactttgtcaattcgaggttcgctcttggtaatactgactgcgtagatggtttcctaccatcgaggcagctgggcagggaggacgtagcgaaccccgagctaatcactcccgacccatgcgtccctccgtgtccgccgtattattgtgtaaaagaagtctcaaagctaaagacgtattgtctacctcgtggatgctcacttggttctgacacgttcgacgagtgccgggnnnnnnnnnncgcgaaccccgagcctatcactcccgacccatacgtccctccgtgtccgccgtattgttgtgtaaaagaactctcaaagctaaagacgtattggctacctcggggatgctcagttggttctgacacgttcgacgagtgccgggctggggctccccgtcgccttctgaattcgcgggcccttcttcgataaagggggcactgccataatgcctcaaggtaggttattgttgctccggtcctgtgatcagttcgtgatgtggcacggctcacccggcaccgagtgtcagcccggccgtcccaccgcaacactgcaggtgcacaggagctgtaccaggagctcctgcgcaccgccaatggcgatcatgccttggcaagggcgtggatgctccaaatggggtgcgtggagatgagatggggggggcgttgcgcggggcttcagaagggcacccacaccactgtctgcacacgcaggacgttcaaaactctgtgagatgcaaccttacacggatgccactctgtgtcacaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccctccccacttcctcctccctctcccagcccctgccaagatcgacatgcggnnnnnnnnnntctgtctacacacaggacgttcaaaactctgtgagatgcagccttacacggatgccactctgtgtcacaggtacccccccctgcctccagcaagcgtcgagcagtccctcccaagtactggtatgtggtgtccaaaggacggggcggctccccatcctgcacaccgagcctggctggcggctttctgcctggaccacccccatgccctgtgagggtaaaggcggtgctcttctcaccccacctccccacctcctcccagcccctgccaagatcgacatgcgggcaaaggtggaggcctctgccccgcagcacttcttctgccccattgccatgcacatcatgcgggaccccgtcgtcctttccaccggccagacgtgcgaggcctggggtgtgggtagccataggaggggggttgggcgtctgcgtgccgggaatccccccgcccacaccgtctgcccttttgcaccccacgccccagaccacacggtgcagccctgcaagcatcccgctcgtgtacccgtccccccaggtacgaccatcccagcatcgagcgctgnnnnnnnnnnatccaaccatcctgctcgtgtacccatcccctcaggtacgaccatcccagcatcgagcgctggctgtcggagggccacaccaagtgccccatcacaggggtcgagctgccgacgcctgtgagcatggcccccaacctggtgctgcgccagagcatcgaggagtgggccgcgcgccgggcgccctggctcttggtaggtggaggggccggttgcagccgggtgctctgtctggaccagcgtcgacgagggtcagggttggtcctgcagggcgcagcttcccatccatttgcccctctcctcactctcatccacccatctcacacacacccaggacgagtctggcggcctgaagccagccaccgtggaccgcaccnnnnnnnnnnattcccgtcccattggccctcttctcactctcatccacccatctcacacacccccaggacgagtctgggggcctgaagccagccaccgtggaccgcacc

SEQ ID NO: 44570 - DNA, 61 bp, Chlorella protothecoides
ggtggcatgtgccattcacgcagcagcagggcgactggatcgtcgaacttcgccggtgcat

SEQ ID NO: 44571 - DNA, 61 bp, Chlorella protothecoides
tttttgggataataaagctgaagaggtaatacttcccacaaatactggccaaatgggagta

SEQ ID NO: 44572 - DNA, 110 bp, Chlorella protothecoides
ggcggcggccaggtcatctcccatcctcaggctgctgctctttgtagagcggttgagagattgcatgcagggaggggccttggcaagaaccacgatgacgaggggcgttt

SEQ ID NO: 44573 - DNA, 61 bp, Chlorella protothecoides
gctctgttcatgtccatgcatgtccatccaggcgtcccccattcatgcagccaagcccggg

SEQ ID NO: 44574 - DNA, 71 bp, Chlorella protothecoides
aagcgcgcgctgctgcgcagcctgggcgtggcgcacgtcatcggctccccccccccccccccccccccccc

SEQ ID NO: 44575 - DNA, 61 bp, Chlorella protothecoides
acctatgcagcctgatacctgctcagagggctacgccgccatttgtgtgcatttgtggcac

SEQ ID NO: 44576 - DNA, 416 bp, Chlorella protothecoides
  modified_base (147)..(308): a, c, t, g, unknown or other
ggcgacccaccctgccccacgacgcctggcgccgctgccccgtccgccgcctcgccctccaccccgggctcggccttgggctccgcgccgggcccccgcccgcccagcactagcgcctccagctcggcgtcggagagctggggcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntccccagccccggtgtcaaacagctccagcgcggcctcgcgaagcacggcctcgtacacgcgcgcgcagccggcctgcgcgcggcccgcgggcgcggcggcgtcggcg

SEQ ID NO: 44577 - DNA, 61 bp, Chlorella protothecoides
tcgccgatctccgtccagaggctggtcgccccgcctgccctggatgccatgccgcaccgac

SEQ ID NO: 44578 - DNA, 75 bp, Chlorella protothecoides
tgcgcggctcggggcctgcgctggccctccagggcccggccccgctgcgcggctcggggcctgcgctggccctcc

SEQ ID NO: 44579 - DNA, 61 bp, Chlorella protothecoides
ttacctcatcccatcttgacttttggcaggggtggtgaaagtagtggatgtggcacgcctc

SEQ ID NO: 44580 - DNA, 61 bp, Chlorella protothecoides
gccatcagtgtagctgaagtcatcgaaagggcctccaggaggctgtacagaaaggcagggt

SEQ ID NO: 44581 - DNA, 594 bp, Chlorella protothecoides
  modified_base (283)..(396): a, c, t, g, unknown or other
ctgagcgcgatgcacgcctccaccttccagcacgccttcctcatgcagcacgcgatgggcgggcccgggcccggcgccgaggccggcccgctgggcctgggccccgcgaggggcggcctggagggcgccgaggccggcagcggtgccagcgcccccggcggcgccacgcccgccgcgccgggcgtggtcgcgccggagccggactgcctgggcttcctgcaggaggcgctgcgcctggcggccagcctgtcaccggagctgcagccggcgctggacctggtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctggtactaccccagcgtgctgcccatgctgcacgcctgcgccgacgtgcccgccctcctggccctctgcgcccagttctggagcaacggcaccctgcgcggcatggccgccgcggcggcaggcggcgcggctgcgcaggggggggctcccggcgcgcagggcgaggggggcgaggcggcgcctgacgccgcagggc

SEQ ID NO: 44582 - DNA, 109 bp, Chlorella protothecoides
ggactggaaccatggggtgtgcgtctcactctgcacacgtggatccctgcaccccctcccttcagcaccccctcccccctcctccggcccccccatccagctcaccgtc

SEQ ID NO: 44583 - DNA, 61 bp, Chlorella protothecoides
cgctggctgtgggggagttcggaggcggggggggaagagatcgcgggcaggggagtactgg

SEQ ID NO: 44584 - DNA, 61 bp, Chlorella protothecoides
gtttccctcaaatatagacaacggcgcccccccccagccacatcagagccaatgggcggat

SEQ ID NO: 44585 - DNA, 6040 bp, Chlorella protothecoides
  modified_base (122)..(131): a, c, t, g, unknown or other
  modified_base (964)..(973): a, c, t, g, unknown or other
  modified_base (1038)..(1164): a, c, t, g, unknown or other
  modified_base (1837)..(1846): a, c, t, g, unknown or other
  modified_base (2109)..(2118): a, c, t, g, unknown or other
  modified_base (3178)..(3187): a, c, t, g, unknown or other
  modified_base (3676)..(3685): a, c, t, g, unknown or other
  modified_base (4047)..(4056): a, c, t, g, unknown or other
  modified_base (5747)..(5756): a, c, t, g, unknown or other
cgctgggaggtggggggcgggggagggagggaataatcagaaaggggtggaagtggagagagggtgtgcgcgcatcatgacatcccctcgtccaagccctgggcttccttcctcgactcccnnnnnnnnnnagggaggggaataattagaaagagggtgaagtggagagagggtgtgcgcgcattatgacatcccctcgcccaagccctgggcttccttcctcgactccctcccttgtccacaccccgttctgttcccattcacacctccaataaaaaatgtgccctcacccctccccaacaatcactgccaggctccgagccggtgaagaatgccaacaagaacaacgcggtgcacgccatcgtgttcgaggcggtggccctggccatcggcctggaggacgccgacctgctgaccgccggcgctgcgctgctggcgcgcttcctggcggtgcgggagcccaacctgcgctacctggcgctggagagcctggcgcgcctggccggcgtcccggccgtggcggagaccttggccaggcacgcgcgcaccgtgcgcgactgcctggccgacccggacgtgtccatcgcgcggcgagccatggacctgctcttcaccatggcctcccccgccacggccgcgggggtggtggagacgctgctggcgttcttaccgacggctgactattcgctgcgcgaggaactggtgctcaagactgctgtgctggcggagaggtgaggagttggtgcgggagggagctgtgtgtgtttgttaaaggggggggggagttagcccaatggtgtggagatgagagggtgtggcggggagaggaagacgcaaggaggaggtgtggaggggcaggcgagttacgcgcccacgcaagtaaccccccattctcacccccctgctcctcccccccaaccaccaccaccaccaccaggttcctgcccaacctggagtggtacgnnnnnnnnnngtttaaggggggggtgggggggtagctagcccattggtgtggagatgagagggtgtggcggggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccccccccccacacacacccacccaggttcctgcccaacctggagtggtacgtggactccatgctgaccctgatggagcaggcgggggagtttgccatcaacgacctgtggcagtcggtggtgcacctggtgaccaactccccggagctgcacgcctacgcagcggggcgggtgctggaggcgctgcgccgcggccagccccccgagaccttcctcaaggtggccgcccacgtgctgggcgagtttgggcccctgctccccgacaccacccccggcgcggagtacgcggcgctggccgcccacttccccgccgccggacccgagaccaaggccatcatgctgaccgccttcagcaagctggccctggcggcgccggaggacggcgagctgcaggccgccgtgcgtgcgctgctggagcgccacgcgcgtggcgtggatgcggagctgcagcagcgagcggtggagtacacgggcctgctggccggcggcccggccctggccaaggccgcggtgcagccgctgccgcgctgggaggggcggggcagcctcctgctgcggcgtctggaggcgtacgaggtggggggggtgattgggtttcggggtagtgtagtggtgtgggggggcgcctcgagcagggaaatgctctgggttgcggcgatgcgacgggcagannnnnnnnnnttttcagggtagtggtgtggtgtgagggggcgcctcgagcagggaaaggctctgggttgcggcgatgcgacgggcagatgccagggaggcgtttatcggcagagcgcgccccggctgggccggactggtctgggcggcgggctgcgggtgctgtgagggggattccctcgatcccatgcacccaggctgccccagtgcccaccactcctcaccccccaccaccaccgaccctaactccctcagggcgaggaggggaatgatgnnnnnnnnnnccgggcacgccgggcgtgggtgccgtgcgccccccgggggatggcgcggggcccgcgccactggccgtgcccgacctcctcgacctgctgggtgagagattcggtgcttgtcggggaggtgttggtccctgcaagcgccctggtcctcggccgtccagcgaccagcgacgtgttgatgtgcggtgggtcatgggtgtgtctgatggaacgccccccctccccccccctggcacttctttgcccgcccagcagtatcttagccccccctccttctcaaccatgtccccctcttccacccacacgcagaccttggggagcccagctccacgaccccggcgctgggcggcctggagggtctgggcctcccccccacgccacaggaggcggcccccgccccatccccgccccacccggcgccggcggccgtggcgcccagcggcagcctggaggcctggtcccggcgcctgtggacgcaggcctcgggcatcctgtatgaggacgccaacctgcaggccggggtcaagtcggccttctcgggcgcggcgggcaccgtgacggtcttcctggggaacaagaccggcggcgtgctggccggcgtggcgctggagatcgtgggtgcgccgccgcacctgacggcgaccctgccggcgccgcccccggcggtgctagagccgcggcggcaggtccaggtccccctggaggtgggcgccggcgcgccgggatccgcgcccctgcgcttgcgcctggcctatcacacggccgacggcgcggcggcggacgtgcagctggacctgccgctgccgcccgccaagttcagccagccagtggatgtgcccaccgaggtgtttgccgcgcgctgggagcaggtaggtgtgggggagggcggctctggcggaggatgcctgagactttgtggatgggtgtgaatgttgcctggtgggtggagcgaggaggggaaggaggggtcgtcattgaaactgccacccgacccagattcccgtgcaccttgcccatcgctgacccccacaaacacacacacacacacacacctcccaacaannnnnnnnnnctgcccatcgctgacccccacaatcacacacacacacacacacacctcccaacaacgcaggtggccggcccgcccttcaaactgagcgccgacgtggcgccggcgagcggcgcgctttccgatgccgcggtgcagcagctgctcgcctcgctgcacctccgcgtgctggccggcgtggcgggggtgccgccggggtccaccgccgcggcctgcgtgctgcatgtgggcggcggcgccgcccccgcccgccagatcccctgcatggtggtcgtggcggcgggggcggggcgggtgacggtggccaccgccgacggcgcggcctcggcggcgctgctcagccagctgacctccgtcctgggctggggggcctgaaggggcctgggggaggtgctggtcaggcacctgcagggatctgtcaacacccccctccataatcccgtcagctccgggtccagacagatcgggcgcgtgtgcagtttgaccccacannnnnnnnnnagtgctggtcaggcacctgcagggacctgtcaacacccagtccatgatcccgtcagctccgggtccagaccgatcgggcgcgtgtgcagtttgaccccacatgtcgtcatctgtcgagcccttccccctcccatcttgtgacaccaagtctcagaggtttacgattccaaagtgctgctagtgtcaaattccggatcgatcaggatcagaggggattcgtgccatagttcgtccttcgagaacacgtcatgggctacgcaggtggggtttccactcgtgcggaggacagatacacttcctattaattcatctccatgtccacccaagactttccagtcccagccggtcccttgtcgcctcgnnnnnnnnnntcactcgtgcggagggcagatacacttcctattacttcatctccatgtccacccaagactctccagtcccagccggtcccttgtcgcctcgacgcagggtacgtgccggcaaagctgcccccctccagcctcactcccgtccaaaccgcactcttcctcgtctcctccgtctcctcgctggagctgatagagaagctagtgtacaacgctgtggtatcgccccaggaaccaaaattcaagaaggtgccacccctggtcactctcccggacgcaatgtcaactgctgctcaccctggggctcttttctcatgctccctttgcctctcagaggtcaacacccctcacctttccaggtgcgactgggcaatccccgcatcaaggccgccatcatcgacacgcccgctgcgctagaggccatgctggccatgggttggcagcaggcccaggagggagaggaatcggtgctcctgctctcaaaatctttgtccatggcagtggtgcgaggggaagccttggggatcgaggggtgcctgtatggatcatgtggttagtatgcaacctgcccgttgcacactttgttacctggctttgtcaagggacgactcaggttctgatctctcgatcatgtgtctctagacacccggttcctctgacctctcctcgtatcaagtatgcatgtatgtatctctcgatcatgttgccatactactggcaagaaggcttccaggccaggccaggcagcacctgcatggccgcctcacccgctcccacccccctctggaccccggcacgcaggtgcgtgatgttcaggaggccgcctcgcgcgcaaagaaggcggcgcaggaggcccagcgcaccgcgcagcgagcggcggccgccaagccagctgcgctgccggggtctgacagccgggagagcctgcgggccatgctggaggccgaccgccgggaaagggcggcgcgaggtccggtcagcgtcggcagcgtcgcccagccgctgcccagcgccggaggcggcggccctgcccgcatccggacggcaggggaggccggactcaactcgggctgatggaaggggcagtgtccagcaggcgcatcactggtgcctcggtattattccctcgggaccttgctagggggttcagcgctgctcagacatcaacaggctgcagtttatggttcgtgaatgtgcccgccagcataccaaacgcatacctgccatcccctttcctggtgcattcggtgcccgcaccctgtgtgcggcgggcagtccatggcgtcgaccatgctcccacacctgtgcctggccagcaaacttgtctgggcagtgttgggcgcggggtggaagcagccgctcaagccgggctggcccccttcacccccgcatcaaccgcccctaatcacccaggaaatgcaccacacctatccctgcattgcacgcttctgtgaaaccacccaactgagagcaagagggctgtacaggacattcaactgtggagactaaggcatgcgtacactgcgcgaggggtgcggggcctgggcgacgctgcgaggaggcaagcgggggcgatggtacagaagcggaatagaggggcaggtgcacaaggggaggtggtcgagatgtacggaacaggataccaaagcagcgtggaggtcacgcaacccctgctgtggggactgggcatgcagcgnnnnnnnnnnaggatgtacggaacaggataccagagcagcgtggaggtctcgcgacccctgctgtggggactgggcatgcagcgcgctggcacttctcccctcagacaagctcgggccccggcgaggcgggcacgatttccgcggcgggcgagcccggagaccccgccgcccggaggcccccgccctccagcagcccccgccgctcgtcctcccgcggcgggctgctcagcgcctgcgtcagcgcctcgggcccgtgccacagccgggccaggcgcctgcgcgcgcggcgcagc

SEQ ID NO: 44586 - DNA, 83 bp, Chlorella protothecoides
cccccccccccccccccccccccccgcgcctttcccttcccccacaaacctgtaaggttgacgccagctgcgtcacggggatg

SEQ ID NO: 44587 - DNA, 61 bp, Chlorella protothecoides
ggatggcgtcggctgccacgacggtggggggggcaaagaaagcctgctcgaccagggcaat

SEQ ID NO: 44588 - DNA, 61 bp, Chlorella protothecoides
tccagaggtaggagaacttggtgtcgtcctcggccgggggcaggtccccatcgcgcacgcg

SEQ ID NO: 44589 - DNA, 61 bp, Chlorella protothecoides
gaaagggagagcaggttcctgaactggctggtttccgacagagtcttgatgtatgccgggc

SEQ ID NO: 44590 - DNA, 61 bp, Chlorella protothecoides
ccaccgcgccggagacgatggtggcggcgggggcggcaaaggtgaactggaagaaccagga

SEQ ID NO: 44591 - DNA, 74 bp, Chlorella protothecoides
ggatcgtgaccgggggatggggtgtggcagagctcccacccctgctcactcctgggccccctgctcgccgccac

SEQ ID NO: 44592 - DNA, 85 bp, Chlorella protothecoides
gtcctcggggctgggggcgccggggggcggtggggcctggagctgcggagggctatccgcggggcagccggccgaggcgtcgtcc

SEQ ID NO: 44593 - DNA, 73 bp, Chlorella protothecoides
tccgcctggggcagggtggtcgggaggcttgagttcaagaatcaaagtcatgtgtcctgccgcggcccccgcg

SEQ ID NO: 44594 - DNA, 61 bp, Chlorella protothecoides
atctggaacacggccttgtccggcagcccccccaggtcagagtgggtggccaggtagcggg

SEQ ID NO: 44595 - DNA, 79 bp, Chlorella protothecoides
gcggccccgacgcccgccccgccgtggtggcccccccgcccctgcgccgcctgcgcgtgccctgccgcgccggcctgtc

SEQ ID NO: 44596 - DNA, 2500 bp, Chlorella protothecoides
  modified_base (175)..(184): a, c, t, g, unknown or other
  modified_base (259)..(293): a, c, t, g, unknown or other
  modified_base (448)..(457): a, c, t, g, unknown or other
  modified_base (702)..(711): a, c, t, g, unknown or other
  modified_base (832)..(841): a, c, t, g, unknown or other
  modified_base (1233)..(1242): a, c, t, g, unknown or other
  modified_base (2063)..(2072): a, c, t, g, unknown or other
  modified_base (2174)..(2425): a, c, t, g, unknown or other
ggcggcggcgcgcgccgccgccgccgaggcggccgccgaggccgtggaggcgggggaggaggtggagctgctgcgcctgaaactggaggccgccgagcaggacaagatggaggcccaccgcctggccgccgaggccgaagccgcgctggcggcagctgtggcggggggggggggnnnnnnnnnntgagcaggacaagatggaggcccatcgcctggccgccgaggccgaagccgcgccggcggcagccgtggtgggcgnnnnnnnnnnnnnnnnnnnnnnnnnnnnnnnnnnncccggcgtggcggagggtacaggtcgtggggcggcggggcgggacgtgcggcgagaagaggccggggcagaggagggcgatttggggggtggacggcgagcggcgggaggaggcgatgccaccctgtggcgcgccgggggggtgccctccccgcnnnnnnnnnnggccgacgtggggcatggacggcgagcggcaggaggagccgatgccgccctgtggcgcgccgggggggtgacctccccgcccgcgcccggggatccctggtccggcacgacggcgagctcagcccagccaccgcacctcgccggcgcgacacgccctcccctggatgacaccgacgcggcggccgcggcgctgctggcccagctggaggcgtgcatcgggccggggagcggcgtggacgccgccnnnnnnnnnntgagggcgcgtgcgtcgtggagcgggacgccgctgtgcgccgcgggccggcgcccctgcgcctcccccgccgggcctcctcgccggcgatgagcgcggcggggacgccggggtcgcatgcnnnnnnnnnngcgcgtgcgtcgtggagcgggacgccactgtgcgctgcgggccggcgcccctgcgccttccgcgccgggcctcctcgccggcggcgagcgcggcggggacgccggggtcgcatgcgctggccggccccgcctccccggatgttccttgctgggaggggcgctgcgacgacgacgacgacgatgaaagtcccagcagcagcagcagcgagggggacgacgatgcaagggacagggcctacaccccttcccaagccacgcccgcccccgcggccaggcggcggcggcgggggaggggccggagcctggagcgcggcagcacccgcgtcggcggccatgcgactggccgtgcgggtctgtccctcgaggcgccgctcctggcctggctcaacgcnnnnnnnnnncggccgtgcgagcctgtcccacgaggcgccgctcctggcctggctcaacgcctggctggcgcagcaggggaggcccaccctggcgcgcctcacggtgcgatgggtgttgggaggaaagggagagtggatttttctgggtggcagggggagatgaggcacggtgcagatcctcaccatacgcgtgtgtccgacctgctggacgctgataccccgcacaccacgtgcgcgcaggtcccggtgctccgcgccttcctcgacggcactgcggccggggaggagggggtggtaatccggggtcgcaggaagtctgccctcctcgcccagctgcaggcctggctggggtcgcacgccgccgggctgcgcccgccggcgctccccgcagaggctgcggggggcgcctgcaccccgccggggagcgacggaaccccactgggcgcggccgaccagcccaccccggatgcgggcctcgggccgctgcagcgcctggaaccgccggagcgcggccccccgccggtcgcccgcgccgaggcctcccccgcggccgagtacctgcagcagagcgaggaggcgcgggcgcggacggccgcgctgaaggccgccatcgaggagcagctacgcaagcccaccctctcccagctccaggccatggccgcctcgccgctgcgtgcgtctgaattcttttgttgttcctggaagggcaggaggggttgtgtctccaatgggcgtgagtctgcagggctggaggagcggattggagggccggatgatccttgttcaggagcacgctctccatgtcgcgcgccgcctcaggcccctgcaannnnnnnnnntggggggcgcctgcaccccgccggggagcaacggaaccccactgggcgcggccgatcagcccaccccggaggcgggcctcgggccgctgcagcgcctggaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcggcatgaagcgccggatgatccttgttcaggagcacgctcatcatgtcgcgcgccgcctcaggcccctgcaa

SEQ ID NO: 44597 - DNA, 9834 bp, Chlorella protothecoides
  modified_base (478)..(487): a, c, t, g, unknown or other
  modified_base (1005)..(1014): a, c, t, g, unknown or other
  modified_base (1699)..(1708): a, c, t, g, unknown or other
  modified_base (1853)..(2036): a, c, t, g, unknown or other
  modified_base (2110)..(2119): a, c, t, g, unknown or other
  modified_base (3321)..(3330): a, c, t, g, unknown or other
  modified_base (3606)..(3615): a, c, t, g, unknown or other
  modified_base (4198)..(4207): a, c, t, g, unknown or other
  modified_base (5018)..(5027): a, c, t, g, unknown or other
  modified_base (5113)..(5122): a, c, t, g, unknown or other
  modified_base (5203)..(5212): a, c, t, g, unknown or other
  modified_base (6523)..(6532): a, c, t, g, unknown or other
  modified_base (6849)..(6858): a, c, t, g, unknown or other
  modified_base (6931)..(7028): a, c, t, g, unknown or other
  modified_base (7890)..(7899): a, c, t, g, unknown or other
  modified_base (8154)..(8163): a, c, t, g, unknown or other
  modified_base (8912)..(8921): a, c, t, g, unknown or other
  modified_base (9409)..(9418): a, c, t, g, unknown or other
tgcggtacccgactgccaggggggggggggagggagggcggggaatgttacggagtcggggggagaaggggaaatgttggaatggtccctgtgccggcaagcagggtttattaccaggatgacgggccggactctcgcgtcaaccccaggttcccccccccaatggcacaaaacgaccttgtgccccggccgcacctgccgtcgcagccgccgtggccgactcgccgatggattgccggaaggattcgctgatgcccggggcaggggcctcctcgatcacctggagtggagggaaggttgagggtttatgtggccatgtgtacttgtgtgtgtgagctggcggaggggctcacacccgcccactcatgactcagagagcctgtacctcgggctcttcccttgcctcctcatccccccgtgattcccaactgccccctttcccttcctcctcaaaggcaccttttggtggcgccgctgnnnnnnnnnnctcccttgcctcctcatccccctgcgattcccaactgccccctttccctttccccctcaaaggcaccttttggtggcgccgctgcacggagcagtcgcgctcgaagaggtacacggcggcgccgtgcgcgtcagccatcacctgcacctccacgtgccgcgggcgctgcacataccgctccagcagcactcggtcgtcgccgaagcccgccagcgcctcgcgccgcgcggagttgagcgcgtcctggagggtggtcggatgtgtggtttgagggggggggaggggggggggtcacgcagcagcacccggcaatgagcacgcagtgctcagtgtggtcggcatgggaccacgagacgcagctggacgagtgcttctcagcgtcctgcatttgccgtgccagccatgcacatacagcagccctggcgcgccgtcgcacacccctcctgaaccagcagaacacccctttggcccaagcacagcctcgtccctccccatgcaagccacccccggacccatgnnnnnnnnnnaacctgcatttgccgtgccagtcatgcaaatacagcagccctggcgcgccgttgcacacccctcctgaaccagcacaacaccccttcggcccaagcacagcctcgtcactccccatgcaagccacccccggacccacggcctcaccatgaactcggcacgggaggcagcgagcttcatgcccttccccccgcccccaagcaccgccttgaccaggacggggtagcctattcggtccgcctcggcctgcagccgctcgttggcctggtccgcgccgtggtacccgggcaccacgggcacacctgccgccgacatcagcgccttggcctcgctcttgttgcccatggagcggatggcggaggcggggggccccacaaacgcgaccccggcgccctccagcgccgcagcaaagtcggtgttctccgacaggaagccgtagccggggtggactgcggtggtgccggtcagctgggccacctgggatgggacggggggtttgcgggggagcgggtggcgggcagtccaggtgccgatccggggaacgggttggcgtggcatgcaccccagcctcgaatgattcagggacccagttcaaggcctctgcctccatgcggcagcttgaagatgattcatgaaagcacctcaaaagcccctccaaggtagaggaccccagaggatgacaagcannnnnnnnnntgggctggcggggcatgcaccccagccttgaatgattcagagacccagctcaaggcctctgcctccatgcggcagtgtgaagatgatccatgtaagcacctccaaagcccctctaaggtagaggaccccagaggatgacaagcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatgcgggagggtgccatatcgtggctgcacatgcatcatggtgacacaatggactcctcctgtccctgctcgnnnnnnnnnnagccatgacgaaacccacctccaggatgcggtcggtgcggaggtagctgtcacgggcaggggcgggcccgatgcagaaggcctcgtcggccagggagacatgcttggccgcccgatctgcctcactgtacaccgcaacgctcggaatgcctgagaggggtgtgcgggggggtgccatgtcatggctgcacgtgcagcatggcgacacaatggactcctcctgtccctgctcgcatgtctcacgcaccaagcttccttgcagaggtgaggactcggcatgcaatctccccgcgattggccaccagcagcttcgagatggcggggggctgtgtcggcagcggcccgctggtgaggctcctggccaggtgccgcgtcaagctcgccaggagtgtgcgtcgtttgctcctcccatggagtatcagagcattcatggtacttatgggtgtgtttcagatatgcaggcggcaggagggggtcagatctgtcgagttgaggtgtcggaggcgaggggggccgcggggaggaagagtggttcgcagaggcgagcgatgccaacttgcaagcgcccagaatagtacgagctttgatcaaggtctatcaaccagctggaggccagccagacacacgaccagccggtttttacttggtcgcatggtgctgagctccacgtcagcgtttcggcgagacaggcgccccgcgggatgaaagtcgaagcgagggatcgtggcgcaacgggatgttgtgggatcatccaaagcaattctggttgcacttgatcaagccacgcgggaggaaacttgcacatcgtgggatcatcggtcctcaggtctgtcgtcgtcgggcgtaggggaggtcggcagtgggctgtcctgcacggtagccttttttacctcgtgaacccaatacttcattctgtgtgccatccacagatccggccatgatgcgccttgcgtcacgttgctggagcagggtgggtgagcgtgggctctccacaggccagttgcaggtggccctggaacccctggatggctccatcttcatgctcaccctgaaccggcctgatgcccggaacgccatcgggcgccagttcctgagggagctgaaggagagcctagacaatctggtcctggagaggtccacccgttgcgtcatcatcaagagctcggtgtcccgagtgttttgcgcgggtgccgatctgaaggnnnnnnnnnnaagcctagacaatctggtccaggagaggtccacccgatgcgtcatcatcaagagctcggtgtccagagtgttttgcgcgggtgccgatctgaaggtgggcatgtgtgctggggggccaggggagcccagggtatgggagctggggatgtccagcggggcaggggccaagaattcaaagtagtaatgccagcttctcagcgctgatcagggagtctgtgttccccaaggctttccctggaaactggtttgcaggagagggcaaacatgaccaggcannnnnnnnnnctgtgctgggggggcgggggagcccaggggtttgggagctaggatgtccagcgggggcaggggccaagaattcaaagtggtaatgccagcttctcagcgctgatctgggagtctgtgtttcccaagaccttctctggaaactgctttgcaggagagggcaaacatgaccaggcaggaggcctccgcattcgtgcgtgacttgcgcggcactttctctgccttggaggccctccccatgcccaccatcgcctgtgttgatgggtgagtgcctggaccatcgatgcgaagggttcaagtgggcgtctgtttgctggagggtttgcagctggctgcacatgtttaatgacaagcgttgcctggctgcaggccggggcatctttggcaagggtggatgtacgcatcatcattctcctcaatctcaattttgcaggtatgcgctaggtggtggtgcagagctggcactcgcctgtgacttcagggtttgtggtgagtcgttggggttcaaagcgacgacgtgcttccttcggcagggcattcctgtcgaggcccagcgcagcgggggtgcgacatcctcggcaatcgnnnnnnnnnnattggggttcaaagcgacaacttgcttccctcggcagggcattcctgccaaggcccaaagcagcgggggtgcgacatcctcggcaatcgctgcagtggctgccttgatggggttcatgcttgctgtctgcgttgcagatgcgctgtccccacccagcactgagtggttagtgaatgttccaactgcttgtgtgctcctttccattccagggactggcgcccagtttgcgttccccgagactcgcctgggcatcattcctgggtcagtcgaggactggaggcggggttttggacgatcaatggacagtacagcagcagtcacgggcagccatggtcactccgggcctcttcccatgtccccgccctcaacactctccctgcagggcggggggcacgcagaggctgccgcgtgtggtcgggactcccagggccaaggagctcatctacacggggcgcaggatatctgcgcaggaggccctggacatcggtgggggcccgcaaggggcagctggctgaggattgggtggcgcggggacctgggtgcggggtccttccctccctgtgctcctgcctgtgacagcggctgccccttctcccccctctctcctttgagatatcaaatccaaccttcccttctcccaggtctggccgaccacctggctgactccgtgtctgctgaggaccgggcgctgcgcctcgcccgcgacatcgctcaggtgagggggggtgccgggggtgccgtgccggaggccacagtttggaaggccgggagtttcatgctgcagtcgactggtgaggggcaaggttcaggnnnnnnnnnncttcttccccccctctcctttagaatatcaaatccaacctccccctctcccaggcctggccgaccacctggctgactccgtgtctnnnnnnnnnnggcaagtctgtcgaaggaagagcaccaacccagtccctgccccttctgccaccatgaatgcaggggggacctgtggccctnnnnnnnnnntaggtggccgtgccggaggccacagttttgaagggcgggagtttcatgcggcagtcgactggtgaggggcaaggttcaggggcaactggccctccatgcctggccggtgtcagccggctgaccatgtacagaacgagggctcgtccattctcagtgagcaatcccagtctgcacacatcagcacccacatcccaacctggcgcacgtctgtccaaggaacagcaccaacccagtccctgccccttctgctaccatgaatgcaggggggacctgtggccctccgcatggccaagcaggccataggcctaggcatggaggtggacctggccagcgggctgctggtggaggaggcgtgctacgcccaggtcatcccaacccaggaccgactggaaggcctgaaggcctttgcagagaagcggccacccgtgttcaagggggagtgattgggcacttgcagggcggcctctctgtatctgttctacaaccccttcccaaccgcatcccccaccccttgtccatgtggcaaggctctgtgagggtagagcatgggagtttgccagacccaggggcgaccttgctgtcgcctccacgactatttaatatcagtcacaacagtacagatccggagtgtccagtgtacatctacaattccaatgatgctcgggtgtgttgtggggggtcctggagctccaggcttgtgcgcctggccacgcctagccgctgccctctgctgcgacgctcttgccctccctgacagcagcgtccttgggccccacacccatggcctggccctcaccaggcgccttcctttccacctgctcctccagctcatcaggggggtggaagggctctgcagcggcgtgcggacccgcgtccgccgccgccagcagcgcgcccctgccctctggggacaggtacgccgatgtggcgtacgccacctggcgcatgaactcgctggggttgtcgatgaagaggtagtgccccgcgctgggggtggtcaggatctgcagatcggactcacaggcggggctgcgctgctgcgccagggctgccaccatgcgcttggcgcccgccgggtccatccagtccttgtcacctgggtcatgcatcggtttgcagggagcatgcgtcggtgtgcaaggtctggaggaggggtgccaagccggtgcgccgaccagtttggatggccaaggccggagaaggggccgctcccatcgccagccgtcccctcccgcccccccgcctctcccacgtcccagacacacgcaccgtagaagaaggtgacgggcacgctgaggtcggcgcagcgcnnnnnnnnnnaccagccttcccctcccgcccccccgcctctcccacatcccagacacacgcaccgtagaagaaagtgacgggcacgctgaggtcggcgcagcgctcctccagcgccgagcgtggccaggcgtagggagccaggatgtggcgcagcgcgaactcgcccgacccgcgcgccgccaggatgtggtagaagtacgattcgaagcgcgccacctcgtcgtcgttgaaggccaggccctgcagagagttgcggtgactggtttggagcgtcagagcggtcgaaggtgtggggtggcagggcatgaggcatggtggacgccacnnnnnnnnnntggcgactggtttggagcgtcagagcggtggaaggtgtgggatggcagggcatgaggcatggtggacgccacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgacaacaccggttcacctgctggaagcggccgcgcgcgtagcgtgccaccaggccagggccaaagggccccagcccgcggatgaccctgcccggggtcaggtcgtggtcccaggccgcgatggcggcgcgcgccagctgcccgcgcagcgtccagcgccccgctagcgcggcgggcgggcgccagtccgggggctggcgccccacgcccacaggcgacaccagcagcaggtgctgcacgcgctctgggtaccgcgcggcgtagcaggtggacaggtacccgcccatgctgtgccccatgagcagcatgcggtccagccccgccgcggcgcgccacgcctccaacgactccacgaagaaggccaccgcctcctccgtggagcgggccgggaagcgcggccgcccggacagccccgtgcccagcaggtccacggcgtggaagtggaaggcggaggccagcccgtccacgatgcggaaggcatgcccagaccccgcagcgtacccggggatggccaccagggggggggcgtcgggatggggagggggggccgtgattgtgtgcatgtagtccgccgggccggggccgaccttgacatcgctggtctgggtgggcgtcctgagcgggcaggagggtgggggacaaggtgggaagacggatggggatggaagggagagtttacactctggaaatggtgtggtggtggtggtgggggggagaatagggtgagccaaccacgtgcacagacaggcttcccttgtgaacacggatcatgtcactctgaacaacagacaccccatcctcattcacactacctgcagagcgcgaggaggcgctcctcagccgccactgcctccttgtggnnnnnnnnnngcagtacccgcagagcgcgaggagacgctcctcagccgccactgcctccttgtggcttgtctgccgccaccgcgagtaccgccggtacctgcgtcgcagcgggcatggttggaattagggacgctgggttaccgagcaggccgctccagggctgggcgcaggcagggcatgcaggttggcccactacctcccagggcacagctgctccaggcatgataagggacccctttcaaacagcatgccaaaagtatggcnnnnnnnnnnatcgcagcgggcatggtcggaattagggacgctggggttaccgagcaagccgctccagggctgggcgcaggcagggcatgcaggttgccccaccacttcccagggcacagctgctccaggcatgacaagggaccctttcaaacagcatgccaaaagtatggcgcccgtctcatcacgccggcatcctgcataccatggagttgcggcgatggccggggaagggggggtggcgtcgggcctggccatcctccggaacaccagaatcagagagcgccgcaccgtcgcggcgggagaaggcgccagagcttgggttttggtcggttctcaacgtgatctcaggtgcagaccgccaatggttggaggccgctcctggctgatcagccgaacgcgccggtgccagaacctcgagatcacttcttgcctcttcctggtcaacacacagggagagtgcagcctgatgcctatgacaggtagttctaaaggtatggggacaaagaacatttaccctcggcgtgccgagcgatgtcgcctcgtcttgaggcagggagaggccccacctctcgagattatggcacccccacatcattgaggcattgtcaaccttcctggtggcttcccccctttgtgcaactcgatcgtatttcagtcagctagaccaccaccatcctgtggaccagcgggggagccagaacaggcggcacagcatgagcatgggttcaggggtgagagagggttccaaagggcggggnnnnnnnnnnggtcagctagaccaccaccatcctgtgcaccagcgggggagccaggacaggcggcacagcatgagcatgggtttaggggtgagagagggttccaaagggcgggggcccggggaaaatgaacaatcttctggtcaacgtgaatcagtgctttcggggtacagggtgtcggtggtcgccgcaagccccctggcctggccaggggagtcaactgtctcaggtggcacacacacacacagtatgggtggggcggggttcaaactcgggactcagaccgggtggcggggctccaggctcgctgcatcgtcccgtccgcgccaagagaaaccaaaaccgttctcatctacgtatctattgctgctgcaggccgggccggccagcgggagggcgggcgggggggtctggcgcggcgcggggccccggcggcatccggggttcggctgtgctggccccgccgcgccccccctacatgaacccattcagctggttgnnnnnnnnnntgggtggggggtctggcgcggcgcggggccccagcgccatccggggtcggctgtgctggccccgccgcacccccctacatgaacccattcagctggttgtccggcagggagttgcgccaggcgcgccagccgtcgtagtcgttgggcgtgaagtcgcccgtggcacaggtcacgccgcgccgcgcccagaggccgctggcctcctgggcgtgcaggcccgcctgcagcagcggcgcgtcgttgtccagatgcttgagcaccgtccccgggccgcagtcgttccaggcggccttgaagccgtcgtggtggtgcacgcgcgcgccgctgccgcgcagcagcgccgccaccatgatgtcctcccagggcattcggccccaccagggcggcgcggcggcggccggcgcggcggcggccgc

SEQ ID NO: 44598 - DNA, 61 bp, Chlorella protothecoides
tgaatgtcgaagggctggatcgcgtccccccccagcacgaagcccagcctacatgctggcg

SEQ ID NO: 44599 - DNA, 61 bp, Chlorella protothecoides
actgggcctcgcaccttgcaccatggaaggaatgcctgcctctgttcttgttagtttatgg

SEQ ID NO: 44600 - DNA, 61 bp, Chlorella protothecoides
tgttcatcttattatggtaaaaatcaaaccggatgaaattagtagtattattaaacaacaa

SEQ ID NO: 44601 - DNA, 42077 bp, Chlorella protothecoides
  modified_base (133)..(162): a, c, t, g, unknown or other
  modified_base (263)..(272): a, c, t, g, unknown or other
  modified_base (2620)..(2629): a, c, t, g, unknown or other
  modified_base (2928)..(2937): a, c, t, g, unknown or other
  modified_base (3190)..(3199): a, c, t, g, unknown or other
  modified_base (3508)..(3646): a, c, t, g, unknown or other
  modified_base (3803)..(3812): a, c, t, g, unknown or other
  modified_base (4008)..(4017): a, c, t, g, unknown or other
  modified_base (4413)..(4422): a, c, t, g, unknown or other
  modified_base (4633)..(4642): a, c, t, g, unknown or other
  modified_base (6589)..(6598): a, c, t, g, unknown or other
  modified_base (7985)..(7994): a, c, t, g, unknown or other
  modified_base (8275)..(8284): a, c, t, g, unknown or other
  modified_base (8554)..(8685): a, c, t, g, unknown or other
  modified_base (8856)..(8865): a, c, t, g, unknown or other
  modified_base (9614)..(9623): a, c, t, g, unknown or other
  modified_base (9851)..(9860): a, c, t, g, unknown or other
  modified_base (9921)..(9930): a, c, t, g, unknown or other
  modified_base (10008)..(10017): a, c, t, g, unknown or other
  modified_base (10589)..(10598): a, c, t, g, unknown or other
  modified_base (10962)..(11027): a, c, t, g, unknown or other
  modified_base (11504)..(11513): a, c, t, g, unknown or other
  modified_base (12430)..(12439): a, c, t, g, unknown or other
  modified_base (12883)..(12892): a, c, t, g, unknown or other
  modified_base (13100)..(13109): a, c, t, g, unknown or other
  modified_base (13490)..(13569): a, c, t, g, unknown or other
  modified_base (13952)..(13961): a, c, t, g, unknown or other
  modified_base (14261)..(14270): a, c, t, g, unknown or other
  modified_base (14340)..(14349): a, c, t, g, unknown or other
  modified_base (14968)..(14977): a, c, t, g, unknown or other
  modified_base (15805)..(15814): a, c, t, g, unknown or other
  modified_base (15919)..(15928): a, c, t, g, unknown or other
  modified_base (16478)..(16487): a, c, t, g, unknown or other
  modified_base (16870)..(16879): a, c, t, g, unknown or other
  modified_base (17609)..(17618): a, c, t, g, unknown or other
  modified_base (18331)..(18340): a, c, t, g, unknown or other
  modified_base (18987)..(18996): a, c, t, g, unknown or other
  modified_base (19860)..(19869): a, c, t, g, unknown or other
  modified_base (20724)..(20733): a, c, t, g, unknown or other
  modified_base (21649)..(21658): a, c, t, g, unknown or other
  modified_base (22440)..(22449): a, c, t, g, unknown or other
  modified_base (22860)..(22869): a, c, t, g, unknown or other
  modified_base (24318)..(24395): a, c, t, g, unknown or other
  modified_base (24699)..(24708): a, c, t, g, unknown or other
  modified_base (24848)..(24857): a, c, t, g, unknown or other
  modified_base (24964)..(24973): a, c, t, g, unknown or other
  modified_base (25432)..(25441): a, c, t, g, unknown or other
  modified_base (27229)..(27238): a, c, t, g, unknown or other
  modified_base (27513)..(27522): a, c, t, g, unknown or other
  modified_base (28211)..(28220): a, c, t, g, unknown or other
  modified_base (28319)..(28328): a, c, t, g, unknown or other
  modified_base (28398)..(28407): a, c, t, g, unknown or other
  modified_base (28783)..(28792): a, c, t, g, unknown or other
  modified_base (29139)..(29148): a, c, t, g, unknown or other
  modified_base (29231)..(29240): a, c, t, g, unknown or other
  modified_base (29912)..(29921): a, c, t, g, unknown or other
  modified_base (31334)..(31343): a, c, t, g, unknown or other
  modified_base (33690)..(33699): a, c, t, g, unknown or other
  modified_base (34176)..(34185): a, c, t, g, unknown or other
  modified_base (34617)..(34626): a, c, t, g, unknown or other
  modified_base (39436)..(39445): a, c, t, g, unknown or other
  modified_base (39949)..(40001): a, c, t, g, unknown or other
  modified_base (40470)..(40479): a, c, t, g, unknown or other
  modified_base (41212)..(41221): a, c, t, g, unknown or other
  modified_base (41537)..(41546): a, c, t, g, unknown or other
ggcggcgcccaccgccgccagctcgcacgcgatgcgtgccagcgcggctgccgcgccgaggccacgcaccgtgaccagctcgtcgctgacgcgcgcggcggggggcagctcgccgcgcggcaggatcttgatnnnnnnnnnnnnnnnnnnnnnnnnnnnnnncaatgatggccgccgccgcggcggtcaggcccgccaccagcgtcgcggcagcctcctcgcccctgcgagacgcggaggggtggagggtggtgggtgggtgnnnnnnnnnngcgccggagtcgcggcggatggcggcgatggtcgcgccgcccttgcccagcagctgcccgatgtgggcgccggggaccagcaggcggaggggggagtcgctgggcttgtccccggcggtgatggccgccgccgcggcggtcaggcctgccaccagcgtcgcggcggcctcctcgcccctgcgacgcgcggaggggtggagggtggtgggtgggtgaggggggggggcgcccgggatggaggtgaggctgccgagaacgacagccaggcgcacaaggcatgctcatggcaggcatgggcggcacggcccgcgccccgtgctcgccctgccccgagcagagctccccccatcctgcgcaggtgtgttgctccttcctcaagccatgggtccctttccatgcgcactcggcggcggtggtgatggtgaccacgcgcgactcgctcccggggaccagcgcctccacgcccatgatggtccccgactcgcgggcgagctgcttgatggcctcccctccctgccgaatcgtgtgcgcggggggtggaggtctggtgtgaagcccagggaggatcaagctcaggggtcggtcccagtcccacctcccgaaccccatcctccccctcgcaagcccaagggttccatgagtgtgcaggcccgctccccagcgacccaactgctcaccccccctcaccttgccgatgaaggcgcccacacggttcaggtcgatgaccacacggatctggggccgggacacggcatgctcagcggacagcttcagtttctggggcacgggagtgaggtggcgggtgagatccctcataccccagcgcaggcagggcggtgatcacgctgcgacaccttccttctgcacacctggacgccattcgtgactcgagagctgtccacgatgccgtcctggctgttgaaagacgggctcaggctcgcggtgtcgtcggaaacttccccgtccgatgccgggtcctgcatcgaggatcatgtgcaacgattcctggtccaaccacagttacagcttgggtaatgatgatatgccctccctcgcggagcctttgagactgcacaccgcacacacggggggtgtccaggagggagatcctcaaccccgcgcagaggcttacttcgctcaccttgcgtggggatgccatccttaccacggcgtgatgataacacaccggcaagcacgcgtcctttgggttgcaaaggcgattacggagcaagagcggtgcaacctcccgaactgtacgagagggcttctcaggagtggaatggagcggggcgtgtgtcaagtaaacaataaatatgatacagttagggacttgcccgtaccaccttgtcatgtcactcccatagtgggaaccagccccttgtgtacgagaatcgttgtgccccgtcacgggctggccctcacccccgcgattcgcggtcactccaaatttcgcgggggcagcatcgcatggagggtcagtgtccatcttccctcataaatcgatccattacatgtgaatgaatatgcaagcgacggtcctgcctgcctggagtggacgggcaggctgcggcccaagccacacccgctgtttccgacatggcgtgcaccccccacgcgtccagccgcaccgacgggacgcacacatccgactgcttgcattgtccaaggaagaggaggacgaggggtggattgagctggacccggagatgccgtggttgcagggggaggacggaccactggagcgccgggtctccacgacattcgaggagggcctcctgtccgatgtggtggatgaggaagccatgcggtactggttcagcgagccgcaaggtgggctgcagggcggtgtacggcttcctggcgcgcgggattgctgctgcccaggctcatcgccctgagaccatgttcattgtgcctgaccatccctccccttccacactccagacggctggcccacggagaagcggcgcgtgaagctgttgaagcaggcacgcgaggccgagcagcgggtgagcgatagcgcatggcacgaggatgcgcagggacgaactccccttcccggggtggtggaggggctcgccgtctcgggcaccgtcacctcgcagatgaggtacctgggcgtgctggtgagttgggatcctagtgccatgcatgggcgggatgagggctgtcgtattgcatgggcagtgaaggatctttatgtccagatggtcactcccggtgtggtgctgtgcagcatgtgctggtttggtgggtcagggtcatctcattcgtccacgccgcacgaacagggtcttagggcggtgctagagtgttgctgcaacctccaagccgggcctcacccaccnnnnnnnnnntaggggcatctcattcatccaggccgcacaaacagggtcctagggcggtgctgaagtgttactgcaacctccaagccgggcctcacccaccactcaaccccatccctcgctcgccccccccccccgccaggtggactttggcgcagagtacgacggcctcattcccctgaacgacgaggcgacctgggacgccctgggcaaccgcctgcgggttgggtcgtgcgtggaggctcgggtgcatcgcgtgagggacgcgcgcctcttcaggtaccccgtccagctggcgcccgtggaccccnnnnnnnnnntgccctgggcaaccgcctgcgggtggggtcgtgtgtggaggctcgggtgcagcgcgtgagggacgcgcgcctcttccgctaccccgtccagctggcgcccgtggaccccgccctccaggccctcctgccgcggcccgagagtcacatgggccccatggaccttcgggacgtgcgcatgtgagcagggccggtgtgcgtgcatgtgtgtgttgggaaggggcgaagggggggaaaaggtgctcgtggtgcaggnnnnnnnnnncccccatggacctgcgagacgtgcgcatgtgagcagggctgatgtgtgtgtgtgtgtgtgttgggaaggggcaaagggggggaaaaggtgctcgtggtgcagggagggacgcagatggttgggcgcatgcaagctgagctgtggatgcaagggacaccaaaggcctctggtacaggcgactccggcacctatcgccaacatgccccgcttccccttccccagggacctggaaaccctggcacgcgtcagtggcaggccgtatgaggcggagaactacaccttccccgtgagcatggcagggggggcgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggaggaggatgggcccgatctgggcgaggaggaggaggtggaggtcctgacctgggaggaggaggacgagctggactccattgccgccgccctgtccacctgatgacgatggagtctggggtaccggcctgccccaggatggtgtaccgagcggcnnnnnnnnnnaaccaaatgctgcctcacggcaagcggcctgcctacagcactgcctgagccaggcttgtatttttcgcgcttgggatttgagtatctaagcctcgacagaatgcttgtggactaccctgtggagcagcgttgcgggcctcctgacgcacgtcctcctctcccttccctccacacagactcagtcgcagctggacgnnnnnnnnnnggtgaggaggaggacgagctggactccatcgccgccgccctgtccagctgatgacgatggagtctggggtaccggcggctggcctgccccaggatggtgtaccgagcggcagaagagggattgcccctgcgtctgcgtcagactggaagccagtgtgacccatctgctgcctctgtgccgcagtaaggccccccatacccgccgcccacaagtccctcgccgtgccactgttgaccccagctctcaaccgagttctttcactgcaacaccacgggcacgtcgccgcccagcggcacgggcaagaaggaaagcgcgcatcgtcaggggaagggcatgcagggaggggggagatggtgaacagcccacatgggatggccttgcagcagggcggcgccnnnnnnnnnngtggaggaacgcgcacatcgtcaagggaagggcatgcaaggaggggggagatggtgaacagcccgcatgggatggccttgcagcagggcggcgccctccgagaaggggcgacgggacgacagcaggtagccgcctggagctcagccaggcacggggtgtgtgcgccgtgtcttgttcccccgcagcccctgggtcaaggagcgaagacacnnnnnnnnnncagccgcctggagctcagccagacacacggtgtgtgcgccgtgtcttgccccctcgcagcccctgggtcaaggagcgaagacacgatcgtcacaggggcgcctgagcgccgacctcttgagcttgcttggcccgttcttcctcctcattgctccccgcgagaccctcgagtggggggggtgggtacgcctgtgcagggagagggggtctggatatgcctgacgtgctggagagggtgttttcagacagggtccgcttgtgatgaggccgcgggagggtggggcaaaccaccgcacattcctcctcaacagggtttgtgcactggccggcggcgcctggcacccagcaagcatcattgactcggcgaggacggcatcccatgcaacccctccaccaccgccatgtgctgatatccacctcgccgcccatgctcggacccaccctcaaaacctcctcccctcacctcatgcttgcccgggtggtacatggctgccatgaggcgggcgtgctctgccgccagggtggccgacacgctgatccccgccacgctggaggtgggggccgggcccggtccccccgtggacgtgccaggtccgcgcccccctggcgccgtccactgcgcggccgcggccgcggaggcgggcccgtccagggccgagccggggcgcgacaggccctgcaccgaggccgccgcctgctgcgcctgcgcgtgtgcagcgaaagcggcgtgggcggcctgcgcctgcgccagctgcgccgccggttggccagcctgggccccgaacatggccccggggtcctgctccatgtgccccatgccgcgctgctgctgctgcgcggcagcggcctgcatgcccgggggccaggcgtgcggctgctgcgcctgcagcatgggcggcagcgccggtgcgggtccgggctgcagtccgggcttgtgcccagcgccgggtgcgggaccgccatcggtgggccccccctgcccctggccctggctgtcgccgcgcgcctggatctggcctcccccaccgccgggcaggccccccccgccgccgggcagacccgtgccgaccgggggcaggcccaggcgtacctccagctcggccatgcggcgctgcatggcgcgcacgtacttgagcacgtcctccaggaaggtggcggtgttggcgcgctccgagtgggggaccacctcgcgcagcgcctccaggcggtcatttatgcgcgagcggcgccgcgcctctgcctgctggtggcgcgaggcgtaggaggaggaggagggggaggggccggcgcgggtgcgttgcttcttgccgcccccgccgtcgccgccgctggtgggggagggggggccgttgcctggggccgggcccgggccggagggtggcccggagtcggggtagccggccaggtgggccaggccgggctggcccagcagctggttgaagaggtgcatggagctggggcccagctgttggcccgggcccggctccgttgggaaggggggcgggtggggcagctgcccgcccacgggcccgaaggccgagctgcgggcggatgcggcgagcagggcctggagcgtggcggggttcatgcccccctgcccgctgtcgggctgtgcctgaccggggtcgccggcctcgcccgggttgcgcggggggtagtccatggtttcggtgtggaagggatgcaggagcagctcgcacgtgctccgttcatatgtttgggtcagcacgtgatgcacgggagccacccagcctctgcgagatcgggcccgaggaaaccagggaacgcgagtgatctgggcatagcgcgcggggggcccgaacatctacaacaatgagctaggggcctctcgacaagccagcgccgcatttccagacctcattctttgggaatgtgataagttgcgtcatcggagtaccccttgcatatacctgtgcttgccacaaannnnnnnnnntccgcatttccaggatctcattctttgggaatgcgataagtcgcgtcatcggagtgccccttgcatatacctgtgcttgccacaaacactcatttcctctctaggcccctttgtgcaccatgagcctggatttgccgacacacaggccacgccccagtggagtcgcagacaccaacgatgacgcccaagctagcaagctgtacgtcaagattccttggagcatatggtgtggctgcagaagctgtgtcggagactacgcaaacctcccatcccaatgcaggtcatgcgttcagcttgggtacttccaagacgagtttgtgcaccacttcgtgaaggcccccgtccgacgcgcgcccctgatcaacagaggtgccgctccttgggctcggtcgcttgtcgttggatgttgtagggcgcgcctgggctgttggactttacctcatggtgcacccgatcgaggacacctacatgcctacctgccagcatgttcacccactgaacccccaacccctccaactcacaggctactatgccaggcaggcatccctgcgccagcttgtcacaaggttcctcgcctgcctgcatccggggcctgtgcaggttgtgagcctgggggccggcttcgacacgctctactggcaactggtgcaggagggtgcgcccatctcgcgctacatcgagctggacatgccgcaggtctggaattgtggggtgggatggtgggtgggtgggtaacgtggagtgcctctgatgatcagtggggatcgtgccagcaaacaaacaccccccgtacagcagcccctccatcgcaccccccacaaccatcaggtctgcatggagaaggcgggcgtcgtggcgaggacgcccgccctgctccgcctggtgggcggcagccccgccgacgcgccgggccacgacccggcggcggggcggtggctgggcggggcataccgcctggcccccgccgacctccgcagcgtgggccaggtggtgagcgcgctgggcctggcggggctcgaccccggcgcgcccaccctggtcctggcggagtgcgtgctggtgtacctggagcgggaggaaagcgacgccctgctccgccagctcagcgccatgctcagcaccgccgcgatgctggtgtatgagcaggtggggtttgtcggggaggaggctggcgggggagggcggtgtgattcgctgtcgcagcgggagggcgccgcgctggggcgtgccacgcgggccagtaccacgcgggatgccttgttggctgcatccctccagtctgggcctgggtgcggcggcgcctgctcttcacctccccttcacccacaggcatgcacaccgatgataccaccgcgccccaccgcagccacccctactcctcacccannnnnnnnnnatgcggcggcgcctgctcacctcccctccacccacagtcatgcacaccgatgataccatcgcgtcccaccgcagccacccctactcctcacccacaccaggtccggcccgacgatgcgtttggcaagcagatgctgctgaacctgagcctgcgggggtgcccgctgctgggcatctgccgggacgtggacgagcaggcggcccggctgaggcaggccgggtgggagcgagccgaggcagcgcccatggatgccatgtacaggtgagggttccaggggatannnnnnnnnntgggatgtggacgagcaggcggctcggctgaggcaggccgggtgggaacgagccgaggcagcgcccatggacgccatgtacaggtgagggttccaggggataccactccatcgcaatgtcgctgggctgcagggagacggcgaggcgcctgtctggcactctggaaactgcaagaaacctacaggcctcgaccggtcatctgcaaacgcagaggcctggagccgcgggatcgccgtcgcatcgaaaccctggagatcttcgatgagtttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgacatgatccgcggtgccggacggtgcacgcctcccagacagggctccagcggccacgacaggccagagcacgcacactcagcgggagtccctcgatgctgctcccccacctgacagacagctgcccagccgaatcccgatgcctccccggcaggctgctccaggggcannnnnnnnnncctggcactctggaaactgcaagaaacccacaggcctcgcccggtcatctgcaaacgcaggggcctggagccgcgggaccgccgtcgtatcgaaaccctggagatcttcgatgagtttgaggagtgggacctcatccaggcccattactgcatcgccatgggcgtgcaagacaaggcggggaggctgcaagagtttggcctgcctcgacccggcaagacatgatctgctgtgccggaaggtgcacgcctcccagacaggggtccagcggcgacggcaggccagagcacacacactcagcgggagtccctcgatcctgctcccccacctgagggacagctgcccagccaaatcccaatgcctccccggcaggctgctccaggggcaagcttgctcgaacgctgccatcatgcgcctcgatccacatcaaaggaggcaatggcacgccgcagtcgctgcaggtcggcttccaggggagcgcaggtggcggtctcccccttcccacaccccacgctggcattcaggatgtgcagcttgctgcccgccaccgtcaccgcagccagcagacgcttcttgccgcgggtggagtccacctcgtactcgaactcgtaggttgtgtttggaggggaaccccgcacgctggaggaaagcatggcggtgctcatcgtgctctcctttgccctctctgcgtaacattccatgggaggagggagtgtaagaccaggaaggaggagcattatgattgggagtnnnnnnnnnngtaccaacttcacctgctgccaagatgcgtgtctccacgtctcgtaagctgccaaactgctccagggactggattcggacgggcaggatgctgacacccagggtgtttgaggaagcagcagcatcttggaacatgacgtcggccccaggtttggacgtctgaacacgtgcagcaagaggaagggactggtatcgtgttgatgcggcaaaaatgtgggttgcaagaggnnnnnnnnnntggaaagttctgagcagcagcaagctcccgttgagacagccctgcagcatgggccagattnnnnnnnnnncatcagaatgtccatgcctagagtgagatggaacccatgatgaccaccatcatatcgacctggtctgactggcacatnnnnnnnnnncgcagcgagaggaagggacttgcatcgtgctgatgcggcaaaaatgtgggttgcaagagggcaaccagatcggtatgctcatgcctagagtgacatggaacccatgatgaccatcatcatatcgacctggtctgactggcacatggcagtgtttggccggcgcaaccccatgcaccaagactcatgacacctacctgcttccatgtgacgggaacaagcatgctgtactggccgggactggcgtatgggaccagatcgggtgacacctgctgcccagcatccgcttgcatgggggccgcacccagggccgtgatcagggcgatgttcagcagcacggcgcgccgatgctggcattcgatcaggcggtcctgctgtggtcctgagactgctgccagggaagggcatcgcccgcaacgcacggtcatggagggtgcatgctcaggccttgtccggacagagggacgccaatgttgggtggccgtacaggaccatgcggctagcatgacagcaaaggggacctcaatgcaacatgaatattaccaatagatgtacatgcaatgctcttggctggnnnnnnnnnngtgtccggacaaagggacgccaacgctgggtggttgtacaggaccatgcggcgagcatggcagcagaggggacctcgatgcaacatgaatattaccaaatagatgtacatgcaatgctcttggctggcatatgtgtgtccctgagagcggcccctggcgcggtgagaccatcagtccctggactcacaggaagcttaagaagaaagggagcgcgagagcgaccctcccccgttagatcaatgcgaaatggtgcacgacgaatggaaacaaggtgccacgcgaatgcatcgtcattgcgagcagaacctcccgacctcaaagagtatagaaagtcagtccagagggctcgatcagcatcggcggnnnnnnnnnnnnnnnnnnnnnnnnnnnnnnnnnnnnnnnnnnnnnnnnnnnnnnnnnnnnnnnnnngagtgctgtcaacggcaccctggcttccgtggcgacgctcgccccaatggcccaggctatccccgccatcaacacggcggagggggtgctggccctgctggcggaggacgatgatgccctgaaggtgtacgccctgcagcagatcaacgccagcatccaccagttttggcaccaggcctcgggctccatcgccaccatcgaggccctgtttgaggacgaggaatttagccaccgggagctcgcggccttagtcgcctccaaggcacggcgccttgttgactgtccttgtgtgtggggggggccatgtgtcgcgtccccatgttgctgtggggtggccatgcatggcgttcctggctgcaatggattgcacggagatacacaaagaggaaacacaccaaggacacagcgtcctggccgcaggaccgccccgatccagcccccactacaccccctaccgcagatcttctactacctggnnnnnnnnnntttgtgtgtggggggaccatgtgtcgcgtccccatgttgctgtgggtggccatgcatggcgttcctggctgcaatggattgcatagaggtgcacaaagaggaagtacactaaggacacagcatcctggccgcaggaccgccccgatccacaccctacttaccccctaccgcagatcttctactacctgggcgacctgcaggaggcgcaggcctacgcgctgggcgccggcgcgctcttcgacgtcgactccccctcagccttcgagcgcaccatcctggactcctgcctggacgcgtatgtggcggcgcgcgcgggtctggccggcgacgagcccggcgatgcgcccgcctcgctggacccacgcctcgccgcgaccgtgcagcgcgtgctggaccgatgcctggccgacggccagcacgagcaggcggtgggcatcgcgttggaggcgcggcgcctggacgtgctggccgctgccgtgctggcggcggccgacccacccacgctgctggcgcacgcgctggacgccgcggcgcgcacggtggtggagcgcggcttccggcgctgcgcgctggccacgctggtggggctgtataagcgggctgcgccggacgacgcgccggggctcgcccgcggcctggccgcgctggaggacgcggagggcgtggccgccctggcccacgccctcctgcgccagggtggcaagcaggtgaagtatgaaaggggggggaggggaggtgccgttgcagtcgtgtgtttgggagcgcaagggtgacgccggcagcagagcatccatggacaggacatgcatgagcctctgacgctccctgcccatgaatgccgctccttccggcctcccttgccaactgcccctcttcaaaaaccatcgtaggcgctgctggcgtaccacattggcttnnnnnnnnnngcatgcatgagcatctgacgctccctgcccataaatgccgctccttccgtcctcccttgccaactacccctcttcaaaaaccattgtaggcgctgctggcgtaccacattggcttcgacctggtggatgcccagctgcacgagttcacgcgggacgtgcatgcgcgcgtgctggcgctggcgcgcgccagcgcgccggccgccggggcgcctgccgaggcgcgggagggggagggggacgcggccgaagaggcgggcctggagacgccgctgctgggcgaggacgacaagactgacgccggcggcgccacccccgcccccgagctggccccggagctggacgctttcctgcgcatcctgtccgggtcggtgagtgtggagctggagcgccaattcctggcgcgggcgtgccacgcggacctccagatcctgaagaacatcaagnnnnnnnnnncttcctgcgcatcctgtccgggtcggtgagcgtggagctggagcgccagttcctggcacgggcgtgccatgcggacctccagatcctgaagaacatcaaggcgggggtggaggccaggaacaggtgggtggcaggtcgatggaccgggggggtggaagggtgtcctggcgcggctaatggaagggttgctgccgggttgtttgggctnnnnnnnnnnggatgggttgaaggggtgtcctggcgcggctgctggaagggttgctgccgggttgtttgggctgggagatcgcaaagaaggaggggcggcagggaatgggtgacagcgcagagccctggtgcccggcgtgctgtccgccttgatgccgggagccaatctgccctcttgccgggcctggatcccgcacctgctgggcctgggtgccggcctcccgagtgttgtggcccaggcctccatgctttcccccctttccctgtcccctcacacccctcccctccccctccccgtccccccccccttccacgcagcgtgtgccactcggcgacggtgtgggccaatgccatcatgcatgccggcacgggcgtggacgccttcctgcgnnnnnnnnnnnnnnnnnnnnnnnnnnnnnnnnnnnnnnnnnnnnnnnnnnnnnnnnnnnnnnnnnnnnnnnnnnnnnnnngggccaagtttggcgccacggcgggcctgggcgtcatccagcgcggcagcgtggccgacgggcgctcgcgctcgctgctctcgccctacctccccgccgcgccgggcagctccacggggtcgccctactccgagggcggcgcgctctacgcgctgggcctcatccacgtcaacagcggcgcgggggcggcgcagctgctcaccgactccctccgcgccacgcagcacgaggtggggctgggggtctgagggtgcccgtagcgcgctggaggggccgggggcctgcgaagttgcggggcgacacgaacgatgcgcgacacagctctcgtacgccctctcccctgcccgaaacatgtggaacaggtcatccagcacggcgcgtgnnnnnnnnnncgggggtccgggggtgcccgtagcgcgctggaggggcggggggcctgcgcagtcgcggggcgacacgaacgatgcgcgacacggctctcggacgccctcccccctgcccgaaacttgtggaacaggtcatccagcacggcgcgtgcctgggcctgggcattgcctgcctgggctccgagaacgccgaggcctttgaggacgtgaagaacgtgctgtacacggacagcgccggtgggtgaggggggggggctttgggggtagtctcgccatgaggcgcgtgcgacgcccaggcacgatcgnnnnnnnnnncgcctttgcgcagtggccggcgaggcggccgggtatgcgctgggcctgctgtgcgccgggtccgggcggnnnnnnnnnncgacagcgccggtgtgtgtgtttggggggggggccccttgggggtggtctcgtcgtgaggcgcgtgcgacgcccaggcacgatcgccggtgggcgaggcgggggtcatgcttgtccccctcccggtcatgctgcatgcccgagccccaccctgccacccccccgcctcggtgcagtggccggcgaggcggccgggtatgcactgggcctgctgtgcgccgggtccgggcgggaggagcgtagcgacgagatgctggcttacgcccacgacacccagcacgagaagatcgtgcgcgccctcgccgtcggcgtcgcctttgtgcacgtgagtacttgcctggggggggtgggaaaggggtgctgcgaagggtggtgagctctggggaaggtcgagcagcctgctgccgaggagcacgcgcgtgccgggcagacgcccgcgcctgctcacggccgatggatggatggcgaccccggcgagcggctccacccctttctgcatggcgccttccgcgacctcggggtttgccacccttgccgtcgccaggggctgtgtcgaggcctggtgagagtacccctccaaatctcctgacccgtcgaccccgcccccccccccccccccnnnnnnnnnnacgtgccaggcagacgcctgcgcctgccgacggccgatggatggctggcaaccccggcgagcggctccgcccctttctgcatggcgcctcccacgacttcggggtttgccacccttgccgtcgtcaggggctgtgtcgaggcctggtgagagttcccctccaaacctatcgaccccgtagacccccgccaccccccaaaaaacacttcatgcgcgcagtacgggcgggaggaggcggccgacggcgtcatcgacgccatgctccaggatcaggacgccatcatccgctacggcggccagtttgccatgggcatggcctaccgcggcacgcgcaacaacgctgccatccagaagctgctgcaccacgcggtcaccggtgagcggctgagctggaggggtgggggggaaaaagatggggatgccgaggggggtctgtcgtcatgcggggacggcgctacacggtccccgggcctcagcgtcgacccccccaccccagcatcaatttccctcctttccacccgttccccagacgtgtcgtacgacgtgcggcgcgcggccgtcatgaacctcggcttcgtcctgctgtccgcgccggagcagtgcccgcgcctggtggcgctgctggcggccagctacaacccgcacgtcaggtgagcgggtcgtggggtggggtggtgggggcccgggcgcacgcccaccaatcgcgccgagccgctctggggtgatgctttcggcggggcgccgacatggctaggtgtgcatgtccaccccttctcacacggtcactccccctccgccgcccgtccaggtacggctcggccatggcggnnnnnnnnnntgaggggtgggggaagagatggggatcccggggggggtctgtcgtcatgcgaggacggtcctgcacggtccccaggcctcagcgtcgacccccccaccccagcannnnnnnnnnaggtcgtggggtggggtggtgggggccagggcgcatgcccaccaaatgcgccaagccgctctggggtgatgctttcggaggggcgctgagatggctaggtgtggatgtccatcccttctcacatggtcactccccttccgctgcccgtccaggtacggctcggccatggcggtgggcatcgcctgcgcgggcacggggtcgaaggaggcggtggccctgctggagcccatgctcaccgaccccaccgactttgtccagcaggtggggagtggggtgggaggggtgccggggctcggaatctctgcatgcagcatggcctgcagcatcaggttgtcactcctgggagggagcctgggcagtggcagtccccagccctggagtccatacgttttacaagccttccattaccacacccggtcctctttggccactgccctgagctgtcgatgagtgtggtctggagaatgaggggatggcaaccaacggccccctggcactccgtccccagccctcgctgaccctcagcaacctggtgtcgagggcgtcgcgnnnnnnnnnncgagtgtggtctggaggatgaggggatggcaaccaacggccccctgacactccgtccccagccctcgctgatcctcagcaacctggtgtcgagggcgtcgcggcaccgtgcctgcctgcttcagcagcactctccccgctttccacccgcagggcgcactcatcgcgctggccatggtgctcatggaacagccggcctccaagaccgagaccctgcgcgccaagatcgacaagctgcatgggaacaagggcgtggaggtgaggggcggtggggtttggttgggaccccaagggcatgccctcgcaaggagggtgctgtgcctgggcgcgctggcgtgcgagggatgatccaggtgtgcgacgcagggtgaccccgtgtcacannnnnnnnnncggttgggaccccaagggcatgcgctcgcaaggagggtgctgtgcctgggtgcgctggcgtgcaagggatgatccacgtgtgcgacgcagggtgaccccgtgtcacacatggaggcccaccgggcgaaagcatctcgcctgtgctgtgccaggcatgcgctcgcacggccagccagtaccaccgactccaagcaacatacgatcactgtcttgcacatgcttgagaaccccccctcaccccttcaccccctcacggcagatcatggtgcgcatgggcgccatcatggccgccggcatcctggacgcgggcggccgcaacgcgaccctgggcctgcagtcgcgcacgggaccgtaccgccgcactgcggtggtgggcctggccctgttcctgcagtactggtactggcacccgctggcgtacagcctgtccctggcgctgcagcccaccgccatcatcggcgtggatgccagcctgcgtgcccccgctgacttcaaggtgggcctcgtggttgcggtgttggggttggagaggaggggtggtagcatgctgtgtgggccaatgcctggtcagcgcgggtgggacacggcaagctgcatgctccatgcgcagatgggcgatgggtttggggaagagcctcgttgcccgccccaaaacatactggtctatgacaggcagagacaagctgcaaatctcttacattcccgggcacatggagggtggcacagcccnnnnnnnnnncgacttcaaggtgggcctcgggcttgcggtgttgggggtggagaggaggggtggcagcatgctgtgtgggccaatgcctggtcggcgcgggtgggacacggcaagctacatgctccatgcgcagatgggcgatggctttggggaagagcctcgttgcccgccccaaaccataccggtctgtgacaggcagagacaagctgcacatctcttacgttcccgggcacatggagggtggcacagccccagcaacaccagcacgcacccatccatgcacctcccctcacggcgctgccacaggtgatcagccgatgcaagccctcgctgttcgcctacccaccccccgtcgccatggaggacaagcgcagcaaggagaaggtgggggacttgctgtgtgggtggcatttgctggccacgcctgcatcggggtttggagtggaaaggtgtcatccccaccgctcctcctgccgaccgtccgttgccctttgccacagtcacagggcgtgatcctgagctgcgaccacgctcctgctcgatgctcgacctcaccatgcccacgaccaccccctcacaggtcccaaccgccgtgctttccacgacggtgcgctccaaggcccgtgcggccgccaagaaggaggagcagggcaaggagatgggggccctggtccccacgacctctgaccctgaggccatgcagacggagggcggcgaggcgnnnnnnnnnncggaatggaaagttgtcatccccaccgctcctcctgccaaacgtccgctgccctttgccacagttacagagcgtgatcctgatctgcgaccacgctcctgctcgatgctcgtcctcaccacgcccacgatcaccccctcacaggtcccaaccgccgtgctttccacgacggtgcgctccaaggcccgtgcggccgccaagaaggaagagcagggcaaggaggtgggggtcctggtccccacgacctctgagcccgaggccatgcagacggagggcggcgaggcggcgcaggcaggtggcgaggcgggaaagggcggcgaggcggggaaggcagcggatggtggcgaggaggcggcgcctgcggaacccccgacgcccgcggagccctccagttacgtgctgagcaacccggcgcgcgtggtgcctgcacagcgccgcttcgtggccttcgagcgggaccagcgctggcagccggtcaaggccgtgacgggaggtgtgtgtttgtcggcacaggggggcagggggaaggccggcatgcatcctggcggcgcggggggagcgggcgaacgagctttgggctgtgcagactgagggggaactgcccgggagtgctggtgtaaacaagtttggctgaactcaccctcgaannnnnnnnnntgggagcgggcgaacgagctttgggctgcgcagaccgagggggaactgccccggagtgctgctataaacaagtttggctgaactcaccctcgaagaacatccttcccgacaggcattgtggtgctgcaggacgtccggcctggagaggggcctgcagagtacctgttccaggaagccgcagcgggggccaccagcgccggccccgccgcgaggggcgctgcgccgcccgcccaggcgcccgccgtgccgagcgctgcggaggagccgcaaccgccggcgccctttgagtacattccgtcctgagggtggggtcaggtcgtgcatgccaacgccacaccacctgcctgccccggacggaaagggccctgtaactgcgagggaggaactgagttcaaactgggaggccacgtggaggctgacccatcccctcggtgattttcgggaaatcatcccccgaaaagccacgacgaggcatggcagggtcaggagacagcctcaaaccccgaacccgcttcaacttatattcgcaatcagatttcacggcgttcacgcactcgggggcgcctcgccagtctcccagcgccttgggcaccgccgtccaccccctcgcggtggcctagcgcaggacaggatgctgtccagcatgcattccaccttagcctcatcccatgccgtgggcggatcacccttcaggcggcatgtggcacgcgggcagcggaacgggcgcaggacggtcaggccccaggtgcgcatctctgcattgtccgcacggggagctgcggcatgcctgatctgggactccgaccacattgtcatatcctggcatactccaatccactcgtgcctgcgtgcaggccgtggccnnnnnnnnnncctgcattgtccgcgcgggcagctgcggcatgcctgatctggaactccgaccacattgtcataacctggcatactccactccactcgtgcctgcgtgcaggccgtggccgcacagccctccgccgcgagtgccgagaaggagctctggctgcccaccccccactactgtgagagcatctaccagactcgccgtcgcccgacccggaccatctacgtgcgtcacgtgcctccagtgttgtcgagatggggggcatggctacgatattgggctgtgcactccagcttccaggggagagtgtccatgtgtatcacatcctgcatgctccctgcctccacggtcccggtccaacccatgcaggtgggcaaggtccccgtgggcagcgagcaccccttggcgcgtcagaccatgaccaccaccgacaccagggacgtggaggccactgttgagcaggtgcgtggaagtgccagggtgtgggcctgcgccctggagggaggggcaggtccttggcgcggcgagagcacagggacgagggtcccatgagtgtgtgcaggctctccacccccttgcatcaccctcctctgcctccgacgctggtgcaggtgaagaagtgcgccgatgcgggcgccgacatcgtgcggatcaccgtgcaaggaaagcgcgaggccaccgcctgcctgaagatccgcgaccggctcttccaggacaggtgggcgccgtgcgtgattttgggggggttactggggggggaagtggggggagctcaggcctggaggacaacagcggggagtggcgccagtgtatactagatatgtggtagatatctgtggaaacttgctcaagatctctgggtccannnnnnnnnngggggggggtacaggggggagaagtggggggagctccggcctggaagacaacagcggggagtggcgccagttatactagatatgtgtatgatgtcagtggaaacttgctcaagatctctgggtccatccccacaataccttctgctgccggatttatactccccatttccttgtgccttgcccagttccacctagagcaaacaccctgtaatgccccctgatctcaaccactctgccaggtacgacaccccattggtggccgacatccacttccagcccaccgtggcgatgatggtggccgacgcctttgagaagatccgcatcaaccctggcaactttgccgacgggcgcaaatccttcgaggagatcaactacgacgaccccgcccagtttgcgcgtgagcgtgagtccttccgcgagaccttcatgcccctggtggagaagtgcaaggccctggggcgggccatgcgcatcggcaccaaccacggctccctctccgcccgcatcctgtcctactacggcgacaccccccgtggcatggtggagtcggcctttgagtttgccgacatgtgccgcgacgccgactaccacaacttcctcttctccatgaaggccagcaacccgctggtcatggtgcaggcctaccgcctgctgtcggaggagatgtatgccaagggctgggactaccccctgcatctgggggtcacggaagcaggtgcatatgcgtgtgtgtgtggtttttgggggggaggggtggatgaggtggtggtggtgctggggaagaagaagtggtaaacgtgagattccagcccagcactgcagtggctttggagtgctggtgcactggagggttgtgcaatgtgcccccagatggttgaacctggctgtccagcactcagcaccccaggcatgttgnnnnnnnnnnacagatgcgtgtgtgtgtggcttttttggggggggtgtatgagttggtggtggtgctggggaagaagaagtggtaaacgtgaggttccagcccagcactgcagtggctctggagtgctggtgcactggaggggtgtgcaatgtgcccccagatggttgaaccttgttgtccagcactcagcaccccaggcatgttgccagtgtctcagcgcctgtacttgaagggtggctgagccccccgtccgacaactcaatacctcttgtactccatgcacaacatttcgcccccaaaccctaccccttcgagcccaggcgagggtgaggacggccggatgaagagcgctatcggcatcggcgccctgctcatggatgggctgggggacaccatccgcgtctccctgaccgaggaccccgagttcgagatcgtgccctgcggcgccctggccgccctcggcacccgcgcccaaacggagcggtggggtgtggagccttttgaggagcaccgcgacacccacctcttcaaccgcaggcgagcgctcatggctgggttggctacgtgtttcgggggaagaggggtgggttgaggattcagggcggggagggaatgttcataagcggggaaacgagggggaggcctgcccatgtgccagcagatttacagactctcaccggacccaggttctgttctaggaagccactgagcgcctggccaggccaatcgtcggccactcacccttgccctctgcacactgaaatcccagggttggggagctgccggggcannnnnnnnnntctgggacctaggttctgttctgggaagccactgagcgcctggccaggccaaccgtcgtccactcaccctcgccctctgcacactgtaaatcccagggttggggagctgccggggcagaaggagggcgacgtactggacatgcgctccatcctgcacagggacggctccgtgatttcctccctgtccctcgaagacctgcgcacgccagagtgagcatggggaggggagtggtcctcttgggcaagctgttccctgcgctggtcagggatcgatgtgcgccgtgaaggtggccacgacaagcgcaccttcatccatgtatctggggggcctgactgcagcagcaggactcgggtcgtgccgcgcatccacgctcttgcccgaacccacccgcaggacgacataccgcaacnnnnnnnnnntggtggttctcttgggcaacttgttccctgcgctggtcagggatggatgtgcgacgttgaaatggccacgacaagcgcaccttcatccatgtatctgggggggctgactgcagcagcaagacccgggtcgtgccgcgcatccacgctcttgcctgaacccacccgcaggacgacataccgcaacctggggtgcaaaatggccgtgggcatgcccttcaaggtcggtggggggatcgaggctggtggggcatcttgctgggcgtgtgcgcgtgtggccaggggcactcgcgtgccttgctgcaggagtgggactgaagcacagctgtgcaggtgtccccgtggcttttgcagcaccctctggatgccccctcccacccatgcaaccttacacgtcccacctcctcaggacattgccacctccgactccatcttcctgagggaggtccccgccgaggatgatgcccaggcccggcgcgccctgcgccgcttgcaagaggtgaggggcgaagggtgggggggtgggaagaatcaaggcatgggtggggcaatgagcgagtgcctgggtggggaatcgaggtcgctgcctgcatggtccccccctcgcgaccatcgttgcgcctcgtcccctcatgccctgggcacattgacgcccttcctccccacgccatccaacgccttcccatcatctcaccggcccccctcaggtgggagttcacgtgctggcggaggccgaggcgctggccgcctcccccctccctgactccgtggccgtgatctcgctcgcggccgccctggccgcccgtgccgaaggccgctcgccgctgccggcgggggcagtgcgcctggcgctggccgtggatggcaccgagcccgacgcggacgtcgaggccgcgggcgggctggacgcgacgctggtcctgctgcgcgtcgcgcccggcgtgtcgcgcgtgcacgcctcgcgtcgtgtgtttgaggcgctgacgcgcgcgcgctgccacctccccgtcgtgcatgcgctggagtttgcaccgggcaccgggcgcgaggagctggtgctctccgccggcgcgctggtgggcgcgctcatggtggacgggcgcggcgacggcgtcatgctgtcggcgccgggccaggacctggcctacctcaggaccacctcctttggcctgctccaggtgcgtgagggttggtttcgggagtgaagcgggggggggggaggctgttggggtctgggagcgcaggggccgagcagggcgcagtttgaagtgtgaggctggtggggtgcggccttggagggcctggatgaggctcagaatctgggtttgcaaccctcttgggggccatcacaccttgtctcgtcatgcggcagcacccctctcctggacacaccccgagttggcggcatgatgcgaccccttgaccttcccggcaagcaccccgccgcacccnnnnnnnnnnnnnnnnnnnnnnnnnnnnnnnnnnnnnnnnnnnnnnnnnnnnnnnnnnnnnnnnnnnnnnnnnnnnnntgaccgccccgactttaatcccccatgcgcccctccacagggggtgaggatgcgcaacaccaagaccgactacgtgtcctgcccctcctgtggccgcaccctgtttgacctgcaggaggtgacagaccagatccggcagaagacggggcacctgcccggtgggtttgagtggttgcgctccggtgtggagcaagcgagttttgctgatttgctttgcgaggaggagaagcgagtgtgctgttatcccccggcctggtcacgagccaactagaccactccaccccctcactctgccaggcgtggnnnnnnnnnnctgagtggttgcgctccggtgtggagcatgcgagtcatgctgatttgctttgcgaggaggagaagcgagtgtgctgctgtcccccggcctgggcacgagccatccagaacactccaccccctcactctgccaggcgtggnnnnnnnnnnatgcctctgggacaggggtcttgcaaatggctctaggtgcagcatctgcatgtgtgccattggattactgacgaattattttcccgtgtgtctggcctcgaatgacnnnnnnnnnnccattgccatcatgggctgcattgtgaacggtcctggggagatggcagacgctgactttgggtgcgtgctgcctctgggacagggtccttgcaaagggctctaggtgcagcacctgcatgtgtgccattgggttgccgacgaactattttcccgtgtgtctggcctcgaatgactgtggtttagtagtaaaatggatacccaaccttcactgtgctgcgcaggtatgttggcggtgcccccgggaagatcgacctgtatgtgggcaaggaggttgtcaggagagccatccccatggagtccgcctgtgaccagctcgtggagctcatcaaggtgaggcggtttgatgtaatgccgcactggggcccaacgctgtgatacccggctgacgccctcgcagagccttaaatgggccgcctgcgactgtgcgattgtttcgtgcacatcatcagcatgtttgnnnnnnnnnnacaacgctgtgatacccggctgatgcccttgcagagccttgaacgggccgcctgcggctgtgccattgtttcgtgcacatcatcagcatgtttgttcaagcccatggggcctgccatcagcgactcggccgcacaagtacacgcatagaatctcacacgcactgtgacgtccctcctacctgtaggagcatgggcggtggaaggacccggagccagaggaggagggcgagggccaggaggagaagcaggccgtcatggcttgacaagctggacacttgtcgaagaatctgggccccttttggacctcggccatcccgctcctgctcaattggagcctggagggcaccttgggtcgtccctgcatgtgcctcctcaccctggagcggccgacgagcgcgcgctcgcgctctcccgggtggggcttgcatgctgaaaagctatggatgaagaccgcgggacagtgcaggccatcacactgatttaagcacgagtgttgagaaggattaaacacaaagtgtcgagaggcgtggaaagatagacgtgagcaatctacatattgtcgacgctgtttttgcctgcgccccccccagaagacgccgtcggatgacaggcagccgcgccgggcccaatatcctcataacaggcactcctgggacagggaagaccaccacagcggagcttgtggccggcgccaccggcctgcgccacctgaacgtcggcgccctggtgaaggagcaggagctgcattcgggatgggacgaagagttcgactgccatgtcatcgacgaggacaaggtgagaattgtggtttggactcgatagaagggaaggagccgcaattggtgggcggtgtcggggatgtcgtccgcctctccctctccgacactcggcctccccacccaactccctcccaggtgtgcgacgcactggaggacatcatgacggcgggtgccaacatcgtggatcaccacggatgcgacttcttcccggaacgctggtttgacctcgtggttgtcctgcaggccgacaacaccatcctttgggagcggctagaaaaacggtgggtgcccattgtcgtgtttatgaacaaggcaggcacagatggaggtgttgattgcctacagatcctttttggcacagtgattcgtgtcgcgaccgtcattcctctccctgcgcccccctcttttggcctcatcgcaggaagtacgggctgaacaagatccaggagaatgtgcagtgcgagatcatgcatgtcatcgtggaagaggcgctggaatcataccggcaggacatcgttcaggtgctgcccagcaacaccgtgcccgagatggagtccaacgtcgatcggatctgcgcctgggtggctgcctggaagcaggccgcccaggctggcccggcatgacgcccgcgatagttgatcctattgccctgcttgctcttgtgcagggccagtgtgcaaagctgtgtgtgtgtcagactcctgctgcatccaaaactgcctcaccagcatggtctaggcaccccacccccttcctcccctgtttgtttttcaagtgcttcctgatacgggcatcccgtgtccatgttggcgtccatgtaccctaacctcgccttgcctgcagggcttgctcgtcatgacaagcacccagccctgattctgtgagattgcaaccccaaaatcctgggcatctggcgccatagcgctccatctccccgtttcactgactgcactgcactggaattcctcgcgggggggcttcaggcacgcggcaatcgtcccagccaggnnnnnnnnnntcacctccccgtttcactgactgcactgcactagaattcctcgcgcgggggttcaggcacgcggcaatcgtcccagccaggccatgagtgggaactgcaggagacccagccccagcagcacgtagttgtgcgtcttggagtcggggttgtacgtccgcgactcctacggggggtgcagcgggaagtgggagaagggtggtggaggttcttaaaaagatgacgctatcggttgattcctcagctgcagcatggaactcgactcttctcaccatgcnnnnnnnnnnggccagcgggaagtgggagaagggtgatggaggttctttaaaagatgacgctagcggtcgactcctcagccacagcatggaactcgactcttctcaccatgctcggccagcacgagaacccacacctgtcccccccccccaatccacacacacaaaagaggcccctttctctcgcacctgcaggatgacgcgcttcatggtgcgcaccaggaacaccgcggcggcgaaggaggcgtacacccagaccacgtggtaggcgacgcggttccgcagcagggtggcggccagcgtggcgcaggcccccacccaggggtaccccgcgtacgcggccagctccagggcgggagccgcggccccagcgcccagcgaccacagcatggcgcgcaggaccaaggtgtgcagtccccaggccaccagagcggaggtcacggcgttgtacaccgcttcgggtcggaagccgccgcgggccagcaggccgatgccgaccagcatgcagtacgtccacagcgccatgaaggggatgtacaggtcgggcgcgttcacgtcctgggtgtgatggtgtttgggggcaggcagaggggaactggtcgtcgaagatgcggcccttcagtggagaacctggatcggattcgacaccctttcaggcctgctgcgacgccagctgggcaggggggggggggggggggggnnnnnnnnnngagatgaggcccttcggtggagaacctggatcggatccgtcaccctttcaggcctgctgcgacgccggctgggaaaaaagggggggggggggggggggnnnnnnnnnnagctgtcgcaaaaatcagccaccctccctgcaacccccgagtgctcacctggcggggagggaggtacttnnnnnnnnnngggggggggggggggggcgacgcagccctagcaaaatcagccacccttcctgcaacccccaagtgctcacctggcggggagggaggtacttgtggccaccggagatgtgctccgggctgcgtgcgtaggtccagcgccgcaggaagggagccagcagcatgagcagtttgcgctgtactgcgacaggggcagggtggagtgaggggagagcgtgtgaggagacggagtgaagtggcgaggggccccccacgagggaatggattcctcaacatgaaggaggggacagcacccccctgctgtggtacgaacgtctgcaggggacaaccaaggactctctcctcgcgcggaacaggcccattccatcaacgcaccgtannnnnnnnnnaagggggccacatgagggaatggattcctcaacatgaaggacgggacagcaccctcctgctgtgtaacgaacgtctgcaggggacaatcaaggactctctccttgcatggaacaggcccattccatcaacgcaccatagccgggggtgatgctaaagtggtagtgcatggtcccaccggagaggaagccaaggttggactgcgacagacatgtgagggcagaacaatcctgtgaaccttcaggtccaggcactcaggcagcatggctttccagtcagcctgtgcctccatcttgggcagtgcggttttgcctcaggcaacccagccagccgtactcaccacatagannnnnnnnnnctgaaagagacggtggggcgagggggtgacaggtgcgggggtgctcggcccgctcccccctgtcgtcgcgagatcccgcaggnnnnnnnnnnttccatcttgggcagttaggtattgcctcaaacaacccagccagccgtactcaccacatagaggcgaccgcgctgtaggtaggactccccttgctgtttgaggacgtcacccgccatccccgtcaggaagggactccctccaccgaatgggtcaaagactgcatgtgacccgctcggccctgccacgggatgcgcagcctgcgcttgaaagagacggtggggcgaggggtgacaggtgcgggggtgcccggcccactcccccctgtcgtcgcgagatcccgcaggtacgcaccgggggcgggacgaaaacggaaggctgtgcattctggggaactgacgtgggcacccaagtgctgccggtggccccgaaagcctggaatggctgtgccatccagcgcagatcacttgaggaccgtcgcttgtctagggaatgccgaccaagtcaggcagtaaatggaagtgaaacgtcgtggattatcgagaatagcgttctaccaacgccagagacaccggagcatcgaacagaaaaagaggtcgcccagaagtttttcatgcacctggctactgctggcccccgcgctcgctgaatagttcgcctatgatttgcgatgggcggagcaagaaaaacccgttatcctatcatgacgtccgcccattcctcacaccatgcannnnnnnnnngctgctggcccccgcgctcgctaaatagttcgcctatggtttgcgatggggcgagcaagaaaatccccgtatcctattatgacgtccgcccattcctcacaccatgcattcaataaaatgtatgcctcctaaataaagcgtcacatgcgctctgtactcgagcaagctggtgtctgcacctgggcgccactccctgctggaggtgcgctccgccagagggcatgcggcgcccattcgggggccacaggacccaggaatgggctcctcaggggtcacaatattctggcaagaagttttcagggcaccctggatgatgcagaccctcaccagcaccatgctgaccaccaggtaggcttctaggttggggagcatgcatgggctcgggggttcacgaagaggggccatagcaaagaaggtgcacgcgtatgaccaacgcacgtgcaaactgcacaggaagctcccttcatgcaagaacttctggaccatgtgcaggaaccggtgcacagctttgtggctgttccgccccaagccccagtccctgagcatcctgccctccagccgccccttgggatggcatgggacgcaggggtttggaccctggcaggcgccttcctcttggctgctcgcatatcgcggacggtgcacgaggagtctgtttcaacgccgcgagggctgagggtaggcatggctgttgtatgttttggggttggagggatgctcgacataagaatataccctatgtagcatagggcggaccacacgatcaaactgctttggagagtattcagcgtgtcgcccgttctcaaaaccatcgtgctccccttgcctcaggaggcagcggctcgggagctggccgccttccaactcagcacggcgacgcgcagcgggcgggagatggtggtcgcccaggaggcggccgccgccgacaccgctcgggtctctgcggctgcgcagcgtgctcagcaggaggagagggaggagagggagcggcaggcggcgtacagccgtgccgctgcgcagcaggcagcccagctgcgtgaggagagggagaggtcccggcaggagtacgacgcgcgacaggcccggctcgaggccgagatggtggagcgggaggccgcggagcgggcgaccatcgccgcgcagcgcgctgaagccgccgcgcaagccgcccgggctcagaggtgtggggctggcggccggatgcgttcctgcgtgcagtccgtcgttcggggtgggcgatgtacggggatgatcgtgggccagacattcgcagcgcaggctggctctggcgctctctgcttctgccatcctgcccgaccaaagcgccccaaatccacgatcattcatcagggaggctgaggccgctgcggagctggaggctcaggagcgtgcagagcgtgctgcggccgagcnnnnnnnnnnatcgttcggggtgggcgatgtatggggaggatcgtaggccagacattcgcagcgcaggctggttctggcgctctctgcttctgccatcctgcccgaccaacgcgcccgaatccacgatcatcgatcagggaggctgaggctgctgcggagctggaggctaaggagcgtgcagagcgtgctgcggccgagctggctgcggcgcaggccgccgagaggcaagctgcggaggagcggcagaggctgcgcaggtccatgcaaacgttttcctacaggctggatggggaggtcacgctccagcgcccgcccaaggtgggtgtgttggcatgttgaccagtccttgaaatggaggggtgttactttgcagccagagatccgggtgatcatgccttggctgcaacgcagccttccactgccattgcatggggaacagcggcaccgcaggttccagccgtggccatttgcatgatctcagaccgtcaccgctggcaccccacccttttgcacaggggacaacggtgatgcgtggcccgctggtgcaggaggccaccctgagggtggccacctcttgcggcagcatcctgggcggccccgggtccgacctgccctggaccgccgactttgccgctgcggtcgaggcgggggaccccaccctggcggtgcccgggctggccggctgctaccgggaggccgccgagggggcgctgggcgcgctgcggctgcaggcctccacagggtcaggcggtccgctgggccacagcggcgtggaccctgcgctgatagagcagtgggtcacgctgggcacgctgcgggcctgcgtcgccgcgctgggcgtgctgcgccccctggtggaggcctttgtgaggggcggggagccagcccccgcccgcttctccgtgaaggccggcatccgggcgctgccggccgaccaccccggggctgcgagcttggcggtgcatcgcgcggtccaggcgctgggggcgcaggactcggaagcgctgcgcgcctcgctggcgctgctggcggaggaggagctagccctggcggcggaggacctgcagagcgtggaggacggggtgttcaacgcctgcttcacaggtcagcccggacgattcgtgggcctggccctggctgtggccagggtgctggccatggtggagctggtgcaggagggcgatgaggacaaggaagccgcgtggaaggcgctgcgcggggcgctgcgctgcggggcgcagaccgcagccagcgacacgctgcaggtactgggcgggaggaggtgttcacgtgcatgctgccctgggctgctgctgcgcgccatcatgtcccctcaatgactgacattcggggtcatccaacccccgcccccaggtccccgccgccctcctggcagcggcgctcccgcccgagcaccggctcgtagaggcgctgggccacatgtcggaggccaacttgtcgcccgcccagaagaaagcgcgcctggagcgcgagcgcgctctgcaggcggcagctgccgcgcagcttctcggtgcgttgccggggaggtgatgcggaccaaactaaggcgcaccctgagccatacacaaactttgcgacatcttgcggagggacacggggtgtgttggtccctcaagcatgagccaccccttcctccctccccacccggcatctccagaggaggactgggtggacgaggctgccgttaaggccacccgcattgcggaacagcagaagcaggttccgtatgcggagaggatctgggccctgaccaacgtcgccggcactctggccatggggggcccgggggagacggagcaggcccggcgcctggctgagcaggcggtgtccctgaagcaggagtggatcggcgcacctcgacatccatgtgcgtacgagggggcagtggtttggccaggtagagggcttgacaagcgcaatatttactgatgtgaggatggagggcgagacctcatgcaaggttgtcaaatgccttcttgccggcctacccttcaccatgccgaatcctgctccctcgtgcaggcctgctccccgagttcctgttgctggtggacatcctgtccaggaacctggaatgggagcgggacgcggcagggctggcaggggtcatcctcaggatcgtgattgaggtggccgatgcgtacgcggaggcccaggacccactctcgggggtgatcctgctggaaggcgcgcagcagaggtgcgagtggtttgaacttgtggcacaggggctgctgattccctcctggcagtgcattggcgggatgagtcccctccctacacccgccaacattctcctgccttggcacaggttggccgagatcgcgggcctgannnnnnnnnnacacaggggctgcccattccctcctggcagtgcgttgacgggatgagccccctccccacacccgccaacattctcctgcctcggcacaggttggccgagatcgcgggcctgaggaatccggccctgaaggcggcctcccgggcctcggagcggctccaagtccagctgacccccgcccagctggaggcgctggtggggttgagaaagcgcgtcgcgccgcgcgcccttcagcgcgtggcaggcgcgctggccgagaagctgggcgttcagggccccatcgtacagcgcagcaagatcgaggagtgggcacgcaggggggtcgccctcctggggcccctgacttaggcgatgggcactattgttgtctcttcctcttggcatggcggcaccaggtgtccgcaccatgcctttgtactctacaaacagggcagcagtgttactcatccagtggcagcaggaccgtgcggcagtcggggnnnnnnnnnnggggcactattggtgtctcttcctctctgcatggcggtaccaggtgtccgcaccatgcctttttactctacgaacagagcagcagtgttactcatctagtggcagcaggaccgtgcggcagtcggggatcaagcatccacttagatttcagatcaataatactgcgatcttcccaggcaaacacagtcgcgtggtgcagcagatgctgtctagagtccaccccgcacagccaaggccgacagctgttccaacattgtctctggggagaggagctcagtcgccccatacaccacgtgcttgggcgtgggctgggccctgcatggattgcgggggagggtcggggaaagatagtgcaagtgcaccccaggcactgtgaggccctgagagttgaggtcaccaactggcagcaggatgtgtagagatcgcactccnnnnnnnnnnaggagggttggggaaagattgtgcaagtgcaccccaggcgctgtgaggccctgagagttgaggtcaccaaatggcagcaggatgtgtagagatcgcactcccacattccacaacagcacacagcaagcagggcaagctcctccgcacctgctggcccagcattgcagagactcagcctcgaggaagttgccgcccccaaccatgaagacaatggcctgcttgaatggaccctggggtctggggccagagccgatgggggcctgcacggtgtggcgggacgaagagttgtcagcagagaaagcaatactggtgcagggagtgcagggtcttggtttgacccattgtcttggcgtgtagtgtggaagagtagcgcctctgcattcaatccccccccctccccccaaaaacaaacccacatgcctctctgtgtgctcaccttggggtcaaagtaagcgtacccatcgacgtctgggttgggccggccctccatgagggcctccacggccactgtgacggccgcctgctgctcccctgcaagcaggttcttcacgcccttggtcagggaggacaagccctgcccaaaggagctgcccagcagggtcgtaagctgcgcctgggcggcgcctccaaacacgccacggccgtccgccagggcggcagacgactgcaggggcggcggggaggaaacagtcggtgagcgagctcgagagctacggcacagcgacggtttccaggcgtgactggtggtggctgaagcgcatcataagccaggacgccgccacccacggtctcaaacacccacgacggaggcgcagcacaagatctttgacccacgcgtcctctcataatcacaaatcctcccacctgtgatttgccggtgaggttcatgcggcgcatgcggcgggcatatgcccacgcccgcacatccgcccctgcagccgcgagcgcggtctccaccctctcgcattccgcctccagcggcgccgtggggcaggtgagcagccagaccagggccaggcgcagcctatcggtgacagtgccttgcgagccctggggagacggacaaggggtttgagtggagagtcgtgaggtctcaagaccgataggagactgtgagtgggtgacattgcaactgtgtgctttaattactggcgtgcgttgcagcattgcccagcaggcaccattgcctgcatacagccagctgcatcctccatgccccgcggccccctatcgacaagaaacaactccccaaatacaatgtccctgcagagcgctgagcctccacagcacccccctccaccacaaccctctacctggaggtgtttgagcactgcttccacatgctccttgcccgcggtgagttcctcctccagcgcataataccggtccaggccccgctccttgatggcccccagcaggtgagttgccaggttggtgtgcttgtctatggaacgcttgcgctccgtcagctctggagtttgcgtcgtgagagggaatcggtcgatggggagcctgagccgtgccatcggtcccggcggcgaggggctggtgcgacgactcggggacaaacatctcaaaagccccccacttccaaagtgcaaaagcaaccaccccagccacccccgcaccgaccagggagcgagttgatggcgctcatgaggtgcttggtgttgccggccatgaggtccgcggggtcggccgcggcgtccagcacgtttgaccccgcgctgcggttgagctcatccacggcagcgcggtaccgcgccagctccgcctccacctgctccgcgatcttggggaactgctcgcgcccgtgcgcagaccagaagaagtcggagtcgtccacctcaaaggtcttggggacgggggtggcggcgccgggcgcgccgcccggcgctgccagcgtcacgcggttcagtcgcatgcccagcacatcgtgcaccagcggcttgtaggtccaggcgtgctgcagcatgaccgacagctcaaagttgcggtcgaagatcgccagcagggggcggtgtaggctggcggccaagcctgcgccggccgcgccggccccgtcggcaaagacgctgccgcgctgatgcagggcctcccttatttgggcatctagcagcgaggcgacgtgctccgcggcgccgccctgtggttggcgagtggggtggaataggggctggtgtcaggcatggggttgggctgatccatggcgcagccggcggcacgctgtcctgcggggccacactggagcgacaggcgtggcatcgtaggggcgcggcaatccatcgacaggcacaggcgcccatgggagcccaggagtgctgtcctccgcccccttgttctgcagggatgcccgcccttagaggtcgccacctccccccacccaccctcctgcctctcacaagttccaccttccagcaccacctcaccctggggcagcggatgatgggcaccgtaccagtgctggccaggacgcagaagaggcgctccacgacgaggccgactgcaccctggatctgggcgtcctgggcggaggggtcgttgaggtcgacgtaggtggcgggcaggcccaggctgaacagccccgcctccagcgcaatgtactgcaggtactggtcatgcacgcgggccacgcgcgcggcggagccctcccgcgccgcgccctcggccagcgcctccagctccttgcgcggcagctgggtggagaagttgaggtggtaggagtcatacagggaggccgccaggtcggccacgatgcgggcggtgctgtgcgggctgggggccacaaagtatacggcagggacgtcggggattggctggcggttggagtccagggggaggtgcagggtgacgccgtgccggcgcaggtccttgacgcggagcagcggggccagcacgtcctgggcatgggggtgtggggatgatggagtgggctcaagcgtgccctatggtagcctgcacctggtcctcccactcagggcttcccccgcccctggcaccccacctgggtggctgcatcgaggatgagcactttgtacagatcctccccgccccgcccggtgctctggggcgaggagttgaggtgcagcatgcgcaccaccgcatctgcatgggcgtgagagcggctgcttcagcgtgtgggggaaccccaggagagtgactctgtggttcgagcggagtcgcccgatcgctcccctcctgccacgactcaccagcctgcttctggcggatgttgagcgccatttaggagtctcaacgctcctgcgccaagtaccaagtcaagcctcaccccgtctgaggccgacccgtgcctgccggggcagttgtcaatctgtaaacaagcgacggatcaccggggcgctgattgcattgactgcatagtggttaagtgttcaaggacactgcgaacgggtataggtaatggcacgatggcgtgccggatctagtgttcctcctgccttcagattgtccgcgccctggacgcatcgcggaactcacacagcaagcagcttgaacacacaccgccacctcagcgacacgctcagcaccttacgctggattcacctactcctcggtagtagtttgatcataagaggacggggtgtagcctcttctcggggtgccatggcggacgctcctcgagtgacctttgtgctgaagaaccccgcgatgacacaggaggtgtctgtcaccgtgccattggatggggacgtcgcgggtttgaagtcaagcatccgggacgcctacccgggctccccttcgacctcccagctgattgtgagtgcaggccacatgggatgtcgtgatcagcaggcaccgcccatcagggacgctcagggcatgaccccacccactcaactcagttgatttacgcgggaaaagtcctcaagaacgatgctgaagcgctgtcatccttcctgaagccggtcagtagataggcttgtgggatgtatccatggcctgaatggggacccccccttcaggagccttatcccggtctaccacccacacctcgcagaacgtgaccccggactctccccagatcctgcacgtggtggtacaaggccaggccactgacggcacggccaggacgagtgcaggcgcctcatcctctgctcccacggcgtccccagcgcctcgggctgcggacgcagtgcgcatgcagcatgctggagcggcggcgccgtctgcagcccggcccccgcctggcactgcagcccccgcagggcccgatcccgaattgccacgtagaccccggccgcagaccgcccatcccgcgatcaaggggctggccgaggtgctccaccttaatgcggctgccgtggcctcggcctccatgtcggcggcctacgctgcggccctggcggtcctgggccacccgatcccacagcctctcgtggagggaggggcagggcctccggcccccgtgcacatgccacaggcgccgcagcaagtcctggcccaggttggcagcgttgagtgggccagtgggctgcttgggtgccatcttgtggcaaggttgtttgagtttgaagcgggggaggtgcagggcactgcatgtacgtgtgagagggacggggaagagcaagcaaaggatcatcagggtgctgtgacgtgaatctgtatccctcatgatgagtgccgccctcgcagaccatgctgcgcaacaatgcggctggccatgtgcaacaccccaacattcaggtggggacgcggggctagtctgggtttgtcgacgaggggtcctcctgctgggatgtgcacctccatgcgagccaagaaggctcatgcgactggtatggatcctcgnnnnnnnnnnccagggtgctgtgatgtgaatctgtgtccctcatgatgagtgctgcctccgcagaccatgctgcggaacaatgcggctggccatgtgcagcaccccaacattcaggtggggacgcggggctagtctgggttcgtcgacgaggggtcctcctcctgctaggacctgcacctccatgcgagccaggaaggctcatgcgactggtatggatcctcgttccatgatgtgccttgatggccctggccatgccgaagaacctgttcgcctcggtggccccgaccctgcaggtcaccttcctgcgccagagggtacaacaccagcgcgaccacggtgggtggcacggtgggtcatgaagcacgccccgtcgcccaagtgagtcctgttcccgccgggaacaggcctcgggatgccctctgacgaacaagccgccaccccgacgcaggcgcggagcctgccgccccggcccaagggcccggcctggcgcccggggcgctgccgctcctacannnnnnnnnnnnnnnnnnnnnnnnnnnnnnnnnnnnnnnnnnnnnnnnnnnnngaggcgcgcggcgaccttcccccaaacgtgcgggccctgctggagaacctggagcggctgcagggccccggcctggaccgagggcaccgcccgcgccccgccgccgcgccgcgcccgcaccccgccgtgcgcctccggcgctgggcggcgcagaacggcatgcagctgaacgcgcgggcgctgctgcagctcggggtcttgcttgccgtcgtgtaccaggtggggcgatgggagagggggggcgaactggttgaccgtgcctgggagtcgctgggtggcggtcagctggcgcggcggggcgctccagctgtgctgtgcgacctggaggtacacgtcctcgtggcgggcatgcaggtttctcccctcctcccagtgtcggggacccccatgcgcacacacaagctcgcccagccaccctgtcacacctgagttcccactttccgtgctcgtgctgcagcactgccccccnnnnnnnnnntctcgtggcgggcatggaggtttctcccctcctcccagtgtctggggacccccatgcgcacacaagcacacccagccagcctgtcacacctgagttcccatgttccgtgctcgtgctgcagcactgccccccccagcgcttcttcgcgctgctgaccctgggcctgctcctcttcctcaccaccacggagccggtgcgccgcttcctcgcgcagctggggcgggtgcgggctggtccggccgtggcgcccgtgccggaggcggggccgccgcgcgctgtcgccggccccggggacgccgatgcgggcatgcctgccgcagagttggaaggtggggagacacgcctggttgggacgacgaccgtgcagactgagtctgggtatcagtagcgaggcagaacccccgtccccaccctgacttttgcagcgcgtccggcagaggaggggccggccccgcaggcgccggcaccccggggcctggtgcaggaggctctggcggtgctggtcggcttcttctcctccatcctcccgggtagggcagcagcctgggagagggatgcgcagccgctccgcatggcatgcttcagcatgcaccgcgaggcgagcggcgctgtgtggtcaccgacatgcgatcccccccattctcacagggtggcaggcggatccggccgaggccgcggcgcatgcggcggcccaggcggcctggccagaggaccaggacatgccggtgctggnnnnnnnnnnactgtgtccgtcccccccagatgcttggtgggctggggccggcgcccttcgcagatctgcgaccctgttgcctgcctagctgcctgtgccgtgagaggttgaatccagtccccttcacagcccaagcccaccccctcccttccaactgccccgcgccccaggcaagcgcttcgccatcgacacgcccaacatcctcatgtccctgagcgacgacgcggtgccggcgctgacctcccagatcgacacagaccgcggccagctggcggcgcagcccaaggcgccgctgcccagcatgcaggccgggtggcaggccagnnnnnnnnnngctgacggcctccccgtcactggagggatcactgcatgcaatgcccggtgcgccgcccatgccagcgacgctctgtcccacacactgcagaccgcatcctcccgtgtcgtgcgatgaacagcgaccttacacccaagacatacccacagctgactctgtgccacgctaccagccgctgcaagctaggcaccgtgcctcatccgggtgcatagcatggtcaggcggtccaggtgccccaggatgctgcatgtggtggccacattccgagccagggcccgagccggagcacaccctgcacagcctggatgggagcagcgcggctgttggccggggggaagccatgtgcccggccgcccgcctttgcatccagcacaagcagggtgggggctgcatgagccgacactgggatggaaaggctgccgaggcgctgacacctcatcggctggacgcttgcacagccggcgacgggctctgggttgtgtgcccgggggtagctcatacaggccataggcgcggtggccgaagcggctt

SEQ ID NO: 44602 - DNA, 402 bp, Chlorella protothecoides
  modified_base (151)..(308): a, c, t, g, unknown or other
agcgccgcggtctggcggtagagcaggggcgcgctcgcggcgcccttgcgctcgccctccagcgccgcggcggaggccaggaacttgagccccgcctgggccaggaagaaggcagagacgtgggtggggcggggcccgccggcgccgccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccgccccgcgcagcacgcccggcagcgcgcaggccagcgcgcccagcgggttggtggcgccgtcgtcgtggcgcggcaccggcgccaccaaccc

SEQ ID NO: 44603 - DNA, 61 bp, Chlorella protothecoides
tgtggcggaacgtatcgggggagaggtggggggcctttgtttgcaagggattgtggttgga

SEQ ID NO: 44604 - DNA, 61 bp, Chlorella protothecoides
acaagccgggtgcggccagggagaggcggggtctccctgaacgagcagggtgcccctccac

SEQ ID NO: 44605 - DNA, 61 bp, Chlorella protothecoides
ctgtgggccattgcgaagatgttggcggagggcacaacaggcgttgcctaccgctcctcat

SEQ ID NO: 44606 - DNA, 106 bp, Chlorella protothecoides
agcatggggacgcccgcccgacggtgtggcctggcctggagccttggcgccaggctgccgtgaatgacctgcgcgtctgggggcgaaagggtccgcagagcgtgcc

SEQ ID NO: 44607 - DNA, 61 bp, Chlorella protothecoides
ggtggagtcgggagagtggtggcttgaagggggggggggttggaatcgggggatagaagtg

SEQ ID NO: 44608 - DNA, 61 bp, Chlorella protothecoides
gccagacggcccgcacgcgtacatggctggggggggcaacctcggaatagagaacaagtgc

SEQ ID NO: 44609 - DNA, 80 bp, Chlorella protothecoides
ggcacccctgctccttccccgcctgtttttaacacacattcccggcttcttttgcgaagcccccaccctgccacacccaa

SEQ ID NO: 44610 - DNA, 61 bp, Chlorella protothecoides
ctctgagagggtgactcctccgggctagggttgggcgcctgttgtgggctgggactgggag

SEQ ID NO: 44611 - DNA, 102 bp, Chlorella protothecoides
gggcaggggctgcaccgacttcgggccgccggccggggccggggccggctgtctgggcgcgtcggcggcgctggggcctcgtgatgcctgctccgcctctgc

SEQ ID NO: 44612 - DNA, 61 bp, Chlorella protothecoides
ccgcattctgttcctggagaccgtggcggggacgaggcatggggtaatggggtgggataat

SEQ ID NO: 44613 - DNA, 61 bp, Chlorella protothecoides
tgcttggcggctcgtgcatactggatgtcccccttctccacctgtcgggcggcctgcacaa

SEQ ID NO: 44614 - DNA, 61 bp, Chlorella protothecoides
tcccccgggccatactagtactggatgcatatgcaggatatcgcggccgcgtcttcagagg

SEQ ID NO: 44615 - DNA, 61 bp, Chlorella protothecoides
ggggttcaccaccggctggaccggggcgggggccacgtctattgaccccgggggccgggat

SEQ ID NO: 44616 - DNA, 61 bp, Chlorella protothecoides
ttcagacacagcgtgtcgcaggggcgggggggggggcgccgaacccccgtttgaagccagg

SEQ ID NO: 44617 - DNA, 61 bp, Chlorella protothecoides
cagaggcatgaacagggcaggctgcagaggggactactctcacagtccccatctgaggaag

SEQ ID NO: 44618 - DNA, 90 bp, Chlorella protothecoides
cagtacccgcccaacccgcagtacccgcccccccagggctggaagcagtaggccctggcgccccggatgcccgcgcccccgcatcccgaa

SEQ ID NO: 44619 - DNA, 80 bp, Chlorella protothecoides
cagctcgacctccccaccacgccccaacgcgggagccaccgtctttcagctccccctgcttcccgcggccgctctgcatc

SEQ ID NO: 44620 - DNA, 106 bp, Chlorella protothecoides
cggcggccacgctgggcgcgctacggtccacggcggtgacctgcgcagccacggccagcgtggcctccgcctcgcccacgtccagccgcggcgcggcgcccgccag

SEQ ID NO: 44621 - DNA, 61 bp, Chlorella protothecoides
aggggctaattgtttcttcttggctggagggggtgagcgtttaaatttcgacacgtatggt

SEQ ID NO: 44622 - DNA, 146 bp, Chlorella protothecoides
cggcgcggcgcctgctggccgcgctggccgccgaggcgccgggcccggccctggcgcacttcctggccgtgcgcacggccggcgccagctgccacgccagcagcgcctgcacccagacctcggccgtggcgctgctgctggcggag

SEQ ID NO: 44623 - DNA, 97 bp, Chlorella protothecoides
ctcgggggaggggctgggggagtcctcaggggatgggctaagggagtccttgggggaggggctgggcgagtcctcgggggaggggctggggaagtcc

SEQ ID NO: 44624 - DNA, 63 bp, Chlorella protothecoides
gaccagtccagctgcgcggcgcgggcggggctgcgcgccgcgccgcgcagcacgtccgtcagc

SEQ ID NO: 44625 - DNA, 85 bp, Chlorella protothecoides
gccggcggccagcgccaggcaatacaccgccgtgggcgcataccgaccctcctgcggcagcgactggcgccccgccgagtccagc

SEQ ID NO: 44626 - DNA, 61 bp, Chlorella protothecoides
cagcgccgcagctggggcgggattggctggggctcactccagcaaactggtacagggcgtg

SEQ ID NO: 44627 - DNA, 61 bp, Chlorella protothecoides
gttccccgtccagaagcgtgtttttgagcccgccatggccgggcaggatctgatcgcgcgc

SEQ ID NO: 44628 - DNA, 61 bp, Chlorella protothecoides
cttcaaccaaaggccatcggtcacggctgggcacacagccacactacattcgcgcatcggt

SEQ ID NO: 44629 - DNA, 61 bp, Chlorella protothecoides
ctcctcgctaacgtttgcatcagctacggggatctttaggcagaatgcattgttttcaagg

SEQ ID NO: 44630 - DNA, 61 bp, Chlorella protothecoides
tgcggcaccgtgtctgcatcatatggcaggggcctgcaaactctatgcacaaatctgagca

SEQ ID NO: 44631 - DNA, 61 bp, Chlorella protothecoides
ggagacgaagtggggaaaggtgtggcggcgggggagataggttaggaaggtggcgcattgc

SEQ ID NO: 44632 - DNA, 70 bp, Chlorella protothecoides
cgtcgtcctcacagacctgccgccctccactgtggcaggggtgctcctttcgtgtcgctctctcagcggt

SEQ ID NO: 44633 - DNA, 441 bp, Chlorella protothecoides
  modified_base (153)..(321): a, c, t, g, unknown or other
ggcgcgcctccaggcccgcgatgcgcgcgcgccaatcgtcggtgtcctccgcggcgcgcgcggcggccagctctgccgccaggcgcgcgcggtcggcctccagctcgcgccgcgcctcggcccacgcctgctcgtcgcgcttgtaccgcaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtcctcgttctgcagtgccagctccgccaggcggatggaggtggtgcgctccagcgccgcggatgccgcggggctggcgggcgccggcccggggctggcgcgcgggctggcgcgcgggct

SEQ ID NO: 44634 - DNA, 61 bp, Chlorella protothecoides
cctggacgtcgcgcggcgcgcgggactgcgtgtcgccgtcgtggcccatgaccccaaggta

SEQ ID NO: 44635 - DNA, 61 bp, Chlorella protothecoides
tatcatgttattccatgctaatgtattcagcgcggatgcctgctttgaaccctctaattta

SEQ ID NO: 44636 - DNA, 61 bp, Chlorella protothecoides
ctggccacggtggcgacatgtatggaagggggcgccgggtcggcgaattcgatgggtgcag

SEQ ID NO: 44637 - DNA, 61 bp, Chlorella protothecoides
gaggtcggttcatgtcggggagaagcgggggaccgctggagcacagcatgggcactcagtc

SEQ ID NO: 44638 - DNA, 61 bp, Chlorella protothecoides
ccgcgacctgctgaggagcaggggctcgtgggcgagcaacttcttgacccttccctgggtt

SEQ ID NO: 44639 - DNA, 74 bp, Chlorella protothecoides
agctgtggccgccgccggcgggggagggagcggtccgcggcgctggcgcccgggacgggaccggcgtgatcctg

SEQ ID NO: 44640 - DNA, 61 bp, Chlorella protothecoides
tgacatggctcccgtcgcagagtgggaaggggcccgaacgccagcagcgacagtaagaggt

SEQ ID NO: 44641 - DNA, 73 bp, Chlorella protothecoides
ataggataatctatatagacatatataggaataatctatatatactctatttttattaccaaatttgtattta

SEQ ID NO: 44642 - DNA, 61 bp, Chlorella protothecoides
ctgcacttctcgggcgcgtagcgcgcgggggagaaggtcagccggaagtcggagtcgaagc

SEQ ID NO: 44643 - DNA, 61 bp, Chlorella protothecoides
ctggtgcttggtctgtgcagcagcaggagggggtggcgggggccggggcagggcgttccca

SEQ ID NO: 44644 - DNA, 435 bp, Chlorella protothecoides
  modified_base (159)..(288): a, c, t, g, unknown or other
accaggggcgcgaggcaggcgcagaggagcagaagcagggcgcccaacagcgccgcctcgcctggccggcggcggcccagcgcgcgcagcacgtcaaacacggcgaagcgcgccagcgccaccgccgtgacgcaccccgccgccagcagggccgtgacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagggccaggcctagcatcggccccagcaggcgggcgcggggcaggaccaggagcgcggccttggacgcgtacaggcaggccatgagccaggtggcgggcgcgcgctgccacggcgcgtgcgccaggcgcgcggtcagcgccaggccc

SEQ ID NO: 44645 - DNA, 61 bp, Chlorella protothecoides
gacggcggggagcaggggcggcgggggcagcgggcgcccgctgcccagccggcgcagcacc

SEQ ID NO: 44646 - DNA, 61 bp, Chlorella protothecoides
tgccacctcctcgacggggtgttggcgggggggaagcattgggatcgcaccatcatggtcc

SEQ ID NO: 44647 - DNA, 80 bp, Chlorella protothecoides
tccaacagatcgatgggcagtcgcgggggtgatgcttctgtgcgcacggacaggcgctgcaaggttgattggagaggggg

SEQ ID NO: 44648 - DNA, 61 bp, Chlorella protothecoides
aatgtccgacatgaaaaagcagcggcaaggggggtggcgcgcgacggtcatgcggggggta

SEQ ID NO: 44649 - DNA, 61 bp, Chlorella protothecoides
cggaaacacgtgtcgctcatgcagggagggggatggtgcgcactacgtcatagcggttgag

SEQ ID NO: 44650 - DNA, 62 bp, Chlorella protothecoides
cccccccaaaacacacacacacacacacacttccctccccattcccccaccgcaccctgcag

SEQ ID NO: 44651 - DNA, 412 bp, Chlorella protothecoides
  modified_base (163)..(350): a, c, t, g, unknown or other
gggacgcttccatggcaacggtgcggtttcatgggacgggtgtcgttgttgccggcgggccgaagcagccacttgaactcctggcggcttgctggggggtgggtccaggacacgcgtcagctcaccgccccccacccacccacccaccccccgaccgctctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggggtgtgggaggtaggggtcgcgagggcgtcaggtcctgggatgggctcggcaggctcac

SEQ ID NO: 44652 - DNA, 627 bp, Chlorella protothecoides
  modified_base (122)..(131): a, c, t, g, unknown or other
gcgccgccagcgcgacgacgcggtccgccgcggcggtcacctccgcgtcgccctgtggcccttcgcccctgcctgccggcgcctggccgtgtccaccgggatcggggccccggcgggggacnnnnnnnnnnggtctgccgcggcggtcacctccgcgtcgccctgcggcccttcgcctctgcttgccggcgcctggccgtgtccaccaggatcagggccccggcaggggacttccggcgacggggccgcaccctctccactcgcaccgtcgccgtccggcgccgcgccgcccgcgccccaccccctctcctcccgcgcctccagagacgcccgcgccaactctggcaggcgcagtctgtcaaaggcgctgcccggcagcaggccctggtaggccaggttgtggatgcacagcgcgcccagcgcggcaggcagcgcagcacgcaacgcggccgccagcgcctccgctggcgcgtcggccgtcccaccaccgtgcccgtcggtcgcgccgccgtggaccacgtggcgcaggcgcagcaggcacagcgtggccggccagtcgttggccacgaagacggtgcgcggaccggccgcgaaggccggcgcggcggcggctgccgcgtccagcgc

SEQ ID NO: 44653 - DNA, 61 bp, Chlorella protothecoides
gcaggtcggtcttttggggggagggggggggggaagagactaccctttttggggtgccctg

SEQ ID NO: 44654 - DNA, 137 bp, Chlorella protothecoides
acatggatatcagctactatgctatgcaggcacactccagcaccgcccatctgtaattcagaagtgcaagggccaagaccactcacaccattgcattcacctgccccgtggatgcaagaggtgttgcgctggaaggg

SEQ ID NO: 44655 - DNA, 61 bp, Chlorella protothecoides
caaatcaatattttaaacacaactctgtgagacatgtaatctatattgttgtagcaaatcc

SEQ ID NO: 44656 - DNA, 462 bp, Chlorella protothecoides
  modified_base (194)..(277): a, c, t, g, unknown or other
ggcgggcggcatgcggcccagcccagcgctccacccgcccaccgcagcgtccacgtcaccggcgcagacgacgcagaggcctgcggcgtgcgcgtcgcccgcctcagccaggcgcgccgccagcgcgcttgccagggcctcgaactccgccggcggcgcggaggagaggagcagggccagggtctcacgccagnnnnnnnnnnnnnnnnnnnnnnnnnnnnnnnnnnnnnnnnnnnnnnnnnnnnnnnnnnnnnnnnnnnnnnnnnnnnnnnnnnnnggacgggccgccaccaggcccgcccagtcgccgcgcaggtggccggccaccaggcgcatgaaggggcgcgggtgggcggccatgtaggccaggcgcgccgagaggaaggcctccccgcccaccagcgaggccagcagcacggcgtcgcccaggcgcccggcctcgccggccagcgccgccgcgcg

SEQ ID NO: 44657 - DNA, 61 bp, Chlorella protothecoides
cgacgtcaccgggccccagaggagcaggcggatgcaagggggcggcagagagtgtcgaagg

SEQ ID NO: 44658 - DNA, 61 bp, Chlorella protothecoides
tgggattggaaagggggggttgggggggggggaggggacatggcccagcaggcttggaatg

SEQ ID NO: 44659 - DNA, 61 bp, Chlorella protothecoides
tggagggccccggggggccgagaggggggggggatgtagataactcgcgcacgggctgcag

SEQ ID NO: 44660 - DNA, 3601 bp, Chlorella protothecoides
  modified_base (121)..(202): a, c, t, g, unknown or other
  modified_base (956)..(965): a, c, t, g, unknown or other
  modified_base (2344)..(2532): a, c, t, g, unknown or other
  modified_base (2604)..(2613): a, c, t, g, unknown or other
  modified_base (2845)..(2926): a, c, t, g, unknown or other
  modified_base (3292)..(3301): a, c, t, g, unknown or other
gaacccgcgcccggcgcgcgcgcgcgcggcaaccccgcgcaccgcgccgtggccacgctgggcgtctacctggtgctgcggggcagcgccagggacggtggcgccaaggacggcgccgccnnnnnnnnnnnnnnnnnnnnnnnnnnnnnnnnnnnnnnnnnnnnnnnnnnnnnnnnnnnnnnnnnnnnnnnnnnnnnnnnnncccacctggacctgctggcggggctggccggcgcgctggacccgcccgcctgcggcgcgctgctggacgcgctggccaaccagctgcgctaccccagcgcgcacaccgcggccttcagcgtcgcgctgctgggcctgttcgcacgcgcgccgcgcgaggcggtggccgagcagctcacgcgcgtgctgctggagcgactgatcgcgacgcggccccacccctggggcctgctggtcaccttcatcgagcttctgaaggacccgcgctacgacttctggagccacgccttcacgcgctgcgcgccggacatcgagcgcctgttcgagtccatgtcgcgctcggccatggggccggggggcggagcgccgccgcaccaggccggcgcggcgccggaggctgccgccgcctgaggtactgcctggagccgtgggtcgcccgacacgccggcctcgtcagcctggcgcagtggcgagcggggcagtgctgcgaatcatgtgcctggccggacgccagggcaccccccgttgattccccgtcccacgcgctgggcccatgttcatgctctctgcctatttttcagctgctgggtcgtcgggcatcgctctgtaagtcgtcacgaggttcctgttcctggcctggaggaaggccggcctccggtggaaagcggggccggaatacgaaatcgctcggcgatgggagcccggtgccacaaagcgcccgcctcgcccacacgtccccagaggcatggcgagtnnnnnnnnnncgcacggcgatgggagcccggtgccacaaggcgcccgccccgcccacacgtccccagaggcatggcgagtgcgggggaggggctctgcccctacgatgtggccctggtggccctcctgacctgtgccctgcgccaggacccggaggcggaccccgcacccccggaggaggaggcgggggacgccctgccccgattcatacatgccgagctcctggaggactggccggggcccgggaggtccatcgcagccctggccgagcgcatcaaggtgactagggggtactgggggagtcgtggcattgcgaatggcgacgggtgacatggcatcacgacccagccgtgcgttgggttgcgtgggggtggacgcgccgtctcaccctgtggtcgcactacccgctcaggcatgcactccatgtgtagatcttggggcattgttgcagggatctggacccatcgatccgagagttccctgtgaatccaagctcagcgcccatcgccaccacaggcctgcctcgaaggggacctccggctgcgcgactcggcctacccgcaggacgtgctggactggctgggcggcacgctctccgccatgcagaccgccgacgacctcacctccctgtttgccaccgcggcggcgctggcggccggccatgcgaccccccgccccgccccggagcccaacagcgcgctgggtctcttcctgcgccgcgcgggggccctgtttggccgcatgcccttcgaggtgaagaggttgaaggagggaaggagtgttgcagggcgtgcgcactcgactcagcacacgcctcgccggctgcgtgagatgtgttgaaaatgctctcggcctgatgtttgaacgaggctggagcgttgatggcatccccgcctgcaatgaaccctccacttccccgcaggccgtgtgcgacctgctggaggaggtgcagctggcggtgcaccacgccgtctccggcaccgcccccgcatcgacgcctgtgcccgcggcggtggacctgggcatcttgcgtgcgcgcctggagtcccacgccctggcgtcatgtggtcgggaagaaagcggggcggtgcctgatgccccactgggtcccccgctcgccgacctggcggcgcacctggcggcgctgcgcaccggcgacttccccgcggcgcgcgacgcgctgcaccgctatcacgaccgctccggcggcggagcgggggccccctctcacctgctgcagcgcggcccgctggcgctggcgcaggcgcatgcgcgcgccgggcacgccgcgcgcgcgcggcgtggcctggaggaggtcgtccgcgcggcgcaggccggcggtgcgcacgccactttggcgcacgcgctgggcgcgctggccgacgttgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctggaccgcgtttttcgccgcgcgcaggccctggccgagccgtcgctggcggtcgcgagtcgcctggcgcnnnnnnnnnnggcgacgtggctgtggtcaaggcgcaggacacggcggccgacgcggcgcggctggcggcctgcgtgcggctggaggccgctgtgccgccggcgccgccgcacgcggcgcgcgtcagcgacggagtatctggcgagcctggccccacggccgcctccgccgcggcgctcgctacggtgcagggcctgtcggacctgttccttggcacgggcagcgtgctgggggagggcgggnnnnnnnnnnnnnnnnnnnnnnnnnnnnnnnnnnnnnnnnnnnnnnnnnnnnnnnnnnnnnnnnnnnnnnnnnnnnnnnnnncgccgcaggaacgacagccgcgctggcggcgcgctcgcacctgcttcccgccgcagcctgggagcgggcgggcgcgccgaggctggcccagctgcgctgcctgctggcgctgcgggacgcggcggcgggcgatgcggagcgcgtcgaggcgctgctgctcctggccgacagccaggcgggcgtggcggggcccgcgcagggcctgaggctcctggatgccaccctggggggagctggggagggaaggggtgatgtgtgcgatgcgcccaaaggcaaacgcgaggaggggcgcgtcgcgatggacggcatgtgcgaggtgggaggcggttggctgaacgatgagggagaggtggcaatcggccgggnnnnnnnnnngaaggcaaacgcgtggaggggcgcgtcgcgatggacggcctgtgcgaggtgggaggcggttggctggacgatgagggagaggtggcaatcggccgggtcgacatcctctccagcctgtcggcggctgtgcgatcgagggtggcggccgcacgcgcatgtttggaggggcgccgagcgctggcggtcggcgacgcgtggttggcgcggcactgggcgggccgcctggccgcactggcggggcctggcgcggccgccctccgcgccgacctcgacctgcaggccggcgagctggcgacggcc

SEQ ID NO: 44661 - DNA, 61 bp, Chlorella protothecoides
ccaccaggtttgcatggctgcattggaagggggcagggcacgacgccaggcgcgcaggccg

SEQ ID NO: 44662 - DNA, 94 bp, Chlorella protothecoides
cgccgtgcccgcgcgcagttcgtccagccctgccagcgccggcgggggggcggcggggcgcgtgatcccggccgccggctcgaaggctgaggcg

SEQ ID NO: 44663 - DNA, 381 bp, Chlorella protothecoides
  modified_base (104)..(308): a, c, t, g, unknown or other
ccgcgctcgccggtggcgctgcccgccgcggcgcacgccaggctgggtgtttggaccaccctcttccagcccctgctccccctgcactggctccaggcgctgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaccaacgaccctgccgccgcagcgccggccctggcggcctgggactcgctgctggcggcgggcccggcggcgg

SEQ ID NO: 44664 - DNA, 17072 bp, Chlorella protothecoides
  modified_base (742)..(751): a, c, t, g, unknown or other
  modified_base (1157)..(1166): a, c, t, g, unknown or other
  modified_base (1753)..(1829): a, c, t, g, unknown or other
  modified_base (2016)..(2130): a, c, t, g, unknown or other
  modified_base (3201)..(3210): a, c, t, g, unknown or other
  modified_base (3757)..(3766): a, c, t, g, unknown or other
  modified_base (3854)..(3925): a, c, t, g, unknown or other
  modified_base (5409)..(5418): a, c, t, g, unknown or other
  modified_base (6581)..(6590): a, c, t, g, unknown or other
  modified_base (6836)..(6845): a, c, t, g, unknown or other
  modified_base (6993)..(7002): a, c, t, g, unknown or other
  modified_base (8218)..(8227): a, c, t, g, unknown or other
  modified_base (9997)..(10012): a, c, t, g, unknown or other
  modified_base (11093)..(11102): a, c, t, g, unknown or other
  modified_base (11614)..(11623): a, c, t, g, unknown or other
  modified_base (12394)..(12403): a, c, t, g, unknown or other
  modified_base (13139)..(13148): a, c, t, g, unknown or other
  modified_base (13639)..(13648): a, c, t, g, unknown or other
  modified_base (14449)..(14458): a, c, t, g, unknown or other
  modified_base (14522)..(14531): a, c, t, g, unknown or other
  modified_base (14616)..(14625): a, c, t, g, unknown or other
  modified_base (14989)..(14998): a, c, t, g, unknown or other
  modified_base (15496)..(15505): a, c, t, g, unknown or other
  modified_base (15762)..(15771): a, c, t, g, unknown or other
  modified_base (16814)..(16875): a, c, t, g, unknown or other
ggggggggggttggacgttctacacttgtggcctggcccctctttctgaacaccaccgatcaggggtccgcaagctcccagatgcctacatcgccccactcaatggcgctgtggaggcaacattgcacgggataggggcccggtgcggccacactcgcgcaccgtcgacgctggggagtccacaggttgcaggagtggtcccggaaccagtactccccctccgccaggagcagggggtcgaagcggtcggtgccgccatccgtgaacacgccgctggccccactcttggtgaggcggcgggtgtggaaactcatgcgcccgagatcaggggggcccgctcagccccggcatccccgctccacgggctggggttgactggaccatggcgcgggctggggtctccgggcatgcaacgcatgcgatccatcctcgtgtccctgcggctggcacccctgatcaggcagcctcgcgggtgcctactgctcaggctgtcggggaagggatttaggtggggtgaacagtaccggtgcagcggtaccctcgtctgggggagtgatctcgggtttttattgctccgcatcgcgtgcagggcctgataacattgcgccaacatcatgttttcggtcgtgagatagcgaggctgaggtctcgaggcctgcatcgccccggcgtggtgcacacgtcaggagcagcgcgcacgggatgtccggggatccggggcccctccccgatgctgcaggcnnnnnnnnnnggcatcgccccggcgtggtgcagacttcaggagcagcgcgcacgggatgtccggcgatccggggcccctccccgatgctgcaggcgctgaggtccgatgggagggctggcatgaatttggaagcatagacccggcatctgctgccgcgccagacactcatgcagcccaggtcgggccacatgtccgaatgacgctcaccctctcctgcccgccgtgcagtggactccccagcgcctgcaggactacctggctgcccgagcccgccgaagggaggcccgcgacctcaacttgcacccagatagaccaggtgcgaaggtgtgcatcgcgcacaccgtgctgttcgtgcttggatggggcgttcattgtgcttccactttgtagcacagcctagcaccctcacccctcnnnnnnnnnntgagggtatgcatcgcgcacccctttctgttcgtgcttggatggggcgtacatggtggttccatgttgtagcacagcctagcaccctcacccctctgactcctgtacctgcaatcctccacggcaccccctcaaccacctccttcccaccccgacaatcattccaccaggcgaggcggctctggcccagctggacagcagcatgaagcgcaacaccgcactgacgcgcaagctgcgcacgctgacagaggagaccagggcgagcgtgctggaggacgcggctcggaccaaccagtccaagtacgtcgccgaggcggcggcggcgctggtggaggccccgcagaaggcgcgcgacgtggcccccgccgccgaggtggcctgcgcgttgcaccgacgctaccccgactttggcgaggccctgctgggcgcgctgcgccgcgagctggacgcacccctgcccggggacgaggagcgcggcgccctggcccgtcgccgtgcgctcctgcgcctgctggccgagctgacggggctgggcctggcgccctcccccgccctggtgatggccgaggcgcggcggctggccgtccnnnnnnnnnnnnnnnnnnnnnnnnnnnnnnnnnnnnnnnnnnnnnnnnnnnnnnnnnnnnnnnnnnnnnnnnnnnnnctgagcatgctttgcacgctggccaaggccgggcgggaggagctgctgggcctgcccccagcccatgccccgccgccggggtccgtggacgcggacgcagggacggcggctgactggcgcgcgccggccgaggcgcgcgaggcgctgtcgaccctgctgcgcggcgcgctggcggcagccgtcgagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcctggaacgagcgcgcgctggtggcgcgcggcgacctcgcggagagcacgctggcgcgctacgaggcgcggagggaggcgcgtgacgcgctgctccgcgcctgcgccgctctggccgaggccttggacgcgccgccgccggcactgggcgacgaggagggggaagaggacgagggccggggcgaggaggtggcggcgcagggcgcgggggcggccgccgtcgcgacggagtcggtgggtactcaatctgtgttgtctggttcatgggtgccatgcgcggatcgcatgccacagctacgcagagctgggcgaggcaggcctgaggggtcaggatgcttacccttgctttcaaacccccttgtgctgcactcattgtgtcacccactcggtgtgccgacacgctcgcagccgtttgaggacgaggagacccgcgccttctatgaggacctggtcgacctgcgggcgtacgtcccggccgtcctgctgggacccccagatgccggcgcagaggcaccggtgactgaccaggagacggggtcggcgccagacgatggtgacgctgatgtgtcagcagccgacgtcgaccacggcgacatgagcaaggctgaggacccactccccgaggctggcgcgccgggtcccacatggcccggagcgggtcccccggtatcgcccgaggcggaaggcagccctgccccaggagcagcagaggagcagagcccgctgcagaagcccaatgagctgcaggccatgctggcccggctgccggtctgcgtgagccgggaggaggccgacgaggcggcgctggccttctgctacgcccagtccaaggcggcgcgcaagcgcctggtgcgcacgctgtgcgacgtgccggggggcgcgctggcgctcctccctttctttgcgcgcatcgccgccaccctgggccgcatctggcccgacatccccgccggtgaggggctgaaaggatgatggggtgtgaaaggggcggggtgtgggggatgggtggcaagcgtctgctcggtgcgtgcgtcatcgcagactcaacatgagcacctgtcctggcgcatnnnnnnnnnnactggcgctcctccctttcttcgcgcgcattgccgccaccctgggtcgcatctggcccgacatccccgccggtgaggggctggaaggatgatggggtgtgaaaggggcggggagtggggcatgggtggcaagtgtctgctcggtgcatgcgtcgtcgcggactcaacatgagcacctgtcctggcgcatctgtgacggcggcgagtgtgccggacctgcactggagcctgtcagtcccccctcccccaaacccccaccccaccgccaggcgtatgccagcacctggagtcggagttccggctgctgcagaagaggaaggacgtcgccgcgtcggggcggaacctggaggctcgcatccgcaacatgcgctacatcggtgaggggtgggagtgggctgggtgcggccggccttcgatttgggggggcccgtcacgcacttgcagctcgggggagcagcccttgtcacaacatgggtaccagcgctcctccgcctcctcaagcatgcatcactccccacacacatacctcgctcccctccaggcgagcnnnnnnnnnncgcatttgagcctgtcagtcccccctcccccaaatccccaccccatcgccaggcgtgtgccagcacctggagtcggagttccggctgnnnnnnnnnnnnnnnnnnnnnnnnnnnnnnnnnnnnnnnnnnnnnnnnnnnnnnnnnnnnnnnnnnnnnnnnaggaagtggactgggtgcggccggcctttaatctgggggtgcccgtcacgcccttgcagctcaagggagcagcccttgtcacgacgtgggtatcagcgctcccctgcctcctcaagcatgcatcactctcccccacacatacctcgctcccctccaggcgagctgctgaagttccaggctttccccgcgggcgtggccttccgcgcgctcaagtccctgctggacgactttaccgggtccagcatcgacgctgcctgcgcgctggtggagaccgcggggcgcttcctggcgcgctcgccggccaccactgcacggctgaacagcatgctggacatcatgatgcggctgaagacagcccgccacctggacgcgcggcagagctcgctcatcgactcggtctactccctggtcaaggtgggagggagtgatttgtgggacgcatgcagggcccgccggtccttggggtgtgggctctcaagcatcgcgctccacagaccccggcctgacacacacacacgcgcacacacacacacatactgtgtcatacactgccccactccccaggccaagaacctggtgcggcagcgcaagcagcgcccgccgctgcactcctacatccgccacctggtgtactcggggctggaggaccgcgcggcagccacgggccccatgaaccgcctgcgccgcctgccctgggccgagtgcgaggcctacctggttcgcacgctggtgcgtgcggcctgcaagggccgccactcggcgctgcccagcctggcctcgctggcggctggcctggcgcgttaccaccccagtctgggcgtggccctggtcgactcgctgctggaggatgtcgccgtgggcctggagagcccggggtcaggtgcgcactttcttcgtgtatgttttgtgtgttgtcaagagagggaggcggggcaagccatgctttcatgtgcagcgccggcaggccctctgcaagtccgcctggcgcgaggggcgcccctcgttgagccacaatctgcgttcccgatactccagtcgttgctttatccttccgcgccgcaccccccccccccccccccccccccccctacatatgaaaacgatatcagtgtcctaccagaagcgcatggcggcggtgtgcttcctgggggagctgtacaactacaagctcgtgaactcgggcgtggtcttccagaccctccagctgctcctcaccgcgacacccgagggggaggggtattcagcgccgggacaggggtgggtaggggatgtgagggaggctggggtcttgaagtggtccctgtggcccctggcctttgcttccacaattctcgtggagtgcatgctgcagctcatcgtcccgtgcggaggcatcatgatggagggtgtggacgaaggatgcatccaaggatagaatgtattcaagtaacaatcacctggcgatcctctgccggactcccctccccagccttgtcctccaatannnnnnnnnnaatccaaggatagaatgttttcgagtgacaatcacctggcgatcctctgcccgactcccctccccagccttgtcctccaataacccaaagcgcgcagggatgcctccctggacccccccggcaactacttccggatcaggctggcctgtgcgctgctggagacctgcggctcctacttcaccaagggcccggcgcggcgccggctggacgccgcgctgacgcgcctggccgcctataccctgtccaaggctgcgcccctgcccctggacgtcgacgtcgacctgggggacctccagacacggctgggggtggccatgccctccttttccaccctggacgcggcgctggccgcggtggccgagctggactccagtggcgaggcgcaggaggggccctccctggccgaggaggaggaggcggaggaggagggcgaggtgagcggggcctccacggcgagcagcgaggacggcggtgcctcctccggggaggaggagagcagcagggaggaggaggacgcggagggcgccggcgaggacggcgacgaggaggccctgctctcccccgccgccaccgctgtcacccccgtgcccgtggaggtggacgaggatttcgagcgcgagttcgcggccatgctcctggagggcaagcgagggggcgcgccctcaatcgccgccgacgcccagaccccgaccgtcagcgtgtccttcaacgtcatgctgcgccgcggcgcgcgcgacacgcgcacgctgcgcacgctggccatccccgtggcgccgtcggtggaggcgggcatccgcgcacgcgtggcggccgaggccgcggagcgcgcgcagctcaagcgcctggtcctggaggccaaccgccgcgacatggccgacgaggcggagagcgaggcggcggtcctgtggcagggcagacaccgcgccaagggcggcagccaccgcgtcagcttcggcggtgctggtcacaggggcgtcgggtgagagagggatgcgtggcactggattcacccagccccctcccatccccggcggtgctgacggcagggtgcgctctggcggcggctgtcgcaaagtggtcgcaagggagctggtggagcgcaatgttcatacaggcagggcactccactctaggcgcacagtccttcccacccaagcacctgnnnnnnnnnngcaccgcgccaagggcggtggccaccgcgtcagcttcggcggtgctagtcacaggggcgccgggtgagagagggatgcgtggcactggattcacccaaccccctcccatcctggcggtgctgacggcagggtgcattctggcggcggctgtcgcaaagcggtcgcaagggagctggtggagcgcgatggttatacaggcagggcactccactctgggcgcacagtccttcccacccaagcacctgnnnnnnnnnngggcccgtgccacccctggcaggggcgcgcgctggacctgcagtagcctgtgctgtagagccacttgcgtaccgcaggcctgacatttgagcagcgcggtggcatgttttacccccactgccccttgaaaggtcctgcccgccacagnnnnnnnnnngcagcggcaggagcgccgctgcgagggggcgacgcttgggcgcgagtggcattaggcccgtgccacccctggcaggggggcgcgctggacctgcagtagcctgtgctgtggagccatacgcgtaccgcaggcctgacattcgagcagcgtggtggcgtgtttcacccccactgccccttgaaagatcctgccccttgaaaggtcctgcccgccacagtccacaacccccaagctggacggctgcgtgcccatgaagtagttgccgtgagtttcattgcaagagcaaaggtggagcgggaggtgtggagctaaaacaggtcaaagggctgcagaggaggttcacagcaccaagggcgcatgccagcggaaagactcaggacgtggtgcaacaggctgtcaggcccgcagcgccgccagccgttgcttcacagcatcatccagctcgtcctcgtcctcgtcgtcacctgtgggagggccccctgctgcccgtttccggctgccttctgcggagcatgaaggatcagtgaggggagcgaggtcacaccagaggttgcccagggaggagccacgacctgcaatgcatgctgaacgtatggcagatatcggagtctccctgaccagagaccatatgatacaggcgagcaagatgcacgaaggagaccgccccacatgcacaaatacttagcagtggccctgcatccatgctgcagtgatctctcacacccaccgcaagaccgaacacgacccaccttgagccggggccggctgctggtcgccctcctggccccacaccgcgcggttggcctccgccgtctcctctgtgtcctcctcgattggggtgttccaccagaggggcccgccaaaacgcccgtcccccgaggcgcagcagatgcagccggtctggacgtcgggggtgatgcgctgctggaaggcgcggagcttcatgggcacgcggcagtggctcgtggtcccaaagttgtggttgttcttctggatggccagcatggagcacaggatctcatacccgggctttcgccatttggcaatgagcgggccgtccgccatcttctcgcggaccagccagtcgtactgggaaggggaaggtggtgagagtgtggaagaattgactttacgcgaaccgcctggcgcagcagcctgaagagagcctcctcgccccaccccccacaccccccaaggcagccactcaccagctctnnnnnnnnnnatggaaggtggggagagtgtgaaagaattgactttaagcgaaccgcctggcgcagcagcttgaagagagcctcctcgccccacccccccaccccccaaggcagccactcaccagctctcgcgacatgaccttgcggacatacatgaggtcgtaaatgaaccggttcttctcccagtgtatcctgtggatcttccaggaggtctcgttcttgcgcttgccctcgtgctcgtcgttcaccgcctccttcatttgctgctcaaagtcctctatcacctgcgccgcgtacgaggatgagggaatttgctggagcataagcagtaccgatcatcgatctgcaccgagaatcctcgcagtctcgtggcccctgctagagcgccgcgcagcacacctcctctatgagctcccatccctccggtggcctgttgttcttcaggcgcctccgcaacgacatcgcggctgccgctgccgcaaaatgaatacttgaatattgctcgtatagtttctgggagtgagtgggcagatgggaaaggcatgcgggcgtgaatgtccacgggtgtcggaacaggactttccccctgcacctcccgagcgccaacagggcagagcaggccccgccacggaagagcactggatctggctgtgttacagtcctggcgtcacgcccacggtatgccggccactcagtcatggcgggatgtggggtggaatggtcacacacgtgtcctatcatgactcatgcaaagcgggaagtagggggtgagagggaacagggagaccatcccgccctgcgcgccggcgtgggcccgacgctcaggggtcggcgatcagctcggagggcttgaaatagtcggcggccatggtttccacgatggactccatgatggcgttcttgcagcggatgtaggcgctcacagggtagccctggaacccgatgctggtcttggcctgccggcgcgaggcacccaggtccacccagttgatctctgggtcggcgatggccaccttcacgtactcgtacagcctggtttaggggcaggtcagggagaagtggggttcatcttccacgggagcggcagcagaggccgctgctgtgcggcgcgggggtggcgcgagctctgctggttcagtgcgcacgcgtgtttgcgaccagctcccacgacaccctctccccagccaaaccagttccgccccgctccccctccctcgtacatattgaagtaggtggaacaggacttggccagggggttctcgtagtcggtgccgcaccacatgggcatcagcgtgtcctccacccgcacgcctgtgcagaaggtgatcagcttcccctcggccgccacgtccctgatcagcatcagcgtcaggcccggcgtgttgaggtggaaatcggcaaactccttctcggacagcacgcagaagccgttagcgtcccccgtcgacttgtacagcggccagagtgaggccaccatctccgtggagccgggaggaaggtccacgtactcgtggttgatcaccttggcgttgttgaacttcttctggcggtccttgaagttccaccgccccttcttggacaggatcttggtgtagtcgtcgatggacttcatgcccctcacgtccagcttaaacacctcagccagcgggaaggtcaccctggcgggcaacgagcgggaggggagtgagggattgtagggggtggaggagtagggatctatctgagcgtgtctctcgccagccagggtaggaggtcatgaattcaattgagtggctgctggnnnnnnnnnnnnnnnncagtactttcacttttgtctggttggtgttgggaaggtaagaggtcatcatcacctatgccacatcacaatcaccccaataccatcccccccctccccaccatctgtatttgggttctagattcttgatgtcgggacggtcgaggacgatgaggaagggcgcggcggcacgcagggccttggggcagacgtcacggtaccccgccatgccgccgctaacgtcggctgtgggccggccgatgagcaggatgtggtccaggcccggcagctggacaaacggcgccagcacggggggcagctgcacgtagctggcgatggggtagcgctggtaggtcacgccgtagatgcccttgggggctgtgtgctctgtctcggaggtggtggatgactccgggttggagttggagcccaccaaggaccttatgggggaaggggaagggagagggtcacacgttgggggtttgggcggttggatcacacctcaagcccaacagtttgaaatgcactgagagtgcggtcgcagggaagggggattcacaccgagaggcctgcgcccatacgaggagcatggacaggcctccatcgacgcaagtcagggttgtacgacacgatcaggcacggcctcgctcacgagaagaggccggtgaagccggaaaccttgtcccgcagggacttgctgacgtcctcgcacaaccggtcccagacatcagactccttgggtgcagcctgaaaagccagctgggccttgctgtcggcccgcttgctgatctcgagcagggccatgctggaggggacaggttgggagcagcgcgagcgcgttgcaggtgtcagatttcggggaatttggaccttagacgccatacaccttcatgaacacgttatccaggtgcatctaccttgcgaccgctgagttgagtccccttccttaaataaacaaaggccgggagcaggttgcggtccgggccgcgacccctagacagacttcgcgaaaagacgcgtatcctttcggctttctctgtcctcaataactatgtcgtttaagatgctgttagaacagcccggggacctgatccgcgatgcannnnnnnnnngcttcgcgagaagacgcgtatcctttcggctttctctgtcttcaataactaagccgtttaagatgctcttcgaacagcccggggacctgatccgcgatgcagccgataattctggcttgggccttggtgacacgtgggcaaaatccccccttgtcagcaggcccacaggtgggggccctaatcgatccacaagcaaaagaacacacaactccaaccggcaggatcctcaatttggagcaatgatccgcatagcaccatcctgcggcagtgcatgagagctccgacagggctggggtaacactctgttgggcaaggctgcacatcaagatcattgcagaggcgtcttacattgtgagatgtacaacgcagtcactgccgcagcagctcgtgtgtgatgcagtgaatctggcctttggtagcacatagaatatcaagttcacatgagaggaatttcttaaaagctcaagcagccggcgtcacgcttacagccacggcgcccaaccgatgtacannnnnnnnnnggatcattgcagaggcgtcttacaatgtgagatgtataacgcagtcactggcgcagcagctcgtgtgtgatgtagtgaatctggcctttggtaacccatagaatatcaagttcacatgaaaggaatttctcaaaagctcaagcagccggcgtcacccttacagccacggcgcccaaccgatgtacatgcgcgacaggttgtctgggtccatggcttcctgtagcaggcgctgcccctgcccctccacgccctgtgcgtccccatcgcctgctcagagggtgtagtagttttgtcaggcgagtgaggggtcagaattggggccacagggtcagaagggcatgagcaggcagatcggcggcaggatgaaccacttccaacccctcccctggcaagcgtgctgccgtccagggctcaccgccctctgcgcctcggagcttctgcttgatgcgcaggatggtccgctcggcgtcggcgttgatgaccccggccgcccccggcccctccgagagcccgcccccttcgttcccggcctgccgcgcgtgggcctggggtaccgtcagcgcccagcgatacagggggtcgtggatgaagacctcgatcaccgtcagcactgactccgagtgggctcgcacgacctgggggtggggtgggagaagggaatgaggtgcactgaaggcggcacatgggcacacaagtgggactgctcggatggtgaccaatccctcacagccaggctgggcaccagcggaatcttgccagcttactattcannnnnnnnnngaatgaggcgcattgaaggcggcacatgggcatacaaaagggcctgctcggatggtgaccaatccctcacaaccaggctgggaaccagcggaatcttgccagcttactattcagggtcgccgtgatggaatctcccccccaagcccgccctcgccccctcacgacccatcgccttgccaattcccattccctctggcgcgctggccatggtttgatcaccttctccacacctgacatccgggtcccccccccccaccaccaccaacattgccccgacaagcagtcagcatcagagactgccgtccccgcagcctcaccctgagcaccgcttcgcagcaacgggtcatcaccccatccacgccgtgcggccccatggcagccaccaggtccggggtcaagcggaaggggaccacctccggcgtattcagaaacttgccctgctcgaaggcaatgccaaggtcgatgtggaccacctcgccgccgcgcagctgcagcaggatgttctggcagtggcgatcgcccaggccaatgacgtggcctgccatgctggcggccgccacgctgcgcacgtaggccagccgggccgtgtgccacgcgcctgtattgtggcaggtgaacagcgggggagggggaggtgaggggagtgtccgggcaggtttgcagttgacaaaggggtggggtggggggaaggaaaggtgcaggatcggggggaccgagctggtaccggcgtggtggnnnnnnnnnncagtgtccgggcaggtttgcagtcgacaaaaggggtgggtggggggaaggaaaggtgcaggattggggggaccgagctggtaccggcgtggtggtgggctgggccccaaggattttaaaagatgcttgcagtgtgcaccgtgctctggcccctgctctccctcgacctccagccctgcccgcccactcaccggggctgtggaagcgctcgaggaagaaatgctgcaggaccggtgggaagtgcgcacacacgtcgtcaaaggcctccctctgccgcctccgccccgcgccgcccgcctggtgcatcctgttccagcactggaaagggcacccaaggtggtttgcacgagggtttggggatcatgaagcggctgggtggcccacaggtgccgatggatgagggtccaactcattgatgcacacaactgcgccccctcctgtgaaagacccagctctctcctcacccagagagcaccccgcgcccgcaaacannnnnnnnnncgccgatggatgagggtccaagtcattgatgcacacagctgcgcccccccctgtgaaagacccagctctctccacacccagagagcaccccgcgcccgcaaacacacgatcccatcccccggaaccattccctcacctgctcaaaactgtactcgccgggcgccctgtatcgggcgtgggcgccgctcctcttccccgggccgataagatagtcggccaggggcacggtgtcttcgacccaggccaggaggccggcggcggggctgaagggcaccacgcggtaggtctggagggagaggcggcgcgagcgcgcccccgcgtcggcctgcagcagctggttgagcagccagaagaactgctgcatcaccgcgtcctgccgcaggtcgtcgctccccgacttcagctgtgggcagggggtggtggggaggggaactcgtggggctggagataatgggcctgatgtctgggggagcttagcgtacgcaacatgaccgcacggtttgtgtcaggcatgttgctgctgcgccccagccagcaggagtcccccaccacctgggtcaaacgccccgcacgctggccaccatgcacaggtggggccagcgggctggcagcctgagggggcaccccgcgaagagtccaccacccgaatgatcaatcctctccacagcccctcaccagctggcggtgctcccgccccgcgctgtccacgcagctgaccagcttggggcggttgatgccacccacgaaggtcagccggtcaccaaaggacaccagcgtgggcacatcctcgtagcggcaggnnnnnnnnnngcccacgaaagtcagccggtcgccaaaggacatcagcgtgggcacatcctcgtagcggcaggannnnnnnnnnggggtggccgtccttgggcgcgggcgcggccgccagctctatgtagacgtctatcaacatctccatctgcgtgaggtggtggggnnnnnnnnnnggggtccaccgccagcaaagcgctggccaccggcacgcggggcatggcccgcgtggagcggcgtagggcggcgggaaatgggatagggtggccgtccttaggcgcgggcgcggctgccagctctatgtagacgtccaccaacatctccatctgcgtgaggtggtggggtgagatgattggggtaattctgcgcctagggaggggggctgggtggtctggcagagcatgagtcgcagcccagacccagaggcagcgatggccagtgatgacgcaagaggagcgcaggcagcgcagcttcagcgcaccctggctgcgaggatgacatccctcgcgagatcctaccagccccaacctcccacccacnnnnnnnnnnacagaggcagcaatggccagtgatgacgcaagaggagcacaggcagcgcagcttcagcgcaccccggctgcgaggatcacatccctcacaagatcctaccagccccaacctcccacccacctgggcgaccagctccctcgcagcgggcggcgcgccggcagccttcaatcgcgccaccagcgcctctgctgcggcgaccttggcgtggtccacggcataggtcatgcccggtcgggacaccccgcgccgtccgtccctgcccctgtccccgttcttcagggccagcacctggaagagcgcgtggaaggggtggtcccggcaaagccgctccagcagctccgtcaggacggcctggaagccaggccctgcggcgggggccgcgccggcgccagcatcttgtgggatggaaggagggggagggatgaggtttttggcgactctgccaggatagtggccatgggggtttatctggcgcttcaaagttgcaccgtggcatgnnnnnnnnnnggatgaggtttttggtgactctgccagggtagtggccatgggggttcattctggcgcttcaaagttgcaccgtggcatgggaacatctgccgccaggcatcgtgatgcatcgcctgcatcgcgtgcagtcccctgctcctcctgttgttcgatgggcaaacccaccaacccccttccccctcgctatgacgaccccctgcaccccatgctacccccccgcccaccagtggagaggcgcgacgccacctggtagacgnnnnnnnnnntatcgtgatgcatcgcctgcatcgcgtgcggtccctgctcctcctgttgtccaatgggcaaacccaccaacccccttcccccccgctaggacaaccccctgaaccccatgctacccccccgcccaccggtggagaggcgcgacgccacctggtagacgaggggcaggaacttgtggctgggggcgtcctggaaggcctccgccgcgtggtcgttcacccaggcgatgcgggggcccagctccagccagagctggacaaagcggaaggctacggggaggtcgtacagctggcctgtgcttaggcagcgggcgtagttgtgcagcgcgacgcgcagcatctgctcctccctctcctccacggcctgcaagaagagggcgtgcatgtcgattgattggcacgtgctggagatgagggttgggggcgagcagcgcagtcgttctgccaccaggttcccctacttgccggcgacctccttcattgcattcagccacgcccaggcccaggccattgctccatcgaatcccccgttctccccccgcatcccagaagtagtccctcatatgcccccaccgcatgctcctcctcgtccatgcgcacggccttgtccagcgccgccagctgcagctccagggagcgggcctccttgtccccaggctcagaccgcgcactgcgccccgcaccgcgccgcgcgagccgagcgcgcaggtcccccgcctgcgccttcttcgcggccaccaccgcacgggcggcacgccactcgtctccggcgcgccgcgcgcgcacggcgcggtggaggccgtcggcgtagtgcgcgaggcggtagtgcgcacggcacagcgtgcgcagcgtggcggcggcgccgtcgtccagcgcgcccagtgcgtccgccgcggactgcagcgcacgcaacgtgtcggccgaggagcccgagtgtcgcgcgcgcgcctgccactttgcggccagcaggcgcagggccgcggtgtcgcgccggcgcgccggtgacatattcccggcgccgtctgcagtccccctctcctccctcnnnnnnnnnnnnnnnnnnnnnnnnnnnnnnnnnnnnnnnnnnnnnnnnnnnnnnnnnnnnnncgccggccaggcgcagcgcgacgtctgtctggccccgtgcccacagcacctttgcctcctccacgcgccaggtcagtgcggggacggggtcggcgatcgcgcccgccgccgccccggcgccaagctcgcgcagcatgcgcagcgcgtacagcgccgaggtcgcggaggcgtggcgcccggccttgcgcgccgcgcgc

SEQ ID NO: 44665 - DNA, 61 bp, Chlorella protothecoides
tccctggtggccggctggcatgcggcaggggcgcctgtttatccgtctgtgcccagcgtca

SEQ ID NO: 44666 - DNA, 104 bp, Chlorella protothecoides
ctccatgcaggcgcccggcggcggcgccggtccggggcacagctaccgtcacgcgccgcagcagcaggggccggggccccaggccggcctgggcgcacaccagc

SEQ ID NO: 44667 - DNA, 61 bp, Chlorella protothecoides
ccttgccacagaccgtctacttccggaaggggacagggccaggccacatttccgagcgccc

SEQ ID NO: 44668 - DNA, 61 bp, Chlorella protothecoides
ctcggtctgcgcgctgtggacgccggagacgtacctgacgcaggagggcgtggtggcgggg

SEQ ID NO: 44669 - DNA, 14875 bp, Chlorella protothecoides
  modified_base (235)..(248): a, c, t, g, unknown or other
  modified_base (614)..(766): a, c, t, g, unknown or other
  modified_base (846)..(855): a, c, t, g, unknown or other
  modified_base (1657)..(1666): a, c, t, g, unknown or other
  modified_base (1841)..(1850): a, c, t, g, unknown or other
  modified_base (2443)..(2452): a, c, t, g, unknown or other
  modified_base (3318)..(3327): a, c, t, g, unknown or other
  modified_base (3831)..(3867): a, c, t, g, unknown or other
  modified_base (4118)..(4127): a, c, t, g, unknown or other
  modified_base (4310)..(4319): a, c, t, g, unknown or other
  modified_base (4413)..(4422): a, c, t, g, unknown or other
  modified_base (5118)..(5177): a, c, t, g, unknown or other
  modified_base (5338)..(5458): a, c, t, g, unknown or other
  modified_base (5591)..(5668): a, c, t, g, unknown or other
  modified_base (6189)..(6198): a, c, t, g, unknown or other
  modified_base (8564)..(8573): a, c, t, g, unknown or other
  modified_base (8780)..(8789): a, c, t, g, unknown or other
  modified_base (10313)..(10322): a, c, t, g, unknown or other
  modified_base (11822)..(11831): a, c, t, g, unknown or other
  modified_base (12066)..(12075): a, c, t, g, unknown or other
  modified_base (12512)..(12521): a, c, t, g, unknown or other
  modified_base (12746)..(12755): a, c, t, g, unknown or other
  modified_base (13331)..(13340): a, c, t, g, unknown or other
  modified_base (13681)..(13690): a, c, t, g, unknown or other
  modified_base (14113)..(14122): a, c, t, g, unknown or other
  modified_base (14553)..(14562): a, c, t, g, unknown or other
gctggtggcggccgcagggtgtgcggccgcctgcgtggcgctgcatcgctccgcggcggccaacgcgcggctgagcgcgcgcctggcccagcgcgagggcgagctggcggagctggtgtcgcgcatcatggcgctgcagcgcacgctcacgcgccaccacgccgtgcgcgctgtgcccatcatcgcgcatgcctcctgctcctggcacggcgtggcgacggcgggggcctccctnnnnnnnnnnnnnnggtgcccatcatcgcgcacgcctcctgctcctggcacggcgtggccacggcgggggcctccctgtgaccgggggccgccgctggtggttccccggcgcccctcgcttgttcactggcgcctgagagcgggggcggtgggcaggcgtcgcatggtgactgggccatgctggcgcagagccatcggcccccccttccccgccatccccccaccccacgagaccaacaagtatcccctcacgccttctcgaccgtagcaccttgtcgccgtctctagaccaccgccatgtgccctcgcctagcttgtgcaggccagtatgcggaaccgccgcccccccgcaaaagagagccttgaaaggctctgccctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaacacggcagcctggcccgcgccctccagacctacatgtaagtgccagccgcccctgtacccggccgtgccttgcctannnnnnnnnngtgcggaaccgccgccccccccccggcaaaagagagccttgaaaggctctgcccttttgggtgcggtgaccacactcctgcccctcaccaccacgttttgtgtgtttcctattgacgggcaggggcagcgtgcgaagcaggcgaacacggcagcccggcccgcgccctccggacctacatgtaagtgccaaccgcccctgtacccggccgtgccttgcctacctgcatctgaaaggcaggacctccaggagccagggcccctcgtcccaccgctgcatgcactcgcttgcccgccccccccctggcgtgcgctcatctctcgggagtgattttccctgaacctgtacattattcccaccctccctgaccacaaaacctgcatgcacaaccgaacgttgcttggtgtaaacatactgacacggagaaaattgagcgggggatgggccacgctctatgaggctgtcgtgggtgaccgagggctggccaccaggctccgatgccggacagcatcccaccccccgccggacgcggactgtgcccgccacgcatgctgtgcatgctgcgcctgggccagcccctcacaggtccaggctccggatgctgcggcgctgggagagcagtgggttctgggaggcatggctgcagggattgttcagcgccgcgacgtgattcctccgctcctccagcagcctgcatttgaagaggggtttgcagggcatgaggcgagcagcagggaatgcagaggcgggtggggttgcagtgatcagcatacagactgcgtgcctccatgcggtcaccaccnnnnnnnnnngtgcagggcatgaggcgagctgcagggaatccagaggcaagtggggttgcagtgatcaccatgcagactgcgtgcctccatgcggtcaccaccacaagtcatccgccaccctcccctccccccccaccatccctcaaggacgcacctggtgacgcgtttggtccagctcagcacnnnnnnnnnnaccaccctcccctcctacccccaccatccctcaaggacgcgcctggtgacgcgtttggtccagctcagcacggtcttcctttccagaacgatgcgcccggcttcgccatcctccttggtccagagcctgaggcggcgcagcacccccgccacccccaggcccacccgagccgccggctgggcgggggggtgtgctgggggcgcagcgctgtgcgacggcttcagcacagaggaggcattgtaggggggcaccttcagcacaagcgttgcgattgcctcgtcttcgcctgccatgatcaggcgctgcatggcagccacctgcatggtgatcggggtgggaaagggtgatgcacacgactgatggcagggcaccgactcccatgcccgagacgggcggctctgttcaggtgctcagcatggctatttgcgtggtctccctcccctgcatccacaatcgctgcgaagcccggcgcaccacagacagggcgtagacctccgccacagcagggctcatgccacgtagatcaatcttcgacccgcgccggagtgagaagtttggcagtgccccactgccagtgtggagggacggggacnnnnnnnnnngagcgtcgcgattgcctcgtcctcgcctgccatgatcaggcactgcatggcagccacctgcatggtgatcggggtgggaaagggtgaggcacacgactgatggcagggcactagttcccttgcccgagacgggcggctctgttcaggtgctcagcatggttatttgcatggtctccaccccctgcatccacgatcgctgcctctgcaaagcccggcgcaccacagacagggcgtaaacctccgccacagcagggctcatgccacgcagatcaatctttgacccgcgccggagtgagaagtttggcagcgccccactgccagtgtggagggacggggactggtgaggccgggtctttgatgcgcgtgattgcagcgcattcccccgggctgaagacgtggcagccctccgatgcgcctttcggggtccggcgaccgacaccctgcatgcctcaaacatcatcagatgacggcgtcacccctccttcctcgacgcaggccccctgtcccacctggcgatgcactcctccaggatggcaagggcgttgcgatggtacacggcctcgatccccaccttccagtccaggggggaggccggcatgcctggccggccatatctcatggaccccaggccctgcaagaggagaaggcaggagtgtgtcgatgatacgttcaactgctggacattgaggcacggcctccacagaagcagacctgcggcctccaccctcccacccaacagcaaacacacccgcgggcccactgtcgcacctggaagggctgccaggccagctcatgtccctcacgctccgggcgggagcgggggacccagggcacgcggaggcagcgcagcgccagctccaggagcnnnnnnnnnncctcatgtccctcacgctcagggcggaggcgggggacccagggcacacggaggcagcgcagcgccagctccaggagccggggctggctgccggggcccccggcctggcgcttcgtggtgtgcttgaatatctcgctggcctgcaggtgccagtccacctcccccatcccgctcagccgggcaggcctgcactcctccggccacagcgcctgtgcaaggggtcgaggcctcccgggtcagacaaaacttctcgttcagaggcccagccacagcaatccagccacgatctgctcaacatgccttcccagggtcaccctgctcacttggagcagacggcggccctgctgcgtacggtatgcctcgggcgcctcgcccgccggcgcgccagacccggcctgcctcgaggcaggccgctgccctgcgtagcacatgcgcaggagcagcgtggcgtgcgcttcctccacgtccacatccatgagcttcatggccctgtgagtggtgggtnnnnnnnnnnnnnnnnnnnnnnnnnnnnnnnnnnnnncgtgcctgtctgcactctcaactttgtgacagcaggttggtggaaggctggtcaacgatcacaacgtaacctggcgggtgagccaccacgcagggcctgtggtccccaccaaggtcccagcacacccctgccccagtcggcatcagacgagcgtattttccccctctccttcccttccccccttcccctgactcgcctgtgcacttgcaggcccagggcggactcgccgcaggagtggcaggcggccagcnnnnnnnnnngacctggcgggtgagccaccacgcagggctgtggtccacatcaaggttccagcacacccctgccccagtcggcatcagacgagcgcatccccccctcctccttcccttccccccttcccccgactcgcctatgcacttgcaggcccagggcagactcgccgcaggagtggcaggcggccagcnnnnnnnnnngccggctccgcgccggacggaagcgctcccttcttcgcccccccgagcctggacggcgccgccgcgatcccccgcgcggccatctccacctgcnnnnnnnnnnacggcgccaaacacgtcctggtcagggcggacccccttcccgacggcttcctctaccagcatcaccacgtcgcccagactcccggccgccgccgcagcctgcagcgcgcccaccagggagctgccgcgcagctgcagctcgaggcccccacgcgtggcgtggacgtgcatccccggctccgcgccggccagaagcgctcccttcttggcccccccgagcctggagggcgccacggcgatcccccgcgcggccatctccacctgcaggctcgcggccacccccggccgccccgcccgctccgccagctggatgagcacagagtacgctgtcgcgtcgggcgtcacgttgttcctacacagcatgtggttagggggtgggaagaaggcgtgatccccggaacaggcatgcgtcatcgtgcgcgcgcagctcattcaggacaaggattctgcgacctcacacccggttcgcgaggacctctaccatgtgtgatcacggctgccccattcaggcacccaggcagcacaccatctcggactccaaccccccccccaccctttccccccaaaacacacctgcgcatgtcgtcatagatgcgcagcccggcctcggcgtcggcatccgccccaccccgtgcactggccacgatggcggcggtgtagagcgggcaggcctggctgcccgcgccgacgccggccnnnnnnnnnnnnnnnnnnnnnnnnnnnnnnnnnnnnnnnnnnnnnnnnnnnnnnnnnnnntgtaggccgcccgcacgtctgtggggctccccccgcgcgccgcggcgtccaccagcgcggtgtgcgtccaggtgtcaggccggcacccggcccgcgccatctcccgcgccaggctctgcgcgcgctggagctcgcccgcgcgccccgcggtggtgatcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtcaggcgcgcggcacgcatgtcggccagcaccgacagcgcgcgctccagcgccaccagcgcgccgcggcggtcgccggcgccggcgaccgcggcgcgcgacgcgcacacggccaccagcgtggtgcagagnnnnnnnnnnnnnnnnnnnnnnnnnnnnnnnnnnnnnnnnnnnnnnnnnnnnnnnnnnnnnnnnnnnnnnnnnnnnnngcggtagacgccaaaggccgcgtccacgtcgcccgtgaccgcgcaggcgcggagcacctgcgtcagcatcgcagcgtccacgccgtcgcgccgggtgcgggccatgtctagcacccgctgcgcggcgcgcaggtcccccgccgccgcgcagacgcccaggaccatgttgtaggtgcgcttgtcccccgcgctgcgcggcagcagctgcaggaagcgcagggcggcgggcacggcgcggttctccgccgcgcgccgcaggaacaccgtctggcgcagcctgtttttcggcgtgggtggtcgggtgagtggggcgcaccgagcaggagatcctcgaggagcggagatggatcgctggggtgtggaggagtgacaggggcactcaaactcggcagagctgcgggaatggtggggctgcatccagccgggccctgccacgttccccaccagcaccaggatccctataccaaccaaccctccacctaacccccctctcacctctccagcacgtccaggcggcccgnnnnnnnnnnggttccccacaagcaccaggatccctatatcaaccgagcctccacctaacccccccctcacctctccagcacgtccaggcggcccgcggcgcggcaggcctccagcagtgccagcgtggcgtccagctgccccgaggcacacaacgcattgtagcggtggaagatggcctggcgcggcagcgtgtccaggctgtccccgccggtgagcggccaggtcacgcggtgctcgtggcccgggctcagggcatcccgctccctcaccgccgcgccgtggtggctgggcagcgtgtggctcagcgccaggggggtggcggcggccgtctgcgacggcagcagctcaaagtcgaaggagcgggtggcggcggcggcgtgcgcgccggcgggctccttggtgcgcttggaggcggcctcgcggccgcgtttggaggcggtctcgtggccgcgcacggacgtcttggccttgccgttgcgccgggcgtccgccttgaagcggtcgatgcccgcctggaagagcaggtggggctcggcgggtacgtccacgtggtagccccgctcgcagggggggccgaagctgtaggtgatgctgccgtcgctgtggcgcgtcaggctgatcaggcccatgccatgcaggctcagctgggggagctcgtggcccctgccatgcacgtgtggggagagggggagcgggtttaacacctttggggaagctatccaccaagggacagacaagcccacaaggcagacactctcagaggcgcccagaggcgtgcacaatggctggaatggggcattacaggcatgctgggcgggccctgcatgcccggcagtgttccgagcaggggtacctcgcgatgcaccgggcggtgacaagggaggtcttgcccagctccacgggggcggggccaaaccgatgcttgagggccatggtcccggtaccgggcatcctcgtcagtggaagaccaggatcagtggcttggggcagagcatgcggcctgggagctggcagggggcgcggcatgtggcgtcatcgctggcagttgcaggtgggataaaccgagcagatcacagggccgccgggcgcccgcatgacggtctgggcacctccgacatcgagcacatatttcttatagaaactatcgaggttgcagagcggcccatgtgccctgcctgtggctcttcagacaccggtgagggttgcggcatggggatcgcgtacagaagaaagtcgggcacgttttcggggcctcgagggtagccgagtcctcatcccctcaccactaaagccagtccaggaaagagtatctaacacagggggctgcgttttcgacattcttatcaacaccacaatatgatgttgcaaccattgatatctatgaacgctctgacattttcatttgagcatgtagggatccagctgcacaggactgcgatgatgcctgtacacatggaaaggctccaccagcagacacatacgccaatctggaacgtgtagtccagttctgggctggaagaaagcaatgtgacttgcggctcttgccatgtcttcatggatctgttcattctgctcaaagggtattgcagaactactacggctgctgtgcaccttcccagtatcgtgacttaaaactcgcacatcaccccgtcccctatgctgaccaccaccgattgtgtgtcggtcgtcgcttcagtatgtcggagccagaatctttttcactggtcggcctcaaggtggtggatggtgtggccatcatctcgctgcagaaccctcccgtgaacgcactgcacccggatggtgcgccaggcattgccattctacattgttatgagggaactagagtgatcctttgactcacatctcatcctcccaccgtccctggattcgacagtgctgaacggactcttcaagactctggaacggtgcaatgcagatcccgacgttgccgcgtttgtcatcaccggctcctcaggttggtggggcgcttggaggcctgccgggcggctcccccccgcgcctggtaatgcttccccttgcctgctgccctccgtgcacatgaccatggcgctgcattctcacccctctgcgagccaaccgttgcacgcatgacatgcggtcccccaccgtcccctctggcatgcccctgccccttcccccctctccactctcagacatcttcagcgcgggcatggacatcaacctcctgcgccagcccgggctggatgtggccagcgggcgccccgccgccgtcgccaacctacgcctgcagctggaggaggccgccaagcccagcgtggcggcggtgaccggaagctgcctgggcggcggcctggagctggcgctggcctgcaccgcgcgcgtggccgcccannnnnnnnnngccccgggctggggggcacgcaacgcctgccccgcttggtcggcctgcagccggcgctgcgcctcatcctgtccggggcggccattggggcggcggaggccgcgaccctgggcctggtggacgaggtggcggcggccggggagggcccggtggcctctgcctcacgcctggcgcgagagctggctgccgcgccggaccacccgctgnnnnnnnnnntggccgggggggccttggtggcctctgcctcacgcctggcgcgggagctggctgccgcgccggaccacccgctgcgtggccgggggtcgctgctggagcgggacgaccgcctgccgccccccgccgaggcggaggagctgtttgccgcggcgcgggacaagaccgcgcggcagtgggtcaacctgcgctccacgctgctctgcctcgacgccgtgcagtacggcgtcgcccacggtggccgcgcgggggaggacaaggtttgagtgtttttgtagtgtggagggggggtgggggccttgggtgtcgtcgagggatgagagggggtgctggtgccagcaagcttcctggggcatgcccagcccaccggcgtgccactgctttcctgcccacatgcacctgcacacatccttcttgaccctggtgcttgcaatgtgtgtatgtgccccttccctcattccgcacgcaggagggcgagtgcttcggcagcgccctggccctggactcccaccgcgccctgctccgtgctttcttcgcgcaccgcgctgcgctcaaggcccgcggcccgcgccgggtccggctctgggtgcagtccctctgggcgcggctcgccgccctgctggccctgctgctggagtggtggcggctgggggcaaggaacacgggcctccgcgtcaaggagctgtgagcgggccacgggggatccgggcgtgcaccgcctggcgcaagttgttcagatgaccccagccacgcaatcaggccggcctggcccggcatagtgctgctccctgctagcctagcaatctcgccgccgctcctctccctgctcgtgcctcgactgggcatcccctctgctgccttctgcctcccatgcaggaatccacagtgacaggtccccttcctttctgctccatcatcccacccccccatttccccctcacatcacacggtattcagaatgttcacatgccagtcaggtttcggcgccctgcagcaccggcagcacgcaccgcccccactcctcgtcccagcccctcgcccgttcggcctccgccccccgtcgcagctccaccagctgccccgcccgctccggccagcccgccagcaggctcagcagctgggcggccagggcctccgccgtcgcaaaaaggacgccgttgaccccgggctgcaccagctccgtgatggtggggtactgcagcgcgcacacgggaacgccgctcccaaacatgtcgaccacctggcgcgggatggggcgcgcgagggttggggttgtggcggggtgggacaccatttgcagggccgaggctggcagggggcagttcttgctgaagacggagggttgctttgctggagaccacatcgcctcccccaaaccatgggccaaaggccggcgggggcgcatgcatcgcaacatcaccgacgcaccacgactccaccccctcctctcccacctccgccatccggcccttcctccgcagcaaaatccaccgccaccgccccgccccaccttcatgggcaggtccnnnnnnnnnntgagggttggggttatggcggggggacaccaattgcagggccgaggctggcagggagccgttcttgctgaagacggaggactgctttgctggagaccacatcacctcctcaaaccatgtgccaaagaccggcaggaacgtacacatcgcaacatcaccgatgcaccacgactccaccccctcctctcccacctccgccatctgcccattcctccacagcaaaatccaccgcccccgccccgccccaccttcatgggcaggtccaggcccgagctggaggcatgcaggcagatgcccaggtctgccgaccccagcatcaggcggtagtcgggggtggagagccagagcaggcggaaggcgacgtgggagaacgcggtggcgtgcagccgcgcctcgtacgccgcccgccccgcgccgcgccccgtcacgacaaacacgatgcggggtagggactcccccttccgcaggtctcgggcctgagagagggaagagtgcagagaaagagggggggggagggggtgctcggacaagggcgaagcgtgtcaggcaacagactgtggggaccatgtttgatgagctggtcatgggcatgcctgcgcgcgcagcatgcaagaatgctggagtagtcatgcgaacctcgcatctgtcgctgggccccttggtcggtgtctcatgcgcattgggctcttggtcggtgtctcatgcgcatgggcctcttcacattctccctgccgcgatccagcccctctcgtagcccgtggattacggttcaggccccgtccctgcattctgttcagccaccctccctccctcctagctagaccccactgccgcaaggagccctcctcaccccttctcccccaaacaaaccaaaaggaaactccctgcaccctcacccttgcgtcgtacagatcggcggcgcgtaggagcagcccaaagtcctcgtccgcggtccagctggtgctgctgagcacgagggcggggcgaccgccgcggcgcgccggcgcctggcccggggccgtgcgcacggtcagcggcgtggcgctgctggccgtgcccgccagctccgccgccagccagtcccccgggtgcagggggcgcgccaggtcggggcgcaggcgctgcagcagggcgtgcgtctcctcgatcttcgcgggccggagggccggggtcgggcggtcgtagaagacggcggccgacacgcgccacgcgcggctcaggtccaccgccatggcccggctcacgcacaggtgggcgtgcgcggtgggcgcccagcggcgctcataccgccgcgccaggcgcacctgtgcgggcggcaaggggagcggatggagggcgagggccatgggcaggtggcggaggggggagggtgaggagggccttggaccctgccatgcttagggtaggcgcagattcggttccaccccccaggctgcagcacaaggagcttggcagcatgcggcgcacatcctgtgcgctgccattggtgcctcggaggcgnnnnnnnnnnatgcttagggtaggcgcagatttggttccaccccccaggctgcagcacaagctgcttagcagcatgcggcgcacatactgtgcgctgccattggtgcctcggaggcgcacgtcgcctttcctccaccctccctgcgactgcgagttcgccaccccccaaaacaaacaacagcttgccagggggtggcgaggccccatgctcaggcccatcagcgtgtaagcgtagttgtgccagnnnnnnnnnnatcgcctttcctccaccctccctacgactgcgagttcaccaccccccaaaacaagcaacagcttgccaggaggtggcgaggccccatgctcagacccatcagcgtgtaagcgtagttgtgccagtcgaagacgaggcgggcgccgtggcgcagggccgccgcccgcaggaccgccatggtcggaattgcgggagggagctggagcaggatgacgtcggggcgaggaagggagaataatgtcagccaggccagggtgaggagctggtgcagagccttgaggacgaggcggagggcccgcgggcagcgcgccagcgcggcaggcctggtgaaaaggggggagctggggtggcctggaggcgtgcgggtcaccacgcttcatcaaggggaacggggagccaggacattcgtcatggggatcagcaccccctggcaccatnnnnnnnnnntacgcttcatcaatgggaatggggagccaggacattggtcatggggatcagcaccccctggcaccatcaacacactgccaccacccagcgcacggctctgggagataggtgacgcgcaggcggccgtgcttgacgtgggcctggagatcgtttaggattggggaccccctctgtccgatcagatctatcgtgtacccgggctggtagggggggagcggcgggggnnnnnnnnnntgcgcagatgttgatttccatggcacgctcagagcattggtgccaggacggtgcactcaggcgcgctcgattaccgtattgcacagggatagggtgtgatactgcatgcgagggctgcgccccacatcccccagaacgaccacccacgcccggggcatggcaactcgtccagaccgctgtccagggcctggggcgttcaatcgaagcagaatctatattcgagcatttctcgaggccacatttttacggcctgatcgcatccattgtaattacgcgcactgagagcaaagtgatcttaaatattcgggattcgccacggagcatcaaggtcctgttaacaaggggtccatcccggtccggatgacttccaccctcgtccaaagccactaccatgccacatcagggatggcagcccatagcccagggcccgtgatgacagctgcccctcccgctgttgaggcccagcctttgcaggccagacgggcactgtcagagctccaggtgcgagatcagagctcgtaccaggtatcgtatgatctcaaatgatccatactgtcccaaaccagtccctggtannnnnnnnnnactgtgcaggccagacgggcactgtcagatctccaggtgcgagatcagagctcgcaccaggtatcgtataatctcaaactatccatactgtcccaaaccagtccctggtaatgtccgacgcaggccgagattacagcggtgaaggaggccctggcggatgtcgaccacctgaggcaggcctgcatagctgcgctgggcctgggggtacgaatggtgagcgctgctttggatatggagcaagcattttctgccctccaagcggcatgtgaccaggaccggctctctccctgcctccccttcatcacaggaagaggcacacccagctccgacattttgccggnnnnnnnnnngttttctgccctccaagcggcatgtggccaggaccggctctcgccctgtctcccctttggcacaggaggaggcacacccagctccgacattttgccgggacccagggagggcaagttcaccagtgcccgaagccctggccagtcctgccagggacgcctcctccccggcttgtagcggccaggaaacgagcggcggcgagtgcagcagcgggcaggacgaggacggggtgcccctggcgattcgaatgcggcgcctcgcgcagcaggccccggcgcccgccccgccccgcaagaggtctaggctggcggggtcacgctccgcctccccgcccccgaccgcgctccaggatgcagcggcgcgctcccagccgtccccgcccgggagccccgcccccagcctcgccagcgacagcgtggaggtgnnnnnnnnnncccgcccccgcccgggagccccacgcccagcctcgccagcgacagcgtggaggtgctgcgctgcagctccccctcccacggcgcacagagcgccggccaccgtgacagcacgggtgcgccgggccgcgagtcgccgcaggtcatcttcctggacgaggatgggtgcgcccagtccgccgcgccggcgtctgcccgcccaggcgacggcgcccaggatgggcgggtggggggcggcgcagcaacggggaacccccggcggccccgggccccgacttcgcagtgtcaggcccagcatgcggggctccggccgaatctgggcaaggggggcctggccggcctcggcatccacagaggtgggggtgcagggagagcggtttgggcagggcttgatggggttgcatggcatgtccgctgccccctgcctgctcctnnnnnnnnnntcacagaggtgggggtgcagggcgagcggttggtgcatcgcttgatggggttgcctggcatgtccgctgccccctgcctgctcctggccaaatgccggcgacgcacaagagcccgcgccctcgccctgatccctccgtgcccaagcacccatcccacaaagcacgcccgccccgcagcgcggtcgagggcgggcccttcccagcccgccgcgccgcctgggcagcagcaagccgccgtccaggaggccgcgtggagggcggcggccgccgcctggcgccagcgcaacgcgccctcggccagcgagctgaccgc

SEQ ID NO: 44670 - DNA, 64 bp, Chlorella protothecoides
tgaccacgctgatcatgcccggagcggcgggccgccccccccccccccccccccgccccccccc

SEQ ID NO: 44671 - DNA, 66 bp, Chlorella protothecoides
ggcgcggcggggcaggaggtcctggagcccaccggtatcggagacggcgctgaagatgtggctggg

SEQ ID NO: 44672 - DNA, 61 bp, Chlorella protothecoides
cggcagatatggcttaaacattatggctcccctttgtgcaatgccataatcaatgtaccag

SEQ ID NO: 44673 - DNA, 61 bp, Chlorella protothecoides
atgagcgtctgcgatcaagctgggggggggggcagcctctcgccacacggccaaggccatc

SEQ ID NO: 44674 - DNA, 61 bp, Chlorella protothecoides
ctgaggagtctcccagtcccagcccacaaccggcgcccagccctagcccggaggagtcacc

SEQ ID NO: 44675 - DNA, 61 bp, Chlorella protothecoides
cgcgacggcgccagcttggggcttggcgggggccgcgatcccggcgccctcctgggccggg

SEQ ID NO: 44676 - DNA, 61 bp, Chlorella protothecoides
tactcaaggtgctcgagggggagggggggggatgaaggcaactggaaagtggtggctgcag

SEQ ID NO: 44677 - DNA, 61 bp, Chlorella protothecoides
ccctcggctcggtgtggtcccggctggggggcctggcaccggccagggccccctgggcatc

SEQ ID NO: 44678 - DNA, 61 bp, Chlorella protothecoides
acacggcagcaggcagcggcagcgcggcgggaggtggcagcagctgatggtagccgcctcc

SEQ ID NO: 44679 - DNA, 70 bp, Chlorella protothecoides
cgggcggcaggacgaggaggtgcacggcgccggggccggcggcgacgatgcggccggcgagcgccggttc

SEQ ID NO: 44680 - DNA, 61 bp, Chlorella protothecoides
tccagggtctgggcagcagggacgtgccgccccttccccccagcctctacgtgtccttggc

SEQ ID NO: 44681 - DNA, 118 bp, Chlorella protothecoides
cggggcccgccttcctcgcagctccacagattccccacgagggccctaaacactgcatacccctcccctcccccgcccttccaggcacccccccgccatcaccccacctggtaggcga

SEQ ID NO: 44682 - DNA, 103 bp, Chlorella protothecoides
gcacagctacacatgtattcgccagccccagattctacctacatgctcaggtcggtgaccctgcaatgtcagctgcgcagccgcagcagcagcagccgccgcc

SEQ ID NO: 44683 - DNA, 61 bp, Chlorella protothecoides
ctccgtctcaccgtcccgatgtgccggcggggatgaagtatgccagactgaccaggatgag

SEQ ID NO: 44684 - DNA, 1086 bp, Chlorella protothecoides
  modified_base (144)..(255): a, c, t, g, unknown or other
  modified_base (549)..(558): a, c, t, g, unknown or other
  modified_base (822)..(831): a, c, t, g, unknown or other
cggccgcctgcatggcgctgctggaggcctggtgccggcgtgggcgcgccgagggcggcgccgacctgcgccgcgtgcgcaatgcggcggggctgaccccgctggtcgccgcactcatggccgggcactttggcctggcccggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctggcggagtcatgggccccgcagcgcgcgcgcgcctggccgagctcctgcaccgcgtccagctgctcatgagcctgcgtgcgctggccgaggagtgcgtgagcgagcgccgcggcggcggctgggccctgcacgccggccaggaggacccggacgacggtggggagggaggggccgggagtgagggggcccgacaagggctgggagcgatgggcaggacggctaggggggtgtgcatcgggcacaacggcctgggcggcatgtggcatgcaggggtgggcgggggcgggcgnnnnnnnnnncgaggggtgtgcaatgggcaaaacggcctgggcggcacgtggcatgcaggggtgggcgggggcgggcgcgcagccgcccgcgagcctgtggaggccaggggcatgccaacagggcatgcccatgcactagctgcaaccaggcttgcaagtggtgcgccgaccctcctgggagcccagtctgcccatggcactggagattccctccttccatggggcccctctttaacccctcacccccccccccccccaaaaaaaaaacctttnnnnnnnnnnagcccagtctgcccatggcactggagactccctcctcccgtgggccccctctttgacccctcaaaccccccaccaaataacagtatacgcccagctgctgcgtgtgacctggctgtcctgcgccacgactgcggacgtggcgcggtgccacaagctgctggccgcgccgcgcggcacgctgcgcgatgcgctctccagcttcaccgcgctgctcagcgggcgcgacgtggcggccgcgggcacggcgccgccggc

SEQ ID NO: 44685 - DNA, 61 bp, Chlorella protothecoides
cccagcgccacagccagactcacggcaggggggaaggccgggcgttttgtatcgggggcag

SEQ ID NO: 44686 - DNA, 1711 bp, Chlorella protothecoides
  modified_base (175)..(277): a, c, t, g, unknown or other
  modified_base (537)..(546): a, c, t, g, unknown or other
  modified_base (856)..(924): a, c, t, g, unknown or other
gggcccccccccccccccccccccttccccgccgcgaccccctttcctcctcagcaggcggcccctcacaggcgcgcccgccgcagctcctccttggccacggtctccaggtgcaccacgtccggcccgtcagccaagcgcagcgtgcgtgcgttggcccagaggtgggccaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagctgcacggcgcggtcgatgacgcgcagcgcggcggcgggcgccagcaccttggccgccgcgatcttggcccgcgcctcgacgttgccgtcgcggtccagcgcgcgcgcggcctccagcaccaccaggcgtgcggcgtccagctcgaggcgggagcgggccaggtccaggcgcaccgcctggtgttcgcgcaggcggcggccaaaggcggtgcgggagcctgcgcgcacgcgcgcgcactccagcgcgcgctcgccgtnnnnnnnnnntgcggccaaaggcggtgcgggagcccgcgcgcgcgcgcgcgcactccagcgcgcgctcgccgttgccgatcaggcgcatgcagtggtgcaggcggccggggcccagccgcccctgcgcgatctcgaagccgcggccctcgcccagcagcatgctctcgccggcggggacgaccacgttctcgaaccgcatctccgcgtgcccgtgcggcgcatcatcgaagccgtacaccggcagcgcgcgcaccacggtcaccccgggcgcgtcggccggcaccagcaccatgctctgctggcggtggggcgccgcgcnnnnnnnnnnnnnnnnnnnnnnnnnnnnnnnnnnnnnnnnnnnnnnnnnnnnnnnnnnnnnnnnnnnnncggcagcgcgggtcgggggcgcccgaggtccaccacttggcgccgttgagcacgaggtcggtgccgcgccgctcgatgcgcgcctggatgttggtggcgtccgaggaggccacgtccggctccgtcatggcaaaggccgaccggatctcgccgcgcagcaggggcagcagccagcgctcctgctgctcccgcgtcccgtaccgcgccagcacctggcagggtgtggggtgtggggtcgtggtgggggtgggggagtgagcaaagggagacttctcgcgaggggacactgggaaccgcgcctccccatcggcgggcggcccccctcctctccagccaacgccagccatgccgcagcccaccttacatcatctcccccccacacacacaccgcgactcctgcccacctccatgtttccggtgtcgggggcagagcagttgaacacctccgggcccgccagggagcgggccatggcctcggcgcagtgtgcgtactccaggttgctcagccccgggccgagcagcagcgcggcctcggcgccgctcacccccgcgccgcgcatcagcggcgccagcttaacgcgcatgtcggccgggatccagaggttccacaggccctggcgccgcgcctcggccttcagcccctccaggcacgggtgcggcgtccagcgctggtcgctgtgggcacgtgcatcgatggcgccctccatgggcaccacgcgctggtcgatgaagcgcgcaatggcgtccagcagcggctggacgcgggccgagggctgcagccctgcgg

SEQ ID NO: 44687 - DNA, 61 bp, Chlorella protothecoides
tgtgggcctgtagggggagtcggagggagggatttccttcgtctggacgctatctaaagat

SEQ ID NO: 44688 - DNA, 61 bp, Chlorella protothecoides
cccaatggtggcagagggggcggtggcggggggggaccccccgcagacctacagtagtact

SEQ ID NO: 44689 - DNA, 61 bp, Chlorella protothecoides
ggccctgaccggcaggtagattgtgcgtgggggtttcgaatgtgtggattgcggagggcag

SEQ ID NO: 44690 - DNA, 61 bp, Chlorella protothecoides
aggaaagcagcgtgattcctactgtggcggggggccccgacaccgacgatggtgcgggcat

SEQ ID NO: 44691 - DNA, 157 bp, Chlorella protothecoides
ggtgtgaagggcctggcagacgcaatacctggggagggggatgcctgcagccagccccctgcatgctgccgcacgccgtcgtgagtcccccgaggcaccgccgacccctcccccgtcgcctcccttcccacccccccaggccatcgtgctggcgtac

SEQ ID NO: 44692 - DNA, 61 bp, Chlorella protothecoides
agcggggtgatctcgctgccctgtggcagggggttgggctggttgacgccctccaagcgag

SEQ ID NO: 44693 - DNA, 61 bp, Chlorella protothecoides
gtgtgagagccaggaggtggctgctgaggggtccccccgactacctgtacgatgttcgttc

SEQ ID NO: 44694 - DNA, 7025 bp, Chlorella protothecoides
  modified_base (624)..(633): a, c, t, g, unknown or other
  modified_base (880)..(889): a, c, t, g, unknown or other
  modified_base (1069)..(1078): a, c, t, g, unknown or other
  modified_base (2045)..(2054): a, c, t, g, unknown or other
  modified_base (2114)..(2123): a, c, t, g, unknown or other
  modified_base (2231)..(2240): a, c, t, g, unknown or other
  modified_base (2605)..(2614): a, c, t, g, unknown or other
  modified_base (3629)..(3638): a, c, t, g, unknown or other
  modified_base (4488)..(4497): a, c, t, g, unknown or other
  modified_base (5493)..(5502): a, c, t, g, unknown or other
  modified_base (6222)..(6231): a, c, t, g, unknown or other
ccggcggccggggcgggggcgccggcccggaggaccccggctgcgacgcgctgccaggccccgccggccgcggctgcacggccaccgcctgcccctggtaccgagcctggtgctgctggtactgggcctcaggccgcatcggtgccgcctgcggcgcggcatcgacggccggcaccctcggcctctgcacggggttgggtggggggagcgggagtggcgccgcactcggccccggcgcagccagatgggcaggggctcgccttccaacgggtgctgcacgggcttgggcggggggcagggcggggttcagtgccatcccgccggcgggcaccgccgcccggtactgccgcttgcgctgaggggtcaccgaccgcttcccgcgggcgtgcttgggagggaggagcagggggctcccgggctgctcatccagcggatccttggagggggctgcacggtgggcggggagattgacgggcttgttcggcggcatcgagggtttcagtcatgcaggtggcacgctgcgtcgaaatccgacactccgcgggccaaagcatgcgatgcacaatcatgaatgcggccagagcatccactgcccctacacattgtcatctgccccaccccagnnnnnnnnnntgatcatgaatgcggccagagcttccactgccctacacattgtcatctgccccaccccagaccagcaagccgcagcacacacagcgcgccctcacctggggggctggcccgcacggcagcaaagggagtgggctcgaagctctgactcctggaccgcttacccccgcggggggccagtgccggcctgctcagaaccccgccgctggctcggcaggcggccgcgtgagcgtcggcagccgctcgcatnnnnnnnnnngtggtgcaggcctgctcagaaccccgcggctggctcggcaggtggccgcgtgagcgtcggcagccgctcgcatcagcaccttgttgcacctggagcaggccaccaggtccaggttccctgcaccccggcacctctgcgcgccacgctggaggtcagctgagtgcaggggcggggggctgnnnnnnnnnnctgcaccttgagcaggctaccaggtccaggttcccagcaccccggcacctctgcgcgccacgctgtaggtcagctgagtgcaggggcggggggctgggcatggcccggcgggcattagcggcacacggcaggggtccgcgcgaggggttctgagtacgggcgaggacctttgcgctggcctgacatgccttcctgtctcgtgagggtgggtggaggagtcaagacgacggtcgatgctggcgtttcggcacacaggcacagcatagctcagcatagcacagggggggtgttccaccacctcccatgagacgcagcaggagttcctgcatgatacaatgaagagcttcacaaaccatcagtctcaccctgctggagcagccagagactccaagggaaacactgacgccaaccagtcgacaaagaggtctgggaattctgattggagtgctgcaggcagggtcgtcacactctccgctagctctgcggggaagggacacatttgcatggcatgtgagatccgagtttcttgttttggaggcgcttcaagaaaaaaatacagcaaggtcagggtatggccgggggcgccctgagcaaaggcctcaccaatgcggagcgcattgatgtcctgcatgttcggcatcccctcagaatctcgaacggatccaatgggtccattcgcggcagagtgtgtatatcggctgaggagggcccctccgcagcatcggagctccggggatacactcggcgcggtgcagagccagcacaaaagcaccgaaaggcctcgctcactgagccactgatgtcggcgcacggtcaggtctcggattcggcgtcgttacgtatcgctggcatgacaatctgtgtgacgaagaccgtggtgatgtaacatctcggctctcgtgcaatcactgtgaggttggggaggacttgtcgcgcgcgaatttaacctcactccggacagcttcgnnnnnnnnnnatcggcgcggtgcagagccagcataaaggaccgaaaggcctcgctcactgagccactgannnnnnnnnnttggcccgatgggctcccggtgtcgcatgcatcatgtgtacattccacaattatctccatggctgacctggataaaaccgccgttgttatcgaccagggggcctcggnnnnnnnnnnatggcccgatgggcacccggtgtcgcatgcatcatgtgtacattctacaattatcttcatggctgacctggataaatccgccgttgttatcgaccagggggcctcgggcatccgtgcgggtaggtcgcaggtggcttcgacctgaaactcctccgtgccctgctccttcccatgtctcatgctatacatctccttgccactaggcctggcgggagaagacttccctctcgtggagttgagatccaggagtgacaatgagcttggcaagggacccgttgatccaggggtgaggtgcctggctttcaatgcacaaaatcagacggctttgctttgaatgattcagtcgtgttccacaccgtgaaccnnnnnnnnnntttccaatggacaaatcagacggctttgctttggatgattcagtcgtgttccacaccgtgaaccgcccccatctcccaaccagggaggctgtgagtcttggcacagcgttttccaagccctgggagtgggtgcagagggcaggaggttgctcatctgtgagccctttggcaccagcgctcatcagcggaaggagcgcttggagttggcctttgaagagcaccgcgtctctgcagtcttcatgcaggtgatacgagcaagattctgctttcctgcaaataccatccatccattggagtagacgtcctgggaccaagattctgcgcggcactggttcgtactcatggttctggcccttcccaccttcagctccagcctgtgctcacgctctacgcgctgggcctgctgactggactggttctggactgcggcgagatggggtgccgggcggtgagtgggttacccacatgagctgtactgcttggtgggtcgccctaggcatccagactgaggattcatcacctacctcagagatcacacaatgcctcagttgtaagtatagctcctcttctgatacatcatttacaggcccctgtgatagacgggtatgtcctgccgcatgccttcaagagccaggcggtggggggccgccacgtggcagcccgcctgctggacctgctgcgaaggcgggggtatgcactgagccgagacacttccctggcagccgtcacagcagccaaggagaagctgtgctacctcgctgtcgacagggaggccgaggcaaaggtggggataaagataactgcttcttgattgtccacacatgctacataccgagtccacaaagggtgccctgccctgagcatccttgggcacatcattcaggttcccacaaccctgcctgccgttggggcatgccctacatgcaccggactgccactgcatgctctgctactgtactactcagccgcttgaccctcttccctaccccctccccccagctggcccgggagactnnnnnnnnnngatgcaccggactgccactgcttgctctgctactgtactactcagccgctcgaccctcttccccaccccctccccccagctggcccgggagactacggtgggcgtgaccacctacacgctgccagacgggcaccggctgcggctgggtgctgagcgcttcatggccccggaggtcctgtttgatccgcaggtcatgggcctggaggcgcctggactggcccagctggctcacgatgccatacaggtggacgcaggaagctgcagggtagctgcacgtgctttgctttcccaatcatgtcccatctttgccgcatcatcgtcaccggaatctaagcttccacctgcacatcaacacgtcccggcacccacaacattttcactcgccaggctgctgacatcgattgtcggagggctctgtaccagcgaatggtgctcgctggcggcggctcgctcttccccggctgctcggccaggctggccaaggatgtcaggacgttgcatgccagcctggcgggcgtgacatccgcagaagccgggtcgaaaaagatgaagatcaacgtcgatgccgtgccacgacggaaacacctggtgtgcaatcgttgttcgtcacagggctccaatgcagaatggtgtatttgacaaagcagctgcttgattgcccaaacccatcagtgtcaccgtttctctcccacactcccttgaaggtcttcatgggcgctgctgccctggcagacatcatgcaagaccagggcgacgcatgggtgtcggcacaggagtgggcagaggatcccacaagggcagctgctcgctgcggctctgattgactcacagaacatgggaccctgacagnnnnnnnnnnatttctctcccacactcccttgcaggtcttcatgggcgctgctgccctggcagacatcatgcaggaccagggggacgcatgggtgtcggcacgggagtgggcagaggatcccacaagagcagctgctcgctgcggctctaattgactcacagaacatgggaccctgacaggcactttcagctcgctatgcaagcatgctggacgcttcacagtactttaacctatgggaagtcggcacaagaaacacttgatgggtgcatgggacttaaagaggagcttcttcctgatattgtgttgtccatgacaactcccgccatcatctgactcagcacaactcgacctcgtccgacacaccacttgcgatcgtcacttcccccacgagccaccaaccgccagaatcccttcgatcatacacatgcagggctcgatgctcactctgaacccccctcggcactgcccggccttctcggctggggctcggaaggggccccgacccaccgtgcgcagcgccaggctggctgtgcgcgtcagggccacccaggctgccgatgcctacatctccccatcttcgaggacggctgcaaccgagctgcaggctctggagcgcttcagcgaggtgagggggcagtttctacatacggtttgcacctcccggcaagcgctgtaggtgcccttacgtaccccgtgggctccctcccccatcgcgcagatcgtccccgacgtgctactcagccaaacccttcaatctgtcgaggctcccaaggccgccacctcctcccgcggcgtgctggcaggcatcctgagctccccctccagctttgggcgctacaaggtgtgagagagatgtggagttgatcaggcagcagtgatttctttgctctattgggcgactggagggggcagctcaggtatggctccctgccgaagattacgcgtcccaccccatccacctggtgaatcatgctcgcatgcccaccccacgcaagcacagtttgnnnnnnnnnncagggggcagctcaggtatggctccctgcccgagattacgcgtccaaccccatccacctggtgaatcatgcccgcatgcccaccccacgcaagcacagtttgcggtggagcaggcgcggcactacgaccgcgccgcccaggccgcaagccccgcagaggcagcctccctgcgggtggacaaggccctcgtcaacgtcggctccatgttcctggagaacgtctccggtcgcgtgtccaccgaggtcgacccccgcgcccacgacagcgagggtgcggcggcgagcgggcaggggatccttgcgtgtgcctggctgggcgcgctggttgcaggagcggttagtcgtgcatgcccgacacactcggcagcctgctgcacaatggcgacgccatcctttgagcccctccaaacccatgtcctctgcctccgatcaatgacgttcatccctcccctttccgacccacgactgtcccttgcagaggccctggtcgcgcgaggccagagcctcatccggttgtacgaggaggtgggcgtgtcgcgcgaccgtgtcgtcctgcgcatccccgccacctgggccggcatccgcgcggcggccgcgctggaagccgagggcatcgccacccacctggtcctggtctacggcttcacccagggcgccgcggcggcccaggctggcgtgtcggtcatccagcccaacgtgggggccgtggccgactggtacnnnnnnnnnntgccacccacctggtcctggtctacggctttacccagggcgccgcggcggcccaggccggcgtgtcggtcatccaacccaacgtgggggccgtggccgactggtacaagcgccacccgggcgtgatcaagaaccccaaggtgggtttggtgtgagaagtggcgggaaggcgtggcggcgcccagggccgccacacatcagctgcatcagtttctcattcaaagtgtcaagcatcctggccggaccctccaaccccccctgatcctcccctccacgccatgcgccagggtccgcgggaggccgcgctggctgtggctgacgagtacggcgagagcgtcaaccccgggctggtgctggtggagacgctgtaccactacgtcaagcgcttccaccccaagacgcgcatcatggcctccggcctgcgcaccaaggccgaggcgctgcgcctggcgggctgcgactacctggtggtggggccgcgcgtgctggaggccctggcagcagccgccacactggagggctacaacgacggcctgcgcgccgacgaggatgaggcgccgggcgagctggcgcccgcgctcacccccgccgccgcgcaggcccacgacttctccgaccaggagacggccaccctggaccgagccctgttcgaggacaggcttggcctggccgcgcgggagctgctgcgcgagggcgtggcccgcctcatcggcgacgccgagcgcctggaggcctacttcctgaacctcgccggcgggcaggagtgaggggcagggagggagggggcgggtgggg

SEQ ID NO: 44695 - DNA, 1549 bp, Chlorella protothecoides
  modified_base (114)..(295): a, c, t, g, unknown or other
ccgctccagcgccgcctcgggcccgcccccgccgcactcgacgacgcaggcgtcctgcagcgccgcgtccagccaggcctcgggccgcccgcccagcgcgcccacccaggcctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacgcccggcaagggcagaggcagggggcctgcgctggcggcggggggcaccggcgtcgagccggccagccaggagccccccgacccgcccggccccccgctgccgccccagggcgccagctcgccgcgtcccgcgctccccctgctccccgcccaggcccgcggtcggccgtcacgctcgatctcgcgcacgaccaggtcggcaaagttgaccagggtgttgtacagctcggcggggaaacggcgcgggcggtagtcgctgacgcagagcgtgccgtaccggaagccgcgcgaccccaccagcggcgcgcccgcgtagaagcggatgtggggcgaggaggccacgttttcgtgccccacgaaccgcgcgtcgcgcagcgtgtcctccacgatgtgcgccacggggtgtgctggaaccagcacgaactcgcagaagccttcgcagcgggcggcggagccgttgcccgcggcggagaggaaggacatgcgctccgagtcgatcagggtgatcatggacagcggcacctggaagatggtggacatcagcctgcgtgtttggggtgggggggaggaggaaagggtggaggggggaggggtgtgcttgcagggcaggagagatgtatagggccacatcgtacatgatcaaagggctgtcagggctcaaatctgccagcccagggtgtgtgtggtggtggaaacctattgaggaatcccgcagggaataaagcaagcgggcgtggggcggggttgccttggaccccctccccactcagtccgagcccaatgctcccttcccctccaccctggccacctggtgatctggtcgaaacgctcgtcctgcttggtgtaggggatctggagggaccgcagctcagacacccgggcaggctcgtcgtcgtacgcccgggtgttgaagagcgagtccctcggaaccagggcgcccgggaccggggggccggcctcctgtgtcgacgagttctccgaggcatcacctctcgaatcgtcatggtgaatcacagagatggagctcggcttctcgagggaggctttctggcgggcaccaccgtgaagttcccctttctgcgccgtgtggggaatgcagtgggatggtgtgccctgggaatgccagggaaggccccccactcacacacagcgagattttccacacctgctcgtgagtcggattcgccgtcgacaaacacaggcccattggcaccgagcatggggcgccacgaggggcacaatatgcttaagc

SEQ ID NO: 44696 - DNA, 61 bp, Chlorella protothecoides
tccgccattgcggcgggggcacggaggggggcaccccctatgagctcaccgtccctgaacc

SEQ ID NO: 44697 - DNA, 61 bp, Chlorella protothecoides
cacgcaacatatactagctactggcggcgggacacggtcttgtaggtgtgagctttctccc

SEQ ID NO: 44698 - DNA, 80 bp, Chlorella protothecoides
ataaccctcctgcatgcgatgggaggaaatgggtggtctcgagcctgtctcactctctgctggtcatgcacaggttgctg

SEQ ID NO: 44699 - DNA, 15642 bp, Chlorella protothecoides
  modified_base (530)..(539): a, c, t, g, unknown or other
  modified_base (631)..(640): a, c, t, g, unknown or other
  modified_base (839)..(848): a, c, t, g, unknown or other
  modified_base (1169)..(1178): a, c, t, g, unknown or other
  modified_base (1997)..(2006): a, c, t, g, unknown or other
  modified_base (2535)..(2544): a, c, t, g, unknown or other
  modified_base (3629)..(3638): a, c, t, g, unknown or other
  modified_base (4169)..(4178): a, c, t, g, unknown or other
  modified_base (4347)..(4356): a, c, t, g, unknown or other
  modified_base (4575)..(4584): a, c, t, g, unknown or other
  modified_base (4931)..(4940): a, c, t, g, unknown or other
  modified_base (5622)..(5631): a, c, t, g, unknown or other
  modified_base (5913)..(5922): a, c, t, g, unknown or other
  modified_base (8155)..(8231): a, c, t, g, unknown or other
  modified_base (11819)..(11882): a, c, t, g, unknown or other
ggcgccggcgcggccgcctctgccggcgcctccgccgcctccgcgccctacggcgcggcccagccctcgcatgcgcccggccccgccgacccccacgcgcccaaaatccagcgcgccagtgacctgggccgcaccgcctggtccgcggggggctccggcgcggagggcacggcgcagaccatgcgcacggtgaagggcatactgaacaagctgacgcccgagaagttcgagcgcctgctcggccagttcatcccgctgatcagcaattacgaggtgctgcaggccaccatcatccaggtgtttgagtccgcggtgcaccaacccacctttgtggccatgtacgccgacctctgccgcgagctggacgcggtgctgccggagtttaacgagccggacactgggcgccccaccaacttcaagaagatgctggccaacacctgccaggaggagtatgagagcaccgagtcggcacgcgcggtgggtggttgttgttttgtttttgttgggggggggggggggggggggggggnnnnnnnnnngccgcattgggctgcatcgccgtccatgggcacccatggtcagataggttgcttctccagggtcgggtcatggatctcgctgttgagcaccnnnnnnnnnnccgcattgggctgcatcgctgcccatgggcacccatagtcagataggttgcttctccagagtcgggtcatggatctcgctgttgagcaccgcgcgcaccgctcctccacccatcaccgccccgggcagtagcatgcaccctccccctcttcacacagatgaaagaaatccatcgaccctgcaccccactcctccccccnnnnnnnnnnagcagtggcatgcaccctccctctcttcacacagatgaaagaagaccatcgaccctgcaccccactcctcccccccacttccacaggtggccgccaaggcgagcgggcccgagcgcgaggcggaggagcgcctggccaagcagcggctgctgggcaacatccggctgatcgcggagctgttcaagaagggcatggtgaacgaccgcatcatgctgctcatcctgatggacctgttgggcaccggcgaggccggccccgacccacccgcggagtccatcgaggcggtgtgtgagctgctgagcacggcgggggcggcgctgnnnnnnnnnnctgggcaccggcgaggcaggccccgacccacccgcggagtccattgaggcggtgtgcgagctgctgagcacggcgggggcggcgctggaggccggcgccaagagccggccgcggctggacgcggccttcgccacgctgtcaaagctggccaatgcgcggggctacccctcccgcatccgcttcgtcatccgcgacgtgatcgagctgcgcacgcagcactgggtgccgcggcgcgaggcgttcacggccaagaagctggaggacgtgcgcgccgaggcggcggccgagctgggcctggacgtcaacatccctgggctggacgggacgggggcgggcggcgcgctgggcgcactcacctcgctggcgcccaagcgccccgaggagctggagctgttccccgccttccgcagcgacgatgcggggtgggccgccgcggcgcgcggcgcgggaggcgcggcgggcgagggccgcttctccgccttcctgggtgagtacgtcgccgtgcagagcggcggcgccggcgctgaggccaagcccgcagcggcggctgcgggcgcggtcaggtgcgtggttgtggtggcggtggttgtctttgtggtggcggtggagggctgtaaggggttgcgtggattatgggcggtttcaagatgccccacccttgtcatcagtcggcaaaccccccttgcatcaacgccgcagcaaccacattgccaggcagcgcctcgttccgccactcagcctcccccttctccccttcctcgcaatcctccaggacgccgatcgacgttacccccgagcggcgcgaatcgctggccaagnnnnnnnnnntttgtcatcagtcagcaaacccccttgcatcaacgccgcagcaaccacaatgccaggcagcgcctcgttccggcgctcaccctcccccttctccccttcctcgccatcctccaggacgccgatcgacgtcacccccgagcggcgcgaatcgctggccaagtccatcttcaccgacttcctggccgacggcagctttggcgaggcactggctgcggcccaggacctggcggtgcccggcttcatgcgccggctggcggagatcgggctggcccgcgcctacgacgcgcgcacggaggaggagtggcgcgcggtggtggatctcctggtgcggctgggcgcggcggggcaggtgcccggtgccgacctgggcgccgcggtcgccggcctggccccgcgcctggaggacgacgccatggacttcaggtttgcgccggccgtgctgggcaccctcctgggccgcgctgcggcaggcaagcagctgggtctggacgtcctggccgccgcggcgggggcggtggagtcggccgcnnnnnnnnnncgcggcaggcaagcagctgggcctggacgccctggacgccgcggcgggggcggtggagtcggccgcgccgcggcgcgggctggtggccgccgcgctgtgcgcgctgcgcgacgaggtgggcgccgagcgcctggtgcctgccgtggccgaggccgggctggacctggcagcgctgctggcctccgacccggagtttgacgacgagctgctggagccggccgcgttcctggccgcgcaggggctggacgggctgctctgagtgctacgccctgaaggggaggggggtgagggtgcggtgggaagcaaaggtggacgcgtgccggccgtgtgaaaccccacatgtttgcctacccacgatgcatgtgtggccgctgggagtggcgccagacagacatgtctggcgttgaaagtgtcgttaccggccctgtaaacttgaaaggctccccgagtgggacgggacatggagggagttgcaaggaagaggcgagccactcactcagatgcccctgccccggcagcagtcgtgaggcgaaggaaagcgcgaggtgctcccctaccaacaccccttgcgaaccccgattgatccgatcctgaccggtgcaaaggccttgtgtgctgcatgcgatccatgcaccgagccagcctgctcatggaggcggtgcagccgtgcgcaggatgcgggccccgccccgccccggctcgcaagtgctgggagagtaggggctgctttcgacaacggttggcgccaccgcctcgctgcatgggggcctcacatcgccatgacaggacagaattttgcgtaaaggttgggtctttggggcaggaggtccagcgatggagccctggctccatcattgccgttgtaccagccgcatgtgagaatgggttgggtggagcgtggccggtgggcaggattgcctgggtcctgcaaggggttcaattctgagccccgagtatcatgtctgcgcttgtccatatgtctttgacactcttctgaatccttccactctcagtgatgctgagtacgggcgcggcctgggcagacagcgacgcgggagggggacccccggtgccccctccccccnnnnnnnnnncctctgtgacactcttctgaacccatccacactcagtgatgctgagtacgggcgcagcctgggcagacagcgacgttggagggggacccccggtgccccctcccccctttccccctgctgtgacgcagcagcgtccctcgcctgccacccccttagatcaggccactggcctgacacctgagcagccctctgcacctcccttggtggatcccccctctgcatcggggtcaaaggccgagactgcaggcaccagtgcggcggcaccacctgaggctgcgaccccaaccccggcagaggaaaccccaaagcccagcaagaagaggaggcggtcacgcctgggtgagctccaggagatacggcaacagctcgctcagcgggagctcgagctgctctccaaggagagatcgctgtcggcgcgggaccaggacatctccgtcctgcaggaggaggtgagctcgtggaaaacgttcagccagactgcgcctcgctgagttgatatgctgcattgcgcatgctcgcccgtgcaatgcnnnnnnnnnnggcctgactgcgcctcgctgatttgaaatactgcattgcgcatgctcgcccgtgcaatgcgcctcgcgagctgtttttattctctcgggctttgcttgggagtgcactgcacgacgcgatgcttggcatgcatcgaaacagcaccgtgcacgatcagtcacaccttgcnnnnnnnnnngattctctcgggttttgcttgggagcgcaccgcacgacgcgatgcttggcacgcatcgaaccagcaccgtgcacgatcagtcacaccttgccgtcccaacccaacccgatgccgcccagctggagatcgaaaggaagctgcgagccctgctgaccaaggacaaggagaaggcagaggaggaggctgccctggcctttggcctctgcaccggcaccagcnnnnnnnnnnaaaggacaaggagaaggcggaggaggaggctgcactggcctttggcctctgcaccggcaccagcatgctgccatgaactgggctgtttgcctatgaactcctttccacccgctggatcctgacctgggcggggcgtgcatccacagccgtcggcttccttgctcgccaagtcaagtctccctatgttacatgcaatcgggtgcggggcaagggcggggtctgccacgcctctgcgcagaggcgcacgctggtatgcaaggccccagccaaagacaggtgtggcgcgcggggggcaacaaaaggtcgagggcgtacacggccacgtgcaaggggcccgacattcaagnnnnnnnnnntggggtctgccacgcctctgcgcagaggcgaacgctggtatgcaaggccgcagccataaacaggtgtggcgcgtggggggcaacaaaaggtcgagggcgtactcggccacgtgcaaggggcccgacattcaagaggattcagggcagtgcatacaagacagtgatgttattggaagggaggtcgcaaagctctgggtgtgtgctgtcaagtcgcaaaggggggagggacgtcgttcaggggctccgcgcctcgctgggcagccgacaccaccgcctcacgtgcgcacccccctgaccgaccagaagcccggcttccggaccaccacctggtcttcctgcggcgtgaagagccgcacgcggcggatggggggcgcgtagacgtgcagcgagacggcgcccggcgcgggcgtgcccgacgggcaggccaccgtgtgcaacgcgatgcggtcgctgatgtagcccgtgtcccccggccccaggcgctgggaatgcgtggcatgcatggcggggcagggggaggtcacccgctccacaccgggtagggcggaggcggggaaggcgctgcctgccacgggggacgcgctctcgccggcctggtaatgcttctcctccagcgtgccctggcagaaggtgaggaaggatggggagagatgagctgggaggaggacagggagaggcgggnnnnnnnnnncagggtggaggtggggaaggcgctgcctgccacgggggacgtgctctcgccggcctggtaatgcttctcctccagcgtgccctgggagaaggggagggaaggatggggagagatgagcggggaggaggacagggagaggcgggtgcttggatggcaatgacatctttgtcgcgggggccggagactgggagggcattcagtggaggtgagggtttgcgaggctagttgctctgagcaagggaggccagttaacggcgcagcagaccaacaatcagcactcannnnnnnnnnctcagtggggtggagggattgcgaggctagttgctctgtgcaggggaggccagttgacggcgcagcagaccaacaatcagcactcacatccaggcatgtcagccagcagtgggagttgtcatggtcgtggatgtgggagccctggcctggctgccagcacaccaactgcaaggaaggggggcggagggggagggtgtgacacctatgggcatcaatctgcaaagttggcggcattcccaacaagaccaggtttcagtgcaggcgggccatgccatacaggtcgcgggggctgccaaagcgccgacccaaacccctctcccacacaaccccctgttcccgcgccgcaccaggatctcaaagtggggagattcctcgatgaggtggcgtatgtagtggtggctgttgaaggcagcataccggcgccagtcggaggagccctcctgtgtgtacctggttagcagtgcctggacccgcgcgttcagccgagcgaatgaggctgcgggctgggagttgtcgatgatgatgccctggctggcctctgcctcgaaggctgcgtggagctcctcaaacagggcttgcagggttggcaccgggttgcggggcaccacgggaagggcgtgccacgaggccaccttctcaggggccctacaaaggtcctcgggaggcgtacagtgcaggatctcggacggcatgctgcttgctgtgccggaacggggggggccaggttatcggcgggtctcgtctcgaagcaagccctagcgtcggggagtcgcagctgtgtcggtgggaattgaccctcccggtgccgaaggaatcccgacgaactcgccctgacatgctcactcctgtaccttgtgtttcagactgtctgcgcctgatcggtgagcttccgcgattctccgaggacacgcaggtgctccgtgagggtcgagcgcccaacactgtcggttacgaagctggtgttgaaatctgatgtcccgattggtgcacggaggctgaacctcgggataagtatgcggtgatgaaggtaaagtgccggctgccttttgtgcaggatacgaagccgtccaggaatctcctttattcgaacggaatcggaccagcggattgcgtccggtcgggacggtaacgggcacgcggcagcctgaaagggacgatgccaggctctcagctcacgcgtactctctcaggccctacccttgccctagaaatcttcaattagttaccaatctaaggattggcaatctatggaccagcccatgagctcagggcgtagatacacgcagggcgtggggcagaggcacctcgctcccagtgccacgtacccgtctctaaaactgtcggggtggcgggtgtcctccgcggacactcaagccaagaccggaggaggccacggtgcaccgagataactgttgtggcacatgaagcaggacgtgttggggctcgagagcatcagccgagggggtatctgctgtgcatgaccagcaaagggccccagcagagatgctcccccttggagcccctaatctcaaaccgtttcacctcctccgtcccaaattctgcgtggcattcgacagaatcgcccttgcaaatgggcaagtattacaggggcggaggtgaatggtcactgggcgccgaaccaggagcatgccgcaggcagctctaaaacttgagtccagcctccctggcggcgtcggccagggcctgcaccctcccgtggtacaggaacccgccacggtcgaaggccaccttctcgatgttgcgctggatgcacacctcagccagcttcctgccgaccagcgtggccgcactgacgttgccgccgtgcgagagctctgcgcggatgtccggtgtgagggacgagatggatgccagggtgtgcccctcagagtcgtcgatcacctgcaggacatgcgtgcgggtgtggtgacggacgtggcgggctggaagacatgcagtgcccagaggtccccaccgagttggaggctttgaagaccgcatcccaggacagtcaccgagacaggcatgctcaatatcactctcgtatcgcgctcggtcagacctgcgcataaatgtgattcaaggacctgaagaccgccagcctcggcctctcagtcgtgccctctacctgcattagaatagggtgaacaggcatgtggggaggggaccagggcgtgacctggtcatactgtgcaactggactgtgaggtcctgcgtgcagccgggcttgtgnnnnnnnnnnnnnnnnnnnnnnnnnnnnnnnnnnnnnnnnnnnnnnnnnnnnnnnnnnnnnnnnnnnnnnnnnnnnntgcctcgtcttcgcctttgcctcgaccgcaaacctcgcggggagtactgcggggtaaggcgacacaggacaacggtcaggatgatcttttgcggtggagacagatacttgaacaaaacaacgtataaaccttccatcacctgcggagcagaatgtggctgcgggctgcacggaggccaggctcatgtgccgacaggacaccagtccctggaaccctgccaggcggggctgagcctgctgcattgtctcgatgtgtgcggcacgtccgaaaactatcctccgcgcacagtcatgcagcaatctggtggtttgacacgtccttggcgctaccccccatgggatgaggttcgtgggggaagcgtggattcctactttctcctaaccgatgtgttccacaacgagctctatgatctgcacgacacatctctcccttcactgactgggtgtatattcacctcgactccaaaaggcaccatgaccgaggaaaagaaggcttgaaagaatatgtggaatgccaggagcctcacatgacatgtagcacgtccaagcgggggcaacaaaactcccgaacgagcagccatcctttcctcagtagcggaatgcggtggccagcttcctgccccgcatcgcctccttggccgcgttgatgctgatctccgtcaccctcgcaaagttggcggggtcgtaggacgcgcaggagagcaggtgccaggcactctcctgggtggccatatcgtagtcctgctgccgcttcatcacaatgtgccccgcgatctcccagcaggcaggatccacctgggactccaccacatctgtgtggatgtttcgaggaggggggtgtgtttggagctgcttgtaagacagtgaagggggggcgtcgattcgatttagggaaacagatcagcggggaccaggaaccctcaaaaatgaagcgatgataccgccgcgcattcagagtcaaaacacagcagtcctgcagcccacccaccaccatcgccaatgatgcccaccttctgggatctcgccccgtgccttcctctccgcaaaggcattgggaaacaaaaagactcggaccccgcagtcggcgatgaggaggttgtgcggcacgcccgcggcggccagcgcctcgcaggccgcgcccacgcagcgcgccaggtcggcgagggagccgcctgcctggaacaccaggccggccacggggtagccctccaggctggccacgctgacgccggccagcgcgccgccggcgcgcaggagctcggcagcgggcgcgcgctccgcggccaggggcgcgtacaggaagtaggcctggaagtgcagatggttgatggtcccatacgcgcccagcgagttgaatccgagacggaggtagggcgtgtcggcctcgcgcgcaaactgcagcgccaagagcaaggaggccgtgtccacggcctgcgcgcggcgggaaagcgcgtcgggcaccagcagcacgtgcccgtactcgatgggcgagacgttgatgaagacgaggtggggcgaggcgcgcgcgggcgcggaggggaggtagcgcggcgcggcgcggccgccgccgcgccgacccgcctcgaacgcgaacagcacctccttctgcgcggccttggtgaagttgaacttggcggggtcgaaggcctgcgtgacctggtccacacggaactcagtgggccgcttcttgctggcccggccctcgttgcactgcgccacaaagcccaggtgccccggcagcacgcgcgtggggcaggcggtgacgtcgtagcggaagaggccgcgctccgcgcggtcctcccactccgccagcagcagcatgctgagcacgctgcgctgcgggaccaccatgggctcggtcatggccgcgtcctcgtccgaggccgcctcggaggagggcggggaggcgccaatcgcctcctccccccccggcgggcccagcgcggcggtcaggctgtcaaaggagccgaaggagcgcactcgcccgccgtccagggcatccacgtcggcgtaatggaaggcggggagcagggacccggccagctcggccacggcgcggtcgggcgtggagatgacgcccttggggggcgagggaaagggggaggccggggggaaggaggagggcggggggaaggtcgccgtctcctccagctgggccagggagtagatggtcggcacgcgcgacaccgtcagcggcttcgtggccatggtgggaagtgtgtcggtgtcgaaacctcgctggcctcctctacccggtacagggggtgacaagaacaggtcttgctgtggttggctatgcgcagggtgtgcgctcttatccacagcaggtcctcacacacggaccccaccgccggaagcccgcagcagatcctgcgtcacgcataattgggggttgtgaggcgcagaacatccggtcgaacgaggcaggactcgcgtggcatgccgacgcatggcgcgtggggggtctagctggaagacccaccccacccctcagcgcccggggcccgggccccctcctcgaaactcgagctacccaccgatggagatcctcctagggctgatggacacccgcgccctcccgaaaggtgaggcatcgagcttctatagtgacgagtacgacctggtccggggcagtgctccgttgcgacgaccactgggtgtggggtccacgggggcctctggtttatgtagtgagcctgattgtgggcgagtccgggcgaaaggtcgggggcggtctgcgcggctgacgcagaaccttcttcatgagcccgactgaccacataccttccagcccggcatcctcgcgggcgcgtgggatgctccgtccacacatacccccccgggtcgagggcatctggcctggcatatgccggcacacttggtaacgtcattccatcgtaagcaagggctttggagtcatcaaggatgcccctcccccgtgcccgggggtccccagcccgcctgcctcgaacccctgtgccggccagtgggttgttacacgggctgagtactgggtggccacccaccagcccacccaccgggcaccgccctcacggctccggccgctgcccctgctccgccaccatgcgcgcgatgccctcctccaggctgaacacgcgcgccgcgccgtcctccgcccccgccagcaccagcttcccgtcggggctgacggccaggtcctgcactggggcctcatggcccctgaagcaggcgttgcagcgcccgctgcgcgcgtcccaggcgcgcaccgcgccgtccatgcacgccgtgaagaccagcggctcactggggtgcaccgccagtctcgtgatgccctttgggggggcgtggggtggatggggttggggggtggtggcggggagagggaggggagtgggtggcccttctcgggatgctgtcgacctgagcatgcatgcgtctgcaaggatgcgcttccaaccaaaccacaagtgttgtcccgtgatgcaccttcccgtgccgccagtcaggcatgctgtgggccggggtgttgatcccctcccgcccctacccgtccgctcgccgtgctcgacgagtccaaaacaacccctcatcatgccccccccccccnnnnnnnnnnnnnnnnnnnnnnnnnnnnnnnnnnnnnnnnnnnnnnnnnnnnnnnnnnnnnnnncgggtgctggcagatggctcgcggcgtggcggtggccaggtcccagaagaccagcgcgccgtccagcgcggcgctggccgccgcgcccggcagcgccggcacccaggcgacggcctcaacccccgcccgctcgccctggtcctcgtgaccggggcgggcggggtcggtgaccagggtcgcgccgacgcgccccgtgcccagcgacacgaccttggccgcgccgtcctcggagccggtgagcgccgaggcgccgtcgggcgacagcgccaggcacgtcacgcctgcggcgtggaaggggtggccggacacgctagcggtgcaggccccggagcgcgggtcccagacgcgcaggctggcgtcgccctcgccgccggcggtgaccacggcgcggccgtcgggggtgaaggcgccggcggccacgggggcggtgtgcccggagaaggtggccatccaggcgccgcgccggccctcccacatccatgcggagaagtcggcggtgccggccagcaccacgtcgccgcgcgggtgccaggccacccactccacggcgtcgccggggccgtccagggtctgcaggcaggcccctgtctccgtgtcccagaccttcaccacgcctgtgtggagtgtggagcggggtgcaggggtgtcctggacgcgcctgggaaggggtgcggggatccagacctgagcgttgccgtcgagatggctcttgacacccccccaacccatcgtcaagccccaccgtccatgccgccagaggccaggaggctgccgtcgtggttgaaggccagcgacgccacggtgtcctcatgcccgtccagctggaagaaagcgccgccagtctcctcaaacgcatcgtgccccacctgcagggagcagggcgccaagcaggggctgggtacggggcgcatcctgtgtctggcggtgaggaggcgcacaggccgagggccacagccatgcatccgctcgatccaggccctcccgggctctctcctcccagcacgcctcacccgccacaggaaggccttgtcgtccgctcccccggtagcgacgaggtccttcttggtgggacaccaggccacagcgtatacgccatctgcacgcggcacggaggcagggttgcacgcccaggtatgcctctccctgcgcagaccatgtcagccccagcccagctggccaatcaacgagagaatcgcaggcaaactccaccgcctgcccaccttgatgcccctcgaacgtgtgtatggagtcgtcctcgtactctgcagcatccacgcctgtggagcccgcctcgtcgtcgctggagtcggagatggcccctgcagcagagggcagcgcaggatgctcgactgcaagataattttgcacacaatatacataatgttcatgcctgcgcctcaggtaccttgatctccatcgtcaaggtcatggacctcctgggcatcccccatgtcgccctctgcgacgccaatgaattgtgcttcctctggttcccgcgcaattttatcaagcaaattttcatgtgcaatatggtaatatgtattatttgtggtctgcgaatggtatgaccgtggaggtgcgcggcatgaggaggaagactcgacagcaaagcatgcgaaaccttccaacgagcatctcagcatcactgttacaatcactgcgaaggggccacctgttctgacagattgcttatcggggcataattatgaggtcctttctaggcagtggtgtgtctttctgcacaataccctgctccgtcgacggtgggtcccgtctcggaaccgtatccggggagcggcccccccaccccctccgaagcacacagtgttccccttagcagtacccaagagacattaccatgtacagcgtcgccattctcggggcattgctcgtcttcctggggtcggagaagagcttcgtgcacttcaggtgggtctgctcgttggggggggccggggacaggtaccaggcatggtgtcggacggtgtgggtgacctacagcacctggcgtgccccatcgactggggtttgcagctgccacaccatgcgtcgggtgccttgggtggtcagatcgcggcatggcgctcggcggtgcggaaagtagttgcctcattgacaaggcgccagcaacccgccctcgacgttcactccttgtcagtcgcaccgcgcgccgggtgttctggtacctcctgagctgcgccctgggcctgtggctggtccgttggctgcagacgctggaggggatgagcatgctctgggtcttcctgtctgcggtgaggctgctgtcgtaggccagggttggcatggttactggcttgctaatggtgtgacttgctgccccgccgctggaattacctgacctaacttgcatcagcagctgggcgattccggactggcacctgaggcctgcctcaatgggcaccttgatcccctggcatcctctcctcgtcggagatcgctcatgagctgtggtttcgcaggaaccccaatcccagcccgccgcaccaaattcctccccatcctcccctgcttccccatgtcactctcacccctggattccccttccccccaacaggtcctggctgcctcggtggtggaagacgaggtgagcaaggcccgtggcttggtcatcctcgacaacgaggcgtgccggcgccagcgcgccgcgctgcgcacgcccgccgcccagggcctggcggagcgggtgatggacctcgtggcagcggtgacgcgcggccagggctacaccgccggcacggtgcagctgttgggcgagctgcgcggcaccacgcgccgcctccgtgcgggcctgcacgccgcgctggccggcgccggcgccgacgagctcaactacgtgctcaccgccgtcaacgcgcccgcgctgctggaggtggtggcgccggagacggtcaccgtgctggtgcgggggcgtgtggcggcgctgaccaccgtgtcgcgctccgtcctggtcgacgccttccagaagctgggcctgcgccaccgcacgagccgccaggccgcagtgcgcgacgtgctgctggccacgcgggggctggacctcacccgcctcaaggcctacatcgacgacggcggggactaccactcctgctacaagctcatgtacaacgacctgcaggtggattggtggggtgggaggaggggggtgggtgaacgaagggggctggggaggggagggccagggctgactttctacggattcgggggtctcgcaagcatgcatggtcttgggagttggaaactcgtggacgggcatgcgcttgggcgccatgcagaccgcgcgtaggtacaacaggaccgcactttccccctccctgcccccccacaatcctccccgacccctcgcacccctcacgccttccgccttccgcctggtcccagggtgagctccagcaggaggtgctggcgcacgtgacgcgggaggggcggcgtgtggcggcggccttcgcacggcacgccggccccgcagcccccccgggcgtggtgctcaaggtcctgtccgacgtggacgacacgctgttcagctccggcgcgcactggccggcgggcgtggacgcgcgctacccgcgcaagtgcttctaccccggcgcgctggccttctacgccgagctggaccgctgcttcgcggcgcggcacgccggcgccctggccgccgtggcgcaggagctgcagctggaggaagccgtgcaggccgcgctgcagggggcgggggacgcgggggcgggcgacgcgggggcgggcg

SEQ ID NO: 44700 - DNA, 61 bp, Chlorella protothecoides
tgcgatagctccatagcatggctgcaggggggccggtttgcgccggcatcccggcctgcac

SEQ ID NO: 44701 - DNA, 61 bp, Chlorella protothecoides
cgacccacacatccgtcaattcatggcaggggggcaatcattccctaccaaagaacccggc

SEQ ID NO: 44702 - DNA, 61 bp, Chlorella protothecoides
cgtcgctcctggcagagatggagaggcgggtgagcatcgggaaaggacaggggcggacccg

SEQ ID NO: 44703 - DNA, 61 bp, Chlorella protothecoides
cgctgcgcctgatacggccagacggcgggggggcagcggcccccggcgcagtcacgacaca

SEQ ID NO: 44704 - DNA, 61 bp, Chlorella protothecoides
catcaacaccaagctggtggaggccggctccgagattgtctccatctaccaccgcaggtgg

SEQ ID NO: 44705 - DNA, 3743 bp, Chlorella protothecoides
  modified_base (94)..(196): a, c, t, g, unknown or other
  modified_base (754)..(763): a, c, t, g, unknown or other
cggcggccagcagcgagggcgtggccgcgggcgccgcactggccgcggctgcgtcggcaaccagcgccgccagcgggtgcggcgccggcggcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacggccttggcgctgctacgtagcagcttcaggcgcgaggtggccagcttggtgtccccgccctccacctcggccacgcccgtggccagggccacgcgcagcgcgacgacgccggcgccggcaggcgcgggcttgccgcgcagcgccagtggcggcagcggcacgcaggccgtcagcgcgctgtcccgcagcacgggcagcaggtggtcctgcgtgcacatggcggcggggatggacagcagggccgtgaggagcgcggcaggggccaggcacgccgcgccgcccacgcggaagtcccacagccccgccagcgcgggcgcggccagcgagaactccagcgttatgctggccttggccagccgcgggcggcgcggggggatggcgcgcaggagcagcgcctgtggtttggagggcggatgagatgttgcgtgagtgtcggtgaggtggtcagtgacaggggagggcatcggcatcgtcagacggtatgcgcccacgtcgctccagcctgtggtcctgaggacggcgagccccccctcccgagggcctgcacatggcgannnnnnnnnntggacgagatgttgggtgagtgtcgatgaggtggtcagttacaggggagggcatcggcattgttagacggtatgcgcccacatcgctccagcctgtggtcctgaggacggcggcccccccctcccgagggtctgcacatggcgagggaacacctgcctcaccacccccactcccttcacctgaggcctggccgccgcccagcagacagagtgctgccagagcgggcccgcccccggcgccagggggaagggcggggtcacggggtggccgggtcccgccagcagcgcgtgcgcgttggtcccctgcgcgccaaaggagctgacgcccagggtggaggcgccggggtgcagcgcgggcaggccgtagggcccgccgcgcgcgatggcgacggcggcgtgccccgacagcgcggagcgcacgtgcgggttcaggctgcgcaggtgcagcgcgggcggcagcgcggcgtgcgtcagcaccgcggcggcctccagcaggcccgccacgcccgccccggactcctggtgccccgtgtagcccttgacggtggccagggcaaagggcgcgtcgcgccgcaccccctccagcatgaccgcggccagggcccccagctcgatggggtcgcccagcgccgtgccgttggagtgcagctgcaggccgtcgacctcggcggggcgcaggcgcgcggcggtcagcgcccagcgcagcagcgcctgctggctggggccgtgcggcgcggtcaggctgctggcgcggccgttggtgttgacggcggtggcacgcagcaggcccagcgcgcccggctgcgggtcctgcgggtcggcgcgcgcgaggtagaccacgcggcaggcctcgccgcggacgtagccgtcggcccccgcgtccagcgtcttggaccggccctcgggggacagcatggaggcgcgcgccagcatgaggctggactccggcaccaggcagagcaggacgcccgccgccagcgcgccggccagcggcgactcgcggaaggcggaggccgccaggtgggtggccaccagggaggcggagcaggccgtgtccacgctggcggtgggaccgcccaggccgaagacgtaggccaggcggcccgaggccacgctggcggagctggcggtgaagctgaagctggagatggggatgccggagcgctcgcacaggggctcgtagtcgttggtggagatgccgacgtaggcgcccacggcgcggccggcggagggcacgccccccgcctgcgccagcgcggcgtgcgccgccaggagcagcatgcgctgctgcgggtccatgcccgctgcctcgctgcgcatgatgccaaaggcctcggggtcgaacagctccacgccggggacaaacacgccgaactggggggccagcgcgccgtcgtcgcgcgggccgcgcgccgcgtggtccacgtcccagcgtgccagcggcacgcggctcgcggcgtcgccggaaccatgcacgtagcgctggagcaggtggtcctgccccgccgcgcccatcagcgccacagcgctgcccgggccgccgggcagcgcggctgcgccgctggcggcaaacagggccaaggatgactcggggcccagagcctgcgaggcgccgccgccggcgccgccggccatgcgccccaccaggtactcggccagcgcggcgatggtcgggtagtcgaagaccagggtgctgggcagctccaggcccagctcgtcggccagtccctgctgcagctcggtggcggccagcgagtccagccccgccgccatgagcgggtcgttgtcgcccaccgcggtgcccaccgcgcccgccaccgcggcgcgcaccgcggccagcaccgcctcggcgtccacctcgatcgcctcctgcgcgcggtcgaaggcgttggggccgtcccgcgccatcccgggcgcgggcgaccagtcgcccgcgccgggggaggaaggcaaaaagtacatgggcgtgcgcggcgtggccaggccgccgcccgcgccaaagggcgagtggggcgtgcgcggcgtgcgtggcgtcatcagcggaggccgccgcgccagcaggcgccggtgctccacgcccgccagcgagaagccggcgcccagcgcgtgggagctggcgtagtggctgcgcgccagcgtggtccccagccaggccggggtctgggagggcgacgtgtgcacgctctcctttggaggaggcagcgccagcgcctcgatgcgtgcggtgacgcgcagcggcggcgcgcgcgacacgggcgagcccgccgccagcgctgcgggcgacaccagcgaggcctccacctgggcggggtggggacccgcccaggtctcgccgtccgccggcgagaagccggcgggcggcgaggtgagggccaccacggtcggcgcgcggcccgcctgcgccattgccgcacgcgcgatgagcagcgccagggtgcccgcctcgggaccccttggctgcccggcacccgtaccgaccttggcgtcatcctccagcgccgcggcgacgctggcgtggaagtgggtgcgcaggcggccgccctccggggtggtgatctccagcgagccgggcaggcgccccgtcccgcacactaccttggtcgccgcgccgctggagctgcgcaggctgacgtgtaccgcgaagacgatgtcgcgcagcgccgcctccagccctgcgatcactttgccggtcagcaggctcgcggcggcagcgctcagctccaggaatgcgccggtggccagcacgcccctgcccagcacgacgttgtcgcgcaggaaagcgaggcgcgccgcgctgaggtccgcctccagcgccgcgcggccacgcccggccggcagcgcgcgctgcagcatggagtggacgcgcggcgccacccagacgcgcgcccgctgccacggcaaggcggtgacagtgcggtccagcgcggaggccggtgcgtcgctggcgtcagcgggcgccagcagcgcgtgcgcgttggtgc

SEQ ID NO: 44706 - DNA, 61 bp, Chlorella protothecoides
agagttgtcaccctcgcccgccctcctcttcccccccaacaccccaacccctgaacccacc

SEQ ID NO: 44707 - DNA, 2624 bp, Chlorella protothecoides
  modified_base (103)..(173): a, c, t, g, unknown or other
  modified_base (530)..(539): a, c, t, g, unknown or other
  modified_base (1117)..(1126): a, c, t, g, unknown or other
  modified_base (2203)..(2212): a, c, t, g, unknown or other
  modified_base (2545)..(2554): a, c, t, g, unknown or other
gcggtacccgctgcccacggccgccgacgcgcgcgtggtgctggccctgtggcactacccgctgggcctggcggacacgctcgcggcgggggcggcggggggnnnnnnnnnnnnnnnnnnnnnnnnnnnnnnnnnnnnnnnnnnnnnnnnnnnnnnnnnnnnnnnnnnnnnnnctgctgggcacgggcatgctgagtcaccgcgggagggcgcgggggggcgccgtgctgggcctgctggccgtcgcagggctgatggccctggagggcctgctctgcagggtgtcgccctactgcctcgccgcggaacccgccgcctgagcgcctactggcacgccctgcatgaccctgactgcaccatgtgtgccggcatgagcttgccctgcaattttacaacgcttttgagcagggacatggggggtggggggggttcattccaagcgttcatgaagaggtggggatggcgtcgggctcgtgggctcatccttcgccctcgagcgcaggcgcaggtcccccatctgaacgaccgcnnnnnnnnnnctggggatggcgtcgggctcgtgggctcagtcttcgccctcgagcacaggcgcaggtcccccatctgaatggccgctggtctgcaccaaggccgtccctcacgtcagcgcgggcagctccaccgctggctggtccccagccgccgagccctcggacatgccacgcaggcccttgacccagacgatgaccctgaccagggccaggcgtgactcgaccatggcccggtccctcagccccagcaggcgggaggcgaggcccgggcgccgcctgaggcgctcctgggagagcgcggcgctgcactcccgcgccgtgctcacaaaggtgttgaccggggtgcccagcgcgcggtccacggccctttaggtgggagaagtgaggggtaagaagggttggatggatgacagacgtgtacttgtagaagggaggaagaaggatggggctgggtcttgggggaggtggacgccggcagactgtgcaagcagcgttcgggcgcaggggcacctttacggggagcagccctaacttaggcacgacttgggcaaaggactcgatccgcacaaggtttcccagtcgcatcnnnnnnnnnngggtggacgccagcagactgtgcaagcagcgttggggtgcagaggcacctttacggggagctgccctgacttaggcacggcttgggcaaaggattcgatccgcacaaggtttcccagtcgcatcgtccacccaggcagccatcagatgggcccctgaccctcactcccttccaggaacaccatccaaccctctgcacgcacctcaggcagtcgttggtcttcaacaggaggagcaggggccgcggcatgcaacgcagcaggtgcgcgatctccgacgcgtactgcaccgcaaagccccggatgagctcccgctccgcctcgctgccctccacccgcagccgctccggggcgccgtgagcgcggcgcacctggtcccaggggcgctgagtcagcatgcctgcgaacagcggcacactggcgcccgcgcccatcgcgctggcgtgccttcttatggccgcctcgtctgcgcagtcgtggtgcatgggagggagggcacggtttgcagtcgggaggctggcagcatgcactctgctgtgttggtggtgaagtgtcgatgcaggtggcgggttgtgaatgggtctgactctgtgataagaattcgtagtggaccacgctcccggcacagcgttccgaccctctcttctcaagagcagcctggaaaattccctcgccccaataccattcccccgtcaacccccccactctcttcaagactccccaccggcaaagatgagggcctgccagaggcccgcgtactccaggcgcagtgcgtcgtccagctggcggtacaggccgtggtccagcagcacgagctgccagccaccaggcgccccaggggcggcgcggactagcatgttggcggcgtgggggtcgcagtgcacatcgccgtgtcggaagatcatctcgttgaaggtgcgagacacccgctccgccacggcggccgggggcacccggagccgggccaggccctccaggtcggtcaccatgacgcctgcatgagtgatcagaaaggaggaatatgaaccttgtctcgccgcacagggccgaaaccttgacagccctgccatgcacagtacnnnnnnnnnntatgagtgatcagaaaggaggaacaggaacccttgtctcgccgcacagggccaaaaccttgacagccctgccatgcacagtacaagacaccaccccttggaggcgcaccgtccatgaactccatggtgaggaccctggcggaggagagggggtgcacaatcgcggggacaaccacctgtccccgtacagagctggtgcctgccgccaagttggagcggcagcgctccgcgttgcgtgcctcctgctggaagtccagctctgaggggtttgggaggggatggaaagatgagtgggtggtgtgaggcgttggagggtggggggtggggatgggtnnnnnnnnnngatcgcggggacgaccacctgttcccgtacagagctggttcctgccgccaagttggagcggcagcgctcc

SEQ ID NO: 44708 - DNA, 61 bp, Chlorella protothecoides
ccacttccaacggctagctgggcgatggcgggttgctctcgtcccaagtgatccttccgcc

SEQ ID NO: 44709 - DNA, 61 bp, Chlorella protothecoides
gctttgcttgggacaaagcggcagcttgagggaggagcaagcaagtgggggcatccagcct

SEQ ID NO: 44710 - DNA, 61 bp, Chlorella protothecoides
agcgtttgatgaatgcaatgcgacaggctcatgctgatggttggtttatcgtttttgacac

SEQ ID NO: 44711 - DNA, 61 bp, Chlorella protothecoides
agagtgtggggagggagggagggggggggggtaatgcacaatggttggtttatggagggga

SEQ ID NO: 44712 - DNA, 74 bp, Chlorella protothecoides
gcaggcggcggcggcggccgccgcctcctctgcatatcgcctctccgccgcctcctccgcaaatcgcctctccg

SEQ ID NO: 44713 - DNA, 61 bp, Chlorella protothecoides
gcaccaagatgtggaacctggaccggctgggccagcgtgacccgcccctggatggcaagta

SEQ ID NO: 44714 - DNA, 61 bp, Chlorella protothecoides
gctccggtgcagtatcggccaaccaggaggggagaggtgattgcgatacgctggaacatgc

SEQ ID NO: 44715 - DNA, 61 bp, Chlorella protothecoides
cgtcgctcctggcagagagggagaggcgggggagcatcaggaaaggacaggggcggacccg

SEQ ID NO: 44716 - DNA, 103 bp, Chlorella protothecoides
cggcaccgcaccgtagccccccacaccgccgtagggtgggcctgggggcggcgggccgtagccagggcccggagggggcgggggccccccaccgtacggcggc

SEQ ID NO: 44717 - DNA, 22330 bp, Chlorella protothecoides
  modified_base (529)..(538): a, c, t, g, unknown or other
  modified_base (850)..(859): a, c, t, g, unknown or other
  modified_base (3147)..(3295): a, c, t, g, unknown or other
  modified_base (3402)..(3411): a, c, t, g, unknown or other
  modified_base (3505)..(3514): a, c, t, g, unknown or other
  modified_base (4218)..(4227): a, c, t, g, unknown or other
  modified_base (4821)..(4830): a, c, t, g, unknown or other
  modified_base (6687)..(6696): a, c, t, g, unknown or other
  modified_base (7035)..(7044): a, c, t, g, unknown or other
  modified_base (7953)..(7962): a, c, t, g, unknown or other
  modified_base (8370)..(8379): a, c, t, g, unknown or other
  modified_base (8805)..(8814): a, c, t, g, unknown or other
  modified_base (9160)..(9169): a, c, t, g, unknown or other
  modified_base (10183)..(10192): a, c, t, g, unknown or other
  modified_base (10429)..(10438): a, c, t, g, unknown or other
  modified_base (10670)..(10679): a, c, t, g, unknown or other
  modified_base (10734)..(10743): a, c, t, g, unknown or other
  modified_base (10797)..(10923): a, c, t, g, unknown or other
  modified_base (11634)..(11643): a, c, t, g, unknown or other
  modified_base (11849)..(11858): a, c, t, g, unknown or other
  modified_base (12179)..(12188): a, c, t, g, unknown or other
  modified_base (12602)..(12611): a, c, t, g, unknown or other
  modified_base (13253)..(13262): a, c, t, g, unknown or other
  modified_base (13704)..(13713): a, c, t, g, unknown or other
  modified_base (14015)..(14024): a, c, t, g, unknown or other
  modified_base (16330)..(16425): a, c, t, g, unknown or other
  modified_base (18577)..(18586): a, c, t, g, unknown or other
  modified_base (19069)..(19078): a, c, t, g, unknown or other
  modified_base (19475)..(19484): a, c, t, g, unknown or other
  modified_base (19795)..(19804): a, c, t, g, unknown or other
  modified_base (20187)..(20196): a, c, t, g, unknown or other
  modified_base (21655)..(21664): a, c, t, g, unknown or other
  modified_base (22075)..(22084): a, c, t, g, unknown or other
ggcgcgggcgggcccgccgcggggcccgcgccgccggtgccggcgttgcgccgggcgtggacgtcggccacggtgcggatcgcggtctccagcttccactgctccagggtgggggcggggccgtccaccccctcctccaggcccaggtaggccagcaggcgggactggagctgggctttgcgcccgcgcttgtccaggcgcaggcgctccgccacctcctgcagctcaggcacgcggaagcggagcagctgggcgcgcaccgcctccatgccaccggggccggccatcgcgcgtcatgcgctgggggcgggcacccaggaggactgcggggggaggtggggatgtcgggggaggtgggggcatgggtggacggcaggggcgcggggcagaacccgccacctcggccgggaaccccgcctggaggaggggctcatgaacttgggttgggacccctctccctgacggcacctccccggagcctcccacatgtattccagtacaatgcccaccatacagctatgccttgcgnnnnnnnnnnagcctggaggaggggcccatgaacttgggttgggacccctctccctaacggcacctccccggagtctcccacatgtgttccaggacaatgcccaccatacagctatgccttgcgaaccgataagtcaggaacaggcgtgcagcagaggggacgaggctccgaatcctttcgctgtccgccttgagagcgcgccacacttcaccctcgtggggagctcggtcacgagggagcccctggaccgagatggtgcttatcaatgatatgacctacaacattacgcgcccctcactgcaccttcagcgccgtcctgtnnnnnnnnnncaccgagatggtgattatcaatgatacgacctacaacattacgctcccctcactgcaccttcagcgccgtcctgtacactgccagtcgcaatcgactgggccagggccgggtgaccgagctgcgctgcatgctgtggacgggtcgtgtccgtgccatccaaatgcgcccatgtaaacgcagggcatcgcacgttcggatcttcccagatcaagcatcaaacagagcatggccttgactccgtcatgctgcgcattgcccgcctaagcgtcaccgctctggtcctgctggttgtctggggcttcaccctcaccgttgcacccccctccatctggacgctggtggccctggtgcgcgagctgctgatgcactggttttgatctcaattatctctttgtcatgacttagcacataggggtgtcggtgcggttcacacccccttatgaccttgcgggcaggcccctatctacctggtcttcgccctgggtttgtaccttgcctcctccttggcctacggcgtagcgaccttccggaccgtgccggaggaatccgagtacctcaagcaggtggggcaatcgcgcgattttaggtccggaaggtcatgtgagctgtcccggttctgataatcccggacccccccacctcttcatccggctcgagcccctccctctgcctcccacgctccaggacatctcccgcgcccgcgccggcctcgcccgagttggcatcacagcctgagtgaagtgcagtcctccagccctcgctcctctctcctccccaagaatgacgtcacgggactatgccgacggcactgtgctggagctgcgtgcggggcggctggagctggactctgtgctcgcctcagcaacggcccgccgccagcccgtgctcgtccagttcagcgcctcctggtgcggcccctgccgcatgatgaccccggtggtcgctgagctggcgcgggcccacacggggcgcctggtggcagtcaaggtcgacatcgaggccggcccgcccaacaaggcgctggccgccgccctgcgtatccagtccctccccactttccagctgtaccgcgacggcgcggtggccgacgcgctgcagggcgccaaccgcgccggcctgtcggccctggtctctcgggcgctcgccgaggcggggccggcgcccgacgccgacgacatggccgccaggctggcgcaggccctgggcagggtcaaggcagcgacctcgcgcgaggacttccacgaggccgcgcgcgtgctcctgcgcttcgtggggaacgtgctggaccatcgggacgacgccaagtaccgccgcgtgaaactggccaaccccgtctttgcgtccaaggtgggcctgggacgcattgttctttgttttcacagggggaatggggaggtaagggagttttccaacggctattaaggatgcagggcatgcccaagcagacgtttgggagtgtttgccaaggaacgtggagatggcaggttcggcatgaccgcccctaatgtgtcctaattgttgtgctggtgcacagcaggcgcacgacgcccccaaccccccattgtggtcatccatatgcctccacatcatgtttcttgcatcaacacctcccccctccctcctctgtgctgcagctgggctcgcggcccgggggagtggatgccatgaaggccatcggcttcgtggagaggatggaggccgcagagggcgtgctgatcatggacaccatccctgaccagctggagagggtaaagcagctgctggaggcagccatgtcaagtgccgccggcggtgggcaggccgcccgcgctgccagcgggcccgctggcggcggcgccggcgggacaagcaccagcgcagctggccctgctggagaggaaggggccaccgggagcatgagcccgacgtccgccccgcctcctgtggcggtcagcgcggagactgctacaggcacaaacacagcccggactgcgtttgccgtggcacccacaagtgcggcccctcaagcgcccctccagagcccgggggagcaggcacggactgcacgcctgatggcgaagctcctggccgcagcgctgacgagcggggggggcggtccaagcactgaagcaagcgccgatgccgccccgacaaccgattcctgagcgcttggatggctgcctcacccctgccatgcccaagccctcccctggctggcagattccaccactctataacccgaagtgcagtatacaagtgagaaaaaactctggatgacacatggggaggcaggcacatgctacaagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggggagggtggaatgggcatgaggtcgccctggccaggtgcggcttgcaccccaaccttcggcgaatctcccgcacggaggggcacaactcaatcccaaacaccttnnnnnnnnnncgtccgggaccacgggtgtcgcgatcagaagagggcagggctcttattcagggtttgaatcacagaagggatgatgtttgcatagagatagccnnnnnnnnnntccgaagtgcagtatacaagtgagagaatactctggatgtcacatggggaggcaggcacatgctacaagataccttgccagagcttcacgccgacagaggctccgctgtctacgaacgaccggctgggcgtggggagtgactgctgcttctcggcgatagccatggcgtccgtgtggatgccctgtctttgcttgtgctgcgaggtgtagggagggtggaatgggcatgaggtcgcccgggccaggtgcggctcgcaccccaacctccggcgaatctcccgcaaggaggggcacaactcaatcccaaacacctttttattttccttgcagacgatgaacacctttccgcgacgcttcaccactcggcatgcctcgcacagcttcttcactgccgcacgcaccctcatggtgtccgggaccacgggtgtcgcgaccagaagagggcagggctcttatgtagggtttgaatcagagaagggatgatgtttgcatagagatagcctcgtacttgccgtcgatctgctgactactcttccattgtactctcgcgcgctccctcactgcaaccagtcggtcacccactagatcagaacgttgtaaatgcaaggcgcgccatgcagcaatactctatgttgagattgcatgattatatttgatgcaaaaagtgtgggttgcccgactgctctatagcgatgcttcccgtnnnnnnnnnntgtcgatctgctgactactcttccatggtactctcgcgcgctccctcactgcaactagtcggtcacccactagatcagaacgttgtcaatgcaaggcgcgccatgcagcaatcctctatgttgagattgcaagattttatttgatgcaaaaagtgtgggtcgcccgactgctctatagcgatgcttcccgtccaacgacagactgcgataccggcacctggcctggataattctcaatgaagtacctggtgctgggcggtggtgtggccggcgtgtgttgtgcggaagagctctgcaggctctgtccaaccgatgaagtcaccattgtgtcagcctatcgaaccctgaaggtgggcagcctggaaacaggctccatgcaatgtgcgagagggtgcgaatggtctttcccatgctgctcccatcaatggcattgctacggctcaccctgctccccctcttaatggcagggagccagtgtcattgccaggatcacgcccttcattgagcagattgcgggtgcgattttgtggcaatgtgactgagcatggaccatgctgcggccagtgcatgctcacaagcagtgtcatgactttnnnnnnnnnncttcgtggcaatgtgacggagcatggaccatgctgcggcctgtgcatgctcacaagcagtgtcatgacttttccaacaccttcccaagcagtggaggagcgcaggctggatgatgaaaggcatggcaatctgcactttgtgcagggctccgccgtccacctagactctgccagaaaggcaagtgtgacgcatggctgtcaagagtcgggttcaatcgatagaatgtgggtggcattggggccgcaagtgatcaaccactctgcatgctgctgcatactgcgactctgcagttcctgcatctcctcttctcgctgcaccttcacagtccgtgcggctggcctctggcgagtcgctggcctttgatcggctctgcatcgccacgggggccggaccgatccacctgcccggctcggattcgaatggcgcggtgctgacccttcgggacacccacagcattgccgccctggcgcaacgcctgcgctccgcgcggcatgtggccgtgatcggaaacggcggcatagccctggagctcatgtgaggatgtggagggacgggggttgggcggtggacaggaactgaatggtgccgcctggggtcaaccatgtattgtcggatgcagtggcggggagctgatcagcatctttcagtccgcgaatcgaccatacccctcttgcgccctcctgctccagctactcgttgcgcggcctgaacgtgagctgggtggtgcggcacgcccacatcggcgacgctttcttcgacgccgatgccgcgcgcttcctgctggacaccctgcagggctgccagggcagcgtgtcagcgccggccatggacggcgcggaggggagctgcgtggaaggtggtgcagtggggggcagcgatgcgactgcgggcagcggtgtagcccaggccaggcagcgcgaggggccgcctggcgcactgctgggccacgccgtgggccccacctggatcaaacacctggcccacggccagcggggcggggccttgacgctgcacctcggctgcgaggtggagcgagtgtcgcggggcacggcccctggagaccctgggggcccctggcccgtggcactggagctgagcgacgggcggtgggtgtgcgctgacgtggcggtggcggcgctgggggtcacacccagcacggagtggctcgggcccgagctggagcgggggcgggacgggggcatcaaggtggacacccggatgcagacgagcctggcgggggtatttgctgcgggcgacgcgtgctctgcgcccgactttgacaccccagactcccagtggttccagatgaggctctggacccaggtgaggaccattggtgggggtcccgagggctgagtggacatgtgttatccaagatcagggtccagagagatcagtgtttgtagccctggttttggttcacggaacagtgcatgggatggggcatccacactcacccaagcgccccagttccacatctcccaacatcccaaatcaccctgaaccaggcacggtcgcagggcatccatgccgcgcatgccatggctggagtggaggaggacacggcttccagcatggcctttgagctgttcacccacgtgacgtcttttgccggcctgaaggtggtcctgctgggaaggtacaatggccaggggctcgagaacgagccggaagcagacctgatctccttctcaaggactacacccccagacccctcccaggcacggagagggggtgcgggaagattctgggcgacgacgggtcgagagcattgcgcccatggtctacaccctctgcgttaaaccctgcatggcatgatcagtgtatgtaccctgcacgcctcccatccacagggannnnnnnnnncctgcgttaaaccctgcatggcatgaccagtgcctgtaccctgcacgcctcccatccacagggaagcccaggttcctttgtgaggctcctgctgctcagaggcaaggtggttggggcagtactcataggagatacaggcaagtcgcggggccccttgggtgtgttggctgtgcatgttgccagtcacactgcaactctgctggtagtcctgaggtgtgcctgtggtaatcctcggtcagagcatgtgatgaacagcacccagttatccttccaaccgacaacagatcttgaggaggccgtggagcacttgatactggataggctggatgtgggggcgtnnnnnnnnnntactgcaactctgctggtagtcctgaggtatgcccatggtaatcctcggtcagagcatgtgatgaacggcacccacttatccttccaaccgacaacagatctagaggaggccgtggagcacctgatactggataggctggatgtgggggcgtatgggcccagcctcctggaccccaattttgagctcgaccatgtctttgactgagggtgcggatgctcaatgtctgcaggctcaattttgttggcaggggtcgcaagaagaggtttgaaatccagatactgaataagaaatgcaggggtaggtcttcaacctctgctagaggccactcacagccaatcacggccaacacaggtcacagactggtaaggctggacctcgtgagcagcgactcggaatcggtggcagaggtctctgatccaccgcttcgagctctgggaggttgagtgtgggggcggtggccccgtcagagaggtcctcgttccaatcgcacacaagcacacctctcgccagcaaccaaacatctgttgcatgtactgcactggacaagcctggacacctccctccggtcccccccagctcacagcaagtgttggcaggtggaaagtgggtgcgccctcctcaggtgcaccgtcaccgatgcctgcgacagacccaccttctgcccgcactcgggacaggtcttgagccccggcttgggcttacgcccctgcaccgtggcgaggcaagagggcgtcgacatttgacagccgtaccaacaagagatcgcctacagaaaccaccaggaggtactgacagggcgcctcgctgtgtcactgcatggagaatctagcgtcctccccagtccaatcacctcctccaccgcttcgtgtcccagaatagtatgccagccccctgcccaccttcacggnnnnnnnnnntgctgtgtcactgcatggagaatctagcgtactccccagtccaatcaactcctccaccgcttcgtgtcccggaacagtatgccagccccctgcccaccttcacggtctgcttgccaaagagctgctcctccagccgcagcagggccgccatgtagcccgcattgggcgccgcctcgggcctgaggcgcgtgaggaagcgcatgccctgccgcaggctccagccctggctctgcatcatccaggccaagatctggggatggatgcaagggggggccattggggtggggcatgggagggggtacttgcgtgtgaagtcatgcaatcttcatgatggtcagctccccaactcacccaccgcgcgatccccacagccctgtgcacgctcaccaggctgcagctccggctccnnnnnnnnnnttgaagtcatgcaattttcatgatggtcagctcccccttcccaaacttacccgccgcgcccaccccccagccctgcgcacgctcaccaggctgcagctccggctccggccggcgtggcagtgcaccaacacgcgcccgccccccgcccgcgcgccgtcgatgaaggcggtggccgcctcgatgtggggggtgatgtcctcctcctccacgtctcgcagggcgcagcggatccaggccgcgcccagcccctcgtcggggcccagaagatccttcgtggagcatcggtttggagggggtgctgatggttcacagggggggggcgaggggccggggggatcgcagacatggcggcgggggcccctggatcgccgtcggcaacaccccccttcccttgcaaggacccaccccattccacagggcccctcnnnnnnnnnngtcctgggtcgccgtcggcaacaccccccttcccttggaaggacccaccccattccacagggcccctcctcctcacctcggtggcattcaggatgtgggtgatgcccaggtggcgcaacgtgtgcatgctgctggcgcccaccgcgtccgacaggtacagcccgggcaggaggcacaggggccgggcggaggccagggacacctggagcacccgcaggcgctgcagcatgtgctccagccgcacctgggcgggggtggggaggcagggggggttgggggtggaatttggaagaagaatgcaggtgcggcagaagttcctgcacgctcacgaccggcaacccacctnnnnnnnnnnggggagtttggaagaagaatgcagatgcggcagaacctcctgcacgctcacgaccggcaacccaccttgagctcgtacacgtccacaaccggccgcacgccgtcgaggaagccggtggtgaggcgggacccggacgcgtcgcgcttctgctgccactcctccaccgcgccccgcagctcgctgcctgcgacacaggcggcgggggagtgaggggatcaggtgagaattccaaaccttttcaggaccctcgagcccacgcatgcgttcttccagctgaggctgccactgccagggcaatctgaccttctcactccattcaaatcaacttgctgtcacggggatatccctcccccccaaccctcagccacatcccaattacctctagcccggaacacgtcgcgccaggcggcgaccttgcgcgacaccgagtggttgtgctgcgcctcctggttgatgtgcctgatcttctgcgtggtcaggcccacgtccgccgatggggagtccgacaccagcgcagaggcgcggcggctgccggacggcgtggcagcggccgtggcccccgctccggcgcccaggctcgccaggatcgagggcgagaagccggagggccccgacgccgcgggaggcgccgtcactcctggcccagggccccagccgccgccgcaccgcccctccaccccgctggcactgctgatgagggcgcggggcggcgtggtggccgccagctcgaagctggactccatgtctgccaggaactcgtccatccagtcccgcaccacctcgtacatcatctcgaacagccccttgacggctgccagggactccagcgcagtcctcagaccctgtaaggcggcggagggggatttgggttggtgaaaggaggagcgggggagtgctcggcaggagactttgcgagggggacatgggatgtggtatatcagctcggggggaggggaccaggaggaaaccacaaccatgccatcttggcacatctgtgccggcaacacttgtccnnnnnnnnnnccgggtccagagcctcgccctccctccacccggtgatgctcagggcgttgcccaggacagcccccgccagctcagcgtcgttcagcgccagctcagcaaggcgctcgcacgcctcgtcctgcacgtggccgaggtgagatgctgttgctcgacggaggcaccccggcgcagcgcgtggccgcagtcggtggacccagaaccgcactcaggaccatctgctttgccccccaagccccnnnnnnnnnnggaggcgcggcggctgccggacggcgtggcggcagccgtggcccccgctccggcgcccgggcttgccaggagcgagggcgagcagccggagggccccgacgccgcggagggcgccgtcactcccggcccagggcccccgccgccgccgtaccgcccctccaccccgctgccaccgctgatgagggcgcggggcggcgtggcggccgccagctcgaagctggactccatgtcnnnnnnnnnncctcggaccccttttccatccgacacagcacctgctggaaggccgcgatggccgnnnnnnnnnntctcagacccttttccatccgagacagcacctgctggaaggccgcgatggccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatggccgaggtgagatgctgttgctcgtgggaggcaccccggcgcagcgcgtggctgcagtcggtggacccagaaccgcacccaggaccatctgctttgccccccaagccccaatcaccctgctgctcacctcagtgcacaccagcctgccgggcggcctcctctggaccacggcgtcaatggccaccatcctccccacccagcgccccgtccgtgcaaacaggacgttgcccaggttgccccgccaccccagcgcctcgatgggcagccggtcggcgttgcccagcatcatgtcgaggcacagcatcctgcgtgggatcaggttggtgaggtggttcgaggcgcaaagaggtcgcagcggtgctcgatgccgatgggtgctgcgatgcatgatttgtttgggatatggagattccagcaggctatcacgctgtgtgcctggagaagcccagcgccctgcgacaaaagcaggcacaccctcctggcctacaacctggcactctatcctccacagcgtctctgtctcactgtacctccgtcctcagaccaggcacactcctcccgcccactcggccagccaatgcaccaacgcactcagaccggctgactgaccttccgaggtcgtgtgagacgtgggccagggtcctgggggccaggaaaccggtctcgcaggccgtcgtgatgctgacggctgggataaactccatcacnnnnnnnnnncgggccagggtcttggggcccaggaacccagtctcgcaggccgtcgcgatgctgacggctgggataaactccatcaccagcacgcagctggaatggaagagagttgagaaaggaatggggcagtgatcttctagagcgtcacttgaaagggttggctgccaccaggggcacatccctcacctgcacctctgcagctcggcatgcannnnnnnnnngttctggagcgtcagtggaaagggttggctgccaccaggggcacgtctctcacctgcacctctgcagctcggcatgcagctccgggtatgcgccggagatggattgggcggcggccagcatcgctgcccactccggggccggacactcgtcctccgcatacatgaactgcagagggcttggcactgggattaggggattgggagggtggtgcaagagccgcttcatcaggtgggatgctgaaattgtggcctcccacaagagatctcgaaacgcactttcacatgatcccagcgatgcgcccgccttgcctgtcgaaggannnnnnnnnngtgaactgcagagggctgggcactgggtttaggggattatgaaagtggtgcaagagccgcttcgtcaggtgggatgctgaaaatgtggcctcccacaagagatctcgaaatgtactttcacatggtcctagcgatgcgcccgccttgcctgtcgaaggatgcgcccgtcggggcaggccaacccgacgtgccgggccacttccccagcaaacagctcagactggcactggaggcgggaggcggggatcttcagcaccaggcagccatgaggtgctgaccgcttggcgacggcgaggggggcattggcgccagggatgacctctatcacgctgggcgacacctcgcgtggccctgcgtcggtgcacgggggcgaaagtctcccattggcggctgcctcagccagcgctgactcgnnnnnnnnnngcctctatcacgccgcgcgacacctcgcgtggacctgcctcggtgcacgggggcgaaagcctcccgttggcggctgcctcagccagcgctgactcggcggccgcccgcagcgcctcctccgatgactccggccccggacaggggggtggggattgcctggggctacagctcccaatgtgcgcatctcttgcgttgaagagacagaagaagaccaggccgccggagttgatctccagggcgctcgcgccccggggcgtgacgggtttgtccccagcgctgtcctgcgccgcagtctgtgcgggcagggcgccggagctgtgcagctgctcgctggtacagcaggcccgcagcgctttccaaggcaccatgcctagccctgagtggagaagtgtgccggagatcagataccaacggggtagaatatcttggtgggtatagaaacgacaaagggcacttcatcaggaatatacaacttggctgaatgtggtccatcccaagcacacaacgcttccaaggggtcgattgtaaaaatatcatgcagtctgatgtgcctcatcaaacccaaatgtaactggagcggctcaccgaaaccctcatgaggctggcggccaaccacgtctcacctgtgggtatgggcactgnnnnnnnnnncacgtttccaaggggtcgattgtacaaatattatgcagtctgatgtgcctcatcacacccaaatgtaagtggagtggctcaccaaaaccctgatgaggctggcggccgaccacgtctcacctgtgggtatgggcactgcctgctggaggagctggcccaggtcctccgggtcggcctcgtcccgcctcagggtggtcttggcgggaaaggaaggggtcaccctccgggagacggggtagtcgcccttgagcccgagcttcggggcggcttcatgcagcagggctgccagctcggcggcgtcatccgggtgctcccccagccaccgccatgcggtggagcggggggacaggggagatgcctgcaaggggaagggtatggatcaaaattttggggatggtagacctgcgcgttggtttggtggacgtgaggcttcgctcgcaannnnnnnnnntgacaggggagaggcctgcaaggggaaaggtatggatcaaaattttggggattggtagacctgcgcgtaggtttggtggacgtgaggcttcgctcgcaaagcacttacgtgactggctcgctcggggctgtccaggccttgcatgacatcaagctggatcctcgcggcttccgctaaggtctcatcgatgccccttgacggcattacagaaaggtgtcaactgtcacatcctcattctaggtggggactgcgatcttgcgtgctaagggaactccgcggaagtgatctcagggtactcgggnnnnnnnnnntagaaaggtgtcgattgtcacattctcattctaggtgggaactgcgatcttgcgtgctaagggacctccgcggaagtgatctcagggtactcgggggtggtgcaaagggccaaatgtgctccgagagtgatatcataaatggataaactcaacaatactgcaggtcaaagcatcaattggctccgcgagccactgcagcattaagatctccagggcgcccacgaggcaactctggcgcgcaccaggtcaccgccactgtttgaagcgtgtgcacacactctacgatcaaaattgagtgatcagtcagcagggctccccttcaatcatgcaaattacttgagtgatcactatgtgtcctggaggcggcaccgcccgagctggcgtgccccgcaccgccgtgtcggagccctgagcagccgtcgccgtgatgggcaatgcggcctcggcgactactgccgcggccttggatgcactggcttccgtgacaggccctgcctctctgcagctggacgatgagacatggcagcccctgctcaccgtgtcgactcctctgtcacggtggtcagaggacgagctccaggccaccatcaggccctactgcggtgatctgggtaggtcgtcgggccagctggttactgcatgctctcaggaatacgttataagggctgtatacattctgcctcatgctggatactctgtatggcatttgttgcaccccagcggagtattctcagtctccagtgcacacatggtcgatgccacatccttctcctccccgctccctccccaatccacgacagtgtaccataactgtcagacgtacaacctgcagcgactcatcgtcctgctgtgccgtaagctggagggggcgagcaagcgaggcgctgatatggcggttgccaacctgctgtgcctgctgcgcatcctcctccaggacctcatggagcacctcacgccggcgcagctccaggcattcctgtcgtggccagccccaggtgcgaactgaatgagggctgctggtggaggtgtgatgtggctgtgactggaagtattgctcccgggtccagttggcctagaccgtgcttgaattcgtgcacccatgaaaatgcaggcctcctttcgttctcttgcttggacaacagcagagcagtgcctcacatcaccccctgcacaggctcccctcacaaggtggctgtggagcgagatgcccaggaggaggagcaaacgcccgtggagcagcagctggtgggggcttgcctccgtgcgctggtggcccgcaatgatccggccgcgaggtcagtttggtacactggtttcagggaatgagcggagctcgctgctttgtcttcaagcgggtgggacagctgtctgcatgtcctgccatatgagagtgtgctgagctgcagtcgtttacctcccccggcaacccattccgccaactctaccttgcctcgtctcgttcatcctttccgctgaattcccaaacgtcgcacagcgctggcgagtacctgacgcagttgcacctgctgcagctgctcttggtcatgctctccacccagctgtactgccaggacctggatgagcaggggctggaactcccgctcctggccgctgtgcttgaagtgagttcctgacggttgccctctggtttgcagatgagtttgtgtatgaactttgcgacctcgtgacatgcacgagctcgcttcctggcctcagcgcctcagcccctccttcctgtccctcctctcccgccagcaaagcgaggtggacccggtgtctgtggtagaaacactgctgaggctggtgatcgtgggaccccaagcccctctgggcctccggctcttcctcccgacagacacacgggcggtactgcgtgctgtgcgagctgctgcaagtgggtcgctcgggccgggattggcaagcactttcaacctgtctggcctggcttgagcaattgatgccctgctaccataccatatcccaggcacgagccccaggcatgctcttggatgcacagccacacgtgtacctctcatcacacccatgtaccaagccctccttcccgcaggcagcctcgtgtggctccccatgtcggccttctccttcctcctgcggcggcagccggcggcgccgggtcagagccccttgggcctgcatgcctgccttctgctcctcacgctgtgcttccacgcgctgcccggcgagggtgccgagggcgcactgactgtacgcacaccggggccctaccgcctcgcgcttcatggtctgcgagatgccgacgatgcaggtgtgtgggcgcaggaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgcacatgctgcgcctggcggaggcatgtgccaacttccagatgcagtgacccctccgtgcataatcgcacgcatgcgcccgcccatccctgtttgtccttccttccaacccccactctccgtcttcgtgcggcagaggccacggcagccgccgccgaggacgggcgaggcgcgctggggcgcggcccacgcgcctccttccccgccctcttcgcgtgcctgacccgggagcccgtggcccccccggagaccgcgctgctgctgtacctcgtgctgcacaacggcggcgacttccgcggctactgcctggcccgcaccgaccccgaggccctgctgctgcccctgctgggcgcgctgcagcgcgaggacgcggggcggggggaccgcggcgccgtgtacgtcctgctcacgctgctgctcgcgttttcttcggatgcgggatgggccgccgccctgcaccgcgtctggctggaggtgagggggtggcaagggggtgggctgggtggctggggagcgggcggggccggcgattgggcccgcagggggttgccgtgcttcgcgggtcgtgctgtgggagaggggcagcggtgacgtgcctgctcgccgaatctaaaccccctctcctcccccccactccccatcgcaacaggccaccccactctggctcaagggccgggctcgggccaagcagccgctgggcagcctggcgctgtcggtgctgctgcgatccgcgcacgccagtgtggcgcggcacggcgacgccttcctccagaccaacaccctggccgtgctcgccaacctggcgccacacgtgacaggtgcgcggggggcttgttgtgaggttcagatgaggagccgggcacgaccagcgcgggtcccgggtgtatgcccgggctgcaggcagatggggcctgcatgcagacagtttctcgaggagcagtgctcatgatacccatcctgattcacaccaggcctgacctccgaggcggcgcagcgcctggtctccctgctggccctgctggcgcggcgctggcgccggctggcggccgacgctaccgggcttgggacgatggcggcggccgtgggcgatcctgccacggcagccgacggcaccccggaggcgacgagcctggccgtctctgagtcaacctccgcggccgccgccgagtctgcgcagctggcgcacgacttcctcaggatggccctggaaagcgcgagcgcggtgctggagcgcgcgctgccggccaacccggcgctggtctacgcgctgctgcaccgcggcgagctgtttgaggggctgccgcgggacgaccccggcctgcgcgtccccctggccaacatcctggccgtcatcgatcacttcacgcgcgccctggcgcgcagcctgggcgagggcgcggcggcgctggatgcagggacggtgatggcggccatccgccacgacagccgggcgtggcggggggaccgcctgcagcgtggggccgacctgcattttgcatacgaggaaggtgcggaaaaggagtgtgtggggaggtgggtcataagggggtgctgaagtgagacaggtgttgtgggagagagtgtggtgcgccagcctgatgcaccagggcacggctccgtggcgatgctccatgggccaggcggaagtctgataggggcagcgagaacccattagtttgcccactgacccggcgtgcatgccatgacccattggagtgctgctatcacccagccactccgaccccgatgccggcaggcctgcaagcgcactccttcttcgtgccatgcctgtgggcgagggtggtggcagcctcctccctgtcctgggacctggacgccatcagcctcttcacccccgagggtgcggtgggctgcagtatctaggatcaggatggcccaatggtgtgcgggtttctacattctgcagccgttcccctgtgcaacaagaatcttctgtgcctgctgcatcctgggggcatctgtgtgcagcgccaagggtgtacatgacatcatccagaacaattaactgcatggctcttctcccttctcaagctcctggacccagacgtcaccctgcctgcccgcccacgtttgacgtaggtgcggccgtggaggacgggcacgaggctcactggacgtcagaggaagccnnnnnnnnnnatttgacttaggtgcggccgttgaggatggacacgaggctcactggacgtcagaggaagccgaggggcaggtgcccaccgtcgtggtcgcgccatagccacccagcggcactccatgacccaagcatgtggcggaggtggcgcctggaagtctggcgggcaccctgcgccctcgtgtgacgcgctgtcccattgtagaggaggcctcaagggcgcgtaggcctgcgagacccttgcggccagagatcaaagtgcaatgtaatgttgcgctgcaggcgccacaggacggccctgccgagggcgcctggcgtgccatctcccctttcgctgtcacaactcttagtaaccgccccctgcctgctgacgaggcgtgggtactccacacatgtacacacaagaggggagtgcagcagggcagcgccagtcactcctccgtgtcgttctcgtcaggaaagtcccctgccaacttccccccggcttcccnnnnnnnnnncagtaagcgtcccctgcctgctgacgaagcgtggggactccacacatgtacacacaaggggggagtgcagcagggtagtgccggtcactcctccgtgtcgttctcgtcaggagagtcccctgccaacttccccccggcttcccggatcttggcgcaccgctcctcatacgacggctcccggacgcgctgcagcagcggcacacgctcgccgtgcctgcgcgccctcctttcccgcccggcgctgggcagggcgcactcgtcctcgcccagcttggtcaggatctctgacagcagactcgcccgcaccagatgactgcatggggtgtgcgccggcaggggttgaaaatggcaagtgtaatgttcaagtgacaacgatagaagtgagccgagggaggannnnnnnnnnggacagcagactggcccgcaccagatgactgcatggggtgtgtgccggtaggggttaaaaatggcaagcgtaatgttcaactgacaacgatagaagtgagccgagggaggaaggaggggaggatccaccatttgatgtcacaatgtagaccgggaaagcacgtccagagtgagtgcaaaccccccttgcggcaccatccaatgcacagacttgcagctggaagccatccacgggctcctcctacctcaccgctatctctcacaccaccctgttcccgcaacacccgcacacctgtccagcgcgcggcccannnnnnnnnntcgtcaccgccatctcccacaccaccctgttcccacaccacccgcacacctgtccagcgcgcggcccaggaccttgcagacctggtcccggttagcctcggtgcgtaggaagcgcagctcccccggcgcatagcggcaccccgacagcagtagcggctcctcgctggccagtccgtacagcggcttggccgggtgcgcccccacgtccagcagggccgccacgacgccggggtcctccttcccgcgccccaccatgagcagcaccgcggccatgcaccgcacctggtgccacaggaaggcggtgccgcgcagggaaagcaggaacaggcgccggccgccggatgcggggccggcggcctcgatccggaagtccaggatccggnnnnnnnnnnagtgccgcgcagggaaagcaggaaaaggcgccggccgccggacgcggtgcccgcggcctcgatccggaagtccaggatccggcgctggaagtgcttaacctgcgccacgtccatctggtgttttggggggatggggggaagggggggtgcggggtcacaagtaggatggtatgtagggcatggcgtcggtacgggctctgaggagcgcccagaggggtggctcctgctgcggtgggcgtcctggggcgagggagggcctgccagtacgtggggcacccatctgccttgtagacagatccccgacgcatccacacgctcacccgagcgctgttctccccaccttgacccggcattgacttcatgtgcactttcaaccatagccaggtatccatttcatcaaccacacacacctctgggtgccgtgactctccctcacaccaatgcaggcatcaaacccggacctccctccaccaagcacgcccgctgaaccttgcaaaagttgcgaaagtcgtggaggcccaggaaagcggaccctgcggcctgcatggcggccaggtccagcgcctcccccggctgcgccaccacaaagtacttgtactcgcgatgtgtggcgctgaagcgtgcggaaaagtctggagaggtcggcgggcaccagcccgtgacccgcacgtcctctggcagcgcgcggttgagcaggcccgggtagtccagctcctggccggggtcggggaggggctcgcccacccgcgccgagctgcgcagctccagggccaccacctggccgagggcggagacgccacggtctgtgcggcccgccctcgagtaccgcagcgactgccagggggcggagaaggggatgaggcgggtccgctccagggccgagaagagccgtgcctggcaggtggtgggaagagatgggggggtgtttcagggtgagaatgtactggaaagggaaattgggtccaggggagggactgcgggggctgcccaggccatagaaaacaacttttggcagcgaagagccctgtgccgagacgccgccccccccctcccacgccgacctctatagtgttcgaggagctctcctggcgagcaaaaccatcgtaggcgtggcccaggtatagaatctccagcgcaacgtaccgggtctggtagctggcaaagtccaggtcgggttttgtgcctttggggatgtggggaatttggtgcactcatgtgaagcacacattcaaatataaatagtaaggtgtgagctttgaacaggacatgttgatctcacatcgcatcattcttgtgccacccttttggcacccttcgtgcatgcctcatctgaaggagtctgcccaatgccaccagcagcgcacgcgcacctcgtcgcttgcgggtcggagccacgtcattctttgatacttcaggctgtggcaactcgttggtgacgacagggggcgcctccaggcgnnnnnnnnnntatgccaccagcagcacacgcgcacctcgtcgcttgcggttcggagccacgtcgtttttggatacttcaggctgtggcaactggttggtgacgacagggggcgcctccaggcgtgcagcaatctccctgaggcgggctgccagctgtcctcggtgctctggctggaaagggactcccgggtacagggcgttgtacaccgcccagtcctcgcgctccattcccgtcttgctcatggctctcacccctgcccagccgcgagcccttctggtcaggcgaacgtacgaggcaaaattcctcaatcccagcataggtggaccataccgacgagggcaatggaagcaccgcgccaggacgaacctggtgtaatctataatgggtacttcatgtatgctgcattgctgaatgccccgnnnnnnnnnntgagggcaatggcagcaccgcgccaggacgaacctggtggaatctataatgggtatttcatgtatgctgcattgctgaatgccccgattaggggggttcctgctgcgatgccagtggacatcgcgcccgatgttgtatattgagattttgtggcgccggcgcctgctcaaaccagaccgatgtgtctatgatacccttctgacctttgtggaattccaggcaagcgcggcctcccacatggccccc

SEQ ID NO: 44718 - DNA, 61 bp, Chlorella protothecoides
agagtatctacagtatcaaattcaaatttgctttctttccatacttcacaagctgcagcta

SEQ ID NO: 44719 - DNA, 61 bp, Chlorella protothecoides
gaccctgcgcttgggtgagtgcatggcggggggcgaagtgcaaggctgcaagcaggttgat

SEQ ID NO: 44720 - DNA, 61 bp, Chlorella protothecoides
ggggctgccgctgctggccgcatccgcagacgcccggcatgtcgacccggtcgccgcagcc

SEQ ID NO: 44721 - DNA, 79 bp, Chlorella protothecoides
gggtggtgggcttggcggacttgggggtgggggtggaggaggcgattttctccagtgcgtgggaggtaagggtgactca

SEQ ID NO: 44722 - DNA, 63 bp, Chlorella protothecoides
gctgcgatcatcggcgacgagcggcgctccggggctgcgatcatcggcgacgagcggcgctcc

SEQ ID NO: 44723 - DNA, 61 bp, Chlorella protothecoides
ccatctaccagctggcaccggatggcgaggggtggatgctgcacaagtacctcttcactcg

SEQ ID NO: 44724 - DNA, 753 bp, Chlorella protothecoides
  modified_base (118)..(355): a, c, t, g, unknown or other
  modified_base (452)..(666): a, c, t, g, unknown or other
cccggcgcgaccctggcggccgcgcagcagcaggccgcggaggccgcgcaggccgcacggcgccacgcctccatgctgcgcagcctgagcgagatgagcctggagggcctgggcgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcgctctggcccccggcctccgcgcccggcgccggcgcgggcccggccaactggagcgacgcgctgctgggcggcgccggcaccggcggcgtggccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgacccagcagctcctgggcggcggcggtgcgggcgtgggcctgcagcccggcgcgcagtatggcgacgccgcgggcggcggcggct

SEQ ID NO: 44725 - DNA, 61 bp, Chlorella protothecoides
ctggtgccatgcggcttgccggcctggagggggccgactgcttgcaggagatgaccgggct

SEQ ID NO: 44726 - DNA, 61 bp, Chlorella protothecoides
tgaagggtatggatggcgacgacggcgaggggccctccgacggtgtctccggcatccaccg

SEQ ID NO: 44727 - DNA, 61 bp, Chlorella protothecoides
aaagtcgggcccaatctgtgcgaagatgggggcgctgtagggcttgatgagagatacttgt

SEQ ID NO: 44728 - DNA, 68 bp, Chlorella protothecoides
gcgccggcggccagcagcagtacggcgccgtcggccagcagcagtaccagggcggccagcagcagtac

SEQ ID NO: 44729 - DNA, 2402 bp, Chlorella protothecoides
  modified_base (414)..(526): a, c, t, g, unknown or other
  modified_base (618)..(851): a, c, t, g, unknown or other
  modified_base (1007)..(1016): a, c, t, g, unknown or other
  modified_base (1170)..(1316): a, c, t, g, unknown or other
  modified_base (1549)..(1558): a, c, t, g, unknown or other
  modified_base (1861)..(1870): a, c, t, g, unknown or other
  modified_base (2319)..(2328): a, c, t, g, unknown or other
cgggccgcgccgcgctctccttcgtcgccgtggacgcgctggcgcggctggtggcctgcctcgcgcgcgagcacggcggcggcgccgcctcgctccgcaccgtgctggacgtgctggccgccgtcctgctcaagtgggtcctggtggatgggtgttgttggggggggaggaggagaaggggtgcatggttgcagtcggcgaggcgtcgacggggagaggtggactcggggaggagatggtgggcggccacggagggcgcccaggcgatcatgcgccgggaagtgcgcgcccgtgcctcccggcatgcatcggggatgggcggcgcggcgcgccccccccgcttccgcaccccgtccatcccctcgccacgcgcccacccctcttcagggacgcggacgagcgcggcgcggcgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgaggccggcggcgctgcgccgggcgacggggccgcccgactcgacgccacccccagctcaacggcgctggagtacctggaggcggtggcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacgttgggagggcttggatggcagccgtccggcacggcgtggggatgcctgtagtccctcgaccacaggcaacgtgccggtggggtgcgccaaaggtcgggggccaggctgtcgaggatgggtgggctgggtcggcgcatgtggagatgggtgcgnnnnnnnnnngcggcgcggcgcgcccccctcgcctccgcaccccgtccatccccttgccacgcgcccacccctcctcagggacgcggacgagcgcggcgcggcgttcaacggccggccctacttccgcctggtggtgggcctggtggccgagctgggcgcgccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngccttcctcttcgcagtgcgcccgcagcgcgccccggcctttgccttctcctggctgcagctggtgggcgagcgccggttcatgccgcgcctgctctccgcgccgggccaggccgggtgggggcccctgctccagctcatcctctcgcaggtgcttgaaaatgagtgtgtgggttggtggtagcgtgggggtggggtggggtggggggcgtgatctgcttgtacgtggacgtnnnnnnnnnngaatgagtgtgtgggttggtggtgggtagggggggggcgtgatctgcttgtacgtggacgtggtcgcgatgggagggcttggatggcagccgtccggcatggcgcggggatgcctgtggtccctccaccacagccagcgtgccggtggggtgcgccgaaggttgggggccaggctgtcgaggatgggcgtgctgggtcggcgcatgtggagatgggtgcgccgagtgcatcatcgcgtcggcgccattctctgctcgcctcgcctgcgcatacatatctgacccccccccccccccccccccnnnnnnnnnnagcccacccccgcccaccacatcaaccccccgcaccacacacacacacacacacgccagctggagttcctggagccgctgctgggcgccggggagcagaccgacgcggtgcggcagctgtaccgcggcacgctgcgcgtgctgctggtcaccctgcacgacttcccggagttcctctgcgagtacgccacgcccctggcctcggccgtcccctcccagtgtgtgcaggtgagcgaggagaagttcttttttgggggggggtccaccggacggggtgtccctggcaaatgggaagcagacatgcattggcgcctgtcctgtcgcgcgcccggcgaagcgccctgctggtcggcgcggcaggcggtgccacgtggccgcagctgcgcccctgcccgtcccgtgcctgcccgcccatcctgcccgcccttctttcccttcgcgccccccccnnnnnnnnnntgccacgcccctggcctcggccgtccccgcccagtgtgtgcaggtgagcgaggagaggttggggaggggggggg

SEQ ID NO: 44730 - DNA, 61 bp, Chlorella protothecoides
caagcacaccctggcaacagttacggctggggattccagcatgtcgcatgacataatgtgc

SEQ ID NO: 44731 - DNA, 93 bp, Chlorella protothecoides
gctcgaacacgtggctgggcacctccatcatgtccagcgggccccgcgtgcctgtgagcgcgcgggggggggaggggagagacgacggggttg

SEQ ID NO: 44732 - DNA, 61 bp, Chlorella protothecoides
tgaaggtgttactcgcaatggctgcctcgggctcttcttcccggggcctttcccagccgcc

SEQ ID NO: 44733 - DNA, 61 bp, Chlorella protothecoides
tgaggcagcaatccggaaggtcgaagctggggcggaagatgtgcctgcccgtcacaggccg

SEQ ID NO: 44734 - DNA, 61 bp, Chlorella protothecoides
ccggggccgacccgaacccgaaggcgggggggctgctggccccaaacagggatgcgctgct

SEQ ID NO: 44735 - DNA, 86 bp, Chlorella protothecoides
ccccccccgccgagggctgggagggcgacgctggctcagcacactgcgccgccccaccctacccggccgcacatcccatgcccgcc

SEQ ID NO: 44736 - DNA, 61 bp, Chlorella protothecoides
tcgaggttttagatcgccgagtgctcggggggacttcctctgtcgcaaggagggactcgaa

SEQ ID NO: 44737 - DNA, 61 bp, Chlorella protothecoides
gctcgtagaggtgggcgaagagcagcgaggggtaccccgggggcgggaaggcgacggccgt

SEQ ID NO: 44738 - DNA, 61 bp, Chlorella protothecoides
aaccggcaaggtgggtggagatacggtgggggtgatgaggcatcggcgaaaagtgccattt

SEQ ID NO: 44739 - DNA, 61 bp, Chlorella protothecoides
cctttcccagcgctgctccccctcccttgccccccccccctgcctattctcaccaacgcct

SEQ ID NO: 44740 - DNA, 61 bp, Chlorella protothecoides
aggtctggacgcagcaccggcggcgctggggggagttcttcaaggccatcaactgggtggc

SEQ ID NO: 44741 - DNA, 61 bp, Chlorella protothecoides
gagtggggccagcggcgtgttcacggatgggggcaccgaccgcttcgaccccctgctcctg

SEQ ID NO: 44742 - DNA, 61 bp, Chlorella protothecoides
tgctattaggagggaggcccggggggggggggggccacgggccacaaccctccatgctctg

SEQ ID NO: 44743 - DNA, 61 bp, Chlorella protothecoides
gagtagaatctgggttcggctgtggatggggcttgacgaaggagaccgcgggggggatgtt

SEQ ID NO: 44744 - DNA, 61 bp, Chlorella protothecoides
tccaacagacgcagcttcctcagcgtcggggccattgcatgaatcgacgatcacattatta

SEQ ID NO: 44745 - DNA, 163 bp, Chlorella protothecoides
ggggggtactgtggacgcggtgccccagcccccgcacgcacaccccggctgccgtgagtgcacgatggtcccacaccgcccattgccagggggggccggccgccgggccaccgccgccagccctccacctccgcctccctggtctccacccctcccctcgccc

SEQ ID NO: 44746 - DNA, 762 bp, Chlorella protothecoides
  modified_base (157)..(166): a, c, t, g, unknown or other
gggggttgggagcgctggattcgggggggggcagtgggggggtcagggtgcgctgttgtgagggcgggaaggggagggagggatcggtgtggaccgccgcttcccctctcagacctcccaacatggcgagacggtgttgcagtggcctgtgtgccgnnnnnnnnnngtggggtgtgcgctgttgtgagggcggggaagaggagggaggggtcggtgtggaccgtcacccctcctctcagacctcccatcatggagagacggtgttgcagtggcctgtgtgtcgggaacccaccccagaatctgttccccatgctgcctcggggccccccacccatccaagccctggccctcggctctgcctcttctcaaagctgaacccccttccacaccccccccctcaaccccacaacaacacaaaggtgccgccacgtgcgacgcgcaccacatgacggagccggagccgagcgggcggggcgtgcggttgtgcctggaacgtggcctggcggccgcaggtgtggcccctgaggaggtgacctacgtgaacgcgcatggcacctccacccccgccggcgacgtggctgagttccgggccatccgtgcggtgctagggcacgacggcctacgcatcaactcgtccaagggtgccatcgggcacctgctgggcgcggcgggggcggtggaggcggtggccaccatccaggcgctgcgcaccggctggctgcaccccaacctgaacctggacgagccggacgagggcgtgga

SEQ ID NO: 44747 - DNA, 3426 bp, Chlorella protothecoides
  modified_base (788)..(797): a, c, t, g, unknown or other
  modified_base (1165)..(1262): a, c, t, g, unknown or other
  modified_base (1936)..(1945): a, c, t, g, unknown or other
  modified_base (2222)..(2231): a, c, t, g, unknown or other
  modified_base (3294)..(3364): a, c, t, g, unknown or other
gagcctcattcccctcgctgggtgaatcaccctggaccccctccccggacccctgcaagtcttccccccaacccccctacccaccccaacacacacactcgacccaccctgagcatgtcgaggagctcgaagcagatgcgcatccactcgcgggcggggacgaactctgcgccgcggtcggcgatgcgccccaccaggtcgatgcagttctcctgcaccttctcgtgccggttcttcaggatgggggtcaggcgcgggagcaggtccttgatgggcggcgtcatgcgcgtcatgccgatgacgttgacgatggccttgagcgcgcccagcaccgaccccagcacgtcggggtactcctcccccaggttctcgtacagcaccacgcccaggtgggccagcaggccctcctggtcgcagcgcttcatgacgggcgcgcagcgcgcgatcaggtcggcggcctgctgccggatcttggccgacttgttgttcagccgccatttgatcacgcccgcgatctggggcaggtagggcttggcacgggtgcccagcgcgttcaccacggtgccgaagccgttgaggaccacggggctctcgtcagccacctgcgggaggtgttggtgtttggtgtgtttgtcgactggaccatgtgtgtctgaagacttgtgtgggacggtcaggggcaggtgcgcgctgtacaatgccccgggcccctcttttgtgttctgtcctctgtgcccagcgctcaaggtcacaccaccacccactgtgcccccaccatcccccattannnnnnnnnntgtttggtgtgtgggtcgactggaccatgtgtgactgaagacttgtgtgggacggtcaggtgcaggtgtgcgctgtacaatgccccggccccctctttgtgttctgtcctctgtgccgagcgctccaggtcacaccatcacccactgtgcccccaccatcccccattaccccccccctagacgcccagacccccaccccccacacctgttcctggaaggcgtagagcacgccgtcaaagagctgctcctccagggctgcgccgatgtcggcggtgcccagggacgcgatcaccttgtccaccgtctccatcaccatcttccggtacggctccgactcgtccttcaggtcctccaccacccgccccacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntagttgcggcggtccagggccatgcgccgcacccaaaagtgcttgaagaactccggcagcacctcggtgcggatgtagtcgggctccacgccctcggtcgccacgcactgcttgaccacgcgcagcacgatcttcttcatctcctcgtcgggcgtggcgaactcgcggagcagcaccaccatcacctcccgcgtgtagtagttggcgtacatggcgtccatgagggggatgatgaagccgatggccttgaggtaggctgccagcaccttgccgcgcagcaggcggatgcccttccacagcggctccagcacatcgtcgaaggactcgatgccgtagggcgcggccgcctccgccagcgcggagacggtgagcgcggtgatggtcttcaccttctggttctcgtcggccagcccgcccttgacaatgtccaccagggcgcgcaggtggggcagtacagcgcagcccatgaggatgctgatctgctgcacgatcttgatgcccgtgtgccgcgcctgccacgacttcttgcctgggagggagggtgattttttgtgtgtgtgtgggggggtggatttaaggggtgcagggtgcgtattcaaagatgtgggggacaccgggttgtaaaggtgccagggggattgtgctctcgaatggcaggcaaggaatgcgcacannnnnnnnnngtgtgtgtgtgggggggggtggatttaagaggtgcagggtgcgtattcaaagacgtggggcacaccgggttgtaaaggtgcgagggggatggtcctctcgaatggcaggcaaggaatgcgcacagggcggccgcactgctcctgcatcccttcaaccattgagtggcccgacttgggggggggggtctcaatacaaaatcaataaccccatgccaactccctcaaatttcctcactctggcagacagccttcaagaaaggcaacagcgtgggtatcnnnnnnnnnnctgagtggcccgacatcgggggaggggggtctcaatgaaaaatcaatcaccccatgccaaccccctcaaatttcctcactctggcagacggccttcaagaaaggcaacagcgtgggtatccccagggcgctggcgacgacggagaaggcgcgggcggtggtgttgcgcacgtactcgtccacgttgtcgatgtcggggcgcatggcggcgatcatggaggccagccccgcagctttggccaggttggcgatgatctcgcgcccctccacgcgcgcgtagtagtcctcgtcgatcagaagcggctcgatgaccaccaggatcttgtgcacaaaggggcgcaccaggtcgtccagcttgaacagcacgcggtcgatgactttgaccagcaggtggcgctcctggtcctccagcgtgggcgacatgagcaggggcaggatctggttgaacagcgcgcccgcgccaaagtcgcgcgccttgtcggtcagcgcccgcagcgccgacttgcgctgcggcggcgtcccgttcttgaccttgagcaggagcttcatgatgcgccgctccttggcctcctccacgctcagctcgccgtcgtccacctcctgcagcagcttgccaaagtactgctggtcctcgggcttgaggtcgggcaggccctccagggcgatgggcacgtcaaaggcctggccccggtcctcctcgggaatgccatagagcggggtgccgccgtagggcgtgggggtcgccgccagcttgcgcgccggggtgcggataggctcgtacccgggcggcgcctccagcacacggtacccgtcgccggcgccgggcagcagcgcgtccaggtcggcgtcgctcagcgggcggttgcgcgcctccgtctcgcgctccaccttgagcgcgtggtacagctccggggtcattggcacgcccgcgcccgccccgggcgccccctccccgccccaggcgggcgtctccagccccgccgcgccaaggggggtggcgcccgtgccgtagccgggggtggcgccgtaggcgggtgtaaccccgcccgccaccgcggcgggcnnnnnnnnnnnnnnnnnnnnnnnnnnnnnnnnnnnnnnnnnnnnnnnnnnnnnnnnnnnnnnnnnnnnnnncggctgcgctttcctcccgccgcctcgtcgacgggcgtggcgtcccagcgattgcgccgtgc

SEQ ID NO: 44748 - DNA, 61 bp, Chlorella protothecoides
accgcctcccagcccgccgccctcaccgccgccaaaccctccgccatcaccgcctccaagc

SEQ ID NO: 44749 - DNA, 61 bp, Chlorella protothecoides
agaagtgagggatccatcacaggcttgaggggagggaccaagcaggggcaggctcgtttgt

SEQ ID NO: 44750 - DNA, 61 bp, Chlorella protothecoides
ccatgtgaacagcaattggacatgggtgaggcgatcctaagagatggggtagtcctgtgtc

SEQ ID NO: 44751 - DNA, 61 bp, Chlorella protothecoides
caacttcaagatgagtagagatgctgagggggcatgcacccggcgcgatgtctattggttg

SEQ ID NO: 44752 - DNA, 61 bp, Chlorella protothecoides
ctgctggaggcggagcagctgccggccgaggacgccggccggcgccagtccatcctgtgca

SEQ ID NO: 44753 - DNA, 61 bp, Chlorella protothecoides
gtgcttagaaaaacaatatagaaagggtggaatttcaaggttgcctttttttatcaaggct

SEQ ID NO: 44754 - DNA, 61 bp, Chlorella protothecoides
cgagtgcggcgacgccggggcctcggaggtccccgctggcctccgccccggagcgcggccc

SEQ ID NO: 44755 - DNA, 61 bp, Chlorella protothecoides
tggccgccgcgccggcggacgcagcggggggggggggcgggggcgccgcgccgtctggcac

SEQ ID NO: 44756 - DNA, 64 bp, Chlorella protothecoides
gggcctgaaccgggagccgagcctgggtctgggaggggagcgggaggcgtctcaggccacgccg

SEQ ID NO: 44757 - DNA, 61 bp, Chlorella protothecoides
gcagtccagacaaggtgtgtgggggggggggggacctgcgtggatgtcatgtcctaggagg

SEQ ID NO: 44758 - DNA, 61 bp, Chlorella protothecoides
gaacccgatcctggatggcaacggctcgggggaggggggagggctcgtacggcagcatgtg

SEQ ID NO: 44759 - DNA, 68 bp, Chlorella protothecoides
ggcactgcatgcatgcgccagggatggcaaagtactgttcccccccccccccccccccccaccccccc

SEQ ID NO: 44760 - DNA, 61 bp, Chlorella protothecoides
atcacccctcccaaatgtacggctcgctgggtttggaggaaagatcctcgtatcgcttgga

SEQ ID NO: 44761 - DNA, 78 bp, Chlorella protothecoides
cgccgcgccaccgccagcgccgcggctcggccagcggcgcgctccttccgcacgcggaaggcggcgcgggcggccttg

SEQ ID NO: 44762 - DNA, 61 bp, Chlorella protothecoides
ggcaccgaccccgcggtgggtgcggcgggggccacgttgttctccagcggcgcggcggcgg

SEQ ID NO: 44763 - DNA, 77 bp, Chlorella protothecoides
acgccatcaccgactcgggggcaggtgacgaagcgcggggcggtgacgagggcgacggaggtgccaaggccgcggac

SEQ ID NO: 44764 - DNA, 93 bp, Chlorella protothecoides
aaaaaataacattaagtttattttgggtttgtcctttatataccttataataaggagttaaaatagtaccattagaagctttatgcccaaaaa

SEQ ID NO: 44765 - DNA, 61 bp, Chlorella protothecoides
tttggttgcttggtggggaaatggggggggggcctggacagctgcatgcaatacagggtga

SEQ ID NO: 44766 - DNA, 61 bp, Chlorella protothecoides
ccggcgacctcaggatcaagcagtggatgggggaggtgagggagtgatggtggtgagggaa

SEQ ID NO: 44767 - DNA, 61 bp, Chlorella protothecoides
aggtaaggagaggcggtctttcaggctgggggagggctgggatggacgctgtaatggtgat

SEQ ID NO: 44768 - DNA, 61 bp, Chlorella protothecoides
tatgtccgtatcctgaagatagcgatggggggttgccgagcctccaggtgaaaatcgatca

SEQ ID NO: 44769 - DNA, 61 bp, Chlorella protothecoides
ctggctggcttgctggatgggcgatgggggggtttatgacgccagggccagggcttcgatg

SEQ ID NO: 44770 - DNA, 61 bp, Chlorella protothecoides
cctgtctgatatctcagggttcatgggggggggtcagccgatgcccatctgcctcacgttt

SEQ ID NO: 44771 - DNA, 61 bp, Chlorella protothecoides
tgatgtcacgctcacgctgcgcatcggctgggatcagcaacgcgtttgagcggggcacgga

SEQ ID NO: 44772 - DNA, 61 bp, Chlorella protothecoides
acccgtgccaggtatgagtggcgactggagggcgcacctgtctggccgggcacccgctgct

SEQ ID NO: 44773 - DNA, 22034 bp, Chlorella protothecoides
  modified_base (109)..(141): a, c, t, g, unknown or other
  modified_base (217)..(226): a, c, t, g, unknown or other
  modified_base (583)..(592): a, c, t, g, unknown or other
  modified_base (756)..(765): a, c, t, g, unknown or other
  modified_base (1244)..(1253): a, c, t, g, unknown or other
  modified_base (1308)..(1317): a, c, t, g, unknown or other
  modified_base (2343)..(2380): a, c, t, g, unknown or other
  modified_base (2458)..(2467): a, c, t, g, unknown or other
  modified_base (3331)..(3340): a, c, t, g, unknown or other
  modified_base (3521)..(3530): a, c, t, g, unknown or other
  modified_base (4168)..(4177): a, c, t, g, unknown or other
  modified_base (6460)..(6469): a, c, t, g, unknown or other
  modified_base (7454)..(7463): a, c, t, g, unknown or other
  modified_base (8388)..(8397): a, c, t, g, unknown or other
  modified_base (9357)..(9366): a, c, t, g, unknown or other
  modified_base (9914)..(9923): a, c, t, g, unknown or other
  modified_base (12415)..(12496): a, c, t, g, unknown or other
  modified_base (12792)..(12801): a, c, t, g, unknown or other
  modified_base (13043)..(13052): a, c, t, g, unknown or other
  modified_base (13284)..(13293): a, c, t, g, unknown or other
  modified_base (13576)..(13585): a, c, t, g, unknown or other
  modified_base (14100)..(14109): a, c, t, g, unknown or other
  modified_base (14862)..(14871): a, c, t, g, unknown or other
  modified_base (15996)..(16005): a, c, t, g, unknown or other
  modified_base (16376)..(16385): a, c, t, g, unknown or other
  modified_base (16803)..(16812): a, c, t, g, unknown or other
  modified_base (18202)..(18211): a, c, t, g, unknown or other
  modified_base (18429)..(18438): a, c, t, g, unknown or other
  modified_base (19257)..(19266): a, c, t, g, unknown or other
  modified_base (21619)..(21628): a, c, t, g, unknown or other
  modified_base (21806)..(21956): a, c, t, g, unknown or other
ggaggggagccagcgtgaagccgtgctccacagctgtcatcagcgaggcgccaacaggctcttggatctgtgcttcagcaatggcggcatctacagtgagtgccggtgnnnnnnnnnnnnnnnnnnnnnnnnnnnnnnnnntacaccaccctaccttcactgcgagccggcggccgtcaaagccggtggcttcgtggacctgtgccaggctggcggnnnnnnnnnncaataacatggctcttttatttgctccgagcctggaccaggaatctcacaaaacatgcacatatgcaagctggtgctcatcctgcatcaagctgctgcgcctcagtctcccgattccctcctttacacaacccgcagtcaagcttggccagcatgtggcgatgctggaccacctggtcccagcagagtacgtgcagaccatgcgcaagcacatgctcaaccgctgccccatcagctcctgggaggaggtggccggcattgtgcgcgaggacttgggcgcgccgcccgagaagctgtttgccagcttctcgccggctcccctggcgtccgccagcctggcacaggtccacgaagccannnnnnnnnnctgagatccctggtccaggctcggcgcaaataaacaagccatgtttttcacaagtttgagcaggcctgcctcaacgttgcatgcctacaatgcctcctgtgcatcttgtaccctcccccccaacacacacacacaccggcactcactgtagatgccgccattgnnnnnnnnnncaggggtcggaggaatacgccggcatgctcggtagcaatgctttgcgtgaggcaggattgaaggctgccggggctctcccagagacgcaggtccttgaggttcagcatcaggtatactgacggccatcatatccatacaaaccagacatactcaggatccacctccttgactgtccctgcctcaacaggtgcagcaccggggcttgagagagtccagctctgcagacctcgccacgctggcaggtctcattaccatcgtcaagtggctcgccccggaatttgactacggctggctgattgaggaggcgcgcaagaacgtccccaagggtgcgtgcgggtggcaggcgagtgtgcacggcgcctgcaccctggcagagagcggggcacagcgcatggggggaggaatcttcaacagagccttttatggctgttggcctcactccccaccccacccctcccaaccccccaccccacccctnnnnnnnnnnatccggaaccaactatgcccttcagatgcatgcacagtcaaggatagactgcatnnnnnnnnnnatggcgtcaaggcacaataagagtacagcgaggcaattgagatgcttggcagtgccagagtgcgcagcatgctgtttacaagggggaagcccgaaaccaactatgcccttcggatgcatgcacagtcaaggatagactgcatgacacgaaggcactccctcggcaaagagactcggccgtcaccccagacagcgttcagtccagaactgcatgtttgtctttcgcacctgcataggtcaggcctgctgccacaacgtccctgcccagcctgaggggtatcgctgaggcattgtacagcaagtagccaggatcttcagatagagcaaggcctcctagtcccacaccggccggaactgcaaggaggaggcgccgggccgaggtgccagccagtgcctttgcaaccccagacgtgaactgtctggtctgctggtgcctcgtccacccaaggaccgcatgccgcagcattacagatattgtttgacgaattaacactccacattcaactgcatgcctgtcgtttatgtctggccatgcggccagatacccgacgacagtccacgtgacccatgtgccggtcgagactcgaagacgggctggtgtgaagtcgtcgtcaaacagcctttgaaggctaatattggactttaattagcatctagataggattgtggcttgggaacgaactagctgctccaatgcgactgtggagcggccagaatatgttgcgagctcggcatggagctgactgaatggggccgagccgatggcaggacagcgcaccaaagtaggggattcggggggtgttaggatggtgattaggatacatataatgctcgtgtcggagagtggatcctgggtacagctttacccaacccatccatcctccttggggctttcggcctgtcagaaggctggcgccctggcggtgcacccggtctcggtggtcctgcacgtggacgccacccacctgcaagccaaactgcagggagggagtcactcttccaaacccgtgccatcccagaagtgagnnnnnnnnnnnnnnnnnnnnnnnnnnnnnnnnnnnnnnccggcacgccagcataataatgaggaatggtctttggcgacgactttcccagccatgtctccggcgctgaatgctgcnnnnnnnnnngcggcacgccagcatgataatgaggagtggtctttggcgacgacttccccagccatgtctccggtgctgaatgctgtgctccatcccagttccccccctcaatcttacctcacctcatcccaggatcatgagcggtcagccccggcacgccctgccagcccagatccagcgcacctgccagcagatggagagggcccagacctgcaacgctgtgctggcaggggtcatgcgcgccctgcccccggggctcgccgggaagctggcctgggtgctgggtgtcgtgaggagcgagccggccctgtggtcacacctccacattacggagggagctgcggagcgtgcagctgcggcacccgggagccatgagcggcaggggaccccggccagcttgccggcgtggtccagcaaccggctgatagagaggcagcccctctcccgaccagtctgtgtaccccccattgacctcaagcgagtggccaccctgtccaaacttccagaagggtagcctgtcttgattattgttcagggattactagcattcagcggaggagtgtcaaggcagcacctgcaaggcaccccatctacactgccttgtatagcagattgcacagacgcgagcccaaggggggaattggaggggagagggtgggcagaggtggggatggagaaggagagaggtgctgcatgctgatctggtcactgcatgtgcaggggaaagcatggccgcaagtgagtgcagtgggatcaacaaaacctgcagcgagagcagctgaaaattttacaggatgagagcctccagtcaggcgctcgtgcatgatgtgcgccaggcactctggcctctcatgcgttcagggctgcctccannnnnnnnnnttagcctgtcttgattattgttcaggggattactagcattcagcagaggagtgccaaggcagcacctgcaaggcagcccagctacactcccttgtatagcagattgcacagacgcgagtccaaggggggaactggaggggagagggtggacagaggtggggatggagaaggagagaggtgnnnnnnnnnngtgcctcgttcaactcccccttggtgtacgcctcgatcatgatgtcgcagccgccaaagaactccccgccgatgtagatttgcggaaaggtgggccaggaggagtaagccttcatacctatcggcggtgggagagctcatgggtgatgcgatgtggctgcgggcacagggcagctgcaggccgctgggtatgcaaccaggtgccatggaggcgctctttccatgcaccgccctcatcccctaccggatctcagcatgtcattctccaggatgttgactgtggtgtaggggacccccgtcgtgttgaggatctgcacaacggtgttggagaagccgcactgcggcatctccttggtgcccttgatgaaggccaccaccgggttttccgtgacaaaggcgtcgatggcggtcttgaactcgggcgggaggcctacatccgtcggagctgcagggcagcgggtgggaggggtcagagtaaatgctggctctccggtgacagcttggccttgggcggggatgcatgcccatgcacgagctcaccctgggcagatatcctctggaaggagcgcctgtcccctcccgcacggtgcgcgcggcggcccgcttggaatacgctggggatggtacgtgcacacttcnnnnnnnnnntgatatcctctgggaggagcgcctgtcccctcccgcacggtacgcgcggcggcccgcttgaaatacgctggggatggtacgtgcacacttctgagagccttgggagagcgagccatgccggccatatgcaggcactcgcgcggtggcaagggacagggctgccatgccgtaggaagggaaggactggctgtgcggatgttgaaggggacgatatccgattgaataacggcagtacagtcctgtaattagagtgctgggatgtgtgtgtttggatcgcacgatatccgtttcccggcagatatgtcgcacgcggtagcgttagcgcgccgaggatttattaggctttcaattggtggtggatgatcgtcgaccgagggaagccaggtacaaacatgacggtgtacgtcgcaggcactggcatcacagaatgaacaactgaggtctcgatcaggcatcgaaaacccgagcttgaagcccagcaagctctccagccccgccagggcgtgccactggctctgccagcctcaggtcccagaggcccacaactagccagcgcatggcctctaatctcctccaaccccaggcacatgcggtattcgtcccattcgtgagcgcgcgaggagcatgccacggcctgcggccggcccgccggaccctgccaccccaggccgggacccagccccgcccccgctcggcctgcgtcgacgcggctgcccaggccgccccgggccatgccactcacaccagctccaccgcagcctcgtccttccccgccatggcccccatgccagcgaccgtgagtcacgaggtgctgcgggcccctgtggcctcagacatggagacctgccgccagaacctgctggatgtcgtcggccagcggcaccccatgctcctggctgccgccaaccaaatcttttctgcggggggaaagcgactgaggcctctcatcgtgctgctggtcgccagggccacgcttcctatcaccggcatgccgtgagtgtgcgggagtttggtggagaggaggggagaggcttgccccttgtgcctggcagggtgcagcggcggttccgactgggcatgaggagctcaggagcggctgggcgggagtcgtgcagtctggaggtgcctccccttggcacactgctccagcctcccgcaccccctcgcaacacctgcagtgaccttgacgagaagcacaggaggctggcggagatcacggagatgatccacacggccagcctggtccacgacgatgtgctggacgagtccagcttgcgcagaggtgcgggaggtgtttggagaggggggcattgcagccgcctcgaactgctgttcatgtgacgttgccgcgctgcctctgtccatgctagtgaaggatctatgcagggcgtgcggttgcagtgctgctccatgcagcaagcccacggcatctcctgtccccctccctcataccaggtaaagctactgtgaacagcctgttcgggtcccgggtcgcagtgctggctggcgacttcctatttgcccagtcgtcctggttcctcgcccagctggagaacctggaggtgcgctgcgtcgtggacctcaatggtgtgtggctcctctgcagagtggtcagggaccccagagaagctggacttgtgccgcaatttcatccataacctgcctcgacaaccccactgcgtaggtgatcaagctgatcagccaggtcattgccgactttgccgacggagagatcagccaggccagcctcctcttccagacagacatcaccctggatcggtacctggacaagtcgttctacaagaccgccagcctcattgctgccagctgccgatgcgcggccgtcttctccgactgcagcgaacccggtgggtgttttcgcggctggctgagcagggtgcttggaagcattgccgtccagggtgctgcgccctccatggcatgctcaagagacacctccaactcaatgagatctccctcgcgctgggcatggccacccagtccctgccgctcccatccctgcccgcagtcaaggacgcgatgtatgcctacggcaagcacctgggccttgctttccagatcgtcgacgacatcctggactacacgcagaacgccgagaccctgggcaagccgcaggggcaggacctggcctctgggaacctcacggccccagcctactacgccttgcaggtgggtggccattctgattggttggtgatgagttgggcgcatgtctgccccgtcaggggacgtgctcggtgcatgccaagcgtgatggtgtgnnnnnnnnnngtgattggttggtgatgagctcggcgcatgtctgccccgtcaggggacatgctcggtgcatgccaagcgtgatggtgtggtgctccgttatgcaggccgctgctgaccttgctcctggtgccaccctgccaggatccgagcaccagcaaggagctgagccgcctcatcacctcacgattcgtggaggaggggtccacagcgcgagcgctggcgctggtcaccgcagggggcggcattgcaaggtgggagggtgtggcaaggctgcggtgagctccttgtgtctgcagggtggattacatagtgtaaccaggctgactgttcctagggctcactcttgctgccaattctattgtgtttgtcccggtgactgggtggacacaatgaatgacaagtgggggtgtaagtggacacaccctcttgtatcttcctgggcgtgctgcaatgtcacgaggctgaccctgggcgcctgccccccccccttgcagatcgctggagctggcaagggaacagggtcaagccgcgctcgcagccctgagctgcttgccgccctcggcctccaagcggtccctggaggggctggtggagtatgtgctgcagcgcctattttgaggggctgatttgcctggccaagcctggagtccacaaagccatgtgccatcacatttcatgccctcgaccctgtgtgcaacatcctgtgcgcctccatctttggaatcccttctcgagcacctgcctggggagctcatggcgatgcgcttcctgcaggtgctcccacgtcggtgcacagacctgaaccctgctcctcccatgattgagaagatgacgatcgccttgcaaattgcacttgtggatgacacccagttttgttaataacaacgtgatgctggacgggtatggttggtggggttcaggaggagggcggtgtggttgtctcctccagagtatcatcgccgatcccagctacacagcatgaaggggctgtccnnnnnnnnnntggttatggttggtgggtttcaggaggaggcgtcgtggttgtctcctccagattatcatcgccggtcccagctacacagcatgaaggggctgtccacgccggcacgctcagccacacctccgcactgattttgtgctcgtcctcttcttctcccatgcagcctcctcgacatctgcctttcggaagaggtgcatgggcaggaaggctgggttgatgggattggaggccacggcgtgtggcagcgctgccaggtccgctggcctcatgcggtacaggtactgcgcatgtgtcttggtgacgaggcgctgggaggggttggggtccgcgtaggctccggcacaggccgagcacagtctgtgcaggagaggtaatggatggtggtgcagggctgagcttcatgtgccccttccaaagccaatggtgggctgtaaaatcaagcccaatgcctggagcctcacctgagcactaatgttgcaaatcccagggtacagtgatcacacggttgcaagcagtcatagcagctggaagagtacttggaacgaaacgtgtgtcgcgctggggaggccccagcctcagcttccccatgggaggcgtccaccgcccagctttggcggtcgcagagggcctgccacagtgcatcggccgtggcagcctcatgccaggacttgcacaccctcgagacggtggctagaccctggtgatccaaatgggacataaccttctggagcacgtcatttggcaagaagggcgcggatgaccggcgagccggatcatctgccctcggccgaggtcgtttccgtgaagaccctattttctcattgcgagacgtacgaggttggcacccttgatcgatgtgtcaatcctgcggggacactcggtggagcaccgctaacaaacaatgtcactgtacttttatgccaggagnnnnnnnnnnagtcaaccctgcgggaacacttggtggagcaccgctaacgaacaatgtcactgtacttttatgccaggaggagaggtatggtgctttgggacctgtgacaggtcgatcacgaatcatagctccttgactttctcccgtcgagatccgggccgcttgcgacgtgattgtgagatggggacacaacccccaggagcttttatactctggattacatgtggcactgagctccattacatcttctcatgagcagtgtgtgcaatcgacattcaggccttgatgcccttggggagcagcctgccaatgatgtcctcagcgagcttgtccacctggaaaaagcaggatgagggggacccttgtcttttactcttgtttcagccaccagtcagggccgactcagctgccacgcccttgccctgggaggaccccggccaccctccaacgcatgcccctccccctcctgcaatgcacccctccaacgcacctgggagtccaggttgctaaaggtcttctccttctcggcagccagggcagccagatccttctccagcgcggcgtcgatcttcttcttctccgctcccaggcgagcatcacgctccttgttcagctctgccttggccgctgcgatctccttttgtgctgccgcacgggcgtctgccagctccttctcagcggcatcctgtggggcaggaaaatgggacaggggaccctcaacacctcccccatcacaccacaacagacgccacctgcgaggcccaatcacagctcggtgccagtgctgttcctcaaaaggtacatcaaacagcccgacagtcaagcctttcatgttagctgcccgggtgtgaaccagcgctgccatgtcactcactaatgcctggccagaagtgcaagcgggtgggcacacccccccctccccagcgtcagccatgcacccacctggagctttgagacctccgcactgtnnnnnnnnnntcgacagtcaagcctttcatgctggctgcctgggtgtgaaccagcgctgccacgtcactcactcatgcctggccagaagtgcaagcgggtgggcacaccccccttccccagcgtcagccaagcaccacctggagctttgagacctccgcactgttgtccttgacgctggccagcttgtcccggagctccttgtcgcgcgcatccaggtggcgtcccacaggcccaaaccagaacttgtcgagtgccaccatgaggaggaggaactgggctgccatgaccggcatggtggcattgaagtcgaagatcttccctggctccgcgtgagccggcagggagatgaggaggggggacagcgccggtagcaaggtggtcgcaagctttcccagtgatcgaggggcgctgtgggggcgagactaagcgaggtcagtgggggatcacttcagcgacaacttggctttgctcagaccctgcacttggcgaaactgaaaggtgaaattacgattcatacatccagcagactccgtcacatacctggaaaccggcctctnnnnnnnnnngaattgaaaggtgaaattacgattcatacatccatcaaactccgtcacatacctggaaaccggcctctgctggttgctgttgcccgacttcgcagccctcaccacggtggccactcgccccgctgtcctgcccgccctgggcgttcccaccgcctggaacggccgcacatgctggagcgtgagcatcatgaccgttagccggtgtccttaggggctgcggtgctgctcgactggttgctcgcgtcgggataagtaggtggatttgggggaggggaacgggggcgcctgctgtgcctgctgactcccgcaatgactctcctcaggtgcagggcgcatgaacaccacagccagccccaggtctgctggaaagtattcaaagcaatactccatcccttcatcatggggcgggggtacggaagaggtcgcggcaaggtgcgccttgggtgttgggtgtccctaactaggctggtccgccggcggggggcgttgatttcaggcccccgatgtgcgacacctctcgactgacgcccacccgccttattttccatttagaagcgcgtgctgcggcgcgacttcaaggatgggaagaccgacgagtggcaggagaagcgccagcggagggacgacgggtggcaggagcagcccacccacaacgatgccttcaacgagtactacaagggccagaacatctgcccgcccgaggtaactttggttccagtggagggaactggcttgtcacaggcgggcttgtacgcatggaggggaaccctgcgtgctgcccgtggccaccaggcctgcatgcctgggcacagctcctgcccgacctggtccccttcaaatgcacggggcgctgtcaccacacggccacacattcactttgtggcattgtctcagcccacgcttcccactgggatcacgtctgccccatcctgcgcacgactctcgtgccatcccccacttgcaggagtgggacgcgttcctggacgccctgcgccgcccgctgcccatcaccttccgcatcaacggctctggcaagtttgcgcacagcctgcgcgaccggctgcaggccgacttcctggcccccttctccggcgcggcggctgtcggccccgagagcgcgggcctgcagccgccggcggcgctggcctggtacccggacggcctggcctggagcttctcctgctcccgcggcgagcttcgcaagctgcccgccctggaggccctgcacgagttcatgaagcgcgagacggcggtgggcgccatctcgcgccaggaggcggtgtccatggtcccgcccctcttcctgggcgtggcgccggggcaccgcgtgctggacatgtgcgcggcgccggggtcaaagaccttccagctgctggaggcgctgcactccggcggcgcgggggaggagcccgcgggcgtcgtggtggccaacgacgccgacgccaagcgctgcaacctgctcacccaccaggtcaagcgcatgtgctccccggccctgctggtcaccaaccacgaggcgcagcactttcccgcgctgacagaccaccgcgcggtccaatgggcgcgtgatctggtgggggcccccggcggggaggcggctggggacgtcaaggggcctggtgctcctgaggaggcggtggatgcacggaaccccctgcccccgccaccccaggccccgcgcgtgctcttcgaccgcatcctggcggacgtgccgtgctccggggacggcaccatccgcaaggcgcctgacatctggaagcgctggaccccgggcaacggcaacggtctgcacctgctgcagctgcgcatcgcgctgcgaggcgcggagctgctggccgtgggcgggcgcctggtgtactccacctgcaccttcaacccggtggaggacgaggcggtcgtggcggagctgctgcgccggacgcgcggcgcgctgcgcctcctggacgtctccggcgaggtgcccgcgctgcggcgcctcccagggctggccgcctggcgcgtgcacgacggccagcgctggcacgatgcctgggcgggggatggcgagcgcgggcgcaagctgctgccctccatgttcccgggcgtgggggaggggggcctgcacctggagcgctgcatgcgcttcctgcctcaccaccaggacacgggcggcttcttcgtggcggtgctggagaaggtcgcgccgctggagggcaggctggagtaccccagcgcgccaccgcgcgacagggcgggcgcagcgctggcacgggaggccgggaagggcgagggcgccggcgcgggcgaggcggggggggcggtggtggctgacgccgtcgaggaagctgggatcgagcagggcgagcagcctgctgccggcgtcgaggccgccgaggccgtgggcgcggccccgcccgctgcgctgcatgaggctgacggagctggggaggaggccggcgctgcagcagcggccgggacgcccggggggggatccgccacccgcgagccggggnnnnnnnnnnnnnnnnnnnnnnnnnnnnnnnnnnnnnnnnnnnnnnnnnnnnnnnnnnnnnnnnnnnnnnnnnnnnnnnnnnccggagcgggagggcatccaagaagcgccgagcggggcggcggcggcgccgggtgcggcggccgcaggcgaggcggacccggcgccctcgctggtctggggcgcggcgcgcggcgggggcgggcgcaaccgccccggcgggcgctggcacggcatcgaccccatcgtgcccttcaccgacccggcgcagctggagctcatgcgcgacttctatggcatgcaccccgcgtgccccgtgccctgctccctggtggcgcgttcggaggacccccgacccaagcgcctgagctacgtgtnnnnnnnnnnctgccccgtgccctgctccctggtggcgcgctcggaggacccacgacccaagcgcctgagctacgtgtcggccggggtcaaggagctgctgctcatggacgtgaaagaggcgatgaagatcaccgccgccggggtcaaggtctttgaccgccaggacagcaaggtgtgtatgtgtgagggggaggggggtggagcggggggaggaaggaaggggggggtgccaggcttggcttgtgggtggnnnnnnnnnngtgtctgagggggaggggggtggtgcgggggggaggaaggaagggggggtgccaggcttggcttgtgggtggggtcgggacggcgggccggagtgcgtgccctgcgtcccttcgcggtgggtgcagggcgccggcaccaggcgcacgccatgctcaggctgtgcgagtccctgaggggccctggggtgggcgtgctgtaccacgcagcctgccccgcggccaccacacacannnnnnnnnngccctgcgtcccttcacggtgggtgcagggcgtcggcaccaggcgcacaccatgctcaggctgtgcgagtctctgaggggccctggggtgggcgggctgtactacgcagcctgccccgcggccaccacacacaagggcgctcgttcatcgctccggtggcaagcgccgcgcgggagcgggaccctgcgacactgcgccggcacgatgtctgtggcccgccagatccccctctcgacgcccacccccccaccccgtgtgcctcgtgcgcgtcgcaggacggccnnnnnnnnnncccgcgcgggagtgggaccctgcgacactgcgccgacgcaatgtctgtggcccgccagatccccccctcgacgcccacccccccacctcgtgtgcctcgtgcgcgtcgcaggacggcctggtgagctgcatctaccgcgtggcgcaggagggcctgcccagcctgatgccgtacctgacgcggcagaccatcgcgctgcccctgaatgagctggtggcgctgctgaaggacagggagatgctgctgccggacgccgccaaggtgcatatcacccgccatgctggcgtcgcggctgatgcggcgacagatggcgcgggcggggctggaggccccagtgatgcggggacggcgcccgtggaggccgaggctgctcctgagggcgccgccgtcgacaacgaggatgtcgctgccgatggcgtcgaggcatcagagggcacagcgggcgacattcctggtgacgctgcgtctgacggcgtcgcatgcagggaaggagcaggcgagggcgctggcagcgnnnnnnnnnngtcctggtgatgctgcgtctgacggcgtcgcacgcggggaaggagcaggcgagggcgctggcagcgccgacggtgcagccaaagccgctgctaccgacgctgatgcggcagctcccacccccagccctgccgccgccgagcccgctgcagcacagcactccccaccgaagcccaaccccaatcctcgacgcctcaccaccctggagagccccgaatcactgaagcaaatgatcgacatcaagtatgggtgctgcatcgccacgctcaaggccgaggatgcccaaggtgggtcgggggagggaggcactccgtgctcgccacaacagggtgcaaaggtactgaggggcacaggcctcctgcacttgcatgcactcatggctgggctgcatgattccgtctgcccttgttgccctcagcccgccctgtttctgctcatggaacacgccccttcccccctcctgctcccccccccgccagccctgggactcagttaggagccggtgcggaaggtgccctcacagcggcggcccccatcgccgtgtcctgctggagagggagggcctccctcaacgtcttggtgtccaagcaggagtgtgctcagattgtggagagactgagtggagtgaaggcatgagagagggcccctcaggccggggaggtgcaggcccgcaggcggggcgggcccgatgtggtcgcgcgttgctcccccccggcgccccttttgcaccatgcacgtacccctgcaagcccggnnnnnnnnnntgcggggccaatgtagtcgcgcgttgctccccccccggcgccccttgtgcaccatgcacgtacccctgcaagcccggccccctagggcctcctttgctgactttcccagaaccaacccttgtgaatcttgaaatctcagactctttctggtgacataggagtctcgcgcccccagcctgtggcccgacaccatgaagtcttcgctcaccaagctgctctgcgcagcaggcgagtgtatatgggcttggatgttaccctgcaccctgtgcggcgcgatagggtcctcgctcagtcaatttaatgtcttttcaatcaatggagggaggtctcatgtacccctccgccatcacactcgcagtcttgctgctgggcgccgtcgggggcacccacggggctcgtacgggcgggggacgtgccctggccagaacaggtcgagtcagtgagggttcctggtcctgtaatgttctaagaacattattgatgcatgcgatgggcattgcgatgggatgagcttggggtctctaccccccgactcgaatcacggaggcggtggggtaggggcggggagaaatgtctttactacactcatcctcccctccctcgcacgcccagacttcgttggctctgatcccgtgggctccgacacggtgggatccgaccccatcggctctgatacggcggggaatggggtgcagaaggagcaggcgagttcctccccaggacctacccctgggcccagccctatcacgcccgtgactgagcctgaccgccccgcaccgcccagccgctccccaccctctgcctcgccagcagtagcactggcacccagcactgagtgcgtgacggcatacgattacctctctgccaacggtacctttacagagtttctccagattgttgaggtatggagcttgcaggcgaacgtctgatagaagggcacagatcctctggaggtggggctgcttcttccttgccatcactgcgtctcctaaagggtattctgcttcttccttgccatcactgcgtctcctaaagggtattcgggatctccctcttgcggcaatcacccaccaagcattgcttctccctttgcgagcacaggcggcgggccttgccgacctcctnnnnnnnnnntgatctccctcttgcggcaatcagcccaccaagcatcgcttctccctctgcaagcacaggcggcgggccttgccgacctcctcaaggatccgtcccaagtcgccatgctcttcgtgcccacaccatcggccttcgaatccatttttacaggtgcgcagggggcttggagaagtacgaagggtacccatggcatgatgtgacagcgtcacgagccaggctggtcctgagctgcctccaggcgaagcatgcccctggcaggaacacctaggggccgacaccctgtgtgagtggggtatgcagatctccctcccaatatccttttcccttccctcccaccgaacaggcgtcgacctgactgtgtccagtctcannnnnnnnnngagcaggcccctggcaggaacacccaggggccgacaccctgtgtgagtgggtatgcagatctcgctcccaatatccctttcccttccctcccaccgagcaggcgtcgacctgactgtgtccagtctcatcaaagacaaggaacttctgtccgcgatcgtggacttccatgtggcccccaactatgccctacgccccgcacagctgaccaacaacctccagatccccaccctcgccaccgaccaactcatcacggtgcaagggggaattgggacatgtggtgaccgggctgtgggattactattctcttcgtgtagtcgatgaggggattcgactgcttttccctcctgcatttgtgcggtggactcgcatgggcacctcatgagataggaaatggtggtgcccagccatgtgatgtgnnnnnnnnnnaatgaggggatttgactgcttttccttcctgcatttgtgtggtggactcgcatgggcacctcatgagattggaaatggtggtgcccagccatgtgatgtgtcgccagccacatcctcgcaggtattcgtcccgctgggctccccggtggccttcgggggtgcacaagggtatgctatcgcctctacattagagaccctgaccctctgtgacgtcgtggcgtacgtgctggactctgtgctcatatcaagtgctgcggacgcaatcctcgtttctcagggcaaggttgccgcctccggttaggggttcgtacagcctccaccgtctgcgaaacaccttgtaatgacaatccgcatactattacatggttttggtgcagggtgttattcaccggcgttccggagagtgttcacgtgcctcgcatggtcccagcggtctgccggtacccaaggtcccgtaaccaatctgtcgccacgagaaacgcgactataggaatttgggtcattaggccaagaagtgcaaaaagaaatcattgttctcatacagtaaacatcatcgtccataccgcctaatacccgcttcgtgtgtaaacatccccaagtgcaaacgccatggcgaacttcaggacggctgccggtctggccatccttgcacttttctgcctcagcagtttccatggtgcgtccggataccccctcagccccgatgatggcatcttaacccttcattcttgcgcggcagttccttttgctgcaggggacgagggtctgtgagcgcatgcaggcttgtgcgcaaggatgaccgcatcccctcgacgggttcatgggaagaggccccgaactcttccacatccctgacaccaacctgagcttctcccatacaggagcgcacgcatctgagctcacagacatggtgaacgctgccgcgcccccaaagaccggtgagtatctccgccagacccctaattttgcctcgcggctgacatgtccaccttttcactggccgtaaccgcgcgaagaccggggtttctcgtccaaactcagccacgatgacctgaacgtgttgatttatcgccaatatattgctatcagaaggctcagcacgccacatgaccctttcctctgctcgcagagggcaccgccccggccactgtcgccaagaagacccccatcatcgtgctcaccccacccgccaaggacccctttgcgttcgccaagaagaccatccctcccatcaaggtccccgccaagagtgagtgacgctcatgtccttccggtggggtggtgatgcaaggtggcttaaggggtagcccatagcgccggcgagcgctggcctctgtaaaaccctgcagcacacccccaccctaaccctcaccaaattgcgcagccttcnnnnnnnnnnctaacaccctgcagcacacccacgccctaaccctcaccaaattgcgcagccttccccaagcccacccctcctcttgtgatctccaccactggcgacaagaagcactagactccacaacctgggtgctggcacagccattcacctcttaggctggatggcggccactccacaattcgtgttcccccaaattccttcatggccaccaagctcgtggttgnnnnnnnnnnaacggccattcacctgtcaggctggatggcggccactccacaactcgtgttcccccacattccttcatggccaccaagctcgtggttgacctgggagggaaccaagaccatgtctgtcacaatacagcagcttgctaattgtaacatcacagaaaaagagtctggagtggagccattcagcatagggtcgtgaagggggctgggaggaggggaggtgcttcaatgtcagtacagccattggatccttccagtgcatgccagacgcatcatatgcgagagattatgctcttgatgatagggtggctgtggcctcatggtgactcgatggcacttttaaaacaagcaccccacacgtgcctagacaccacacccgtaaggcaagcaacaagcgtgagtccttgctggtagattgccatgtcaagactcagtccgctactgcctgtcctttgggcggagttttgcaacctccgtacccagcaaccccctgttacagtccagcttgaccctcggccatgatgtatggcttggcaacccttgtctcagttccggacagatcatctccggacctccctcaaatgcgtacccgagcaagcgcgcctcaatttctccaaagactgaagctccaggcgaggttttcaacgaaaagagaggggaacgcagggaatggttccgggagggcgagctgaagcggagtgaagttgtgtccttctctcttgcatgtgacattcctggctccctctcatgcctcccgattttctttctacatatcaaggggtactgtagctcagtggcaacgcttgtaagaaggagggaggatgnnnnnnnnnncggctccctctcatgcctcccgattctctttctacagatcaaggggtactgtagctcaatggcaacgcttgtaagaaggagggaggatgccgtgcagaatgccggatgctgtgcaagcaaagcttctgtcacgtgtcggcgcagccagaccgactgcacgaatcggacggcccaagggctggccgaacaggtccctgggtctaccccactctcatgcatcagccgctgcggggaggggcgtctgataggggagaatctcatggaagtggagccatcttccactcatcgacgtgttgtgaacaaggaattccaacccaaaatggtgtctgcgcgcgcctttgttctggtggttgccatcagcctgtgggcaggtgcggggtgggtgacccttggcacaacatagacgcggcccgcagataagtcaggatcttaccagtactcaatgaatctcattacatttgcaggtgtacacgccgatgaggtcgactccctgctgagcaccaagaagggtgagtgggttttgagcaaccctcgcagtcgtgtgtgacttcgtttccccgcggcggcccacccctcgacccgtgcaaaccccacccatggccccccttcttgcgtgcagaatgggtcgatgaggccctctcatcgtgggagaaggttctggcgccggtgcccaaggtcgagaccccacgtgagcgctggggaatcgatgcggaaggggagatgacggctggatgatcatggtcggggggcagtcgagactccggttagctcacccgatattaaccgacagttctctccccttgtcatttggcagccgccaaggtaccaaagtacgtatggccggtccctgtccccaaggaggagcccgaggtgcccagcaagaaggacctcgaatccgagctgtttgccaagtttgatctgaagccggccacaccctcccccaagcccaagcccgaggtcaagctgcccgccgtcaccctgccccccaagcccgaggtggaggtgaagtctgtcgtcctgccccctgtccctgagatcaagctgcccgcggtcactctgccccccatccctgagatcaagctgcccgccgtcacgttgccccccgtccccgagattacgctgcccgcagtcactctgccccccgttccagagttcacactgccagccatcactctgccccccctgccagagttcacgctgcccaccttcaccccctcccccaaggcctgagcatcagctcatggctggaagtacagccgtatcgtgggtgctttgaggtgtgatggactccgtttctcataacctgtcacgctgtgaattgtttcagacccctcccattcttgataaactggtgatcacactgacacatgtgtgatcccactccctcaagcggaatcaaagctgtaaattgggtgatgcacgcttcccgctcaaaggcgcgggcagtgacgggcacatgattggtctacgcgaacttcatgcacgggattggcgtcgcacctctcaacgtctcagcgcatgcgcgcattccacggcgatctgctcacccaacgtcaaacttggagatccaatgtggctcaagaaactagtcagaggtttgtgttgccgcggttcttggatagatcgaacattgccgcgtgtccactagcgtgcatcgacagcgcaatggaaaggtccagccaatgcgcagcatcatttcaatttggacccattgtgcactcttggtcacatctaagggtttcggatctaccattgtatccacgtctgcacttgtggcaatgaaggcattcttggctatcccactcctggccctgctcctggttctgccagcaggtacggagtctggaggcttcggcaactgcaagcttggttgggcaatgcgggtccccccaatgccgatctttctgttgatgagagtgtggacgggttatgcgccctgccaaccggtccccgcacctgcagggtaataaccgcgcatcttcccgggcttccgttgccgcagggacgaaggccaatggttccgtatcgatcgaggatctcgtcagcgctcatggtgggttcacaagcgggtgtagagcgctcttaccccatgtcatcgcgttacacgacccctggtgcgatggattgacgatgtctccttcattacccgctttcccatccgcagaggccctggccgctgacgtcggtggctggaccaaggaggccatcgcaggtgcgatggggatttgatgggattccgccactgacatgctgaggtgcagggattttaacaatgaaatcttgactcactttcctctccccatttctcacttgcccacagagcacaagaagttgaaagagcagctccttgccnnnnnnnnnnggcaatgaaatctcgactcactttcctctccccatttctcacctgcccacagaacacaagaagttgaaagagcagctccttgccaagctttttggttccccttcaccagcagaggctcccaccccggagagtccagctgccagcccctctcccaaggagtctccctcccccagcccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcccagcccttcccctgagccatcaccgagtccttcccctagccccagtcccagcccatcccccagccccagccccag

SEQ ID NO: 44774 - DNA, 61 bp, Chlorella protothecoides
cgccgccagcactacatggcataatatggggggagggggggggcatgtacaaatgtcagca

SEQ ID NO: 44775 - DNA, 64 bp, Chlorella protothecoides
agccgcagcagcagccgcagcagccgcagccgccgcagcagcagcagccgccgccgccacagag

SEQ ID NO: 44776 - DNA, 11107 bp, Chlorella protothecoides
  modified_base (105)..(177): a, c, t, g, unknown or other
  modified_base (793)..(802): a, c, t, g, unknown or other
  modified_base (1124)..(1133): a, c, t, g, unknown or other
  modified_base (1620)..(1629): a, c, t, g, unknown or other
  modified_base (7446)..(7455): a, c, t, g, unknown or other
  modified_base (7717)..(7726): a, c, t, g, unknown or other
  modified_base (9083)..(9092): a, c, t, g, unknown or other
  modified_base (9179)..(9188): a, c, t, g, unknown or other
  modified_base (9383)..(9392): a, c, t, g, unknown or other
gctacgacgggcggccgccccggcgccgggcgtggagccgtacgccgacttctactccggccacgagtataacagcgcgggcggcgggtccccccgctcctccgnnnnnnnnnnnnnnnnnnnnnnnnnnnnnnnnnnnnnnnnnnnnnnnnnnnnnnnnnnnnnnnnnnnnnnnnngcgagcccagccgcgaggcggggtcggtcttggccaccgcgccgctcgcagcgcacgcaccggggcggcccgccacgggcccccccggccgcaacgtagtgcgcctccgcctgccggcccgccgcggcaggtcccccggcgaggccggcgccgggaagggcccggacgcgatggccctgccccgacctgcaccagctccaggcgacgtgccgcggatagagtcgctggccatgctggccgggctggtggccgacgcctcgggccccgaccccgagggatgggccggaaagaacgacgcaaggggcagcgcagtggggctgctgacgaccaccctggcgctcatcgtggcaggggcggcggcggcgctgacaccggccctggccagggcggggccgccgagcgccgggccgccgagcactgaggcggcgaggactggcgtcagggcgctgcgcttcaccgaccaggtctggcgccgtggatggtgggaggcgagcggggaaggggggtgggtggaagcggcccatccatgcctcatagagctatggtgcggtgtgcgcactgttcctaagcgccgtggagcgcccacccgtcaccgcagggaacattggggacgccnnnnnnnnnnggagctatggtgtggtgtgcgcactgttagtaagcgccgtggagcgccctcccgtcaccgcagggaacattggggacgccgggcgtcgaagcggagctcctgctgtgtctgggggagggtagcgagggtggaggaagcggggtcgccaaactgctgcggctgctggagtgctccaaagacctagctgggcaaggtgggcgactgcttccctaggaggggggaaggtgcaattttgcggcagacatcctgggaggagggtgttttgtgggagcatgggcggtgtggtggctcttaccttgcgaccccggggcggtgccgcacnnnnnnnnnncttgcgacagacatcctgggaggagggttttttgtgggagcatgggcggtgtggtggcttttaccttgcgaccccggggcggtgccgcacaggcttaacaacagatgctgggagaggggcccagcatgagtgctggccccgaccaaaccccagccccgcccatgaacacgtcccacagtggcctcgttcgaggagcttggcagcggggagctccgcgtcatcctgcgctgcccatcacgagaggccatcgcccaggtggtgaccaggcttgtgcgccctgatgtgaccctgtgacacccatgactgacacacaaaacacgaaaacccaggaagagggaggcagagggtacaaagctatttgtgggacgagcttgcttgtacgataccctttgatgccggttacatttcatggggcggatatgatgtaatgcagcgtgcaggacccggtctgtccacatgggcccccagtacgacaggtccgtccgtnnnnnnnnnngtgccggttgcatttcatggggcggatgtgttgtgatgcagcgtgcaggacccggtctgtccatatgggcccccagtacgacaggtccgtccgttggtggtcaggggatttgaattttccgaccaccgacacgacaacgcggagcgggcgcaggcgtacttttcgccgggcgccctcggtgtgcacccgacacaaccgtattgacgaagactgagcgcccgtacccggctgatggggcatgacgcgagcgacctttgactgacccaagcccgtgcgcagctcacacgacgcggcccatccatccggctgcccagtataatcgccgcgcagaattgcacggtggaattgtgaccagctgacttcaaaacaccctctcgacagcggggagtggtgtcggggagcattcgccgcacagattttagcgcaggcggaggatgccgacgtcggtcacggaccacagcgatttgacgatctggcgggatgtcgccgctgagctgcacgccacactgatgacacagtgccaacacctgctgacaataggcgagctgcccgaccttggggccatggggaggggtgcgcttctgtggcacggcatatctgccgggacacccgcatggctgaccaggcaccgtcacatccccctcgtacaggcgcgacgtgcacaggggactcctatgcatggcgcagcacgccatgtcgtagtgagggggcgctgtgcctgcgtcggaccccgcccgactgcgtcaaggtggggtcagggtccccggagaccggaccgcccaacacccgcaagcgcaacgcctccccaggggacgcggccacgccctgcacagacacgtatgtccaccccaccaagcggatctgtgcctcgccaggcccacccagcgcgctggcgtccaactccaggctcctacaccgcccccgaggcccacgccggaacctgctcttcaccccccagatccccccgaccttcctcaaccaggtcttgacaaaaggtcagtggtctccctcatgtgaggtggatgctgccagccgttaaaaacccaaacaggcagccctcacctctcaaacgctgccctccgatcttgcaatttccaggctctcctaaaagactggcatcgcaggagactcccggcactgcttggtcactcatgattgggcggtgttggcttccgccccgtgcggcccgtcccagcatctttgggcctgcgctggccacacccgacctcagggcggcgctggaggtgaggctacaggaaggagtgagggttggcatccttccagtggccccttcccggggccgacggaccaagcgcagtgcttgactcaggccagtgcctgccaggcttgcgcccggcttccatctgcatattgggtggcctatccacatggcccctgctgagccggcatctcgctccttctccccatgcagctggacggggtggaaaccgtgaatgcccggctcctggcagccgcggaagccagcacggcgcgctgcgtcatcccagactccggtccctccctgtcgggcaccggggcggtgacgccgtgcagccggcccgaggtcggctgccctcacaggacccggcagctccgacagcgacgatgctgacccgttggccggccattgccaacctgtagacttcgacctggggagggccacctggagccgcccctgatcccaccccacccttgaccagatcctcactgcttggccgatgtgacgctgccgtgccattcgacaccccctttgtccctaccctttcctacccatagccacgtagacatgctccatactctcccctcctgccgaagtgccattccttctgacgctgcatggaccgtccagggaccccctggccatcaccgactgagaccagaacccttgctcatgcccatccacccctgagcggcagggtcccccatcacaccctcacgctcacctgcccattgcctgacctgaccggcatcccctcccgcaagaaatgaataagaacgggtgacctcatgtgagtccttttgcatggtctgtgcaggaacgtcttgcacactcctctccgtcatgtcaaacccgcaaagcttgaggaggatgaggatgatggctggaaggtgggggggaggtggggggaatgtccacgtgggcattttgctgaagcggacaccagtgcctggcagggagtgccggggtaaacacctcgattgtttcgacacaataacatctcatgtcggtcctgtcgcaatcagccttcctgcccaggacatttcagcgtgccacgcacctcgcggcaagagcccgatcgcttgcacccgcgagccggaggtaccgccgggcctccagagtcgggcatgaagaggctcaatatgcagcgggggatatgtttcaccagatcgagatcgggtttgtgtacatgcatggacggatgtcggcatgtgatctgccggtaccatcagcatgctcctgccgcacgcccggcgcagaatggcagccacagcgtcagctgactgggcccaggaggacaagaggcgcctgctgcacgccgtctaccgggtgggagacctcaacaagaccatcgaggtctaccaaaaggcttttgggctgaagctcctccgcagccgtgatgttccagatgtgagaatggttggatggtgctcacaggctgtggcaggggttgcctctcagaggcagggagcgcgagggcgcacctgatcccctgtctgagaccaggtctgctgtgttgatcctcgcatctgcgacagtaagatccgttcagatattccggactgtgtccaagggcaatccccataacccctccaagtaaacaggagaagtacagcaatgctttcctgggctatggtccagaggaggatcactttgcattcgagtgagtggaggtttttgtggtactgcggtgcggagttggcagcgggtttttacatcctgagcctgacctaagtgaggtacaggagggctcattgccctcctggccagacccttgagcaggcttctgatggcgctgtccgagcctcgcctcctgaattgctcccttccgcctttagacaagctgttgcgaccatccagaactccaacgaccccttccccccttaggctgacctacaactatggcaaggacagctacgacattggggagggctttgggcactttgccattgccaccaacgacgtgtacaagctttcagaagacatcaagaaggcgggagggaacatcacccgcgagcctggcccggtcaagggcggtaccacccacattgcgtttgcaaaggatcccactggctaccagtttgagctcatccagcgggagggcaagatcccagagcccctggctcaggtaatggcgctggcagtggtggtgggcggattcctgcacatattctactgcttggtgcttgtcctgagctggagatggatcctcaaattaagagcttacatccccccccccccagatcatgctgcgtgtaggggacctggacaggagcatcgacttctacacccgggtcctgggcctgaagctgatcaggaagcgggataacccggagtacaagtacaccctggccttccttggtgggttttagttttggaggagtgaatctgttcttgtaccaggtggcggcgctgatgttgcgggtccacccagatcaccttttgatggaagtgggcttgacttcccacaacgttgtacttcaacctcaccctggaaacaaattgatcactgaaacccccatctgccaagcgcacaggttacaagggcgacgagagtgctgagaccgtctttgagctgacctacaactggggccgcgactcgtacaccaagggggatgcctatgcccaggtcgccatctccaccgaggtgggttgggcctcttgacagtggagtttgaactgtgtttggtgcctcaaagctgcacatgcttgtgtgtgtgtagtctgaggccactgatgggccccgcctgctgtggtgctctgttccacatcaggcctccacatgcacgcgccacccaagccctcctttccacccggccacgccaggatgtttacaagaccggggaccagatcaaggcggcaggcgtgagcctgctcaaggagcccggcccgctgcctggcctggggaccaagatcctgtcgctgaccgaccccgacgggtacaagatcgtgtttgtcgacaccgccgacttcctcaaggagctggagaagtgagctgcgcgcccattctgctgttgacagcctggtgtgaacgtcaaaagctttaaaagcagggccgtatgaggatggctggggcatcaagcgggtgtgactccagggggagcagggggtggcaggttcaggcacgggtgggaggggccccatgcttccggtgtcctcgcctggacacgccggcatgcaatgcccaagcgtcaatcaggctgcccgcacgcagaagagcgccgtggtgcggcgtacggctctggaacgccgctgtcgaagctcgcacggggtcgtgtcgactgcgcaccccctggctcccctcaagcaaacagagcaagccacagcctcctcaggtcgactgcgcgggcggtagccttcgccgcgcatgcgtggcgatcgtctccccgatggcggagggcaggactttggcacccaccagcacattggccatgcggctgaagaggtccagctggcaaaaaaaggggttaagaaagaaaggaagaatcgaagtaggccgccgcgtcgccgaatggtcgtgggcgtgacgcggaggccagccgcaaggtgacgaccccccgttccacacggcgttcctcctttcccccttcccccctccccgcacctgctccaggggcgtgagccggactgcggcggagaggacggagccgacgctgggccccgtgggcgcgacgtaggaggtgaagtagacgtaggagaagacggccatgaccacctggcagtccatgcggtcggtcatgccgccgtggccggggatgctgtcgccaaagtccttgatcttgaagccgcgcttgaagccggaggcgaagaagccgccaaacggcgcgatgagcgaggcaaaggttgccagcaccactgcgtgcagctgcatgggcaggcacgtgagggaggcgccgcgcgccagcgcctgccacccagggtccagccggtcgaacagggtcatgagcgcgtcggaggcctccgcggggagcagcgtctgtggaggagaggcgtgtgaagtgtggttgtgggggtggggcatgtgagggcagcagcagaccggggaggtgcaggatccggcggtgcgcatggggagagccgatcatcgatctcgccggcctcgccgggacaccggtcatatgaccttgattggacgacaccatgcatggcaaggaggaaccatcgtatcaggctgcaaatccagagccaccttcgatgcccacatgtccaccactcaccaggatgtctgtgaggtaaaacgtttgaggggaatatatgctgggggtggctgcacagtcgagcggctggatgatggacagatcctgtggtgagggtggggcagccgtgggtgttcaggcgtcagtcagatggatgaggggcagcctccattgccttcgaatagccagaccatctccagcaggggcgcagaagtctcgactggcaaatgcacgccgagggcaaacacccatcctaccgcccccccattcccagcagctcaatgcgctgaagccagccgatccatgatctgttcacccctcaccgtgcgagggcagacgaaccagtcaaagcgggacagaaagcctgccatgtaccaggacgccacagtcgtgcctgtgaannnnnnnnnngacacctcaccgtgcgaggacagacgaaccagtcaaagcgagacagaaagcctgccaggtaccaggacgccacagtcgtgcctgtgaaggggggtgttcgggtgggtggatgcttggctgtcattctccaaaatcagagcacagccccagcttgaggtcttgcgctgcccatgcatccagcaggaccgtgacctgcgccgcgtatctctgcgtctgaaacagctgcatacccaacatccccccccccccccccccccccccnnnnnnnnnntcgtatctctgcgtctgaaacaactgcatacccaacaccttccccccccctgcacataccaatgaggccgccaacaaagccttcccatgttttctttggggacagctggatgaggggggtcctgccaaagaagaagcctgttgatgaatgacaggagcgagggagggaggaggtattagggggttaggattgccatccgacgagggagacgagctgtctgagaatctcccagatcgcagcccattattattggtatcgcccgcttgggtggccggcatgttgagagcagcaccacaacaacttttatccctgccagactgttttatgggtgcccacagaccctcctaccagctagataggctgcaatgtcattgatgatgaccagggcggccggcagcaggaaccagatgagcccttcgaagatgttggacacgaagaaggaggaagggaagaagatggtctgtggggatgtgggaaggggccggcgtaaagatcgtgtcacatggtgtctccatgccaccccgactcagaggcgcccattcccccttgacccatgccgcaggctgatcactttacgaccccagtcctcctcccctgcagcggcccaggacccccccctcaccatgagaatcatgtgcgtccaagcgtactgcccaaactggtaggtgtacatgcccttcttcagcgtcagcacaaagagcacgaagccggctgtgtagagcgagaaggacatgatggtgtggtggcggaggagccagccaaacattgcggcagtgcgcgctgaggaggtgagctcgatggtcaggttcttcttgatgaacctgcaggggggcgtaggggaagggcgatcatcacttcagtcgggggtgccagggtcaaaggccagcacagcagggaagcaggggcactggtcacccatgcagcgcaggctcccccagcaggctcaacatggtgacaagaatgtgactgccaaaagacccccccctccctgcaccctgtccttgcctgatgtagaggtagaatgctgcgacaaaaaagaagtaccattgctgtgctctgaaacctggcaccttcttctcctgctgcctgacccgggccagcgcgaacacttccctgaccatgagaaactgcggcatgggcggatgggtcggggcggtttgcgtcagggtttgtgacgggaacgcgtttcaaatggtgacataagggtgaagctgcgtctgaggaaccctgagcatggctcgcgcccccccgcatgctcacctggatgcctaggatcataaacatgaggggaacatggccggcagcaatgatgccgatgaaggtgccgatgagcacgatggtggagatggtgcgcacnnnnnnnnnntgtttgcgttagggtttgtgacgggaacgcgttccaaatggtgacataagggtgaagctgggtctgaggaaccctgagcatggctcnnnnnnnnnnccgaaaggacttgaaccggttctcagcctgcatggaggtgtgttggggggttgaaggcaaggggctgtgtcatggaccatgcctgatcagcccaggtgggtacagggcccaaccagccatgcagagccctacttccagacagcacctcggcggcagcgcccgcgttcgatgtcctgcgcgacagtttaggggatnnnnnnnnnntcgaaaggacttgaaccggttctcagcctgtatggaggtgtgttgggggggtgcaggcaagggggtgtgtcgtggaccatgcctgatcagcccaggtgggtacatgccccaaccagccatgcacagccctacttccagacagcacctcggcggctgcgcccgcattcgatgtcctgcgcgacagtttaggggatgcggtgtccgcgctcccattcattgacccggacgacagacgacgccagccgcgtcgcctgagccgtatggttagggctttggggagctgcatccggtggggagcctctcagccccacccttgccaggatttgacagtctaaagggccgggtggcggctcagatttctacctcaagatccaagatgttgtgtggtttcaaatttggacgatgggctattcgtcgatagaggcttgccgggaaggcgcgcaagttcagcgagggacactcccgagcctgcaggagggtacttcagattgtctagcagcgacaatcgtactttcgacccacaaccgtatactattgtcctcgtccgtggtattgggtggcaaagattccatgcaacgtctcagcgaggggcaacagggagcccgcccgcatagcacacccagcatgtcagggagcttctcttctagactttcgcagcatatgaagggccgcggtgccgcactgaaaccctctcgcccatactttatctcctctggggtgcgaccagcacgcgcttgtattgactagcaactcaagtcaggcagtcatcatgtctgcggcgaagaggctgatcccccttctagaccgagtgctcgtggagaaggtcgtcgctcccaccaagagcctgggcggagtgctgctgcccgaggtggcgtcatccaaggtgcgttatgtatatgccgatctcccatgcacccgcgcgaggctcggtagtgcgtggttctcgctgctctcaggccacacggcaccggggtcgtggaggtttctccagggactcgaccgctgcacgcaatgatccagatatctacatcgccgcacagatcaaccagggcactgttttggctgtggggcctggccggagaacctccaccggggagctgattcccgtgggagtcaaggctggggacaaggtgctgctgcccgagtacggcggcacccccgtgaagctggaggatactgagtgagctggcggtggggaagggggagggtggtggtgggagttggggatagggtatggtttctttcagtggccctccaaggtctgggtttgtggggtgcacggacactcagtgctttgaccatgcgcactctgcactgctccccctcagacatggcgtccatttgtctcttgacttccaggtacatgatcttccgcgacgaggagctcctgggtgtgctccagaactgatctgcgtgctggggacccggtgccacccacccaggactcgacgcaatcctcctctgctttctaacttccggctgcactgctcacgagacccccctcatgcattgccttgggttcgtcgcactgtgtcactcactgactatctggcaacgaggtcaaggtcttttgctgccgtcattgccgtgtccttggtgactgtgaccgattcaatgtcatgatataagcgatgccatccatggaagagcatggtgtggaaggggggcgagaccatccctgaaggtaatccaggggggaggagggcggggggggg

SEQ ID NO: 44777 - DNA, 61 bp, Chlorella protothecoides
ggggacatggttgcgatggggagaggaggggatgacagtcgcggacgggagtccctgctgg

SEQ ID NO: 44778 - DNA, 403 bp, Chlorella protothecoides
  modified_base (100)..(251): a, c, t, g, unknown or other
cgcgcgggggcgccgggcgccgcgctccccgaccgcgtgcgcctgggccgccccggcgccagcctggccgtggaggtgtacgtgcgccgcgcggtggagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncggcgccgctgtggatcgccaacaccacgggcctggcgatggacgtggccgtcgtcgccgtcgcggcgccgagcaggggcgcgtcggcgagccccggcgcctctttttcatcgagggccgccagacgcgactccggcacggcccgcgcgccg

SEQ ID NO: 44779 - DNA, 61 bp, Chlorella protothecoides
ggcggtggctggcatagggataggaggaggggggagtcgggtcatgctgctgttgccctct

SEQ ID NO: 44780 - DNA, 73 bp, Chlorella protothecoides
gtccttcctgctcaccgacccacgcttgcccggcggccccattgtgtacgccagccccggcttcctggcgctg

SEQ ID NO: 44781 - DNA, 61 bp, Chlorella protothecoides
ggcaaccggctcagattcctgagaggctggggtggccactgcttgagatgcaatgagctgt

SEQ ID NO: 44782 - DNA, 61 bp, Chlorella protothecoides
cgtactgagtcggattactatggcgggatccaacaacagtagggtaaaactaacctgtctc

SEQ ID NO: 44783 - DNA, 61 bp, Chlorella protothecoides
catcttttgtgacagcggtgcgtgcggcggggcgcatcgcatccatcacctgggctcctcg

SEQ ID NO: 44784 - DNA, 61 bp, Chlorella protothecoides
agctcacctcatgctcatggctgacggcgggggatccagaaatcggtggggaatctgagcc

SEQ ID NO: 44785 - DNA, 61 bp, Chlorella protothecoides
gacggagtagacgtgggacagctggcgcacggtgtgcgccagcgccacctgctgcaggtag

SEQ ID NO: 44786 - DNA, 61 bp, Chlorella protothecoides
gatggcggcggccgcggccacgcagcacgatgaccaccaggccacgctgcgcctgaccctg

SEQ ID NO: 44787 - DNA, 72 bp, Chlorella protothecoides
gccggccccgtcctggccgcggcagacgggcctgcgccggtgggcgccctgcaccttccccagccggggccg

SEQ ID NO: 44788 - DNA, 87 bp, Chlorella protothecoides
tcctgccccggcgatgcagggttcaaggtactgtgtgtgtagggggggggggagggaagagcatactgctcgttgtgagggactgtg

SEQ ID NO: 44789 - DNA, 68 bp, Chlorella protothecoides
cccagaccggccgtctggccattgcagtcctccttcccccccccccggcaggccagaggctccacaga

SEQ ID NO: 44790 - DNA, 62 bp, Chlorella protothecoides
cgagattaagactgccttcgcctccttccacaccccccccccccaaaaaaaatacttctacc

SEQ ID NO: 44791 - DNA, 61 bp, Chlorella protothecoides
ccgtattgtgcgtggccagcagcgggtgggggtctccctgcagcacctcgatcgcgccctg

SEQ ID NO: 44792 - DNA, 61 bp, Chlorella protothecoides
gggacccgcgcccctgtgccgctcgccagcccccgcctccagtccgacatgaggctccatg

SEQ ID NO: 44793 - DNA, 61 bp, Chlorella protothecoides
agtaaaccctctccacccccacacatccccacccccccccacacacaccacacatactcac

SEQ ID NO: 44794 - DNA, 61 bp, Chlorella protothecoides
gtgtgcttggcggggcagtgtgcccacatccccccgctgctacctctgagtcttcagaccc

SEQ ID NO: 44795 - DNA, 104 bp, Chlorella protothecoides
gggagtgaggactggggggcgacatggttttggaccccccaacccacccaagttacccacccactcaaacccccccggccccctcgccctccacacatgcgcag

SEQ ID NO: 44796 - DNA, 61 bp, Chlorella protothecoides
gatgttgggccgcaccccgcgcgaccccatctccttgaacacctccagcgcgcggtccagc

SEQ ID NO: 44797 - DNA, 61 bp, Chlorella protothecoides
tccactcactgtgccacctggcttgcaaggggtgacgccgacggccccaaaacccccgccc

SEQ ID NO: 44798 - DNA, 61 bp, Chlorella protothecoides
caccgcgtccacgtcggcgcggtgcgtgaacaggcgcgtggaaagcacggcggggggcggc

SEQ ID NO: 44799 - DNA, 99 bp, Chlorella protothecoides
tcagcttcgtggcgctagaaagcgcggcggctccgcagcgctcgccgagcctgcgctcgccggaggcgccgggcgcccccccgccgccctgcgccgacg

SEQ ID NO: 44800 - DNA, 61 bp, Chlorella protothecoides
aaatcccatgctttgcagggggagtggctggacatgattgagtccgactatgtcttcatga

SEQ ID NO: 44801 - DNA, 61 bp, Chlorella protothecoides
cacgtcccttcatgcgtggatgcccattcacgcgtggatgcccattcatgcgtgggtgctt

SEQ ID NO: 44802 - DNA, 61 bp, Chlorella protothecoides
ggtattgggcggggggggagggatgggaggggggtgaagagttgggaggtgggtgaagagt

SEQ ID NO: 44803 - DNA, 61 bp, Chlorella protothecoides
aagctggattgggcgggaatagtactgcggggggtgaccacgtgggaagtccccgtgacga

SEQ ID NO: 44804 - DNA, 1807 bp, Chlorella protothecoides
  modified_base (122)..(327): a, c, t, g, unknown or other
  modified_base (575)..(584): a, c, t, g, unknown or other
  modified_base (1194)..(1203): a, c, t, g, unknown or other
  modified_base (1386)..(1395): a, c, t, g, unknown or other
gccgccgcccgcggcctccaccaccgcgcgcgccagcgggtggctgctcccggcctccaccgccgcggccagggtgaggagcagcgcagggggcacgcccggcgcggggcgcgtggccaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcacatcacatcccgggccgatcggagcggcccacgtcggggctgcggtgtgtggcgcaagagtcggagggggcgagggcgaggacaccaccggccggctcatgcagaggccacgagggacctcgccatccaacccgcatcctacctgctaaagtaatcgtcgcatcccccctcgtcaccacacatctccccttcccccctcacacactgcaacagaatcgagcaagccgccccccccccctcacctnnnnnnnnnntccctcctcgtcaccacacagcttcccttcccccctcacacactgcaacagaaacaagcaagccggcccccccccctcacctccaggatgtcgccgccgcggatgagcaggccgtggcgtgcggcggcggagctccccaccagcacggcggtgggcgcggccaggcccagcgcgcaggggcaggccacgaccagcacgctgcaggcgaggcggagggcgaggaggagggcgggccgcgcggcgccggccggcgcgtgggcggtcacgacgcgcgggaacagggccgcgccggggcccgcccagaaggccagcgtggcggccgaggcggccatgacgccgtagcagaagcgccccgccacggcgtcggccaggccctggacgggcgcggcgcgcgactgcgcggcctcgatcagcgaccccagcgcgcccagcgtggttgcctccccagccgcctcggccaccaccaccagccgcccctcactgttcagcgtgcccgccgacacgcgctggcctggccaggggatggattaattcgatgggggggggtgagagggggttggttgaggtgcgactcgggacggggggttgacgcggaggagccccgccgcgnnnnnnnnnnggaggggagggggttggttggggtgcgactcgggatggggggttgacgcggaggagccccgccgcgcccagacccatcgtggaggccgcccgcaggccccgcctgcattcctgccagcggcctgccgcccgcgtggatgcgcatcccctcgccccccccaaacaccctcccaacacacccttnnnnnnnnnnacatgaatgcgcatcccctcgtcccccccaaacaccctcccaacacacccttggccttgggcacgggcatggcctcgcccgtgagcgacgactcgtcgcaggcggagcggccctccgccaccacgccgtccacgggcacgacgtcgcccgggagaacgaccacggcgtcgccgcgcgcgacagcgtgcgcgggaacgtcccgcagcgacccgtcgcccagcagcaggcgcgcgctgtccggaagcaggccctggagggccagcatgtcggaggcggcacgcaggcgcgcgcgctcctcggcggtgcgccccgccagcaccacgcccaggagcatggccgggtcctcgaaggccacgcgccagcccagcgctggccaggcggcggcggcggcggaggccgcgaaggccgcgcc

SEQ ID NO: 44805 - DNA, 35276 bp, Chlorella protothecoides
  modified_base (379)..(388): a, c, t, g, unknown or other
  modified_base (1046)..(1055): a, c, t, g, unknown or other
  modified_base (1382)..(1391): a, c, t, g, unknown or other
  modified_base (1795)..(1804): a, c, t, g, unknown or other
  modified_base (3004)..(3013): a, c, t, g, unknown or other
  modified_base (3254)..(3263): a, c, t, g, unknown or other
  modified_base (3836)..(3845): a, c, t, g, unknown or other
  modified_base (4414)..(4423): a, c, t, g, unknown or other
  modified_base (4977)..(4986): a, c, t, g, unknown or other
  modified_base (5699)..(5708): a, c, t, g, unknown or other
  modified_base (5815)..(5824): a, c, t, g, unknown or other
  modified_base (6311)..(6320): a, c, t, g, unknown or other
  modified_base (6697)..(6706): a, c, t, g, unknown or other
  modified_base (7455)..(7464): a, c, t, g, unknown or other
  modified_base (7988)..(7997): a, c, t, g, unknown or other
  modified_base (8507)..(8516): a, c, t, g, unknown or other
  modified_base (9115)..(9158): a, c, t, g, unknown or other
  modified_base (9386)..(9395): a, c, t, g, unknown or other
  modified_base (9511)..(9658): a, c, t, g, unknown or other
  modified_base (10345)..(10354): a, c, t, g, unknown or other
  modified_base (10879)..(10888): a, c, t, g, unknown or other
  modified_base (11433)..(11442): a, c, t, g, unknown or other
  modified_base (11849)..(11858): a, c, t, g, unknown or other
  modified_base (14318)..(14327): a, c, t, g, unknown or other
  modified_base (14919)..(14928): a, c, t, g, unknown or other
  modified_base (15185)..(15194): a, c, t, g, unknown or other
  modified_base (15358)..(15367): a, c, t, g, unknown or other
  modified_base (15554)..(15563): a, c, t, g, unknown or other
  modified_base (15671)..(15680): a, c, t, g, unknown or other
  modified_base (16353)..(16362): a, c, t, g, unknown or other
  modified_base (16691)..(16700): a, c, t, g, unknown or other
  modified_base (17000)..(17009): a, c, t, g, unknown or other
  modified_base (17148)..(17157): a, c, t, g, unknown or other
  modified_base (17736)..(17745): a, c, t, g, unknown or other
  modified_base (17824)..(17833): a, c, t, g, unknown or other
  modified_base (19408)..(19417): a, c, t, g, unknown or other
  modified_base (20313)..(20322): a, c, t, g, unknown or other
  modified_base (20767)..(20776): a, c, t, g, unknown or other
  modified_base (21807)..(21816): a, c, t, g, unknown or other
  modified_base (24274)..(24283): a, c, t, g, unknown or other
  modified_base (24756)..(24765): a, c, t, g, unknown or other
  modified_base (24881)..(24890): a, c, t, g, unknown or other
  modified_base (25476)..(25485): a, c, t, g, unknown or other
  modified_base (26141)..(26150): a, c, t, g, unknown or other
  modified_base (26983)..(26992): a, c, t, g, unknown or other
  modified_base (27482)..(27491): a, c, t, g, unknown or other
  modified_base (27592)..(27601): a, c, t, g, unknown or other
  modified_base (27834)..(27843): a, c, t, g, unknown or other
  modified_base (27904)..(27913): a, c, t, g, unknown or other
  modified_base (28424)..(28433): a, c, t, g, unknown or other
  modified_base (29306)..(29315): a, c, t, g, unknown or other
  modified_base (29574)..(29583): a, c, t, g, unknown or other
  modified_base (29757)..(29766): a, c, t, g, unknown or other
  modified_base (30670)..(30679): a, c, t, g, unknown or other
  modified_base (31129)..(31138): a, c, t, g, unknown or other
  modified_base (31332)..(31341): a, c, t, g, unknown or other
  modified_base (31601)..(31610): a, c, t, g, unknown or other
  modified_base (32080)..(32089): a, c, t, g, unknown or other
  modified_base (32727)..(32736): a, c, t, g, unknown or other
  modified_base (33227)..(33236): a, c, t, g, unknown or other
  modified_base (33674)..(33683): a, c, t, g, unknown or other
  modified_base (34304)..(34313): a, c, t, g, unknown or other
  modified_base (34474)..(34483): a, c, t, g, unknown or other
  modified_base (34962)..(34971): a, c, t, g, unknown or other
  modified_base (35139)..(35181): a, c, t, g, unknown or other
cagcctcgccagccgaccccgccgggccgttcacgcccgaggcagacccccctggcgaggccgcgcccaggcctgcgccgcccctcgccacgccgtcctcccccagcggcagcttcgcaggcgccccccgcgcgcccggcgcagacagccacgccacgtgacgcgtgccctcgccgaccctccgcgcctgggcgccggagggcaacgcgccggccacatcccgatccagcgccgccttgctcaggcccgacgttgctggaggagcggcggggcgctgagacacacgcagagggacccgctcaggtggcgcagcattgccggggctcctcgctcctgcacctgtcccctgagaaggtgagcttggcgtgggaggatccgnnnnnnnnnngcgccgccggaggagcggcgggggcctgagacacacgcagaggggcccgcccaggtggcgcaccactgccagggctcctcgctcctgcacctgttgcccgagaaggtgagcttggcgtgggaggatccgtgcgcgcggtggcagcccgggtcttgctgctctgggcctcagacgctgcggctgactcgccctggggcggggcaactggctgaggccccccgccctccacgaccaccctggtggtaggggcccgagccgccgcagcggagcccgatgcagcctctgccgcggcctggctgaagcgcttgaccctctgccaggcgccctccgactggatgtctggtggattgggggacgacagccggaccaaaggctcctctgtagccagattaagcccctggctagctgcagcgtggacaagcgtgcctgtgtcgattgaggagagtgatggtgagtaggccctcatggaccggcctaggaacggggcgagcgtggtcaggccttgatcagggtgtggtagagctcaggggtctagtccttcccttcaagcaaaaacaggcagaccaagctgggcaatcgcaaggtgcagcgaggaacgcaccttgtgtggcggcgcccgctgggggcggctggaagatcagggcatccagggtgtcannnnnnnnnnaattgaggagagtaatggtgagcaggcccttatggactggcataggaacggggcaagcgcggtcaggccttgatcagggtgtggcagagctcaggggtctaatccttcccttcaagcaaaaaacaggcagaccaagctgggcaatcacaaggtgctgagaggaatgcaccttgtgtggcggcgcccgctgggggtggctggaagatcagggcatccagggtgtcaaaacccttcctctgcaagcattatggaatagggagcactgattgcaagccacacaggccagcgttgctgagttgtgccacgtccctcaccattgcctgtccnnnnnnnnnngagagaatagggagcactggttgcaagccacacaggccaacattgctgaattgtgccacgtccctcaccattgcctgtccgcacttcagatgcggaaacccccgttccctaatcctcaccaagccaaaggcagctgagagccagaccttccctagcattgatctctgggattcagatagggctatacgggaggaggctgttgccccagcatcttctgctggagtgatcgagtcggagggcgcctctccctcaggcgattgcaagagccctggagacatgtcagctccgtcccccatcctggagatgacctgttttcacgtgtgtagtgatttatcagtattctgtgaagtcttttaggccatcaatcagagctaggccccccggcatggcaccagacctgcctnnnnnnnnnnataatggactcggagggggcctctccctcaggcgactgcaagagccctggagacttgtcagctccggtccccatccttgagatgacctgttttcaggtgtgtagtaatttatcagtatcctgtgaagccttttaggccaccaatcagagccaggccccccggcatggcaccagacctgccttggatgcagcgttgtagccctggaccgcgacagctgtcagaaccactcccacccctgcggggctgcggaggacccggcacaggagatcgaccctctccttcccgctcgggagctggtcggaccgagggcgtggggcctgtcggggtgtggggcgggtcccactccgccggtatcccggatcatcgatgggaggattccccgccctgatcgacaaagtccctcgcaggcccgatcccatcgcacggaggcaatcagcaacccacttccatgtattgggagcgatgaatcggtgtctcggagtctacatcgttgtgcctgaatctggccgtcgtcagatttggccggaaatcgcgggcacttctcatgcaggggcccctcggttccatgtgggtaacccagggtcgagcgtcatggtttgtccaaccccgaccctcccatgcccggtgaaaccgtggttccccgcacgcccctccaccactcgacacccttcccgacctgctgccatggccacgcgatgcatggtccccgctgcccccagcggcatgctgcgatcgggcaggcaacctggcatgcaccggctcgccctcacccctaggcaccgacccgtgacatgccgccccatgctcgtcatccgggccgctggtcccgggcagacggtggtcatcggcctggcggcggattctggctgtggcaagtccaccttcatgcgccgggtgacaggcgtgtttggcggagtgcccaagcccccatcaggtggcaatcccgactccaacaccctcatctccgacatgaccaccgtcatctgcctggacgactaccactccctggacaggactgggaggaaggtggagaaggtcaccgcccttcacccccgcgcccagaactttgacctgatgtatgagcaggtgaggcattgaaggaggttgggcatcgggtgggatgagctggtatcattgcaccgctgcaggcccctgcagatgctgcaggggggggggggtagggttgtgaggcagtcaaannnnnnnnnnaatcgggtcggatgagctgctatcattgcaacgctacaggcccctgcagatgctgcaagtgggggggggtagggttgtgaggcagtcaaatcctgtgccatctgaggctgccagaccctgccaatgcgccgcgcgcccgaggtcgtcgagaagcatctggcgtggctcgactgcaggtcatgcctggtgagcggactgacccaggtcatgccgcgcttcaccaactgctgtggcacacctnnnnnnnnnncggtgcgcggattgacccaggtcataccgcgcttcaccaactgctgtggcacaccttcttggcccccacgtttgccactgcaggtcaaggccctgaagaacggccagtctgtgcagaagcccatctacaaccacgtgacgggggcgctggatccgccggaggagatcactccccccaagatcctgatcgtggaggggctgcaccccttcttcgacgatcgcgtgaacgacctcatcgacttccgcatctacctggacatctccgacgccaccaagtttgcctggaagatccagagggacatggaggagagggggcactccctggagagcatcaaggccagcatcgagtctcggaaacccgacttcgacgcttacatcgacccccagaaggccaaggccgatgtcatcatccaggtgggctgagatgtgtgtggggtggggggagtgagtatcgggggtcctgtgctggtttggcttccatgcatgacacacatgtgggcaagcgggtgtgtgggagggggcgaatgaggaccgaggggttgtcataatgtgggaagagggactggcatgttcnnnnnnnnnnagtgagttatcggggggcctgtgctgggtttgcttcaatgcatgacactcatgtgggcaagcgggtgtgtgggagggggcaaatgaggacctggggggggtgacataatgtgggaagagggactggcatgttcctgtcatgggcccggcatgcgtagccatctgttccatccagggacttcgttcccatgcatccctcgagccatgcgctgcaaggatgaacccatcccggctttcatcatgcgcaggtcctgccaactgacctggtgcctgatgagaaggagggcaagatcctgagggtgcgcctgatccagaaggaggggcgcgagctgttcagccccagctacctcttcgacgaggggtccaccatctcctgggtgccctgcggccgcaagctcacctgctccttcccgggtgcgtggtagggggttgctggtgggctgcagggatttgggattggcagtgtagttctgtgtcgggggcatggccgggcctgggtgccaccctggatccatgaggagccaccaatagcatcgacgagaccctctcctttgccaacacggcattgcnnnnnnnnnnagcatggccgggcctgggtgccaccctggattcatgaggagcgaccaatagcattgacaagaccctctcctttgccaacacggcattgccgtgtgcttttgacttggcacctgccttgtacgtgtaggctgaagaggagttgcttggcatgattcccccaccccgtcctcccttctccaaaatcaggcatcaagctcttctatggaccagacacctactatggcgaggatgtctcggtcctggagatggacgggcagtttgagaagctggaggagctgatctatgtcgagtcgcacctctccaacacctccaccaagttctatggcgagatcacgcagcaggtgggggtctttgtgctcggaaagagggggggggccctatgttgggctcctattgtggactgggaaattttgcaggcaggggaggagatgatacattgccaaggagatgcgggcatggggaatgggggtgaagagcatcataggatttttggcatatggcatgaggtgcggcccccagcttgcccgggacgcacatcgtgctgccaggagtgnnnnnnnnnngtgtgctcggaaagaggggggggacttatgctgggcttccatcgtggactgggaaatttgcaggcaggggaggacatgatacattgccaaggagaggcgggcatggggaatgggggtgaagattgttataggatttttggcatatggcatgacgtgcggcctccggctttcccgggacgcacatcgtgctgccaggagtgtcacagcatggccttcttctcctttggagcctcatgcactgcatcacccctccggcacccaacagatgctgaagaacagcaacttcccggggtccaagaacggcacggggctcttccaggtcatcaccgggctgaaggtcagggaagtgtacgagcagctcacgcagcgcgaggtggccagggtctaagagccgccgcctcctgcccctgcatggaatgtgcctgtccattacaaacgtccattctttgagaagatgatccattatcttgccaccgattttgaaaacaacgattccaggagccctgatcctcgggttggggtctgaccagtcgagggaactgagtgcatgcccgaaagggaaacctacagagagcaggggctcaagggatgtaggaagcggggtgcagggttgtgggttcaagaaccacggcacattgaggttggacacagaatctaactccagcatagggtcctgggtatctggttgccgccatgcttcgttcataccatcnnnnnnnnnnggggttgtggactcaagaatcacggcacattgaggttgggcacagagtctaacttcagcatagggtcctgggtatttggttgccgccatgcttcgttcataccatcnnnnnnnnnntttttgcaggggttgcgcaggctctacaaggaccaagggagaggttgttgcaggcgctgcacgaggcaagctgcttccccgagcacatccatcctgtattccttacgcctgtatgtaaagtaggtggaacatccatccctttgtcgaaccgatggactaaaagggttggatcataacaccgagaggagtcgaagccacatcgaggggaattaacaagctgctcatcacttgacactcttggaaacctgccagccgccatgcttcgttcataccatccagaacgcatccgatcccattagacctcggtaattaagctggattgggcgggaatagtactgcggtgggtgaccacgtgggaagtccccgtgacgaagtgtactttttgctggtttggggttggctcgggaagccaaagggggaaggcaaccacccaccgagatacttgcagctgatgcaacaggcaagctctcaccgcaagcatctacannnnnnnnnncaagggggaaggcaaccacccaccgagatatttgcaggtgatgttacaggcaagctctcaccgcaagcatctacatagccctgtttcatacgcctggatggaagtaaaatgaacggcattctgtcaaagcgcaggactaaaaatgaaaaaatgtatgacacagataggggtcgaacctacgaccttccgctccgtaggcggatgctctatccattgagctacagtgccgatgaagacatcgcgtgtcctgtgatgtcagggcgggatatccagccgcatactgtttgctgtctacgagccaggaagttggaatgttgtctcacatcaaattcccgcaacaacgtagctcctactgccatcggttgttcgaccactgnnnnnnnnnnctttgctgtctacgagacaggaagatggaatgcttcctcacatctaaattctccaacaacgtaactcctactgccatcggttgttcgaccactgtgcccgcgccagacaatcagtcacatagtaaaaggtcgactccagactggcagggtcgaaaaggtccccggatgccgccatctcctcctcaagcgcctgcacctgggcaggggtcaagtacacgactgcagagtctgaagcgagcactcctgccctcctcagcgcctcgtccggagcctcaggactgtctgtcgcaatctgcagcaggagggcatgcgcggacaccatgacgtggcaagatagtactctgatgcggatcagtccgcctgctcatgccaggaacaacaccatacagcctgcatggccactgtcggccacccctgctcacatccccaagggcgcttgcatcacgcatgcaacacgctgacctgctggagcgctgcccagttctcaaagggtacattgcgacatgcgaatgggttgacgaatggcacgcttggctcgctctctgtgacgtcaaatacatccttgaagggagcttcctctgtactcaaggtttgagatgaacctctgagcttgaggtaggcggcgttgagagcagtggctgctgccgtcgtgtcctggtctgggttgacgtctgggtgaagcctcctcattcccgcaatgtatgccgccctgacttcggaaaggggggctccagaccggactcccagcnnnnnnnnnnccccgcaatgtacgccgccctgacctcagaaaggggggctccagaccggactcccagcaccttttcaggagattccatggcacagagcctccaactccggtcatgaggcgcccttcttgctggaagggtgcccctggcatggggctgctgcatgagggtccacagcatggggcttcccttcctccacacgccggaaccgcggctgattagcatcctgtgtggctttcgaattgcttaatcagtagccaagctgcgaatttgaagcgcatgagtcagaggcgagcggtgagcctgcggcatcgatgtgggcctcatgaaaggatccgagcagttcggaacatggacgagccatgcatgggtttttgccaatatgtttggttacttggcatgggacagcaggaagtttcaccagatggcctgtaaattgccggcgatgtggatggaccatcgagcggtgatctttgcgcgccgaatgacaggtacctccagatcacaagcctggatacagcagaaggcagagatannnnnnnnnnacgatgtggacctcatgaaaggatccgagcagttccgaacatggaggagccatgcatggggtttttgccgacatgtttggttacttggcacgggacagcagaaagtttccccagatggcctgtaaattgccgacgatgtggatggaccatcgaccggtgatctttgcgcgccgagtgacagttacctccagatcgcaagcctggatacagcagaaggcagagatacagctttcgtatgttcacacaattataagctggccacaacaagactcacgctttatttcttcagagctgcatgcccggttgcagcaatgtgcttgaacagctgcgttctggaggggaagccctggctgcacacctggcacgaatgctccgtgcagacctcggcagcgcccgcgccgcccttgcccttcttcttcttcctggaggcagcgctcgagatgagcactgtggcagctggcggcaccgccccttgcgccggccctgctttcctcccttccttggccgctnnnnnnnnnncgcatacctcggcagcgcccgcgtcgcccttgcccttcttcttcttcctagaggcagcgctcgagatgagcacggtggcagctggcggcaccgccccttgcgctggccctgctttcctcccttccttggccgctcgccttcttcgccgtgccggcgggcagctgcccctgccgggccccgaggcctcgcccccgctcccctcgcccggatcagcgctggcgcggccgctgccgccagcgggtgcgtcccggccctcagcctcgctctcactctcactgccagccacggactcgtcctcgccggacgtgtccgcggcgtcgagtcgcagctcctccagctccgccgccgccctgtcggccgctcgctgccgcctgcgccggcgtcctggcagctgccgctgcgccgccagcatgcgctgcagcatggcctcgtcatcgtcatcgccgtcatcatcatcgccgtcatcatcgtcgtcgtcgtcctcctccgcactgtccccctcgtcctcccctgtcgtctccccagcactcgtgctgtcatctgcactgctgccggtcgaggcactctccctgtctgcaaccccgggcctgtctggcgcnnnnnnnnnnnnnnnnnnnnnnnnnnnnnnnnnnnnnnnnnnnnttgagttcacctggacctgccccatcagccacctcgtccagaaggaccaactcatcctcctgcatcacagcccgcaggagcgccacctcctccttatgctttttggacctgcagagtgcagtgaacaggcggcggtcacgcagaggtgcaggtggcgtgcacaccctggcaggcaacctggatggactcggcgcccgtgcacccaacccccccccccccccccccccnnnnnnnnnntcctcgatcccccgagccaacctcggaacttgagctgaactgctcgtcagtctcatcgtcctcctcaccactgggcaggcgaactgccccatcttcggaaggctcctcagccttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgacctgcagagtgcagtgaacaggcggcagtcacgcagtgatgcaggtggcgtgcacaccctggcaagcaacctggatggactcggcgccccgcgtacccacccccctctgcccacctcgagtggttctggagcgcacgctcgctcttaaagtgtttgtcgcatgccatgcagtaaaaggtgtggagctcctcttcctgcaggtcagcctcggagcctgaggagcctgcctcctctgctgccagccatgcagcctccttgtactgccgtgccttgaggagacgctcctgcttctcacgctccttcctgcacaacgggagtggagcgccatggacttcaccaaacgaaacatgaaagacattgcatgtggtcggaaggttttcaatcaaccaagcgcgcaggaaaaccgcaaaagggagtggaaggcaactatcctaaccattggactacaagcgcgggggtgatgcgctcgccgggaatcgaacccggatcaattgctgacaccatggatcgagtgatgcaaatgtgccatttttcaggaacaggaagcttcaatttgacacagaactcccatcctcgaggttttccatggtgcagagtgaacgttccatagtatctgcacaacataaaggcaagggccccatcccaaccccatggccccgccgaatcgcacctctcggcctccannnnnnnnnntatcctcgaggttttccatggttcagagggagcgttccatagtatctgcacatcttaaaggcaagggccccatcccaaccccatagccccgccgaatcgcacctctcggcctccagcgccgcagcctcggccttccgcgccgcctcctccacggcatgcgccaggacgcgcttgtcccgcttcttcacgaacgccaccatctcccgcacattctcgttgaactcgcggcgtgccgcacggcgcgccttctcgttgtcagcctcgatcatgcgccgcacctggcagcatggccgggaaaaggggggggctgagtcgtctgcctcccacgcagtgcagccgcagtggggcaggcaaggaggcactcgcttcccttggtcaatctgcttcctgagcagaggtgcacgagctgcatgcaggcgggttcgctgagtgccactcccacaaatgtgctccgatgcggcatgcgccgctgcagcgcatggatgtggagtgcacgccccgccatgcatcccactcctcgctcannnnnnnnnnttggtcaatctgcttcctgagcaggggtgcacgagctgcatgctggcgggtttgctgagcgccactcccacaaatgtgctccgatgtggcatgcgctgctgcagcgcatcgatgtgagtgctcgccccgccatgcatcccactcctcgctcacctggcggtttggggccgtggccgggttgtactggtcggcccaggaaaagctgcgtgcagacgagaagctggaccactcggcatagaaggtcgccacctccggccatgcagaggcggaggtgcctgcagtgtggagcgaggagcgggtgctgaagcggtgcagctattcaatgcagcacaggttgatcaaggatgaaggcaggtcgcaataatgcaccctcccaaggctgctggtgggctcgtggctcgccgctccatgtgcacaaaggaaatagtttactatctcagcgcataatttcacaagggagggccatgctggtacctcacatgacagcatgcatactcaaaaactcccataaaatgtctcaccaaaggaggggtacacgaagctcnnnnnnnnnncttactatctcagcgcataatttcacgagggagggccatgctggtacatcccatgacaccatgcatactcaaaactcccacaaaacgtctcaccaaaggaggggtacacgaagctcgtcctgctcttcccaccccgactctcggcctcctgcttggccagccgctcaaaaagcccggaatatacgccatagaagctctgcggtgttatggagaaggtgtccctcagcatcttattcaagaggactggagagtgtcaaccgatcaaacaagcaagctagggaccatcttaaactacccattcctgttgtggcctccctagatcagcccggtgccggccgaccatggacatcctcgtgccgggcacatcaccgacagcctccaaccacagctgcacactccctccctgnnnnnnnnnngtagaagccctgcggtgttatggaggaggtgtccctcagcatcttattcaagtggactggagagtgtcaaccgatcaaacgagcaagctagggaccatcttaagctacccattcctgttgtggcctcccttgatcagccaggtgccggccgaccatagacatcctcgtgccgtgcacatccccgacagtctccaaccacagctgcacactccctccctgtctccacgcgtactcacccgcaggccgtccccaaatccagagtaggcagtggacgagaagtaggcatacaggtttatgtcatccggtgcctgctcggggccgcccatgctgctggcgcccgcttggtgtcggtccccagatcggaggatggcatcacggtggccatcgtacctacaggatgtcagaggaagggggaggatggtctcaggatgtctcatgtcaggagtagcctatctctctgcaaggccactctctggcatgtggacagggagggctggcgtgggggcaccccgagaacacagtcgccgcttcctcaccatgagcgctcatgcttgtcgctcagcacctcatatgcgttctgaatctctttgaatctgtcccctgcgagctcggcctggtgctggttcttgtctggggtcaatgtgggtggagggcatggtggaggtcatcggtgcagccggtatgagcgactctggggaacaccacaggagcagtgcacgagagactctggggaacacttacgagcagtgcatggcgacacataacacttctatcgcacctggatgccatttcaaagcagcttttctgtaggccaggcggatggcagaatcgtcggcgtccctctccacctccagcacctcgtagaggcagcgcaccatggcagcgccaacagcccaccggccctatcaattgccgcagtcaatctgccacatatacactctacattaccatcatgagcatgtacgtgaagtgtgtaagtagccctaccaacctgtagcagcagtcgcgcttggtgaggaagcgcgaggtctccaagctcagcatgcaggacatgccgaatccgaacgcttcgagcacagccagatatgccgcatgccactgcgtagcccggcgcgcagcctgacactctacattcatacattacgtgaaatcagtgtatcccgacacagacatgagtcgtttgagcctcaggacaaaggccgaggccccgccagagccggtgactgatgctcactgcgaggccgcactcaacgccgtgcaggcatctgaggagccgatagcagtcaccatggcaggatcgcctcccggaggagaggatgtggtgtcggcaatcgagcatgccgcgccatcaccaggcccggcccaggtcgccacagaggagcgagaccccagtcaggagtccggcagggccaagcgcagcgtgcgccgaaagtccgccgtcatcatagaagccgcaagcgatgatgaagaggcgggagtagaggacaaaccaggcgagaaggggaggagctcgtgggggagtgcctggtgtgatgtggcgtcgtcattatgggcggcatggaggagtgattgtgactcctgcgctcgctcttgctgatcccaggtgaccaagatttcgaggctttttctgatgactccgcggactcggatgaggactcggatgatggcgactccagcgaaaacctgtcaggtctgcaccgggtgcaggtgttcggcctgatcaggcatcaattacatgacaattcaccattaggtggcggcacacgctgagaaatctctggcatgagcagcccaaatgcgttctggctgggctactccccagcaggctgtgtgcagccagggtactgcaatgcaagcttgctgacctcaacaaccctccccgcgtcccgaccctgcagatgaggagtcccctccccccaaggccaagggcagggggaaggccaaggccgccgcacccgccccaaaggccacgaaggccgcaaagcccagggcctcggcgggctccgcccccgcgccccgccccagcaagacgcccaggctggaggcgggcaccccacgccgcaccagcctggcgtcctccggccccaaggccaccccgcgcgcccccgtgtcgctggcagggaaggagaaccccgcgcccggcagcgatgactccggcgcccggctgggcaggaagctgcccacgccccttgcctcggggctgcctgcagccaggcaggataagccgctgacgccgcgcctcatccagcctggaggtgggtgtgagcgctctgtgtatggactgctggtcctggcatggaccagcgatgccagtggttgttggtactgctgcatgtgtgggcattggctggggtgcttcttcagaagcagggcccggggcacctgcaggcgccatgctccacgtcccatgcatccgacgcagccctgcgttgtcccctggcaggcatgctgcgcgtcccnnnnnnnnnncctgtgtatggactggtggtcctggcatggaatggaccagcgatgccagtgggtgttggtactgctgcatgtgtgggcgttggccggggtgcttcttcagaagcagggtccggggcacctgcaagcgccatgctccacagcccatgcatccgacgcagccctgcattgtcccctggcaggcatgctgcgcgtccctgggctacggcggaagtgagtggccgatctggcaaattcctgatcattcactgggcagccgcagcctgacccctctctgctctgctgaaacgcggtgtagccgtcccagcccttgcacccttgcacgcgtgtccagaggagggctcaaggtgcaagcaccacctggtgccaagctggaggcagccacgctcaatgtccctgctctccatgcatggcgcacctcgagccaccgtgtcccaatccccaccaccagcgcttggtacctattacgctgccctgaaagaccgatgccctgtactccccacacgccctttgaaatggcacaactactcaagcgagtggcaggatacagaggtgccctgccacgcaggcaggcgcagcaatggcaacagagtgnnnnnnnnnnatgaaatggcacaaacactcaagcgagtgggcaggttacagaggtgccctgccaagcaggcaggcgcagcaatggcaacagagtggcggcacgcgatttccgtcctcagacggtgtgttgagtcagcgcgtcagtgtcaacagtatgtccatggggcaggcagccctctccctggccagatcgcccgcctgccaggcggaatagggaggcaggcagcgtggcggcgacgcttcaggcaggaccggcgccgccggtcnnnnnnnnnncaggcgcaagcaccacccggtgccaagctggaggcggccacgctcgccgtccctgctctccatgcatggcacacctcgagccaccgtgtcccactccccaccaccagcgcttggtacccattacgctgcccttaaagaccgatgccctgtactccccacacgcnnnnnnnnnntggcaggcagccgtctccccggccagatcgcccgcctgccaggcggagtagggagccaggcagcgtggcggcaacgcttcaggcaggaccggcgccgccggtctgggacacgggtgggggcggtgaaggcctgagtgcatcgcccagtgacgtctccacgagatcctggaaggtcgcctgggtgggnnnnnnnnnncaaagggtgtgtggctgcaggtgcacagaacacaccatacaacagggggctcgatttctgggcattcccccccaactggagcgcaccaccgcacctggccctcctggnnnnnnnnnnggcaggcctgagggcatcgcccagtgacgtttgcacgagatcctggaaggtcgcctgggtgggcgacacccacttctgaacaggagggaggcatgaggagggggtgtcgcaaggtgaaccggactcaaaagtgtgtgtggctgcaggtgcgcagaacacaccatacaacagggggcacgatttctgggcattcccccccaaccggagcgcaccaccgcacctggccctcctgggagccggccgaggcgaggggcgcggcgaaggcctccgccgagaagctggggtggcccaggggcgagacgggtggggtgggggtcgccgggctgcgcagcggcacgccggccggcacgtgctgcaggtaccagggccggtcctcctttccacttacggaccggcgcagctcgcccgacccctggaagctggagaacacgtcgtccgccggggctggcggggggggaaatgggggcgatggctgttgctggagtgatgcggctgccttgcaaatcactccagtccccctggtccatacatcagggctggactgcaggctgtgacatgaggaccagcccgtgagaccatggctcacctggcgcaccgccgtgcccgtttgagcttggcacaggggctgcgtccgggctgccagccatctgtgagaagtctggggaccaggacnnnnnnnnnnaggaaatgggggcaatggctgttgctggagtgatgcggctgctttgcaaatcactccagtccccctggtctatacatcagggctggactgcaggctgtcacatgaggaccagtccataagaccatggctcacctggcgcaccgccctgcccgtttgagcttgggacgggggctgcgtccgggctgccggccatctgtgagaagtctggggaccaggaccctgggacctggaccggggcgggtgcagcggtggatacagtgggcgctgccactcctgcgctccccactcccagagaattgctgatgttctgcaagggcgaaaaggggagnnnnnnnnnnaggggggcgctgccactcctgcgctgcccactcccagagaatcgctgatgttctgcaagggcgaaaaggggagattggaggggatgtgggtttgctggtcaggagcttgggtgcagggtttgcagagggtgcaggatccaccaccagtctgcactggaggtatgtgatgaagctcaagcacccccagcaccacttcgatatccagaataacggcgagcgactggccagcctgtcccccagcatgcaccccgcatgcacagccccaggacctacacattcgtgttgctcaccaggttgtannnnnnnnnnaaggggacagcagggggagaaggtcagggcagggttcggggcatgcactcttcaaaccaccgtactgctggcctggcgggtacccccctccagcctgcctacagcccgacaccccatcacccggccacggtacacacannnnnnnnnnatcaagccaccccagcacctcttcgacatccagaataaccgcgagcgactggccagcctgtcccccagcacgcacccagcatgcacggccccaggaactacacattcgtgttgctcaccaggttgtagatggggggcaggtcgtcccgagtcggctgagagggcgctgcttggacctgtgcagggggtaacagggggagaaggtcgcggcagggttcggggcatgcaatcttcaaactcctttactgctggcctggcaggtacccccctccaacatgcctacagcccaacaccccatcacccggccacggtacacacatccgaccactctgcacaggctcaccggtgagggagggtcgaaatccagagacagcaggtcgtccaggacctttgggggtggctgcgtcagcgcacgtgacccggaatccacctgcagcagcatgttgggttgagcactcgacggcgtgtccttgcctgcacaaacttggtcccttgacaggccacgcacagctccccgacggcctctggcccgccattcccaggatgcagcccccaacacgccgccgcaccgagacgtgtnnnnnnnnnntccgcactggcagcgccggcatcgggggccacagcaggcgtacgcgcatcgtgcgtcagcaccagtcgcagcagggctnnnnnnnnnntgtacgtgacccggaatccacctgcagcagagcatgttgggttcagcacttgacggcgtgttcttgcgtgcacgaacttggtccctagacaagccgtgcacaactccccaccggcctctggcccgccatccccaggatgcaccccccaacacgccgccgcaccgagacgtgtgaggtcaggggtcggggtggggaggtcggggaggtcgaagcgagcgaggttgccctccccgcaccggcagcgccggcattgggggccacagcaggcgtgcgcgcgtcgtgcgtcagcaccagtcgcagcagggctggcagcttggccccctgtggagtgtgcaaaggatggagggcagggatgaccagcagaaggaaactgttgtgccaaggggtcatggtgaagggtgggcaaagacttgcgtccatggccactctacacagcccctgtctggcccaccaccatgcaacagggccatgcgtccagagcctccggatcccatctcacaggcgccttgtagatctcctccagagcctctgcccagaactcggccccatgcagcccccccgagcgcctggagccgtaggacagggagcgggccagccccttcatggcgccctgggccgacgccgttgggttcaccacggggggcccatgcgccacggcctgggcgtgtgcctcctgggaggacggcgtgcggcaccgggcgcgtggtgggtcggaggtcccgtgccagacgcgtgcgaacgccgcggccccgccatggcccccgccccgccaaaccccacactaccaacaaccagagcgctcaccgcaaagccgtggatgaggcggaggactcccaggcgcagctcggcctgcttctcccaggtgtcgcccgtgacctgatgggggtggggtgaggatcatggtccgatgagctgcagaacaggataccaggcagaggaacacgcaggacggcttcttcaagcggcatgcaggctgcccgtggcagtgcacaggcaggcgccatgctgcaccgtcacccaccaggcgaatgagccggtaccgcaggatctgcaggaccgcgctggggccctgagggtcctggccctgtcgcagcctatcccagcaaatgcgctccagctgggtgtagagggcaaagagctcgtccacgctggagccaccatccctgccgggtgtgaggagagtgggagatggcgtccaatcattgtgggatggctccttccatccgcggcgacctcctgggcagcagcctcgcatgcagcagcaggggattgtctgcacggccaagtgagcgatgcatggcaatgcagccaccttgaaccccccactgcaggtctcccatggcttacccattgaagtaggtctggtcgatggcattacgaatggccttgaagggtgcctttgagtcttccgacttgttgccagtcgccacaaccagcttctgcatcagcactgtttcatacaggcatggatgaggcttgactgtgaaatggcctaagagagcatcacacaagtctgcaggctcgtgaaccttgacctggggtttcccaccaactgcccccccaccccagctcacnnnnnnnnnngataaaggcatggatgaggcttggcccaagagcgcatcacacaagcctgcaggctcgtgaaccttgacctggataccccaccaactgcccccccaccccagctcaccaaacacctcctcggacgcgatctctaagtttttctgatcgttccctgcaaactcatggcgcatgtacttgcgcactatctcggaggcgtattggggcacagttagaccctgcgcaggtgcgagaatgacccatgaggtggggacaaatgaggtgcaacagggactcgcactccgtatcgcattcccagcaagtgccccggcaagacatataatgcgcaggatgctacaagcatgttctctgtaagccagatggtgtacgacgtaccctgggagccatttctctccagttttctcttgaagtctgcttctcgagcgttgacgatctttggggccagagcgctggcgagcgagctcttcagtcgaatattcccatgatatgattgcagcagggttccgagaggatggcgtcgacagcgtacgccgcgcaggggaggtggactcgtcggatcgaggagctgggtgggggcgttgttaggaggaaagcgaggcggtgcatggtctggcccctagcagtcgtgcgatacaatgacatggcaccttgcaatcccctgacaccatatgtgcggggctgtggcggtgccaaggagtgctagtgggggttcgatcctctggatggtagggaatagccccagaccgcagatcaaggtatgtggcttggatgggagcagatgcgtattcatatggaccttggcaacgagactccgggggcaagttactctgcctttaattgtggggttgccgtgccaggagcaatcgattcacgggcagagctggggcggagtctcggcnnnnnnnnnnatgttgatatggatcttggcaacgagactccgggggcaacttactctgcctttaattgtggggttgacgtgccaggagcaatcgatcacgggcagagctggggcggagtctcggccttaaccccatactataaggaagcgtggggcatttcccgccacgatccccatccccagccagcctgtcgggaccagaagatgcatccccggggacgggggtgattagctgggctaggagtgaaaccgcgctcgcgatcaccaagatgcgcatctaggtgaaaatcattgattcaactggtaattcagggtccttcagccccggaacgaagcttccaatcgcaagaggcagccgcttcgagctcgtttacgccgagcgacccaggagctccaggccgccctaaagctgaataaaggggcacagagcgcactcgtactctctcatacaccgnnnnnnnnnnactaggtgaaaatcattgattcacctggtaatacagggtccttcaaccccggaacgaagctcccaatcgcaagagactgccgcttcgagctcgtatacgccgagcgaccgaggagctccaggccgccctgaagctgaataaaggggcgcagagcgcactcgtactctctcatacaccgtctctggcatgcctacctgagtcggtaacgttgcgaggcccccagcacttaagaagtggccggcacctgcaccgagggctggcgcacgtcaccagcaggccgacgcccggtcatcagtacttcacggcccggagttcacctttcggctcctagtatgccctcgatgccctactacgacaggatcaacgacgccgcggcctgtctcatctgcttggccaaaggtgcgacttcttgcctggccctgaaccgattgcattggtctgagatggaggggtgcttgaccaaggatgggcggtgcccgctccagcctcagatagcttgtttcagcacccagtgtgtggcaatgggccatggaaccccgtctctctccgcaccgcagggtcccaggattgtccccatggcccctccacccccgccgaggtgcgggtgctggaggtggaggcctttggcagcgtccaggacctcatccacgcctccattgcctcccgcggcggccaggccagcctggcacacatctaccagctgtgccacagccgaggccgggtcgcctaccggcggtcgggggggtcccgcctcatcacccagaacgagcactggaagagccagattcggcatgcgctctacaccaacccgcgatttgagaggtgtgtgcctcaggcatgcgatcgtgggtatggtggaagccgaccacccgagcctgcctggctggggctcctggcagcaaaatgatggcggacgtcgacctcacaccctcccacgttctattatctgcaaggtgccctgacgacccggacatgtggcgattgaccccggggaagaccatctccccgccctccatcgtgcgggtgctggnnnnnnnnnngatgatggcagaagtcgatctcacaccctcccacgttctgttatctgcaaggttccctgacgacccggacatgtggcgcttgaccccggggaagaccctctccccgccctccatcgtgcgggtgctggtgcgaaccgatgaggtggctgcccagacggaaccgccgccggaggccagccgtggcagtgccgcgggcggcgcggccgaccgataccctggcgcctccggccactgccagctggataccccgcccctgaggcaccgcagggccaccttccccgccatttccacctccgactgcgaggtggagcagcggccggtgcccggcggcagccctgctcgaccctcggcgggtctgaatgccccacgccggcatgcgaccgggcgcgccgccgcgcccgccacctcgaccgacgcctcctcagcgtcggcgcgccccgagcccgcaccagtctctcgtcagcgcaggcctgccgaagcctgtgaccctggcatgaacaccgtgggggcgtcccgctgcgtgcagccacgcccagctgtgcggcgccgcacgcggttcccgagcgcggaggcccggccagaatcatgcgccggcgacgccgccgagctgtgctggggcgccaaggcacggcgcagctcctgcgccgcgcggtcgccccctcgggactacaagaaagcgccgagcgggcgctccacgctgtgcgacgacggcggggccctggcctccctcgcggtacgtattattgttttgggacggcatgggcgggtgttgcctgctgaccaatccactcggctttatagcgccggactcctcggttacatgccgatttccatcccagttgcagtccccacatgctgctcctcccttctccttaaaacacaaaaacattcaggcagcggcttggtgccagccctgccgcgaccgggccaggctgacggccccgccgcagtacctccaggcgctgcaccagcaccaggccgccctgctggcgacgcttcgctgcaggctcgggtcagggacgtcgcacctgctggggggaggagcccacaccctggatccgcccggagctggggagccgccgcggcttggccaactcaggacgcagcagcacccgtgcccgcaagccggagccttaaatgtcgagaggggcgccacatctccctgatgcggggaggatcttgttgtgttaccccgctcagcacacccctcgcgcgatggaggtgcctcctattttgccggttccggattcatgatcttcggcttgctcccctgtgtatggccagacagtgctctggcaaccctggcggcctgtactgctccattgcatcggcgccggagctgcctctgtgcagccatctgtgcttgcagcccgccgcctctgcctcattggcaccgctctgaacctttgaaccatcttcctggcaggagctggatgctctgccgttcctgtctgcatgcctgtgcccgtcccggtgcgggctctgggttccctcgtgtggcctgcctgccgagtctctgccagaaaatacatgctcaggaggtatgggaataatccgtgtggggtgagcaagcgaatgtgatgcaaaggtgggtcaaagtgagccagcaagagtctgggttctgctcgccggtgccaccacccgccatcccggccccctacgcctccacatgcgcggtcagccgctgcatgatgtcgatggcatcctccagcgtcaccacctcctgggggcgcagtgggtggaaggggttcccaagggcgtcggaggtcggtccatggcgcgagaggatgcatgcaggggtatgtgcagcatgcccacgagactctacagccgacttcccctgccccgggcctcccatccacattatcatctgcacgttccccccatgctaccatctccactgccccccgtgtgaccacctgaactccacacccccccccatacacacacacacgcacacacccctacctggtcaaagacgaggcgctcaacggcgtgctggcccgcacggcgcacccgcacgtccgcccccagcttgtcgatggagatgaccacggcgtcgtccacgccgccgccgcgcgcgccgaagaggccgcgcagcgcgccggcaaagcgctcgttgagcacacgcaggacggcggtggggccgtgcaggacgatggcgtctggggtcgcggcggcgtactcccccgcgtccacccactgcaccgtgccgaagccgcccacaaagtagatgtcgcgcaggtggtgcatgcggaagtactgggcgttgccggagagccagcgcgaggacttcttggcagggtcccccgcgtgcgaggcgtgcttctggtggaagatctgggataggggagggggaaagcagaggagtttggggggaggggcagagtgcgatggtgtgagaacctggtcggatgggtgggagggatgagccacactccacacggcacactgcatnnnnnnnnnnaagaggagtttgggggaaggggcagagtgtgatggtgtgagaacctgctcgggtgggtgggaggaatgagccacactccacacggcacactgcatgtcactggttggaaacgcgggaggggagccagattcgaccacgccggcggcagaacgatttgccttcctagtatcaccccgagtcaatgcatcggcatcgccccaagctcatgttacaggccgccagcacagggcccaataggaacccacctcgcgcgcggcctcttgcatgtcgctgggcagagggtagacgtccccgaagatggtcactcgggcgttggccagccccgtccagccaggcaactgaacagaggggtacgaggaggggtacatgagcgcatatgcaaaggggcaggtgagtcagcgaccagcagatcttttgggttggttcggccgccctcgaccgagatgcccagggccacacagaaaaacatagannnnnnnnnncatttgccttcctggtatcaccccgagtcgatgcatcggcatcgccccaagcccatgtcacaggccgccagcacagggcccaacgggaacccacctcgcgcgcggcctcttgcatnnnnnnnnnngcgaggaggggtacacgagtgtacatgcaaaggggcaggtgggtcagcgatcagcagatctcttgggttggttcggccgccctcgaccacgatgcccagggccacacagaaaaacatagaaacgaacacctctcccacgtggaagcacacacctgcagcaccaggctgcaccgcgcatcctcccggatgttgcgcgtgtggatggccaagggggagagggagaagagcgggtgccccgcgccgtcggcggcaaactccaccaccgtgccgaaggggtaccccgcccgccggtggtgcatggcagacatgagggtgcagaggtgagcgtgctgggcctgctccaccaggttgcgcacggccaccgcgggggagggcaggtcgcagcgcagcgtcgcgttctgcacgccgcccgacagggaggtgcgctggaggccgctgcttgacaggctgcggttgccgtctggcgacaggttgttggaggggaaggccaggctgctgggtggggagcctgctggtgttcatagcggagggggtgggaggatggtcgtgtgtgtctgtgtttgcgtgtgtagatcaacagacaccnnnnnnnnnnttccatagcggagggggcgggaggatggtcgtgtgcgtgtgtgtttgcgtgtgtagatcaacagacaccctggtagcctggccaccatggaaaaaggcctcgcgacaacccacctcctgacgacggagggctggacttgctgcgcgacgcggctggcttggagttctcctccttgctacaccgggtcacctggaggcggggcattggccgaggaaaggcccgacccctgttgcggaactggtgacatggcgtggcaagctggcactgcgccgaggccaagcagtgggctcctcccgacatccctgctgagactcgcgcgatggattacaggccgagcgagcactttatgatgggtggcttggtgggtgctgggagggagtggacgaggtcggagagcacactccccttcagatggccactccgggaagaaccaggaggggtagtactgcggcgcctgaatggaatgcaatgtaagaatcgtcgagtagtctgtaatgacggctgaccgcgacggttgggaagcaagacgaaatctagcctggcttgaggggcatcggaaaccacgcgcgcgcgcgggaggaattgggggggggtacgctttgggattggaagcagtccagggcctaacaccgtgctgccagggtccttccatagcnnnnnnnnnnacaatgtaagaatcgtcgagtaggctgtaatgacggctgaccgcgatggttgggaagcaagactaaatctagcctggcttgagggggcatcggaaaccacgcgcgcgcgcgggaggaattggggggacgctttgggattggaagcagtctagggctaaacaccgtgctgccagggtccttccatagcggcccatcagaattcacgctttcgacgcctctgcacccttggccaccggccaccaggtcttcacgggggcaaaggtgcgcctgtgcgcggggcatggcccatgctgccgaatggctgcgatgtgggccggcacgccataccctttgtgctggtcgaaaccgtactcggggtgctgctggtgcaagctcaccatcagcctgtcgcgcgtcacctgtggggtggggtggaagaattgagagggattctatccacgggttgctccagccaccatcagtgactcatgcgtgtcgcagtttgtcgacccatgcccccacagccagcagaaaaccttggcgaggatggaggctgcggcgatgggaatgctcttgctgtcacccttgatgatggcggcgctcctttccctgtccatgtcctgcacagggtagggggctgaccacaggtctgctgcaggccctggacatgtggtggattgcccccctggctgtggaggggggtcctatacatgctgaggacccagcaccatccatccacccaccctcctgctcccctgccaccttgggcaatcggttgccatcgaccaggacgtaatctgggtaccccgttggtagggcgtccacagcctccaccatggccttcagagcggccnnnnnnnnnnacctcctgctccccagccaccttgggcaatcggttgccatccaccaggacgtaatccgggtaccccgctggcagggcgtctacagcctccaccatggccttcagagcggcctgcaggatgttgatgccgtcaatcacctccactggcaccacagccctgcgtcgggggatgagtctgggtctttgaggcagccaacgccctggtccaggcctggtgggtcaatatgtaatcgtttggccaaacagtatgcacgccctgccaggtattcacatgcgggagcaagcagcgcactcacacggcccattcgacggctgggtgttgcgtgaggaggtcgtaagccgtctcccgcccctcctcgctcatcactttgctgtcatccaacccagggatggtcacgtctggggggatgatgcacgctgccgcaaccacggggcctgccagtggtcccctcccggcctcgtccacgccttcgatgatggtgttggggtcnnnnnnnnnnagccctgatccaggcctggttggtcaaaatgtaatcgttaaaccaaacagtatgcacgccctgccaggggttcacatgcgggagcaagcagcgcactcacnnnnnnnnnnagggttgcgattcatgcccatgagcagccccctagctgccctgtgtggctgcaaggatcacctgcaggaattgcgcctccggcatcaagcccacgaatcaacgtttccttctctgcacccgcatgccggcgcccccaaacccacctgccactcgacggtgtcctttggcccattgtacggcttcatggtccctggttggaccagtgctcaccctccgcccacctgccctcacnnnnnnnnnnggggtcgcgattcatgcccatgagcaggcacctagctgccctgtgtggctgcaaggatcannnnnnnnnncttttggggatctgaccagttttgaacccttaagaactgacttggaagggccgatgccgttgtggggcttcaggactcgagcagccgtgccatcggccacatcggtgccccggccagccacccgcctggatctcctcagcggctcccctgaagcgaggggcatcgtcatacaggctaccgcttcattgcttggatgagctccatcatcacattcctcgaaacgctgtcacacaacgaaaatatccccattgctagagcgaggttttcaaaatcctgagcgcgggcgcgacggggaacccggcaccgcacaatttccgaatggacaggtgtctgcgacaccactccacgctgacgctcaacagagcaaaggcctagacggacgcaatttgttctgatgtacacatggaggatgggagtggactgcggcgtctcttcctcgaccaagccagcagcggaccgtccgtggccctattgccaacgtcaggcccgaagcgatgcgggaacccagaannnnnnnnnngcgcaatctgttacgatgcatacatggaggctgggagtggactgcggcgtctcttcctcgaccaaaccagcagcagaccgtccgggggcctattgccaacctcaggcccgaagcgatgcgggaacccagaaacgcagactttggcgactgagaacatagaccttactgcagaagagctttcggatgccgaaaacgatcggtctggcctgcgcgtcgaggcaggggcaggcccccacatagatctcccagaagcccatggtgaggagtggtcccacgacatcgatgacaggctccaggaatggctctcctccatcggactggcgcactaccacccaatcttcagcaatgcaggtgatgcagttgtggtgttatgcttgcatccacactgaactctgcacagtggatttcacatacccatatcgcctgagcccctccccaggactgtcgctcgacgctgtgcggcatctcacggaggaagacttccgagtcctaggcattccgacgctgggggctcgcaggcggctcgctcttgccgtgcacgacctcaagcgccctggagctgtggggaagggtgagcagaagtgggaaccccaccaacctgaccaagcccagagcaggacacccctggcccccctcaacagacgacccatctccggcatcacccacttcttccgaccagcccaaaggtgggagacagggtaggattgaaatgagagtagattgggtaggcgtttttcatttttctctttgcgcgtggctagcacccaaccccggccctgaggcgcatgcaccccagcgctcggaattactgccaagacaacctttcaagagaccgcctgatcccccacaacacagcccgccctcgaagaagannnnnnnnnncactgccgagacaacctttcaagagaccgtctgattccccacaacacagcccgccctcgaagaagagagtcgtcagtggcatcctgcagtaccttgatggcggagaggagtacgctgccagccggcctgctcccccccagcaggcggcacagcagggttggacgcacaaggcgcccgacatggccggcaccacggcccgaccctacaccatgcgccggtgagattgtttgttctgttggacgggagggacgttgccatnnnnnnnnnngtagcccgaccctacacgatgcgacggtgagattgtttgtgttctgttggacgggagggacgttgccattccaaccggcttctgacacccgccacaatagaccaggatgccaagtagttgaggacaatgcgcacagcaatgacccctcccctgcgccgtgcctcactccttcannnnnnnnnngcaccgaccataatagaccaggttgccaagtggttgaggacaatgcgcacagcaatgatccctcccctgcgccgtgcctcactccttcacccgcctggacccgctgtcttcagaaagggtggcgtggtcccgctccgcccctggcagctggtgcccggcacccagtttgtggtggacaggtttgacagcctaccgccctccctgccccagcaccgccactggttcctgacccacttccacgccgatcactacaagggcctgaccgggaagtgagcgggattcgtggtgggagggatggttgggatcatggccccgcagaggggcgaaagctcctcaccccgcactccccaggccgcccaccaggatcccagtcctgccctgccagggcctcagatccctcaaacacactccaccaaaccacaccacattcctccaatccctgcatggctcgccaggttcgaccgtggcatcatccactgcacccccaccaccggcgccctggtggcgcagcagctgcgcgtgccgccggccaggctcaggacgcaccccctggacgagcccttcgacctggagggcacgcgggtcaccttcctggacgccaaccactgccccggcgccgccatgctggtcttcgaggcgagccccggggtcgcgggggggcaggcgcgccggcccgtgctgcacacgggggactgccgcctggtggcacccatgcagcgcctgcccgccctggccaggctgcgtggcagggccgacctcatcctggacaccacctactgcgacccgcagtaccagtttccctcccaggacgaggtacggcatttcgggtaaatgccggtgtggggaatgatatgggggtggtttcatgctcttccagacagtgaattggtctctggggaggcannnnnnnnnntccggtgtggggaatgatgaggggatggtttcatgctctgccagacagtgaattggtctctggggaggcaggaggcacggcatgcagctatgtgcgacggggggggagggggagcggatcctgctgatgtgcgcagcatggtgagcaaaggctgccctaggtgggcatgaacagacgttccgcgtgcggactcttacgatttccacactctcacaatgccgagccaggtcctgtcctttgtcatcgatgctgtcaaggcggaggccttcaaccccaagaccctcttcctatttggctcgtgagtgcaagttttgggggtttgggaaggaggctgtcctggtatggagggatgggcggcgcaggcaggaacctgcttagttgtggtcatgttgcccagtctcagcccgggctcctcctcaaaggtttgctgcaccaagcacagtcattcgnnnnnnnnnngggaacctgcttaggcatggtcatgtttcccagtctcagcccaggctcctcctcgaaggtttgctgcaccaagcacagtcattcgcacccagccaagtcccacacgcccctgccgcttgccagatacacgattggaaaagagcgtgtgttcctggaggccgcgcgggtgttgagacagaaggtctatgtgtctnnnnnnnnnnccgcccctgccacttgccagatacacgattggaaaggagcgtgtgttcctggaggccgctcgggtgttgagacagaaggtctatgtgtctgccaccaagctcaaggtacggcggctcgccgtgtcggggaatggcaggggcacggctatttaataggtctgaacatgcatgctcacctcaggttattgtttcagacctctgccggcttgacgcgtgcgcgcctgccgctccaagttcaacctacctttccaacaccttgnnnnnnnnnnctgtcggggaatggcaggggctcggctattaaacaggtctgaacatgcatgctcacctcaggtcattgtttgagacctctgccggcttgacgtgtgcgcacccgccgccccaagttcaacctacctttccaacaccttgccagatcctgaactgcctcgagcttgagcctgaggtgagggcccagctgacgaccagcgaccgggagacctccctgcacgccgtcccactgtggatgattacgcatgaccatatgaccaagctgctgaagcactaccggggcagattcaccaccggtgagcagccgagggaattggtctggggaatttgtgcgtggcaaaggagtgcccgccacatcgccgagggcggagtggcggaggaggcgcgtcccagcttccccagccctttctagctcgcactaggaggcacacagcttacgtatggcccctggcctctgagcaaacgccaagcnnnnnnnnnnatgtcccagcttccccagccctttctagctaacagtaggaggcacacagcttacgcatggcccctgacctctgagcaaacgccaagcaccgccgcccctcgccctcctgccacagtggtgggcttcaagccgaccggctggacgcatgacaaggaggccgggcggacgagggcacgagggaggaaacagcagcgggggtccctcatcacctaccaggctagtttgttgtgctgtggagcaggaaatttgttgggcctcctgggtgcagggtatacctgcgggcaggtgcagcagctgcatagtcaggtgcggaagacccattcacatacatcccaaacccacaggtgccttacagcgagcactccagcttcagcgagctgcgggagttcatgacctggtttgctcccctgcgcatcgtgccctctgtcaactcggactgccacggcccaaaggccaaggcgttggtagacctgctcacaaattgatacctgcacacctgtcgagctgtgatgcacccttttctcgccgcccaattcccatgtaaaccattctttccgaaaatcagcacgaggatggactgcttatctgcagatggattaaggggtctgacagcaacgctcctgtgatgtgcgtgctgnnnnnnnnnngtgcacccttttctcgccgcttaattcccatgtaaaccattctttccgaagctcagcgtgaggatggactgcttatctgcaaatggattaaggggtccgacagcaacgctcctgtgatgtgcgtgctgagttccgactgcagcatggagcatgaagccttgttcggtggcccgtacttcaatgcattgccacgcaggaccgctgcttgcatgatctgaggctgcgttcagtaggatacacccaaagggctgttgccttgttgcgagtggtggggccgaggtgtgacgagatgtctagaaccgacgcccccgtctccaagctggtcgagcaagccaccagcaaggcaagtggtgtgctgggtgggaattaaatgcttcaagtcttgaaaaccaccccgacatctcgcattgatggccgtcttctcaaactgcgtagtttcacacggcagtactgcttctactctcacgccacctcaggccgacctgagctannnnnnnnnntaccagcaaggtgagcggtgtgctggctggggattaaatgcttcaagtattgagaaccacccagacatctcgcattgttggccctctcctcaacctgcgtagattctcacggcagtactgccactattctcacgccacctcaggccgacctgagctactcctactgggcggccaaaaatgcacacagcacggcaacacccgaccccaaactgctcacccaagaagaagtagctcgccagatgagcgaaatagaccgcctgaaacagactacaggcgcctcagcctggaacatggtgggttttggcgggtgattgctgctatggtggacacaggtggctcgaaggcgtggactggaagatggccaccatctttgggacgctgctctgacattaaagagctctggatccttgattgtctgtgaaagactcgctctgtgtnnnnnnnnnnatatggtagacacaggtggctcgaaggcgtggaccggaagattgccaccgtctttgggacgctgctctgacattaaacagctctgggtctttgattgtctgtgaaagactcgctctgtgtcacagtgcatgagcgacttcacgacccacacacagggcggcacctttgaggagcgggccgtgggcatggagtgggtcaaggcgtcgctgggggagctgttgaggagcacgtcggtctccgtggggggctccaccctctgcgtcgccgccgtctcctcctgcacgggcgaggcccaccagtggctggtccggggccgcaagagggcgggcttcgagctggaggtcgacctcgccctgacccaggacggggaggcgaggggcaagttgtgcttgacccagatctccagcgacgacctggaggagatgcagctggcgtaccggagcgaggggccggggctgagtcctagtgcagtgcactccgccttccacccgacgctgctggctgcattcaaggacctgctcgagagaatcaaggctcgatgaggtctggccatccctcgcacctgcatcggtcatgaataatgccaggtgaacacctggtgacacacggtcactctggcgnnnnnnnnnntgcacctgcattggccatgaataatgccaggtaaacacctggtgacacacggtcactctggcgtgctggaccttgatgagggacctggggcagcttgtggggccactggggtgcacgggatcaacccagagtccgcctggccacatgaatctgccggtggnnnnnnnnnntagggacctgaggcagcttgtggggccattggggtgcacggaacaacccagggtccgcctggccacatgaatctgccggtggttacaggagtggcttgcagctgctcgatgctctcatgcacttgatgcggcaactgaaggtcaacgggagtcaggcagcaagcaggggataccctcgcacagagtcagtggccggcggtcttgtcggcaccctcctcgcccgaagctgtgcgactgccccgcgggttgctgggcacatccaggttcctcgcggcctccggcgtcggcacctccttgctcgggtccaggacaggatccttggagggcgccgcgccatcgccagcccgggctgcctcgcctgctgaggtccgtccaccctcccgcagcgaggcggcggcgccgccctggcgcgacccggcccgctcgctctccaccccgccttggtcgactcgtgaaccagcgccgcccctctcagcctnnnnnnnnnngggatccttggagggcgccgcgccatcgccggcctggggtgcctcgcctgctgtggtccgtccaccctcccgcagtgaggcggcggcgccgccctggcgcgaccccgcccgctcgctcgccaccccgccttggtcgcctcgtgaaccagcgccgcccctctcagcctnnnnnnnnnnnnnnnnnnnnnnnnnnnnnnnnnnnnnnnnnnnctgccccggccccctcccgcctggcttcccgcgtgccggcggcctctggctgggccgccccaggaccccccgcctgcacacccgccagcgcccgt

SEQ ID NO: 44806 - DNA, 71 bp, Chlorella protothecoides
agctcccagcacagcaaagttgcagactggaaggatgtttaagaagaggggtggatgcaggagggtctggg

SEQ ID NO: 44807 - DNA, 387 bp, Chlorella protothecoides
  modified_base (101)..(287): a, c, t, g, unknown or other
tgcacggccgccggccctgcaccgctcgataccgctgctgcgccggcgccgccgcttgacgcctggcggccggctgcaccggccgccccgtttccagggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctggcggtccgcttcgccgccgggactgggccccccgacggcgcctcgccgagcgccgccttgggcgtctcgccaggcgccgccttgggcgccgccgac

SEQ ID NO: 44808 - DNA, 458 bp, Chlorella protothecoides
  modified_base (131)..(312): a, c, t, g, unknown or other
ggggcgggcgaggcggcgcccggcgcgccgcgcctcgctttcttcctgggcgccacgcgcctgccgcgccggggcacgctgctgcagagcctcggcgcggcactggcggagggggcgcccgatcgcggcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgccgctgacgacgcagcggtcactgctgcgctggcctccttagacgcccccccgcgcgcgctggcgcacctctttgccgacggcttcggcgaggtgggccccgcgctggcctcggcgctgtgcccgcgcgccgcaccgggcggcg

SEQ ID NO: 44809 - DNA, 78 bp, Chlorella protothecoides
gggggggggggggggggggggggggggcaaaaggagttaagcttggaacactcaaggcctggactcgcacacagtcct

SEQ ID NO: 44810 - DNA, 61 bp, Chlorella protothecoides
gccctgggtcgtatggcttccttgacgggggcggaaggctttgggccgcctgcagccacca

SEQ ID NO: 44811 - DNA, 61 bp, Chlorella protothecoides
acatggggcaggagggtgctgtgggggggggggagacgccacaggcgacaggcatggaaag

SEQ ID NO: 44812 - DNA, 111 bp, Chlorella protothecoides
acgcgcgccgccgctatctgagccgccacacgctccggcgcccaggcgacgtccagcgccgccgccttgacgtacagctcttcggcgcggtcccagcgccccaggcaggcc

SEQ ID NO: 44813 - DNA, 61 bp, Chlorella protothecoides
tcgtgtttgctgaagcacagaggcttgagccaggaccccgtttgcagggcgctggcttggg

SEQ ID NO: 44814 - DNA, 61 bp, Chlorella protothecoides
aggcggggtttgcggtagctaatacggctaagtgacgcgctgcttcactcggggatggcgg

SEQ ID NO: 44815 - DNA, 61 bp, Chlorella protothecoides
gggtatcaccttgtggatgggacgaggaggggcatgccgggccgagggaggttgtgttgtg

SEQ ID NO: 44816 - DNA, 61 bp, Chlorella protothecoides
ggtggtgctggggttatgtggggccgggggggtttcctgcgactgctctccttcaagttgc

SEQ ID NO: 44817 - DNA, 61 bp, Chlorella protothecoides
ccccagaacaacttcctggtgcggcttggggtggtgcagtgagaggggctggggatcgatg

SEQ ID NO: 44818 - DNA, 61 bp, Chlorella protothecoides
ttgtggactggtgggttgagaagtcggggggggagaccaaggcagctgcggcctagctcaa

SEQ ID NO: 44819 - DNA, 61 bp, Chlorella protothecoides
cgtgcgcagcgcggcctcggcctgggggggggggatcgagcctctgactgtgagtgctcgt

SEQ ID NO: 44820 - DNA, 61 bp, Chlorella protothecoides
cacatgggctgtgtcccccagaggggcaggggtgcggggcatgtagttagcttttaggggg

SEQ ID NO: 44821 - DNA, 70 bp, Chlorella protothecoides
ggacaacgggcgggccaccgtcatcggcgggggggcgggaggggggggggggggggcgatcgatgagtgt

SEQ ID NO: 44822 - DNA, 61 bp, Chlorella protothecoides
cgccgcctggttccacagacccaagcacgcgcgccgcagggccgcggaccgccgtttcgag

SEQ ID NO: 44823 - DNA, 61 bp, Chlorella protothecoides
ggggtggcggtcaggtggcagggaagcgccccctcggggaagctataaatagtgcatgtcg

SEQ ID NO: 44824 - DNA, 61 bp, Chlorella protothecoides
cagctccccaagctgggcaaccggctgcaggctcgggactgggtgcccacggccgaggttg

SEQ ID NO: 44825 - DNA, 108 bp, Chlorella protothecoides
ggcgcgcggggcggggaccgggccgaggcgacccctcaccgacggcagctgtcggcggcgaccagcctgcgcctgcccgggccgcccccggccacggaactgggcgcg

SEQ ID NO: 44826 - DNA, 61 bp, Chlorella protothecoides
gtaaacgcggtaatgaaacccgcgtgggggggatacgacacgcggcactacccccttcaac

SEQ ID NO: 44827 - DNA, 121 bp, Chlorella protothecoides
cggccacgccgccctgtgtccccgccgcgctggaatggcacggccgcgacgccttctcggtgtcggtcaagccgcgccaggtggaggcggcgctggcgctctggcgccgcgaggcgagggg

SEQ ID NO: 44828 - DNA, 8381 bp, Chlorella protothecoides
  modified_base (168)..(211): a, c, t, g, unknown or other
  modified_base (3435)..(3444): a, c, t, g, unknown or other
gtcagcgcgtggcgttgcgagcgcagcgtgcccagcgcggcgcgcagctcggcctggcccgcgcaggcctgcgccacgctggcgccgatgaccacgcgccgggcgggggcgtccgggcgcggcagcagcacctcgttcgcgttggcatccgcgggcgtgggcgccagnnnnnnnnnnnnnnnnnnnnnnnnnnnnnnnnnnnnnnnnnnnngcctgcgtgaacgtagaggggagggaggcaggagggggggggagggggtcgtggagacgagctggaggggggtgaggtgctgaagctgggaagcacagtcgggctcagaccccagggaccagaaatccatgctgactggcagtggcacagaggcgcagcggggagagtgcagggcccaaatggggcgtagagaccccttccgacagcctgtttggcccttccaccggtccagaaggaaacacggaccccccacattgtcgggccggtgcccgcagggcgcatgtccctgcactcaaccccctcctccccgccgggtcgcacagcgagacccacctgtggcggcaaagtgctgcatgctgtaggccaggcgcgcgcggttgaggtagggcagcaccaccgagtcgacctcacggcgcgaggcgtacaggtaccccgccgacagcgcgaggaaagcggggagtatggggcaggccgcgcgggccagcgctatgccaaaggcggtgcccacgacgtcggccaggttggccacgctctctcctgcgccagcgcacgcgattggggggggggcatcgggggcgagtgcacagagaggcagggcggccagatggcaaggcacgagcgcgccatgcatccgccgtgcctgcacggattgggtatcgcccgggaccctggccccggtcagcccttcggcgaccgtcccctgccctccccctccgccgagcccgccaccgcccgacccgtcccggatcgcacacctttggccgtgacgtcggccaggttgttcacgcgcgcaaaggtgcggtagatgggggcgcgggtggaggaggcagtgacggccgccaggttcttggccaggttggcggtgcaggctagcgggaggaaggcgcggggcgccagcgcggtggccagctccagggcagcgcccgcctccatcagcacgtcgcccagcagcctgaactgcttcagctccccgtccagcgatcggcccctggaggtgcaggaggggagggtatgggggaaaggggagtgtcatcagtgggccagtcaccaaaggctcaggtgggcatccgaccggcgcagcaccgtctcaggccgcccccaggtgccgggttccgcgaggttaaccatctggcaccacatgccatggccggccggcccgtccccaaagcgctcaccagcgggcaaagaggaagcgcccgaaccggcccgcgccgtccttcaccacccagttgatggcggcggccgcctcgcccgagccgcggttggccaccccgagcgaccccagcagggagcgggtggtgtagacgctcagggcgccgccgaagaagtactgcacagcccgccagctcatgtattttgcgtactgcgggtccaccgagtcgggaaagccctgcggcagcaggtagtttgcaaggatgtcctttgcgcgccggcgccgggactcctggggagggaaggaggggggtgggggcaggggtgagtttgagaggccgggggaggatgcagggtgtcacgctgggaaagacgaggggcgcatgggtggagctgtgcttgggggccgctgacgctgcggaggggcgactggtgcccaggagccccgggcgtgccttgaactcgatggtgctgaaggacgtggcattctccagcaaggatgccttgtacactcgccggccgcgtctgttgtgctcgatgcacagtgtggaggaggagggctctggggcaggggggggcatggaggggcagtcaaggcctgaggtgccaccacacgtgatgggacccagagtggatgctgcacccgcgcactcacctcccatgtcactgccattggaggcaaggtatgagttcagattctgcagactggtggacgcaaatggagcacccacctgcacaggcaaggaggaagagggacgcatggaggcctgggcataggggcattcagcatgacggcatacagcctgcagctcacagtgcggcacgtagcacccactcccagtacccacctgaacttcgccctctggtgcatttcctaagggtgggtcaggtccggcgtctgcccatcgggacaggccatggcgcaacgctaggacgaccgggtcaatgccgcccgagctcgacggcatcggacagaaactggagcacgcctcatgcagggagcctcccagcatcacggcctgcgacatgcattggcagattttgatcaagtcgccgcaccgctgcatgcatgctgggggcgacgatcgatgtgcgatccctctgagctgtcccaccacagtactcgagtggacgccccctaacacacctccagctggaatcaagccgtcgatatgacaatcagcacatgagatggtagcacacacatgtcggaaaacaggaatctccttcacatgcagaccgggaatgcatgtggcgatagggcgtacattcagtccagcagggcgcgaggtcgggagatgccagaggccgggcggggcccgccagatcctcccgtccgacttcagagcttgggaggggtcaccacggcctgcccgatgtttcttgacttcttcgcgccgcaggcccccaccgaggcattcgtgcactgctccagcgtctcaaaattgttggcgttgcccttgcacccgccatatacaaagggtgtgcagctgcccttgctgccgtcgtatgtccaccgagtgatggccgccttgcatggaccggagtcgacggcctgggagcagaactctgcttgtggggaaacgctagcaacctgcagcggttgttgcgtggagatggtaggggcgtcaggggatacacttgatcaggctcggacaggccgagatttaggatgccaggccccacaccccacgctcttgcacctctgccggcggcggcaacacctccgtggggggttgcgggatgcagacaccacacgtcagttggcagaacccgccctgcattcatgcatggaaggttgaggaggttggggctgagtagtcggcaaggtggtggatcgctctatgggccacgactggagcaggtggccggtgcctcggcaacgcagggcccgtcctgcctgctggccgcaagggtgcccgcacttgggggagttcctctgacggcatcagaccaggctccaaggcatgggtgcatcggctcacctggcttcgtgcacacgatctcaagacagttcacaaggtttcccctcacctccccaatcgagtaacggccacatcatgcactcaccnnnnnnnnnngcggcatcagaccaggctccaagacatgggtgcgtcggctcacctggcttcgtacacacgatctcaagacatttcacaaggtttcccctcacctcccccatcgagtaacggccacatcatgcactcaccacgaccatccactgctcggcacacttgccccacgcccgctgctgttcgcaggagaaggtatctggcgtggggttatcgatgcaatcacccgtttcgagcagcctgcggcctgggaagggtgctgcaggcaggaagtggaggaggggcggtgaggggttatggtggccttgaccaaaacagggcatgccggcactctgcatgcgcccactccgcgcacatacgttcatcttcaaactcaggctccagacctggcatttctgcctcaggacggggtgcagggttcgggctgggcggagggggggatgacacgccggtcccggaggcggaggtggaggagggggtgccgggccgctccaacgccacgctgatggccaccatgccggggggcagggtgcccagctgcgtggtgcattccccgttttgccacaagcagcttcccgaggacgttatgacgttgttgcaggtggcctcgtcggtgtaggactcacacactgtggcgacaacgccgggggtcacgaggaggcggtagatgagcagcaacgccacggcacgcccctccaggagcctgatgcgaggcatctgcctgtgtaatggcatgttaaagggctggggtgcccaaacacgccgcggaggagcagtaatgaggcttgctttggcagacgcggttcaagttgcgcgagctgtcccagccgattgcgaggcactcccggtggcgcgggtgggactgcagtatcggtgcgcagacaaagagtgcggtcgggatctgcagggcatccattccgtacgtttggccccttctaccttgcaacacgcccccgcagcgttggcagggtctgggattccccgacctggggcacgtggtgattcatgccggcagcatgagcgtggcttgagcgaagtgatgggaggccagaacctcttcaaagaggagcatatgcccaacaaatactcattcaagggtttcaggccgctacaccctccaacgtggagctcgtccatctagcatgatgctgtttccctcccctcccactatcagagcctttgccccatgccaggttctgtgagctcgccaccgtccttctcgccatcaatggaggggagtgggagtgatagatgcatctacagcttgcaagaggaaacatcagcacagcttggcacagggcttcgttggcagcattgtgaccccactggaaggcactacttgggcatctgtcgcagggcgaatgcaggacaggcctcctcctcgcatttcctggggtgctgatgctgctggaataccctcttgcagcgactacactgtgctgccactgggacaaagcggatgaacttggtggagttgcgattgcctcgtcggtgagggctcacctgtcagggaagggcgggggaggggcatttgatcactgggtctgttataaaggtacgcaagccaaatactggtaagttcatgcggcataagctgagcgtcctcaacagggagatgtggaactcctttgcatgcagccgtcaaaggcactgcgtgagcccatgcacgcagcctcctccatcacaggcaaagcaaggccccggcagcgcaccttccgcttcggaactgccaagaggcccatgtccgctaagctgggcacgagggcccgcatgctttccaggaaggatcccagggaaggggctgcagcagccaatggggcaaggtctcgagacggaaggcactgccgcaccgtcacaccaggctgattgatgtagcgtgccgcatgccgggcaagccagctcatcctactccgtatagcagcggtgagcagcccgtggtggattggagttggtcgcaatgtcaggaggctgcgagaatggtaccaacttcagccctgccaccgaaccaatgctgctgtggtctatctcgacgcagcgcttgggactcccgctttatttacactcaataatcgtttcaatcaacaccacgtcatcgtgcaggcctcccttcctcgagcgagaacttgccgaggcatggagcgctgtcccttggtggtggaaagcatgccagacagagccctgtgggacaagcttcttgcacgctggaggggaagacctaatactcattgagacacatagtcgaccaaaggccacgagttcaatcgcggcgctgatcttctgcaacatcttacggctcctggttgagccgcgcgtgttggcacccgtgtcgggttgtcccccaccttcgggcttgcgagacaacgggaggcccggcatgacatcggcagctgatttcccactgacggaagtgagtgaggaagtgtcaagaagctgttgatggcctaaggttggagtggcgctgtactgacctgcaatgctgagaatcctgtccttgtggaccccccttgacaggaggagatgcgggtggccaggatcgacatggcctttcgggatcggtgtgcggacaagctggtgcctctgaacaagtgccgacgagcgtccttcttcctgccctggaagtgtgaagaggagcgccatgcgtatgagaagtgcgagtacctggagtataagctccgggtggcacaggcctctgcagcgcgacaggaggcataatggcgggaggtcacgtggagcattgggctcgaggctgcggcaccagacccgagtcttccccaacagctcgtgcctgagtattccgtggaagtctgtgcttaggccaggtattctccgttgctgagccctcttggctccctgtgggttcctgtcctggtcagtcaatccatagactcctcatctaccctggtgacttctgagcacatcttgtcagcagacaaatgcatcgtcagatccagaaaagccgaggtcgataccatggaaagtggtggcatggcatggctgttcattggtttgggggtgccatagaggaagtgtgaggagcaccccactccccattgggcagagccttgctgcattccaaggaacacaaatcctgatggggggttggccacaagcgcaggtttgtacggaggttggccagcacacttgcatattattatgcatacctgtcgatgaattgggaggaaatacttgcaaaaataggggccatctgtccactctgtcaatgtcagaaaaaatacaggttgatgcttagtagaaatgaattcatgtcagaatagggaatcattgtatgatgaagccccatacattcagtgcatacaggatgcccaagccacccaactctgtagcagcaaagctgccctcagtgctttcaacccagtgccacacagttccccaactcatagcaataacataaaagtgctgatgtacttcttactccacactctggcaatggtctcgtcaccacatttccgggcggcatcgtgaggatgcagagccaggggcctgtgccaatgacagacttgtcactcgctgcgtctctccacctggcaccaacaaccatggagcctgagacgcaagggaaagatggtgcgctctgtatcttgaggacaagaatggcacaccaccgctactgctgggaacctctggcaactcagccctgccatcagaggaccggcatgggctcacttgagccctccagaggctggcgatgaggatctcgctgatcgtggagaagggagtgcaaatgagcttggcgcacgctacaagctcctgacgggggctgtgctgccagtgatgctcgttctgttggctgataccattgcctacgagttgcaagtcaagggcagagcacgctgcattcactcccaacttggagggaaggtgacaagagggcgggggatagtatcagtaagccaatgaagtccagggtgaattgcacctgctgtgggtcgcatgtctgaacatttcgaccagcaatgaggcaggcagagtgtgtaatgggacgctgcgcgtcatgcacagcatgcttggcccaatttccccacactcggtcatcgtatccttgcatgttctcgagtgctttatgaatttgcttgaagtgtaacttgctgcctcctcacgacacctcacactatgtgacgtggcctgttcccttgccacacccttggacagaaatccccctgctcgtctggacatgatacccaataagctacgctgtacggccctttcctcgacagtattcaggttaaattgcacgtttgtacggtacggtcttttcgaggcccctgacacgggagggacagaggcagcctgaaatcgctacctcgtccacctactggcgactgcttacagcacgcgcaagagaatgggcatgatctcgacatcatgcccatctcattccgaactctgacgcagatagtgtacgactataaggcagtaagttgtgtgcattactcgtgggggagttacaaggggctgacagggacgctcccaatcgttgcatctgcttcccttcaaaagggcagcgggtcgaggacttgtagcatcggccggctcctcagcagcccagtcatccctgataggattcaaaagtccacgcaagcctgagttgacatctccgacagccacagattggattccatcgcctggcaagtgaaacagtatgtcttgctcgcggtgtattcacgatcctggtaggtggtggtgtccgtgtgctcgtctgggaagttccaggtgtagaccttgtcgccatcttggaaaacgtcaatgacagctgggaaatacgatgctgcaattacagtgaagactaccttgttcgggtaatatttcttggccactagtgttggggcaggcagcattggtggaggggagatggaggggagggaggagaaaggggaggaggaggaggaggagaaggtgggggagggggaaaaggagaagggggaggt

SEQ ID NO: 44829 - DNA, 105 bp, Chlorella protothecoides
ggaggccaggtacgggcggtcgcctgttgaggggggtgggggaggaggaaaagggcatcagttttttattttcttggggagttggggggggggggactcgggggg

SEQ ID NO: 44830 - DNA, 61 bp, Chlorella protothecoides
ttcttgcacccctatggccccggtccgaggggctcccacctctccgccggagaccaggagg

SEQ ID NO: 44831 - DNA, 61 bp, Chlorella protothecoides
gaggcggttgggtgtttgtgatggcacggggggtgaagtggaagcagggatttgtttggca

SEQ ID NO: 44832 - DNA, 61 bp, Chlorella protothecoides
ttttccggcaccggctccctcccgtcagggggcgtgcttgccagcacctttcaatgggaca

SEQ ID NO: 44833 - DNA, 61 bp, Chlorella protothecoides
tcaccagggcgacaacggtggcagtggcagggatgcacactgccgtcccagggtcctggcc

SEQ ID NO: 44834 - DNA, 61 bp, Chlorella protothecoides
gtctcgtagtggatcttgggattggcgggggtctcaaactgctgcagcacaaacgcgttgg

SEQ ID NO: 44835 - DNA, 61 bp, Chlorella protothecoides
cttattccaaatgagcatgtcgaatagaggaagtgggtcccatctgcgccgttgattctaa

SEQ ID NO: 44836 - DNA, 61 bp, Chlorella protothecoides
agtgcttgggtgttgccccagggtggctggcgtaattgtttggggtcggaaaggtcgacaa

SEQ ID NO: 44837 - DNA, 62 bp, Chlorella protothecoides
ggcttcttggcgggtggtggcggaggcttcttgacgggtgggggtggggacttcttggcggg

SEQ ID NO: 44838 - DNA, 383 bp, Chlorella protothecoides
  modified_base (95)..(312): a, c, t, g, unknown or other
ggggggggtgtcggtggatgagggcgagccgggagactcgagggtgcgttcccgggagcctggcgcgcgggatgctgtggccgaggccgggcgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggctgtctttggcctgatgcccttgtgagcttccctgccctccaacccccccacccccacccgtccccat

SEQ ID NO: 44839 - DNA, 61 bp, Chlorella protothecoides
agagcttgctcagtctggcagggcgtagggggggagccggaagagggggaggggaacgtgt

SEQ ID NO: 44840 - DNA, 891 bp, Chlorella protothecoides
  modified_base (95)..(239): a, c, t, g, unknown or other
cgcgaggccgcgcaggacgcgcgtatggaggaggcggcggccggcctgtctgcgctgcagcggcgcgccgaggagcgcgggcagcgcgtcggcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggggcggcgctggaggcacgcctcgcagcccgcggcgaccctggcaagggggaggatggcgagcgcgcaacggaggccctggggtcgcgagtcgccgagctggaggcggagctggcttcggcgacggcagccgccgaggccgccgaggccgcgcgcgccgaggccactgccgacgccgcccacgtccgcgcagaggtgggaagggggcaggattggggggctgtgggtcttgagggctgttcatgcaaacgaggctgaagtgccagcacgctctgcgtgttgctggagcagggcctgggaatgcgtgtgggcgtgcttgggagaagacgccaccccttccatcactccctcctggcgtgtgctgcgtgctgccgaatcaggagaccgcgcacagaccgtctccccccctttgcccctcattccccccttgcctcctccgccctcgcagctggccggcgcgcggcaggcgctggccgagtcgcggcacgccgacgtggtcgactaccagcgccgcgcgcgcgaggccacggagctcctcttcgccaagcaggcgcagctggagcgcgcgtcggcggaccgcgccgcgctgcagctggcgctggagcgggagaccgccaacgcgcgcgcggcggcggccgaggcgcggcgccg

SEQ ID NO: 44841 - DNA, 61 bp, Chlorella protothecoides
aggggcgcagcggcgggccgagcgggggggtgaaacgctgcactggctccatgatcgtgca

SEQ ID NO: 44842 - DNA, 61 bp, Chlorella protothecoides
ggactgatcagcgtctcggcaggggcggggggcgtgtttctggttcgggacgcctttatga

SEQ ID NO: 44843 - DNA, 61 bp, Chlorella protothecoides
ggattcttgttgcgtgtggatggggggggggccttggaaggtagaagcggtggttgccgag

SEQ ID NO: 44844 - DNA, 61 bp, Chlorella protothecoides
ccgtcaaatgccgccgtgatgaggtcggggggattgcagttcttgcgcagctgcatcagca

SEQ ID NO: 44845 - DNA, 61 bp, Chlorella protothecoides
tggcatgggccgcgccaactaatggcagggggatgcattcctgtgaaggaggcagggagag

SEQ ID NO: 44846 - DNA, 61 bp, Chlorella protothecoides
agtagttgtgggagcctaggactggggaggggatgtagcgggggatgcccatgagtttcgc

SEQ ID NO: 44847 - DNA, 61 bp, Chlorella protothecoides
tgtattcattatttatccaattggacaagggtcattctctgatggtatgccattaggcatt

SEQ ID NO: 44848 - DNA, 61 bp, Chlorella protothecoides
gttagacggagcaaaattaatcggagcaggctgtgcgacaatcgcacttgctggtgccggc

SEQ ID NO: 44849 - DNA, 61 bp, Chlorella protothecoides
gccaagcggcgggagggggtcattgcgaaggggcacgcggacgccccacccttagtcaaga

SEQ ID NO: 44850 - DNA, 61 bp, Chlorella protothecoides
tgatgtgtctgtgaagtaggggggcggaggcgattggtgatgtgtctgtgaagtagggggg

SEQ ID NO: 44851 - DNA, 445 bp, Chlorella protothecoides
  modified_base (165)..(341): a, c, t, g, unknown or other
cggccaggcgccgcaggagcgggcggtaggcgtcgggcgcgggcagcaccagcgcggtgagcaggcgcccgaccagctcggcgcgcggcgcggaggactggtgcgccaccgcgatggccagcaccgcgccgtggtcgtcggcgtgctgtgcgcgcaggccgtcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcgcgcgcgtgcgcctccggccccgcgccgtgcgcggaggccacctccagcaggggcgcgaggagcggggccagcgcggcgcgcgcctcgggctccgcgcccgc

SEQ ID NO: 44852 - DNA, 61 bp, Chlorella protothecoides
ctttcgcttgtcctgcatgattaggcaggggaccatgtatgggtaagtcaggccatgcctc

SEQ ID NO: 44853 - DNA, 61 bp, Chlorella protothecoides
cactctgtgaaagaggcaggtggagaggggggcctgctggatcacagctcatcgcggccgg

SEQ ID NO: 44854 - DNA, 61 bp, Chlorella protothecoides
aatcttctcatcaaatcgcaacatggcaggggggtgcttggagtcttctggatcgcctgct

SEQ ID NO: 44855 - DNA, 61 bp, Chlorella protothecoides
ggggtggggccggtgcattgggtgggggggggcattgcaccgagtctccctcaggcccgac

SEQ ID NO: 44856 - DNA, 16766 bp, Chlorella protothecoides
  modified_base (196)..(294): a, c, t, g, unknown or other
  modified_base (1317)..(1326): a, c, t, g, unknown or other
  modified_base (1834)..(1843): a, c, t, g, unknown or other
  modified_base (2306)..(2315): a, c, t, g, unknown or other
  modified_base (5175)..(5184): a, c, t, g, unknown or other
  modified_base (5260)..(5269): a, c, t, g, unknown or other
  modified_base (5344)..(5353): a, c, t, g, unknown or other
  modified_base (5560)..(5569): a, c, t, g, unknown or other
  modified_base (5867)..(5876): a, c, t, g, unknown or other
  modified_base (7941)..(7950): a, c, t, g, unknown or other
  modified_base (8232)..(8241): a, c, t, g, unknown or other
  modified_base (8490)..(8499): a, c, t, g, unknown or other
  modified_base (8849)..(8858): a, c, t, g, unknown or other
  modified_base (10891)..(10900): a, c, t, g, unknown or other
  modified_base (11940)..(11949): a, c, t, g, unknown or other
  modified_base (12167)..(12176): a, c, t, g, unknown or other
  modified_base (13976)..(13985): a, c, t, g, unknown or other
  modified_base (14850)..(14859): a, c, t, g, unknown or other
ctccccccccccgcgccgcccttcccgtccgtgtccgggatgacggcgcgcgggtcatcacacacgtcgccgtgcacgaggcggaggtgggtgtgcgaagcctcgtacacgccgttgccccagcgttcgcaggaggcggcctccaggcccggcagcgcctcgcaggaggcgttgccgccccaggagcgccggaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtcggcggcggtgcaggcgcagcgctcctcgcgtggcgcgggggcggcccgccccggcggcgtgaagcaggccgcgtcggcgcggcgccgcgtcagcgtcagccgacggcccagcaggcacgtgcccggcgccggcgcggcccagtcctcgtagtcggcgtcggcgcaggcgcggaagtccgctcccagcagccgggccaggtcgatgacgaagagcttgcccggcggcgacacgccgccctggaaggtgcagtccgggtgccgagtcgtgcgcgtgcaggcgctgccctggaccatgaacacggtgccggcggaggccgggtccacgcggatgttggtcaccaggatggcctccggcaggtccacctcgtgccagcaggcgccggcgtcggcggtgaagcgcaccttggcggtggggccgtcggaggcgtgccccgccgccaccaccgcgtccccccccgcgccgatctcgtagatgtagggccggtccgccacgtcctgccaggtcagcccgccgtcgcgcgaggcccaggtgcaggccgccgccgccgagggcttggtgtccaggtgcaggccggtgttgcccgtggccagcagcaggcccggcgccgccgcggagctgtacaggttggggcgcggccccgccggcgacgcccacgacgtcggcccgtgcagatgcaggctgcagcggtcgcgcagcgcgccggcggggcaggcgtcgcactgcgcgtagcggaaggaggtggggaggggcaggcgggaccagtccgcgccgccgttgcgcgtggccaccgtctggaggtaggcgccgtagtcggccacggcgccggtggccaccgtcaacgggtccacgcggttggcgatgaacatgccctgcgagagagggagggcgtggtgtttgcagggttgggggcccatatcaaccggcccctcaacatccccggggtcgcacacaacaaccgcctttgctgctcccctccccgtgctccacaaggctcaccggcaggccctccacgcgcatgnnnnnnnnnngcacagcaaccgcccctgctgctcccctgcccgtgctccacgaggctcaccggcaggccctccacgcgcatgaagtcggcgaggaagtcgcggcggaagacgttgcgcagggacagggtgtgcatggaggcgttgtaggccggcgcgtaggcgtcggaggtgggcgagtcggaggtggggccccgactccccggctcggcgtggtccgccagcacaaaggccgccgcgctgtcgtgggtctccaccatgttgtaccctggatgacggtggcgattgaacagaggctgggtgagggatggggatgtggagggggggaggcagcagagacagggttccacgcttgttcagcgactcggcacagcactgcactgcgacccaacggctgtgcagcgcaggggcatgcacgagttccagcgctgcacgtgtgcacacgttccctcacgtttgccaaacccatcactcacgcacgcacgcaagcccaagtccccccgttccccgggcccctcannnnnnnnnnccgttcccttacgtttgccaaacccatcacccacgcacccacgcaaccccaagtccccccgttccccgggcccctcaccatcgtcctccaggttgctgggcaggcagacctcagtgaagtcgtcgccgtcccagtccgagacgtagagcgtgacggtgcgcccagccacgctgcgggacggcacgctgcgtgccttgccgtcggcgcccagcgggcagtcggagggcacggccaggaagaccttggaggccaccacctcgaacaggttgccgcaggggaccatgcgcgccacggggctgacaaagaagtcgaggctgaccacgtagtgtaggtccttgtcccagcctggggcgtcggggtgtcggggaatgcagttggcgtacatgagtgtcctaggctgccccaggctttgagtccttccgcggaagccatcgatcccagcattcagctgcgggggcgagcnnnnnnnnnngcaggcttcgagtccttccgcgcaagccaccgatcccagcattcagctgcgggggcgagcgcacccacgatcgtgctcctcggagtcaaatctacatacaccctgctcttgccagcactcaccagggtagaggcccttggcgcccgcatcccccgcaaaaacggtggcaaagatggcctcgtcaggggtgggcttccccgcatacctgccaggggagaggtaagaagggagatgggaggatgtgaacgtccacggcgagtggtgaagcccttggaaagttaattaagccatacacagacttgctggcatgatggcctggcaggcaccgcagagtaccaccacccgatggggcataaggccaggctccaggtctcaggctcatctaccgaggtcaaagatagccccacacagcagagcggcaggcaacacatcatccaaaaggaaaaccccggctcacatcggcatgctgactccccagtcaaagtcacggaagctggacacccgcccgcttgcagcctcagtcaggttacgccaggatgttccaaagtcctgccatgcaacagatggatggcttgagattagccctttaaaatcactgggcataaagggctttgcatagaggcaggtgggagggcaagcacctcatccattaccatgcaatgcctcccacccccctccccaatgggtcaacttaaggatgaatgtcttgctccacaaacgaccactgcacctgtgtcaggtatagatcgtatccgcaggcggagctccgcatgtaccaggagcagctggggcggcgtgtcttggccagaatccactcaggctgcttggggtggaacaggatctcctgcggcacgagagggccaggaatcgagagatagagagtttgaagtctgttcctgaggcaagatgagtgtgctcacgaacctcgcctgcctgtaggctgaccatgtgccgcatgttgctccaaaccctgcgaaagatggtgcctcgaccccgcctcacggctcacgttcccccacccccaaccaccatacctggtcgaatccggtcgtattcccaggggtgccgatggccttgaacgtcttgccaccgtccctggaggtgaagtggaagtgggccctgccctgcaggagaatgtgctggccgagtgccggcgacaccagcacatttgtgatgccaaagtacggcgacaccttgcctggcaccaagtctatttgagagggaggggagaggttggatggcacgctgagacattgagatgtcgtgctaagactgtctacgcaaggtttgccatgccagccaagactatgccagggataatcccccgcgacctgaaactccacccgcagcccagccacttcaaatcaggtgcaactcctcaccacaaccccactcccatcgtgcctgtcagcattggggttatgtcgcgccaggcctcagccctgccaggctcctcagaccgccacaggggaccccccaggaagcccccgctgtcctgcgtgactgcatacacgtgaggctggcctccctcagtggaattcacccacacaaggtccagaatttgggtgtccagcgtgatgggcatcaaggagccggaggttgggtacttcttcggctggcatgcgcccagccctgactgggcgctgctcccaagcaggccagctgcggtggcagctgcgtgatccccggcgcatgcccctccctcgcatgtgccgatgaccgaggagggaaggaggaggagggacagcgcgagcaccagacgcggccccggctcgaggcgacgagcccgcgccatgcactgcaccgtcgagatcgcttcgtgggtctccggtcgcgcaggtgtgaccagagattcaggtggatcgaacccgcgacgctggtcaatcgtagcttttttatgatatgtagggtcccgccggacctcgctcgtgcagggtcgtgatcccgcgcatgctgcacacaaccctttcagacgagggcctgtggtaccggcaagccagcgaggacccggtactgggcgcgaggtgattgccgtgcggggtgaattagcacggactgattaatcgaagagaaaaagcaggagcataaaacattcggtatacaaggcgtaagccattcttagcgcacctgtgccatctgccctgggacacccttgccttcttgagtcacggtagcaccgcgtgacgagccggggccagcactgatggctcgtcgggcgctgggacgagcctggtcgctatatatctcatctcctgcagcagaatgctcgatatcagggagtacatggtgccagtcagtgcgatacagcaccgcggtggaagccaagggtgagtattgtgtctgcgtgattttcatttttgcatccacccaatacgggggtgctcaacctcagagataagagcattaccggtgatcattacgtgtgtcattctgtgctcaggtctgacgcagctgaaggctttcctgcgtgaggattctggaaagaagatcagcaaaagcatccgcaaggtggagttcgtgtgcctctgcaatgcagtatcatttcatttttggcattctccatacaatgccaatataccactcgatgtatcgtctttgcaggggggaagagtgcccggggtcgtgttttccctgccacaagagcaagagctcctggtatcatttgccgccaaggacatcgagacacaggtgcttttaattggtagcgaaagcctggcgatgataaattctggttgctgattcgttctagcggtgttccatttggattgtttgcattgcctagcatgcatctggactgccgtgcttgatttgttgaagcagtatgccccatgttttgctccttctcctccccaccctcttnnnnnnnnnncgcagtatcatttcatttttggcattctccacaaaatgccaatacaccactcgatgtatcgtctttgcaggggggnnnnnnnnnntctccagctgctgcgtctgggccggacggggtggggctgccacctctttgacgtggcagtgatgaatggcgatgnnnnnnnnnnccaccagctgctgcgtctgggccggaccgggtggggctgccacatctttgacgtggcagtgatgaatggcgatggcaagaagatgacacactacccagcagtggtgagagggtggcttgggagggccacatgggcaacgagatactcaagtagcacgtgataggtttacatcttgcacatccatctgccgaatcccaatcaaccccnnnnnnnnnncattacagccgacacggatgtggtggagaatgtcaccctcgtccactgtcctccggatcggcatgtgaaggtcgcagtacccatccaggtgggagcatgtgtgtggggccggcgcgaatgtgacttgcctcattgccctgctgcgaggaatgcctctcctctttcgctgggctgggctgcttgggctcaggcagcagatggggagcactgcaggtgttatcctgccacccatgtcgcaccctgcattgcgacggctaccattgacctcaggctgcccctgcctctccccagatcttcnnnnnnnnnnattcgctgggctgggctgggtggggtcaggcagcagatggggagcactgcaggtgttatcctgccacacatgccgcaccctgctttgcgacggctaccattgcccccaggctgcccctgcctctccccagatcttcggggaggaggtctgcccggggctgaaggcgggggggcgcatcaaccatatctcgaggaaggtccgagtgctggcgcggggcgactccatcccggaaagctttgagctgaacgtcaggtgggtgtggcggcacctgttgtcgtcgggtcggcgggtctaccaactgagtaggctgctgtggcgccgaacgacactcccaccacaaagcagcatgaccaccgcccatgccaccctgtccctgtcgcctgcagcgccttgaatgtgggggacaagctgcacttctccgacctcgtcatcccggagaacgtcaagctgctcgaggatgtggctgcccccgccctcaagatcatgaggaagtaggccggggccggacactggatcatgcccacccatccagggacccaccaggcacccgggagcgacccctttgccggcgaatgggccctcgccagacgcccaatgaccctgccggccctgctctgggcgtggcacccttgcctgcgtccctcgcagcccccgccatcgcttccctggcaggtcattatgaccctctgaaccatcctgctgcggtttgtggctgggcagtgctgcatgttccaggcagcaccttcacatgacaggctgctggtcaggaggcatacatccaggcccaggcttcccagcatcaatcacgcctccgacaggcccgccagcaccgccaggctttccacggcggtggccgccgccacgcccgcgccccagtgccggtcgtgccagtagttgaccgcgatggtgtccggggactgctccaccgcgtgccaccacccggcgggcaggtacagtgtctcccccggccccacctccacctccagcggcggtggcaggaaggggtcggcgaagtgcccaggggcatcagaatttgccccaggggcgccgggtccgggagcctccgctgctcgcgacaccactgctttgatacctgcttctccccgcccagtccccggcggggtaaccgaggaccacgccgtcgtctcgccggtgggtcgcagctccaggccggtctggggcccggggcccgccgcctcccagcagtgcacctcggcgcgtcgcacggccatgcgccagccgtcggcgggggccaggaggtggaagcgcttggcccctctcaccaccacgtacatgttctcgtagggatcgcggtgccacgaggtgacagaccgctcgtcgcccacccagaggttgacggcctccggctggttgcctggtggagtggtgtgttgatatggggggagaggatagtcagccatgggcgccggcagcagtactgcggaattgttcgtgccggaggcacgctacacggaggttgtgccaagctcggcggctgcctcatgcacgcccaagaggtcccagagtgcattccaaggacagaattgcacgcagcacactaccccccgccgggctcatgcctcaccaaaggcttcggatgcccagcccagctccggggcgacgtcaaccaggagctgcggcgcctcgaccgagagcgaggagttctggtactgcaggtatggcacgggcgaggcgccgtccctcctcctcaagcactggtaaaaggtcgcaatgtccaccttgctctccatcgggagggcaaacacagggttgcccgtgtcaggatccagggcgctgccatctggtccagggaccaaggcgtccgcccggccattgggggtggtcgagatggtcagtggggtgggacccagtgctctgatcaggtactcttcattccaaagcgtcaaggcaggccactcactcacagcccctgcaggaaagtcatgagtggcagctcaattgccgtgtcaatgggggggtgcttgagcaccaaagtctgagggctagtgcaaatctatgagattggggggttcacactgctccataaagcatttcacccatgccnnnnnnnnnnaaattaatgagattgggggggggttcactgctccataaagcatttcacccatgccacccatattctccagcatcaagccttacccctgaccagcacagggcgattggggcctacatactccctgcaaaactgcagggcgctgggagggtgctccagcatgggaactgaactccccacatcaagctctgcacaagatgagggggtagatagtacatggaggaccgttgtgacctgtccaatgagaacagcttagacggaacaaagtgaccagtgcactacagnnnnnnnnnnttggaggaccgttgtgacctgttcaatgggagcagctcagacggaacaaagtgaccagtgcactacagacagtgaagggatgcaggccagcacgctgcatacccaccaccttcagcacacattgcctcaccacgagcatcgagggacagctgtcgcaagaccgacacaagcaactccttagagatggatgttgcacggacattgccatacagagtgtcctccatcacggagtgcgggatcccggacgtnnnnnnnnnntcctccttagagatggatgttgcacggaaattgccatacagagtgttctccatcacggagtgcgggatcccggacgtgcatgtgcatgagcagactccaatcgactacctacacatggcaccgttgaaatgcgaagccaatcttataaaggcttcgaataatattatatataaacaaactaactaataggtttctgaaaatggtggatcgagcctcatttcactagtactagttagagttcgtagacgttgcgcttcggcggcaaggaagtttggatcaattgaccaagtgttgcatgccttgcaatttttaagagcccgattctggttattctaggaattacatcatgnnnnnnnnnncaaaggcttcgaataatattatataatattaaaccaactaataggtttctgaaaatggtggatcgagcctcatttcaccagtactaattagagttcgcagacgttgcgcttcggcggtaaggaagattggatcaattgaccaagcgttgcattccttgcaattttcaagagcctgattctggttattctaggaattacatcatgacacatgacaagttggggcactgtttagcatatacggttgtggcatgggtctgtgtgaggagtgccgccgaggtttcccaatccctcccaggcgcggttcggtcagtcagaatttatcagaccgttggctagcttctgacgggccgccgcattcacctgctcaacatcagccgctgtgatgacataatcagcccccttggtctgggtgaggtcgctgaagccagccctgttgatgtcaggatgaggacgaattgttaactgggcgctgtctgggagaggatccctgcctgggtgaaaggtgtgcgctatggatgcatacgaggaagaccagcatatgccaagcaggtggacgacatgccaccgctgcaagttcccatccgtatctcttccctttgtcatgcccacacatcaatcattccactccccgctcaaactcctacatgattgcgtcggtgaactgcctgaaccctgcagcaaagtcccgctgctgggaggctgggagagcactcaaagcatctgcgcactctgcgtccacggagcttccgcacaggcgctcgcgctcggttatggctgcggcgatctcctgcagcctcaccacgccttcattcgcatcattgtcctcattgagagcagcaagacgtccgtacgtactcgaatgcccctccttgctgcctgagaattcgccggtgctcttcccctcctcatcagcgagttgccagagctcgccggcccgccgccatgtcagatgctctgggatcaggtccatcgaccctgactccggatcgcaagatcccagacttaccatcgcatctgcagcaggtgtcaggtgacaggatggaaagatgttgattgcaggaggactggacgtgatcctgccacagaggtcgaatcattgagagcggctgatgtggttcttcacagtcactcacgttcagaagggaaccaggcaaatgaatgtacttcatcatcgaatccgtcctcgctgctggcttcatatctgttcattggagggtagaggggcaggtggtgcttgcagcatgcttcaatctttcatttgagtagcaaactgttgcaaaacccagaattcacgtcccttataccaatcaaagccttcaaaccgcgcctgagggtgtgcacaggtccagccgtgccgtgttgtatctcagatcctacactctccaccgtggctggccaccactgcacggacagcaaatcgaatcagtgttggtctgagccaagggacaagtggtaagcgtgtcctcagaaaccatcctctcgcaccttcaacttgggatcactgtcctcttctgagtctatttgccaaagcacctcgatcctggtgcccacatccagccgaatggcatcgctgggagctggcgagagtctggaccttgaggcccacggcagggctggggatgcaggctccgtcatgcgaggggatgttggacagaggtacgtcccctttgatacttgctaatagtctcaagtgacgcagcaacagtgaatccgtcgagtgtgagacgaaagttgaatgtgatcttgcggggctagacagctggcgacgcgcgcgatttggtcgccaggggctctctcggaagggtgccgacatgacacgaagcaccgtctccaaacctgtccatccgctgatcacaagcttcgacgcatgtgaaggacctgatctgcctacatccagcaggcaaggcgcgatctcggagacttctccgctggaccctccggaaaagtatcgtcaggattcgaaaggggccttcaccatcgatcgcgcctcgtaagcccccgtaaggctaccgttttgaggcttcgaccgtgannnnnnnnnntggaaaagtatcgtcaggattcgaaaggggcgttcaccatcgatcgcgcctcggaagcccccgcaaggctaccgttttgaggcttcgaccgtgattatcggacaaccaattcaccgtccagagctgacagcatgcgggcgcggctggaagctgcggcaggctcggtcccccctgtcactcggggcttgatcggcaccctgatatccggctacctcatacagctcatcttcccagccgccaaaacgcacctgggccttgtggtgggacgcttcttggtgtctccctggaccatcgtcacgtccggtctcctggtcgactccagcatagaggcaaggcggggtgggtggatgtcatgggcaggtgctcaaggatgcgtgcaaaggacgcctggttccaccccctcccctctatcccatccctaattctggtcaccactccatttctccatgccatcagctcctgacgagcctcgccgcggctgccgtgctcggccgagccgtcgagggccagctgggcgggcgggaaaccctcgtgaccctgtgcagcgccttggtcggcgccagcctgtgtgcctgggtctgggtcacagccacctttgccgtggcggtgtccacctccagcacggccgccgcgcgggcgggggacgccctgtacgaccccatcctcggcttccacggcgcaacggccgcgctgctggtggccctcaagcaggtggtcccggagaatgaggtcacgctcttctcccacttctccttccgcttcaaggtccgtttgtcgcattctgcgacgtgtcgcgctggggtggtgcgctccggcgggggatgtgcttgggaccgggggtgtgacacctccgtcagggcaaacaagccctgggaggccttggcattgttggaggttgagggtacggaagccaaggggcaagcccctaccagtcctacctctcaccggaaacaagcaatgccggtgcctgttgggccgccaagctgaggctacgtcccgggcatgccaccctggccccacccgccaccctccccgcagtnnnnnnnnnntgcccgttaggccgccaagctgaggctacgtcctgggcatgccatcctggccccacccgccaccctccccgcagtatctgccgagcctgttcgtgctggtggccgcggtgttcggcgtgctgacggggcgcacgctgcgcacgctgccctttgtcgtcggcggcaccctcgcctcctgggcctacctgcgctttgtgcagccccaggccggctcgggnnnnnnnnnngccgggcgccgacttctctttcgcctccttcttccccgagcccgttgcgcccctggctgagcagctcgcggtcctctgctcgcgcctgaccggcctgcgtgctgcggagcgcagcgtgccgagtgtggggtcaggactcggcttgggaggggcggtgctgccgggcacgggagcggccgacgccgcacgacgaaggtgcgagggagaaggggggtggggaaggaaggaatgaattttgtggcaagtgtgcggcagagcaaacgcagtgctggtgcagtgacgggagggcaacggctgcgcatgccgactggagctggccatgcaatccaacttgcctcatccctgggccccattacccccagggagagagggcagcgggccctggaggagaggctcggactggcagaggaggcaggtctgccgcgggggcccacacgcggcgcctctgccacctccctgcatcagggttccgtggaactccagggtgacgtgcagaaggagatcactgtggcatgagggcccttgtaataccatgcaaatttgtgggtgcgagagtgcacgctctcgtgcggagcatcagttagagcagagaagttggggaaaagtccagcacagcctgggctggcgatatcaaagccttgcagggtacaagagaatgggcgcgatggaccgcgagacacccatggcacgagcctgcatggctctggcatgctcatcatttatcaatccgcgtctgaaaccccgctgcagttgtatacatgattcatcgcaaggtgttccatatctacctcactcaccgctggacgctcgtcggatcatttaggccttgccagcttatgcccacagcctggcatggaagaacattgatgccggcatacaatcaagccctcatcgacccagcggtgatctaggacctcttaacaaggacctgaacatgtcatcgacaccgcagccgagcacattcttctctccgtgggagccacccccaccttttgcccaccctccacccgatcccgccctcgctcaacgaatagtcaagctcgtcgaatttgcagtcagaaatggtgggtttgggatgatatgcaatcgttacattgtcgtaagagactacggtcgacactgacgagactggagccaccatgccagcatgcatccctgcgaaagcacacctggagccctttcccaggatttcagcctcgtcctacggcttcatcccctgtaccccaacaaatctccctataaggtccaagctttgtggacctggctcgtcagaagcaggctggcaacccagagtacggcttcctgactggtggtgacggagcggcttttttcacctggcgactctttgcggccgtcaaccacctcccggccgatcagccccttgctgccggtcagcatgcagcactggcagctcctgcagcgcctcagcctggcgctgtgggcgctgtatccagcagtcccagccccgccctgcccccggaggtggcatcaggatggacgcaggtcctggctgcgctctccgggtcgcatacctccatccgtgccagccaggagtggttcatggcgtgccggcagcacgcccagggcatggcggagatgatgctgcaggtggggtatggtggggttggggggctgatgattctggagaccccgaccggctcgcgccgagccaagggtatgtatgcagatgcaagggcggttgctggtatgctgggttgcacaaaatgatttgccccgcgctcaatgcctccatgcatgccacaacaagtgcgcaggcatccaaggccacacaggaagctnnnnnnnnnnctgcagatgcatgggcggccgctggtatgctgggttgcgcaaaatgatttgccccgcgctcaacgcctccatgcacgccacaacgagcgcgcaggcatccaaggccacacaggaagctgccaagcagctgcacctcctgtacctcgcgaacgacgtcctgttcaaggcgctgccctcccggcccaccggctccacgcccgaggccgacgccgtcgccgaggccttttgtccccggctgggcaccatgctacggcatgccttcctggcaggcggccagacagacgaggtgggtggtcctccaaccctcgcggggtggggtttgaggtggggtgtcagcgcttgcaaaatcaagagcagcgtgaggtgtgggtggacgcccgctggaatccttggagcgtagcctggccatcctgccggcgtgacttcttgaaggttcttagatctgagttgttccctggcctttaatggcattgaggtcactcacgcttcttccagccactcacactcaatgcacaggcccaggcccccctgctcaagatggtcaaccactgggctgagaagcgcatctacagccaggccacgatagaaaggatgaccatggagctgctggggttggtgcccgagccgggcccggccgccgcagcgccctccccggccgccgcacccgtccccgccggctccgccccgcagcccaccgtgccctgggccaaccgcccaccggtcccaccagggctgccgccggtggccgcacagccaccggcgcctgggtatctgggcgcccaccccccgcccatgtgggcggcagaggctgcggccccggcgcatcaccccggtgtgccctggggccacgccggggcggcccctnnnnnnnnnnagcagaggcggcggccccggcgcatcaccccatcgtgccctggggccacgccggggcggcccctgcagcgcatgttcctccgcaggtgcaggcggcgccgctggcggagccggagccgcctgggtttgaccccatgtccttcccgccaggtcagcccacgtgcaggaagtcagggtttttgtgtggggtcattcaagcatccaaatgtactttgcttgggcgcatggctcccatgtactccgctgctggttgttctctacccgacggtccgttgggatgctggtgcagcccacagctgtcttggggttcaacttggttttgtctgggccaccaagccaagaggcactggaaagccttctgcacatcctcgactcgtcatatgctgtgccaggactcttccccccatcggaaccatgcaggcttgatacccaaactggtggaggagagcctgaaggttgacccgccctactccccgctcaccatccgggcggtcagcgaggccggggtgccgccgccgccccaggtggatgtgtacctgtccgcccgcctggacaagttctacgcccagattgcggtgagtacaagagtggtggtcaattatgtggtcgaggcacagggcgcacccgcgccaggctgtaggatggccgtgttgaatcacagacaacctcctggctgaggctgtcgacgggctcccgcttgcatcagagacctctgtgagcgatggttcagcaccccagagacagacgcccctcagtgttctggcccccaagccgctgcacctcgccatcaccaaaccccccatctgcccatgtcctgcaggattaccggcccagcatgcaatttgtggacctggagacggagccgccccggcggcggacctttgtggaccgagggacagaggaaagggtgcaccggaccacggtggagccctttgacgacgggtcgggcccccggggctcccgcggcagcggcggggcccaggggctgggctacggcagcgcggagcctgcagagccgtccgagcagaaggtggacgtcttcaacaagtatcgcagcatgctgtccggagcctactttgagcagatccaccgctccctggccaagagggggggctgagggagccttggattgcccgtaatacaacgcacagagcctgggcatgatagcgaagagcatgggagggagggggagggttggtgtgacgggccaggagtgatcaacacgtgagtaacataagtggcccccgtgcaatgtgctggatcttccagcggcatcactcaacgttcaggcgatggtcgaaattggaaaaaactaaaagttaggatggcagggacctattctaccactaaaccaactgcgctggttgggagggtagtcatgggattgactgcgcaattccgggaatcgaacccgggtctggtccgcatctgctaagccgttgttgaatgtcagcccaatctcactgtatatgatttggagtctcgaagttcaatgcgtacatcgggggggcgcaggccgtgccgtcttggtcctgcaatggcgcgggctcctgattggcgatcgataccgtgactatcccttacatcatgatagcgatgcttattaccgatcgacacggcgtccgtgttgacccacccattgtcggactgagcagtaaccaccaagggggcagccatccatggccagggtcctccgctctatgcccgcaccgccttccccaggacgatggaggcggccacctcttccttgtgccgcgccacggcggcctggatgccctcctcgcacggctggagcagcacccccgcgtacacgtgctcgatcgtccccggcgcgacggccgcgtgcgcccgcagccgcgcccgctgcgcctccagcgcgccgaccagccgcccggcacgcgcctcgcg

SEQ ID NO: 44857 - DNA, 61 bp, Chlorella protothecoides
atcggtaggggagcgttctgctttagggtggagtttaaatgtaagtttagatggaccaagc

SEQ ID NO: 44858 - DNA, 61 bp, Chlorella protothecoides
gctgcagcaggaagtcagtggccaggcaggggagtgatcaagctaggaggcaagagccaac

SEQ ID NO: 44859 - DNA, 61 bp, Chlorella protothecoides
cctctaaaagggtccgcgctggactggcggggcatgttcaccaccaccaccccccgttggg

SEQ ID NO: 44860 - DNA, 61 bp, Chlorella protothecoides
gaggcacggagacgtcggcaggggaaagagggaacaggcggtgacgggagtaccccgcacc

SEQ ID NO: 44861 - DNA, 61 bp, Chlorella protothecoides
cctttcccacataccttcagcgacggcggggtggtgaaggtgtgggcagatgccagctctg

SEQ ID NO: 44862 - DNA, 105 bp, Chlorella protothecoides
cgcccgccgcgcccagccgccccaggcagcgcgtgagctgcgcggccgcgtcggcggcggggccgccgtgcaggtgaccccggtccagggcccccggcgaggcgt

SEQ ID NO: 44863 - DNA, 66 bp, Chlorella protothecoides
tggtgaggtgttctggagggaagcggcgggggcggggcgcatgcgctgccctgctttttgagccca

SEQ ID NO: 44864 - DNA, 61 bp, Chlorella protothecoides
tgcggatgtggctgcgtctcggagtgagggggtttatgactgtgtgcgattgattgacgcc

SEQ ID NO: 44865 - DNA, 61 bp, Chlorella protothecoides
cctcgtcgtccacggccatgtcgaggcgggggatgaagaagtgctgatggtgcgcggcgtt

SEQ ID NO: 44866 - DNA, 677 bp, Chlorella protothecoides
  modified_base (139)..(203): a, c, t, g, unknown or other
accacccccctccccccacccctcgcagcagaacaccataccttgagcctgcgccgcgcggcctccgcctcctccgtcttgcgccgcagcacggcctgctgcttggcgcttagcgcctgcaggcggtgcaggctgggcnnnnnnnnnnnnnnnnnnnnnnnnnnnnnnnnnnnnnnnnnnnnnnnnnnnnnnnnnnnnnnnnncttgcgcagcgtcgccacctcgcgctcccgcgcgcgctgccactccaggtgctcccgcgccgcggcctccccccggcgctgcagcgcggccttggcggtcttgatcccggcgatgtcgcgctccagccgcgcacacgtctcctccgcccgcgccttgaggcgctccagctcccgcacgcggcgctctttctggcgcagcgccgccagctggcggtccagcgccgccagccggcgcctgtagtcgtccgccaggcgcgcgcgctcctcctcccccgcatgcgccagcctctccagctcggccagcagcaccgcgcgctcgcgcgccaggccgtcgcgctccgcggccagccccgccagctgggaggagagcgcgtcgcgcagcgcggcgtgcccggccagcgccagcgccgcacgctccttggcctccaggctcagctgcagcgcgcccagctggcgctccacgtcggcgccctc

SEQ ID NO: 44867 - DNA, 61 bp, Chlorella protothecoides
ggcttatatacatgtgccatggcagctggggactgatgattaaagctgtgacctgttgcaa

SEQ ID NO: 44868 - DNA, 61 bp, Chlorella protothecoides
ttgtatatttggagaggtagtagtctaaggggattgggggggggggaggaggctgaggcac

SEQ ID NO: 44869 - DNA, 61 bp, Chlorella protothecoides
atagcagtcgcagaggagccgaaaaggaggggtaatgaagagatcgttcataagtgttcgc

SEQ ID NO: 44870 - DNA, 61 bp, Chlorella protothecoides
ctcagacctgtagccgcgctgcgccaggcgccgaccaccgccgtctgtcgaggagccctta

SEQ ID NO: 44871 - DNA, 61 bp, Chlorella protothecoides
tttgcccgtgcatatgcaactcgaagcctccccctcctcatccagtctgccccgcctgctg

SEQ ID NO: 44872 - DNA, 61 bp, Chlorella protothecoides
gctggcagcctggcagccgcggggcggggggccctgccacccctccccagcactcccccca

SEQ ID NO: 44873 - DNA, 2571 bp, Chlorella protothecoides
  modified_base (104)..(304): a, c, t, g, unknown or other
gcgggcgcagcgtcctacgccgacggccccgactgcgcccccaacgccgcgccccgggcgctgaccgcgccgccgctggaggagcagctggcgcagagcacgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgatctggctctgggacgcgcgcgcgcgctgggcgccggcggggcagctggaggcgcacacgctgacggtgatgcggctggccttctccccgcgcggcgacctgctggcctcggtcagccgcgaccgcacgctggcgctgtggcgccggcggccattgcatggggatggcggagagggctgcgccccgcccttcacgctcgtggcgcgggtgaaggccgcctcgcgcctgctgttcgacgtgagctgggcgccggacgaggcaaccctggccacagggtcccgcgacggtatagtggccctctggcgagcggcgccggggtcaagcgaggccctcaccaaatcgctggagctgcgcagggggtcggcggtgcgggcgctcgccttttgccctggtgagctggcgcagggcagcttcctgctggccctcggccacgaggacggcacgctgtgcgtgctgcgcttcagggtgcagtccgggaacgcgctggaggtggtctggcagcgcgccacgcacgccgggccggtgcggcgactggcctggcggcgggatgacggggaagaaggcagcttcctcctggcttcctgctccagcgacggctcggtgcgcatctggcacgtggccgggtgacgtgcgctgagttcttcccctggccctgtggagggagtggctcgtggaggagacagcgcaaggacttcccatgacttcatcatgaagacgtgcacatgaatttctcacatcttccccaccccttgtgtacactctgtttccaacttgccacaccccttcccccattcaaacccatacattacatgctgtgagagcacattggcgacagagggggctgctggggtggttcaggttcgggaagaggcaggagggatgctcaatattagatgcaggggcatgttcccgccggcactggtgctgggcctcaatgatctgtgtcgtgtgccctcgccaggcgtagcagccaggacgggcatggatgcctgctcggcgtaatggggccgctggaatgtacagggagttgatttgcatgcagggcaggggggcgggaggaatgtgggggactgagtcccctggtggaggataaactctgttggcaaaagcgccgcttgccctggtgggtctgcccagtggggacccagggcacagaagtgacgccacgagtgattcaatgggcacacaggaatcggcgcatccagccgtccctgcagccgctcggccagacccctctgcacctcagcatcgacacacaccaccatcaggccacgaggctgccctccgcctgccgcgccaggcggtcctgcaggctctgcagccgcgccagccccgccgcgacggtcagacgccggtgcgggccgccgctgcccgcagctgcgcccaccccaccccgtccgcaggcctgcagcgggggcgcgtcgcgcagcaggcgcacaaaggcccccaccgcggcgtcgctgtcttgactcgggggggccgaggtggggtgccctgcctggggtgcgcccgacgcaaaggggctgggcagcgccagcgcggtggtcccgggcgctccggccgactgggtcgacatggaactcggtacggcgccctgcgttgccgatggcacgcacacgatgattctgccgtccacggctgccagcgcaccgaggccagggtgaccacccacgccgccgccgccgccgccatgctgctctccgggctgcggggtggcgcggccgccgtccaggcctccatcgcccacatctccagcctggccctcgccctcccctgccgcctgctccacgctgctggcctcgccgtccagggcaaagggcagtaggtcctcgagcacatcccgcggcgtggaccgggcctcaacgtgcgtcgccgacgacgggccccccgccgagggcagccggcccccgcccgccacgtggacgagggcggtgctgctgctctcgacgagtaccgccggcagcgtgcgcaggccggacaggtgcgaggagtggcgcggcgtggaggcggacagcagcgcctccagcgtcacgtccttcaggaaaaggggggagagtttgtccgaatggaggggtgcgtgcggcgagggttgcgcaggcgagccgagggcaaggcacggacggtcacatggggcggcgtcggacagccgctggccgccgcgcggcacgtggcgacatgcactgtaatcctgattctcagcgacgccggtgtaaactcctccctcgactcatgtaggcatctgccatgacaattctcccccccccc

SEQ ID NO: 44874 - DNA, 61 bp, Chlorella protothecoides
ctcggaaggacagggcacaccgtggcagggggaagtcgcatcgccctctcacctgtgcctc

SEQ ID NO: 44875 - DNA, 61 bp, Chlorella protothecoides
ccactgtggcaggagggcgaggggcggcggggcttggcgtttgctcagaggccaggggcca

SEQ ID NO: 44876 - DNA, 61 bp, Chlorella protothecoides
cggcgtccttgcccaccaggtccggggcggggccgtgcaccgcctccatgagcgctagacc

SEQ ID NO: 44877 - DNA, 61 bp, Chlorella protothecoides
acaacatgggaaccaatacacaaaacgagggggcaggcatccactcgaccaggcgcgataa

SEQ ID NO: 44878 - DNA, 61 bp, Chlorella protothecoides
gcagactgctacaaggagtggtggcaggggggctgtacttgcagaggagcactcgcgtgaa

SEQ ID NO: 44879 - DNA, 61 bp, Chlorella protothecoides
aggacctggatggtgtgaggagggggggggggggcgagctgtgtctagttgcgtgtagata

SEQ ID NO: 44880 - DNA, 61 bp, Chlorella protothecoides
ggtccagcgcctcgcgccgccgcgcctccaagtccacgacgcggcgcagtgcggcctgcgt

SEQ ID NO: 44881 - DNA, 96 bp, Chlorella protothecoides
gggaaggctgcggaaccgcgcggcggcggcacacccaactctcgcggtcccacatgcgtggtccgccccgccctcccatgtccctgttcctcccca

SEQ ID NO: 44882 - DNA, 61 bp, Chlorella protothecoides
gtcgtcagatgaggcgatattactggcaggggaaccagcagatcatctttctgacataata

SEQ ID NO: 44883 - DNA, 61 bp, Chlorella protothecoides
ctacgtgtcggtggtcctggagctggctgggggggctgggggggaagacggcgacgctccg

SEQ ID NO: 44884 - DNA, 61 bp, Chlorella protothecoides
tctacactgcgccgatataacggaagctcggcaggccgacatgattttccattactggatt

SEQ ID NO: 44885 - DNA, 61 bp, Chlorella protothecoides
cgacgaccatgcatgaccatactcgcaaggggccgccttcccatggcacctgtctactttt

SEQ ID NO: 44886 - DNA, 61 bp, Chlorella protothecoides
ctcgtctgctggcactggtgtggtgggaggggcgggggagcaggcatcagctgcgagttgt

SEQ ID NO: 44887 - DNA, 61 bp, Chlorella protothecoides
cgcgctcagcaatagccatcggctcgagagggattttccatgtagccaccagctcaccggt

SEQ ID NO: 44888 - DNA, 61 bp, Chlorella protothecoides
tgagaagttttgggagagagtaggaggggggggtccgctgcagattggccaggtcctccct

SEQ ID NO: 44889 - DNA, 61 bp, Chlorella protothecoides
ctcaccccctcccagcccgccaccgacctccccccctcccagcccgccaccgacctcaccc

SEQ ID NO: 44890 - DNA, 183 bp, Chlorella protothecoides
aaaaattttaatataattatattattaaaactcgaagtaacggaaagggagggattcgaacccccggtagctttaacactacgtcggttttcaaaaccgatgcattgaaccgctctgccacctttcctaataagtatcaaattatagcggataacgcgattcgaacgcgcgacaagcaccttg

SEQ ID NO: 44891 - DNA, 61 bp, Chlorella protothecoides
aatcatttttccgcccaacgagggaagagacgcacaatacacatttgtcgacggatctggg

SEQ ID NO: 44892 - DNA, 17199 bp, Chlorella protothecoides
  modified_base (172)..(298): a, c, t, g, unknown or other
  modified_base (557)..(566): a, c, t, g, unknown or other
  modified_base (905)..(914): a, c, t, g, unknown or other
  modified_base (1132)..(1141): a, c, t, g, unknown or other
  modified_base (1779)..(1788): a, c, t, g, unknown or other
  modified_base (2733)..(2742): a, c, t, g, unknown or other
  modified_base (5683)..(5692): a, c, t, g, unknown or other
  modified_base (5835)..(5844): a, c, t, g, unknown or other
  modified_base (6106)..(6115): a, c, t, g, unknown or other
  modified_base (7684)..(7693): a, c, t, g, unknown or other
  modified_base (8789)..(8798): a, c, t, g, unknown or other
  modified_base (9308)..(9317): a, c, t, g, unknown or other
  modified_base (9414)..(9423): a, c, t, g, unknown or other
  modified_base (9999)..(10008): a, c, t, g, unknown or other
  modified_base (11227)..(11236): a, c, t, g, unknown or other
  modified_base (11638)..(11647): a, c, t, g, unknown or other
  modified_base (12570)..(12704): a, c, t, g, unknown or other
  modified_base (12797)..(12806): a, c, t, g, unknown or other
  modified_base (13087)..(13096): a, c, t, g, unknown or other
  modified_base (13162)..(13171): a, c, t, g, unknown or other
  modified_base (13237)..(13246): a, c, t, g, unknown or other
  modified_base (13394)..(13450): a, c, t, g, unknown or other
  modified_base (14270)..(14321): a, c, t, g, unknown or other
  modified_base (14468)..(14477): a, c, t, g, unknown or other
  modified_base (15082)..(15254): a, c, t, g, unknown or other
  modified_base (15619)..(15628): a, c, t, g, unknown or other
  modified_base (16967)..(17021): a, c, t, g, unknown or other
gccccaggccaccgcggcgtgcccagccacggggggcagcgcggcgccgtcgccgtcgccggccccggcgccgtccgccgccggcgacggagccactggcgcccatgccagggactccaggtccagggaccaggtgtcgcccaggtagcggccggagtaggatccgcccagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcgcggcgatgaacggcgatacccagctgccctccaccaccacctccgccacggagcgcggcttgtgcgcgggcggcgcgggggcggccggcgcaggcggcagcgacgccgcggtggaagcacccgcgccgacggcctccttctcgtccacctccgcacccttgtcgacgggcccctgcgccccgtgctcggctgtgccgttgggtcggggccgcgcctcgcgctcaatgccctccacccagcccggcacctcctcgnnnnnnnnnnttgggctgcgcctcgcgctcgatgccctccacccagcccggcacctcctcgtccagcgtgcggacgtacaggcgcatggcctccatggcgctcagctcgcccagctccttccaggcctgccacttagcgttgctggccgcgttccagccccacggcttgggctggttgcaggggccctgtgggaaggtggtgggggacaggatgcaaaagtcgaggcgtgtttgcatgcgtgtgcaggagggctacgcagactcgtcaactcaggcaggacagagggctgatcgcgaggcggtggcgcgacgcggtctcaggccgagatatggaggggatttcagacannnnnnnnnngcacacagtcgtcaactctggcaggacagagggctgctcgcgaggcggtgtcgcgacgcggtcccaggccgagatatggaggggatttcagacagtacaccaccctggagtgcatgcaccattggacccgtcaacagcaatcctcttggcacaagcatgcctgccagaacactggcacagggatgctcaggcaacgacagggtcccgctcttgcaacnnnnnnnnnncgacccgtcaacagcaaccctctcggcacgagcatgcctcccagaacactggcacaggcaacgacagggtcccgctcttgcaaccaagtccactctccccatcgaggcaccaacccccctgcaacactccaacactccgcgcaccacggtggcttgctggtgcagggcgtatagggccagcttgatttcgttggagatggttgccgagtctgcgcggtccggaggaggctgggctgcctacaagcctcgtaagagtcagcctaacagaccggatcatgccctctagagctccacccaccttcaagtgtcggctggatgtggctggccgcgaccgtgaaccgttctgggtacgccatggtggatactgggtgtgccatcacctcaccgcgttcgcccggcgcacactggggatcctcggctcccagttgaataaggcgtgatctatcttccgctcgtgctcgcaatacgttgctcccaggacgacgcctgtcacaaccagggtgatctccgcgtgacgcaggggcggttgttggcagcgagtgagcacgatccagtcgacgatttacagccaccgaggccactagctcccttcagtgtgggtcagtgcgctctgcagcgtgagatccgcgcttgtcccnnnnnnnnnngtcttccgctcgtgctcgtaatacgtcgctcccaggacgacgcctgtcacaagcagggtgatctccgcgtgacgcaggggtggttgttggcaacgagtgagcacgatccagtcgacgatgtatagccaccgatgccactagctcccttctgtgtgggtcagtgggctctgcagcgtgagatccgcgcttgtcccctccccggcgctccctcggcccccgttgaggcgcccgggtgggcacgtggccgtaactggactgggcttccacccggcaagcactcccccccaccaactgcaggccctgagaagactctaccagaggcaatacctaaaatgttgacataaaaggacaccagttcatgacaagggtagaagggaagaagttcaacaccacgcgcaggatgcggtggtggctgagctgcgggggcgcggggtgcgggcgcaccgcggcccggggcacaatatgatgcctgcttcccctcaaggtgtcgctcagacgcccctccgcgccgcccggtccgccgcacgcccgagcgtgcagcctcggtacgctgcagccaagctctaccgtgcggcctggtccaggccgtcgccgccctcaagatccagctcgtccaggaggtcatccatctcctcctcgttcaggatctcgtcggccaggtcgttgatgtccaggcccgtcgcagtgcgcttggaggcctggggaaagagggggggtggggggttgactgcctgagcgcagggtggagtgcaatgcaggacacgtcattcacagccgatgccggcaggcggtgcgggagcagtgcattctgctttcgctcctaggcgcggagggaggaaaggaggcccaagtcatcaggagcgagaggcctacaacctctcgcccaagcccacctcgtctatcagcgccagcaactccgtctcgctccacagcggcttctggggnnnnnnnnnntggaggggggaaaggaggcccaagtcatcaggagccagaggcctacgacctctcgccctagcccacctcgtctatcagcgccagcagctccgtctcgctccacagcggcttctggggcacgcccggcgccaggaggtagggcgggcagtccttgacaaaccacgggtgcaccatgacctcctgcaggctcagccgctgctcggggatgcgttggagcatcttgctgcgagatgggaggaggttcagggggggcgcacagcgtgagggtggttgagggagagggcgtgggggctgtgggaggacagctgccgcgggtctgtggccaagcgggcacattgccgcacacaatgtgcaagtgataagcctgatacattctctcctcacaccggggacatccggctttacccagaattgcaaaagggcctggcggccagggcctcacctgagcaggtcccggagctccggggagagcgtgtccggcacatcgtactctgcccgcgcgatccggcccaagatctgccaggaggaaagaggggggggggggtgagcttgctcgggaggggagcatgaacagcgcatgcgttgggcagtgaactgccctgctcctgggtgcaggctctcgtgccaggcaggggccgggagacccaaccagcccctcacactctcagcgcctgccggtcactcaaatgcggggtgctgcccaggtagctccccgcccagtccacccactgcagcgtcgcccccccttgaaaacccccaacccctgctcctccctctctgcaccacaaagtcaccttctgcaccacgtcccgctgccccgccaggtcctccgcgcgctcgaaggggaacctgcccaccgtgagcttgaagagcgcgacacccgcggcccacacgtccaccgcccccccgccgcgcaggctgttgcccagcacctccggcgcggtgtagggcagggaccccagcgcggagttggggtcgctgttgatctgctccgtcttgctgtaggcaaagtcctggaccttgacgacgggcggatcccccggcgccgcgccggggacgagcagcttggactcgagccgcgcctcgcggttgtgcgcgcccagcgagtgcaggaaggccagcgccgaggcggcctgctggaacagcgtgcgggccaggggctcggccagcgcgccgcgtgcggccacaaggcttgccaggtcccccgccccggcgtgctccagcacgatggccaggtgggtgtcggtgaggaagacgtccagcagctgcaggatgtggggctggcccgcgcagcgtgcgtggaagaccagctcgctgcgcacgaactgggagacggtggggccgcgctccaccagcttcagcaccaccaggcgacccgtgctgacgcggcgggccaggaagacctggcccagggcggggccgaacagctcccgcacgggttcgtactccctgggagggtgggcgatgggggttggggggggtggaaagatggaacgtgggggtggcatgtgaaagtacacggccaaagggctgcgcaggggccaggcacacacacactgcacacctgtggccgaagaaggggcaggcggagaggtccgcgctggggctcggctccgtgagcccttccgcagggtccaggtcggagctgcggcacatgggaggcggggggtcggcacggaggggggcggaccctgcaagtgacaccctggccgctccgcgagcgactccagcaatcccttctcacctgctgagctccgcgcctgcgggcttggacgcctcgctggtggatgccttctgcccaccgaatcgaaagctttccctgaacctgttcatgctgcccgggctcgttgggtgctgggtcgcgagccggaagcgcggagcaggcaggtgcctaggggggcaacgatgagctcagataccagaacttatttcctggattccatcgaggaccctccacgcctagcttgagccgtggcgccggagcgaggacgccgatgatggggcgggggtgctagggtgagcacgcgatgggcgtctggcggaggctggagataggatcgagacgagctgattacagcgtgattcgatcccgtttctcatgaacgtgccgtgtagaggccgcaatctgcgcaaatgggcctgctgcggcactacaggccccccaggttcctgatgacttcagcatttttgacggcccaggtcagccgtgcattgccaatggggaaagggcacacagcatgcctgtgacaaaggcatctcgccaacattcgaccgtccagtttgtcagcgcaagctttcaatttagaaacaatgtactggattccaatggttgtcacgatgaagcagaggaagaaaaggagctgaaggcagcgaccagtgaatgcgcattgctgatgtggaaccctgattggggtttctgggacaatttccctctcgcccagctagccatagaccgggggggcggtggatggtccgtactgcatctcttccccccagtagaattcctccgggacgtgcaggcccgccgccgcgctgacgaccacgcccctcacccgcacctcgcgcctgcgagggtgaggaggcgcgattcagcctgattggctgcaccgccaggcagctgcgtgacctggctgtgactcattgcagtggaactcccatgcaaaactcgggagggcacggccatgcagtgggctggaacgaagcccctggcgccctcatcgccacgcaagcacagtattgggtccgagcccggacaggtccaccaccggacaggcctgcgcccaacccccgccgcacccgttggagtcggtcctccctgtcgtcctcacgcgcaccacacattccggggagggcgtcacgaggagcaggtcgaggtgctcttgggtcgcgaagaggtgtgggatggtgccgttgagggggatggggtcgcaggagcaccccnnnnnnnnnnaggagggcacggccatgctgtgggctggaacaaagcccatggcccctcatcgccacgcaagcacactgttgggtcggagcccggacaggtccaccaccggacagccctgcgaccaccccccgccgcacccgttggagtcggtnnnnnnnnnngcacacattctggggagggtgtcaccaggagcaggtcgaggtgctcttgggtcgcaaagaggtgtgggatagtgccattgagggggatggggtcgcaggagcaccccgagatgcagctcgcctctgcagcgtgaagggacagggggagcggaggtgaacagcatgcagtgccccttgcaggcactgcacccacccacacacacatttccgctcggcgtcctggttgctcccatccagcgcctcctggatcaatctgtcccannnnnnnnnntggcgtgaagggacagggggggggaggtgaacagcatgcagtgccccttgcaggcactgcacccacacacacacatatttccgctcggcgtcctggctgctcctatccagcgcctcctggatcaatctgtcccacccacaaacttcacacagtgcccctcctcgccctcgatcctacccctcacaaccctcacacctgcgttcccaatcttgtcatggctcttggccgtgaagaggagcaccgccgtgcggtttgaccccggcgccgtcactgaggcgtccacgtgaatgtccagggtggcattggggttctgcgtcacagcccgcatctcatcccccttgcccttccaccagaagccgccggtggcgttgcgagccacgtcgcgtcggaacctctcgccctgggcgcagtactcggcgggcagctccaccaagttctgagcaggtgacagggggagaatgagagccgccgggggggtggtcactgtgtgaatcgcggagccggggccaaaccaccaggaacacggtacgcaccgggagcatgggggcgggaagggcgccgtcgtcccctcccagggtcacgtgctgccggcccagcgcggcgcgcgccgcctccatcctcaggaagtggatgaccaggtctgccaccgcacgatgccccttgttgatcaggtgcaaggagtcgccctgcgaccgtcgacaaggaaaatggagaagtgggaatgtcttgggatcccaaacaactctgcaagggggtggggaccctcccccctcccattgagtacagaacgtcacagggccacgcacaaaggcctactgcctgggcaggtagggacccttgtatggccgctgcgctgtgacgtcgggctgcactccaacgccccaccctgcctcaccatcatcacgtccgactttttgacagcgccagtcttgatggggtggtacagcatgccccgcatgctgagccacggcaggtcatagtacagcgacaaggtccccacatcgttctctggggtgtggtggaacacgcccttgtgcctagcatggtgggggaacgcagtgttgtgtggcccttggtgggggggtagggcagctgccgtgaactccctcgagtacatccacgggacactccccgccaaaaggttgagcaggagagacccgtctctgttgcaccgactgcaacaaggcgctccgcttgcctgcggccccggcatgcattggacagcatcgcctctcacaccggtgcccgcatctcactggtgtggatggtaattgaagagcatgacagggacgaccagcggccgagtgggcagctgcagcaggcggcgcagcaggcgctcgtagctgcggcggtgggcgtgctcccagggcaccgtcatgtcgttgatgatgtactccacctggggtgttgcgatcgcgacgcttctggttggggccaggctgcagctcggggagtgcccatcgggatggcattgtgcctcagtccctccccaagcagccctcatgctgctgccaccccaaacccaactcaccagcacgacgtctggggccgggggcaggtgctcgtgcnnnnnnnnnnggtccctcccccaagcacccctcatgctgccatcaccccaaacccaactcaccagcacaacgtctggggccgggggcaggtgctcgtgcatgcagaaggaggcccactcgctgggggcggccgggatcgcgccgttcctgagctcgtgctgggtgccggggaaggccctgcgcacccagtcgaagaccaggggcgcccagtcggtcttgcccctcgtcgtcgccccgcggccaaaggtcaggctcccccccagcacgcccacgctgagcggccgtccggccagcagcgggctcagggcgcgggcggcggcggcgtgcgagcccgcgctcaccaccccgcgcgccaggaacgtgctgggcagggacatgttgtgcgcaaaggccgccaggaggggctccaggggctgggggacccgggggccggccatgacccgggcgatgccctcctcgctcatgaccaccaattccgggccgagggcctggtgtgggggcccggtcgaggggcaggctcgacccctgggtctgagcatcagcaggccggtagcatacaccccggcggcagtcagaacgagcagggtgagggcgtggcacctggcctgcggagtggtccggaggcccatgcgtgcgccgcgcagcgcttgccctcctcgatttggaccgcaagcaatgtggttgtgtggcccaaggcgcttcagagcaggtggagaggggaatgctccgccgtctcgctcgagtcgaatgtgtcccggcctcggccggctcagcacggtacacacacaaaagggtgaagtcagcaagggcgagacatgggggagggtggcacagggcactgtaatgggttttgtaatgcgtttctggcaagaggagcgcaattgcaggaggaggtcatctccagccgtacagggtcccacctcaaggcgctcatgggtctggcgtgaggttccggatcccacacgcttccacgatttcctttccacagcagtctcctcacccaccccgactttgatctccttcagtggtcctcacgaattgtaatctttccctactctaataaacgcaaccagcatgtagtcgtgtgtgcacgttacaccaagaannnnnnnnnngttcccctactctattaaacgcaaccagcgtgtagtcgtgtgtgcacgttacaccaagaataacaaactttgaatcggacgcaaggggggagtgtttctcggtcacagcgggggagggcacgggggaggactagcgcctgggtggggtacaaggatcaccagctgtgggcacgctgcattccttacaatgcatctggacagctcagggtttggcgtggcaccccgcccagcaccgaggctggggccaggggcgccctgtcaatcaaaagcgggaaggtatcccctgctgcttagggcaggggcaggctcagggccgactcggggatcagcacatggtcgatgacctgtcgagggggagtagttgggagtcgtcggaagcaggggttgtatagacttgccctgcacggcctgcttatggatcaccccgggcccaagcgccctttacccccggcacaaacagaccacctcccccccctgcaactcacgtggacgatggtggcctcagaggtnnnnnnnnnngtggtcgatgacctgtcgagggggagcagttgggagtcgtcggaagcaggggttggggacttgccttgcacggcctgcttatggatcaccccgggcnnnnnnnnnnctactcccggctcaaacaccgcacctccccccccctgcgactcacgtggacgatggtggcctcagaggtcaggatgtcgcccttgaccacctgggccacggggaggacgccgccggtggagaccagctggatgttgtagccaaagtagggggcctccttctgcagcacctgggtgcgggagacggtgagcacctcgtcgccgccgagcgcggtctccagctcctcgccgtcggagaactcggccagggactgggcggtgggcagcacgtggtagctcagcacggtggtcaccagctcgggcgccgccagcagctcggtggcgctggtgacgttgagggcggccagcagctgtgtgtgtggggaaggggtggggcccatgagggtgagatcgcagggggctggcgattcagatgcaccaggacacgtgagcgcaggtgctctgatgctggtggcatggtcgagggatgccaccagacaatggtgcacacggcgatgccccaggcagaggtgcatggggcgtagtcctcctcccttggcctggcacgtgcccaccctcccacgttctcatacctcggnnnnnnnnnnggcgcgggtgcgctgatactggtggcatggtccagggatgccaccagacaacggtgcacacagcgaagccccaggcagaggtgtatggggcgaagtcctcctcccttggcctggcacatgcccaccctcccacgttctcatacctcggcgaaggccttgttggtgggggcgaacagggtagcgccggagggcacggtcaggccgacggcctgggcggcagtggcaaggatggtcaggtcgttggcggcgagcacctcagcgatgctgtcgctgccgacggccggtggggagggggcgccgaagatgccgccggcctccttgttgaggagacccttgaggctgggcagctcccagtgcttcttgccggtggcgggggaggcagcgggggagcgggcgccggacacggggacgcgggcaccggaggcagggacgcgagcgcccgagacggggacggcgggagagggggcggtcttgggggaggccttgcccttgtgcaggatctcgtccaggctgggcagatccgttgccacagcgctgctcactgcggaagaagggagtggaggagggggcggagcaggagtgggcaaggggtgaagggggcgagtgggctagggcgagagcatgagcatggccgagcgagcacgccccctgggtcctgttgatcacgacgtaccgagcagggcgcagagcgccacgaaagccacacgacgcatcatggcgactttgtaatgtatatggaagataaaggtatgaaggtgtaagacagtgcaggggccggtgggtgggccgaagtgctggttcagggtgggagaaaggttggttgtgagtgccaagcacggccgcccatggttttatcaccggactgtcaatgaccgtgcatcggagtatcgagcaagcaacctgctcacacgggctcccatggcgatgctccgtcatgtgggcttcggatgcgtgaacgaacgctgggagggcccgacgcatgcggggatgcacttcccgcgcagcatcggtccgtgtctcgggctgtcgacggcatgcgacggcgcatggagaacagtccggtacgtggcgtcccgcacgggattgagggtgttttcgcgtgcgcaatgcccttggtcgacgagcttgcatcttcgggacatccgcaggggaccctggcgaaacccccctcccccataggaactaattaaccaccacccaactgcttcggttgagtctnnnnnnnnnnccgtggcgtctcgcacgggattgagggttttttcgcgtgcgcaatgcccttgggcgacgagcttgcatcttggggacatccgcaggggaccctggcgagccccacttccctcataggaactattcaaccaccacccaactgcttcggttgagtcttgagccagccacaagcagtgtgggattttttgtaaaaacacagcttgccacaagacgtcaacttcgatcattgcaggaaattcgacgcacagctttcgagtgtcggcatttgcgaacgtctggcggatacacgcactggcttgtccaccaagtacgggcgcaccccaccaccaaactggcttggcccaacatcctcaaaactcatttgtggggatggccaataccttgtcaagctttgctccgtgannnnnnnnnncgggaatttttaagaaacacagcttgccataagatgtcaacttcgatcattgcgagagattcgacgcacagctttcgagtgtccgcatttgcgaacgtctggcggatacatgcactggcttgtccaccaagtacgtgcgcaccccaccaccagactggcttgccccaacatcctcaaactcatgtgtggggatcgccaataccttgtcaagctttgctccgtgacctccaatttgtcgccttgcctagatctggataatcagacccaccctcctgaatcctgatctggagttacaggtcctaagtttgagtgattgggcaatctgaacatctacagtgtggagaaatcgaccgtcgtcagagtttgtattcaatgggtttcgacactattcaactgggtcctgtgtctaaccggagagggcggcgatcaggtcatcctgcgtaggatggtgggagttgcgtgaggccgggtccccttggatacatgctgggaggtgcaacccccccaattggtctccatgtcagacaacgggcaacacacaccttagagggaagctcccacttgtgggtgtcaggggaaggcagaggggcggggacaggggccggaaggggggtgggcgcgacgcgcgctccactgacgggctgcatgtgtgagatggaaggtgggaggtgatggaatgaggaatcatgcgcgactgctggcaaacgcatctctcaggcttggactcaccacagcacggctgccgctgacgttctgcgccaacacaaggtggggaggggaggaggagtgagccacaccgttggtgtctgggaaatctcaaagcaaggcccgggcaggtatcctacaagaatccccgcggaacgatggcgtttcacagcatgcacgtattagggctgttcattagttccataactcaccaccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatgagacttgaagttccaaaactgtgcaggcgtgctgtagactcggtctcagccctgatccaagacgccgcacccgcaagccggcacgcttnnnnnnnnnnattggtgtctgggaaacctcaacgcaaggccccggcaggtatcctacaagaatcccagcggaacgatggtgtttaccagcatgcacgtattagagctgttcattagttccataactcaccaccggtggcgcgacgggggacacaacgggggccacagcaggggctacctccggggactccttgtggaagaagtcctcgagctccttctcgatcttgtcaaatgtctgcaactcacgcgcggacacagcgacgcctgaacggagggtttgttttgagtttannnnnnnnnntatttataattacgaggatgggataagatgataactgagaagtagggaagatcgtacgcctttggnnnnnnnnnnattatatatttaagaggagggtataagatgataagtgagaagtagggaagatcgtacgcctttggnnnnnnnnnncatgagacttgaagtcccaaaactgtgcaggcgtgctgtggactcggtctcagccctgatttaagacgccgcacccgcaagccggcacgcttccgcttaccgagtgccagcatggccaggaggaagtaggcagtcttcatggcaagtnnnnnnnnnnnnnnnnnnnnnnnnnnnnnnnnnnnnnnnnnnnnnnnnnnnnnnnnnggaatgtgaaaatgcagtgtctgccaggactcaagtaccgcctcgagtggactgcagtccccgagacagatcgtgggcccccgcccgcttcccaggcggccattgggttgatttcaccggaagaatcaactgcaaatgcgacccctggttcgccgcgtggtctgagtctccaagaatacccaggaaaccatgacgagacgcaacatggtttcattcatgacttctccgtttcttccgccgacgatcgttcctgtcatcggatcgcccaaacagcagctttgtgttcgagactcgaccatgtggcacgttgaacggtgattcgaagccaaacaagcaatataatcccactcgagggactagattcgaccaatatagtccccagggagccccatatcccgcgaatgcagtcctactcgatccatgaacggctctcttgttctgaacagtcgaacatgtactctttacgtcatcaacacagtcgtaagtactcatgtaatgccgacttgtgctatataattttgctgtgtgagtatgcctcttggagcagaggtactgattgtttctcaactcggtcttttcattgtcctcccagatccttgcctgaggtgcatagcagcatggtgttttttcgtttacaacggtctgtgcccagagaggatgtctggcatgtacagcttgaatcaatgtatgctgttatgacgctacaacaggtgtagtctgtcctggtctactctgatatcagcggagacagaatccaggaccaacttccactctagtggccgatggagctctgcagtgatgtcaggcatcgtggacgtannnnnnnnnnnnnnnnnnnnnnnnnnnnnnnnnnnnnnnnnnnnnnnnnnnnaaaaaaccttgaaaaggctgtttgattgtctgcaccccccagaatcctaccttctcagcgtcaagcttcttcttggcctcttcgaaatggttgcgcgcgccactgatcgcctgaagtgaggagggcaatgagggtgacaggtgggcnnnnnnnnnngttcgaagccaaacaagcaatagaatcccactcgagggactagagtcgagcaatatagtccccagggagccacatattccgtgaatgcagggctactcgatccatgaacggctctcttgttctgaacagtcgaatatgtactctttacatcatcaacacattcgtaagtacgcatgctgacttgtgccatatacccttcctgtgtgagtatgcctcttggagcagatgtactgtttgtttctcaactcggtctttccattatcctcccagatccttgcccgaggtgcatagcagcatggtattttttcgtttacaacgatctgtgcccagagaggatgtctggcatgtacagcttgaatcaatgtatgatgttatgacgctacagcaggtgtggtctgtcctggtctactctgatatcagaggagacagtatccaggaccaatttccactctagtgaccaatggagatctgcagtgatgtcaggcatcgtggacgtaaattcgaggattgacttcgacaacaaacttgaaaaggctgtttggttatctgcaccccccagaatcctaccttctcggcgtcaagcttcttcttggcctcttcgaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgtcctgcatgtgcttgcgtgctccgctcaccgcctgccaaagtgagggtatggcagttggtgagaaggaggtcaacgctgtctgacccacgaaaacaaggtgccgcccttgttcccgaaccgccaactatacactctgtggtcgactcaccactgcccacttggcctgcgcgtctgtgatggcctgtgcgatcgtcgtgccaaacgagggtaaggaagggatgcatgacctgggctcatctgcgaacccatgcagcggctgcccatgacgcacaaagttcaggagacaatccactcaaactcaccgcctgggtggcgttgtgcagggactctttccactcctcgtcgtcagactgcagggtgnnnnnnnnnnttcaactcaaactcaccgtctgggtggcattgtgcagggactccttccactcctcgtcgtcagactgcagggtgcgggcgttggcaacggcacctgcgcgatgtatgcggcggggggattatgaggtccccgggcttgtctttcgtactttaatgacccatcatgtcgtttgacattgactcactgatggccagcatggcgaggaggacgtaggcgagcttcatggttgggtacgactggggtgagtgaagggagtgatggcgaagggaattgataagacttgtgagtattccttcgaacttggaaggtataaatcagagtgaataatgaccctcgagctctcaaacagcggggaatatggtcgactgcaacgcggcattcgcgtgccgtcctagaattgccttggatgcgacaccctagcctggctcctcgacgctgcacggcaaggcacgcgtctgcacccaggcaacgtgaggaatggatcctacaatgccttgttcctggaatttacgccctgacaagtgccaatcgaccgggttcgtggggatgtcgaccctggggtcttcccgtgctgtcgcttgcaccctgtggcggctcatccaactccgacgccccgtgtccccggaggatggccacgcatctcggctcgagatgacaacacaagtacctggagtttagaaacgggttgcgatgccatgcagtcttcttgatgcggtcggcatgcatgcacggggagccctgcgagtgctttcctcccgggtccctgggtggggcatgcccagcgatgggcgggctcgcaccccccatcaccgcccctgctgcgcctggatgatcgccgccatgccagcgggagtcgcgtccgggtccatgcccggaggcagagccgtcacgccccacgtcgggcccgcccgaggtcctgtggcatggcatgagagggggttggcacgatggataaggcacaggaccagttcatgcatgctgtgcaaggcgggggtgatggagacgaggacggagagcgaggatatgcagcccctgtgtcgcccttgtgacccccagcctgcccatgcctcaccctgcccgctcagttccgtccacccccagtggcgctgcgggcccagatacttttctgggtccaggctgccctgccacgtgtctggtggccaggggaggcaggaagggaaagggggtgctcacgaccgatggcagcagggtctgagccttgcctagcggtagaaccaagcccaccctcgacagccatgccagccttcgacgcggccgggcacggtcgtgcacatgtccgccccaccacaccacaccacactcccacctgccacattgnnnnnnnnnnnnnnnnnnnnnnnnnnnnnnnnnnnnnnnnnnnnnnnnnnnnnnnggtgctggcccggatcctggccctcggagtacgtcccccccgtccccgcaaactcctgggtgagggccggggcgcgccgcttgagcagcgagctcagcgtctgcgcctccggcggcgcgccgcccggcggccgcgccccgcacgcggagcacggccgctggggcaggggcgaggcggg

SEQ ID NO: 44893 - DNA, 61 bp, Chlorella protothecoides
gggggaccacacctgatgacaagcggctggggcaggcgtgccgggccccaagcatccagtg

SEQ ID NO: 44894 - DNA, 61 bp, Chlorella protothecoides
tgctcggagctgtgaggtgacggatgtgaagtgtgagtgcaagtctgtatcagagcaagca

SEQ ID NO: 44895 - DNA, 61 bp, Chlorella protothecoides
ctgatgcaaggacatcagggatgtggaggggggcccccagctcccccgccaatcccgtttt

SEQ ID NO: 44896 - DNA, 61 bp, Chlorella protothecoides
taagtaagtaactaataaactaactaataacctaactattaaagtaaataagtaaataagt

SEQ ID NO: 44897 - DNA, 61 bp, Chlorella protothecoides
ttttattttttttttttttatttctttgaggttctctttttctaaacctttttgtggttgt

SEQ ID NO: 44898 - DNA, 61 bp, Chlorella protothecoides
cgactggtcggcccggcaggacagaggcgggctttatgcggacgacggtggcggggatggg

SEQ ID NO: 44899 - DNA, 61 bp, Chlorella protothecoides
ggccgcgtcatcgtcaccaccatccaccagacctcctcccgcatctaccagaccctggaca

SEQ ID NO: 44900 - DNA, 919 bp, Chlorella protothecoides
  modified_base (252)..(261): a, c, t, g, unknown or other
  modified_base (689)..(831): a, c, t, g, unknown or other
ggggaagtggggttgcggctggggttggggggacgcggagtgggtcaggggatgagaggagggcgttcaggggtgggagaaggaggcgcacggcgtgtgggagtggaagggagaccaggggtccattccacggcagtgggatctgagactgtacgcagaggttctcttcacgtcatccgaggcccgcacgcaacatgcacttcagacccttgctcgacgcgcctccgcagggaggcggcggccgcggcggcnnnnnnnnnnatggaagggagaccagggttccactccacggtagtgggatctgagactgtatgcagaggttctcttcacatcatccgaggcccgcacgcgacatgcacttcagacccttgctcaacacccctccgcagggaggcggcggccgcggcggccaagaagagcaagaagaagaagcgcagggtcgccaagaagcccatgacgcctgggaccagcgaggtggagctcggcgccggggacgatgcggcgaaggaagacccgcacgccggcggaggggggaatggccgcgacccagggccagagcctggcgacgagccgggcgctgcgctgcacggcgaggcgcctgggacggccgcgggtctgggtgccgccagagcaccgcctcccagacgtgccgacgcgaccgccgacggccacgccagccgggagccggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagggcgagggaggcgctggagcgcgcggccgaggcggccgcccggcagctgcccgagcgcgacgagggcggcggcgggagcggcggg

SEQ ID NO: 44901 - DNA, 61 bp, Chlorella protothecoides
ccatgctggatgcccccgtgtccggcggggggggcggtgccgctgccggcacgctcacctt

SEQ ID NO: 44902 - DNA, 1271 bp, Chlorella protothecoides
  modified_base (95)..(287): a, c, t, g, unknown or other
  modified_base (1063)..(1072): a, c, t, g, unknown or other
  modified_base (1164)..(1173): a, c, t, g, unknown or other
ccaggcgccggcgccggcaccgcctgcagcctgctggctcatcgcccagcgcgcgaggttgggcgcggagccgacgcggcgcgagcgcgggcgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaacgtcggaggcgtcggaggcgccggcgccctccccgccgccggcgtggccgccgccgccggcgcgcgcgctggcctcgtccttgaagttcacgtaggaccgcgcctccttgggcttcaggcgccacagcgcgctgtcgtacgcgcgcgcggcctcctcctcgctgtcgaacagctcgcggtaggcccagcgccggttgaccatgaccttggcctcccagcgcccctttttcttggacacgccgcggtagcgcgacgacttgtccatgggcttcacccccagcgcgcgctgcaggtcctcccgctccagcccgccaaaggcgcgcagctcgtcgcgcgggtactcggcggcggggaagttggtctgcgccgcgtcgccgtgcagcgcgatggacacgcggtcgtacacgcgcgcggcctcggcctcggtctcgtagtaccccaggtgcgtcacctttccgtgcaccagaatgcgcgcctgccattggttcttgcggttgctgctgcccacgcccatgaagcgcgaggtgcgctggcgcgaggtgaagcggcgccgcggcgcggccttgatgcgctcgctcttcagcgtcgtcttcacctcctcgcgcgacttccccgccaggcgcgggatggactcgcccgcgtagtcccccagcccgtagttggtctgcaggctgtgcgagtcgcggcccagcaggccgatggccgcgcggtcataggcgcgtgccgccgcctcctccgtgtcgtagtaccccacgctcacgccggacttgcccnnnnnnnnnnacggcccagcaggccgatggccgcgcggtcgtaggcgcgcgccgccgcctcctccgtgtcatagtaccccacgctcacgccggacttgcccnnnnnnnnnngtacgacacgccacggtaccgcgacttggtcaggcccgccgtcccgccggcggccggatcggcggcggcggccgacgacagagcgccggcgccgccgc

SEQ ID NO: 44903 - DNA, 61 bp, Chlorella protothecoides
aaccttgttacgacttctccttcctctaagggggagggtttaatgaacttctcggctgctg

SEQ ID NO: 44904 - DNA, 61 bp, Chlorella protothecoides
atagagaagagatggtatatgagtgggggggggttggagtaacggcctgggagtgggaggc

SEQ ID NO: 44905 - DNA, 61 bp, Chlorella protothecoides
ccaccgctgggcccagtactggcggtgaggggggagggcatgacggttggacaagggggtg

SEQ ID NO: 44906 - DNA, 61 bp, Chlorella protothecoides
ttctatctgcttgcggacaggggacgaaggggttcggagccggaggatgatcgtacctgtc

SEQ ID NO: 44907 - DNA, 61 bp, Chlorella protothecoides
tccaggcgcatgcggcggtgcaagcgaggggcatccttcggattgcacaccatgacgcgca

SEQ ID NO: 44908 - DNA, 69 bp, Chlorella protothecoides
aggtcgccgccaccgccctcaatccagagccctcctcctcccaaccccccccccccccccccccccccc

SEQ ID NO: 44909 - DNA, 87 bp, Chlorella protothecoides
caggatggggaggaggagggacaggatgaatactgcagggagggagggggggggggggggatccgttgacgtgaggctcaatgtggg

SEQ ID NO: 44910 - DNA, 61 bp, Chlorella protothecoides
agtcgaactccgtgccgtcggcttgcagggggccctgcgcccagcttacagcgagcggtga

SEQ ID NO: 44911 - DNA, 61 bp, Chlorella protothecoides
gggctgggagacgggctggggctgggagacaggctggggctgggagacgggcttggagacg

SEQ ID NO: 44912 - DNA, 61 bp, Chlorella protothecoides
gcttccccgcacccgacggtgagacggaggaggggggggggggggggtggggggggggggg

SEQ ID NO: 44913 - DNA, 61 bp, Chlorella protothecoides
gtgccactgtgagccttatggatcggtggggatgggattgccatgagatctgccatccagc

SEQ ID NO: 44914 - DNA, 42247 bp, Chlorella protothecoides
  modified_base (121)..(234): a, c, t, g, unknown or other
  modified_base (312)..(321): a, c, t, g, unknown or other
  modified_base (8925)..(8934): a, c, t, g, unknown or other
  modified_base (10960)..(10969): a, c, t, g, unknown or other
  modified_base (11392)..(11401): a, c, t, g, unknown or other
  modified_base (13472)..(13481): a, c, t, g, unknown or other
  modified_base (13858)..(13867): a, c, t, g, unknown or other
  modified_base (14636)..(14645): a, c, t, g, unknown or other
  modified_base (14732)..(14741): a, c, t, g, unknown or other
  modified_base (15333)..(15342): a, c, t, g, unknown or other
  modified_base (15416)..(15425): a, c, t, g, unknown or other
  modified_base (15524)..(15533): a, c, t, g, unknown or other
  modified_base (17000)..(17009): a, c, t, g, unknown or other
  modified_base (17250)..(17283): a, c, t, g, unknown or other
  modified_base (17350)..(17359): a, c, t, g, unknown or other
  modified_base (19417)..(19426): a, c, t, g, unknown or other
  modified_base (21475)..(21484): a, c, t, g, unknown or other
  modified_base (21890)..(21899): a, c, t, g, unknown or other
  modified_base (22281)..(22290): a, c, t, g, unknown or other
  modified_base (23461)..(23470): a, c, t, g, unknown or other
  modified_base (23522)..(23536): a, c, t, g, unknown or other
  modified_base (23665)..(23689): a, c, t, g, unknown or other
  modified_base (24319)..(24328): a, c, t, g, unknown or other
  modified_base (24709)..(24718): a, c, t, g, unknown or other
  modified_base (25316)..(25325): a, c, t, g, unknown or other
  modified_base (26254)..(26263): a, c, t, g, unknown or other
  modified_base (26803)..(26812): a, c, t, g, unknown or other
  modified_base (26888)..(26897): a, c, t, g, unknown or other
  modified_base (27166)..(27175): a, c, t, g, unknown or other
  modified_base (28889)..(28898): a, c, t, g, unknown or other
  modified_base (29682)..(29691): a, c, t, g, unknown or other
  modified_base (30429)..(30438): a, c, t, g, unknown or other
  modified_base (31025)..(31034): a, c, t, g, unknown or other
  modified_base (33535)..(33544): a, c, t, g, unknown or other
  modified_base (34997)..(35006): a, c, t, g, unknown or other
  modified_base (35090)..(35310): a, c, t, g, unknown or other
  modified_base (35427)..(35653): a, c, t, g, unknown or other
  modified_base (35794)..(35996): a, c, t, g, unknown or other
  modified_base (36068)..(36168): a, c, t, g, unknown or other
  modified_base (37744)..(37753): a, c, t, g, unknown or other
  modified_base (38174)..(38183): a, c, t, g, unknown or other
  modified_base (38656)..(38665): a, c, t, g, unknown or other
  modified_base (39270)..(39279): a, c, t, g, unknown or other
  modified_base (39970)..(39979): a, c, t, g, unknown or other
tcacccattcccagccccgaggagtctcccagcccaagtcccgtggagtcaccctctcccagccctgaagaatcacccagccccagcccagaggagtcgccctctcccagcccagaggagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaccctggtgcatgttccggagtcttttctgatacgattgatggtcgctgcactgaagtggattatcccatcctcatcnnnnnnnnnnaagccccagtccaagccccagccctccagctgacacttgcccagcagacgcacccacaaccaacgatggctatacatgtgatggggacttgaacccagtcatctgtactcgagacggcacaaacaccgcggtttgtgtggaagctgaacagccggcccctggtgaatgttccggagtcttttctgatacacttgatggtcgttgcactgaagtggattatcccatcctcatcctttgctctgctggtggaactacctacgctgtctgcgtccctgtttaatcatctttctatgcacaccgccccgtttcctcgcctcgtcctctgtcagtgattatgtaccacacatgtcctgtgcaaagacgatagattttggagccgagcattgttctaaggtgaaagaagccgtttcaggtggcaaggccatccggcatttggatccagcgagacacatctcatcgaatatcactcattggtgataaagggtcaattactctagcagcatactgtcgtcacagggcgagtgctcctggcgcaagctgctgggtcgcctccctcgccgagtatcgacagcccgacaggtggccgggtgccccctcccagaagctgcccagagggagagcggcataggggaaggcctctgtcttacttgggtggatgcattcacgctgttgacacctcacaccagggaccacgcaatgtcatggtcctgtccatcaaagaccagcttgccactccatccctggagccttttgcccttcccatcccgtgccagtgcgccattatgatctcgtcccagcaaccaggctctcttcgtgacacacatgtagacttggactgagaacaaaagtcaagactgtaccatgctgctctgaagtggccctgaaagcttcaaacccggcatccgtgccccagtgccggtgctcatgaaggcaccagaggccaggctccacatcatcaaggcgtgccccgcatcaggcactagaggagaagcgctccctgtcgtgaggctgctcccaccaggcctccccgcccaccggtatgacggagtaggtgttcagcttggggtggctggtaaagtagtgccgcttcaggtggtcgatgttcacgctcttcctcacctctgcgaaggccacaagggattgcacgggcattaaagagtgactgggctagacatgttggcatgcgccgcggtgcacatacccaacatggcgcgagaaacgaccactcctgctggtctgcggacaccagctgtaataaccaggcccacatgcaagccagggcctggtcatcgctgacacccccacatgagtggagggcttccccctgcccctctgtcaccctcctgccctgcacacacactagacctcgcctgggatctggaagacatcgcgcgtgtggttgcaaaggttggggtactcgtgaatggccttcttgttcgtcttgaagtacacctgcagcggaccgttgcggtgccaagggtaaggaactccacaccatggacaccgcaccctcactccacccagcatgcctgccccatatggcgtctggcctcacggctaggtcccccatccggagagggcccaggctgctcaccacatacacctcgtcgaatcggatgagggtgacgaagaggcggaggtcggcctcggtgaaacgatcgccggccaggtagcgctgcttcgagagcagcgcctcggccttgtcgaggtgctcaaacaggcccctgtgtgccatggtgacatgaggcatagcgcctgatcggcccgtgcctcaagcactgctggacaagccacgcatcccgacacttccctcacgccttgcgctggcctcaacggctgctcgtgcacgggtaggggaccattgaaccgccagcctcccggaactcacctgaaagcctcctcgtacgcctcctggctggtggcaaagccacaccgatacacgccgttgttgatgtaggtgtacacccagtcattcacctagcgccagggtgagagatgagggtgaggagcggcggcgctacaatccaccaggcgccgtcacccggcccggccggcccgtcatcgtgtgtaaccagagtgctgtctcgttcctcccctcaccaacacccgtggaccatggtggtcttgccaagcctccccacctcatcaatcttggcgcgcaggtcctctgggtacagatccagctctggcttggtggcaacatcattaaactgcagggttgtcgggtggaggggcctgacttgtcagccggccagggcaacacacactggacgcccaggcagcctccgcgccgcgcctgcctcccaggttatcagccacccagggtacaccgcgtcgggcgcagtcaccagggtcatgccagggattcgacagcgccctccaccgattctccaacgcaactcaccgccgagttgaagatgcgcaagatttcggaggactcgttgttgacaattgtcttctccttggtgtcccacagaatgggcaccgtgtactttcctgcagccaaaagaattgcaagagggtttggggaactggactggtggcatgggccttgcagcagtgtcgatattggtccaagaggggtaaggctgcctgggtgtacccagctcctgggccccatgcactgggaagcaggccgccccatagtctgggcacacgttccaggcaagccctgtccctgcgtctcgccactctggctgaaggggagcccgcacgcatgccaccaggccatccgtctccacatacagcccagccagcctcaccacccgcgccacatctcaccaaatgtgtcctctgcgagctcatacagctgcctcacattcttggcatggtagtgtgggtcgggcacacagcccgcacagtccacggacccatggccggagacgggggtgaagggggtgtcccccgggctcgcaaaggtccagcccgcatgggtgtcgtcaggagagtcggggcgagtccgctgccaggtggggtgcgtcacgctcaggccgatgctctcctccaggcccttgaggtacaggccagccacgcaccggctggcccaagggcaggccaggctgacatacaggtggtaccgcccagctgcacgagcaggggaagagtgcatcagttgatggggaagggccgcaccgcggagaggcaaggacgcagggccatggcggtcagttgatgaacataggtttctaaacatatcaaaacttctcgcgattgccaacggaacagcgagggctgcgctccctggcatgcatccatcaccgcaggcttcctcggtcatgccccaccttccggctcgaaacgggagcctttggcgacctggttccggaacaccgattcctggcgcttgaacgctcccttgtcacccatctcctccagggcagtgcgagccttggacattgtgcggatgcagcggaggggggtggcgcggggggggaggagcaggttctggcccacgactctcagcatacgaaccacagaccacgtcgttggggaagggtgtccggcacgtttatgattgtactgaattttccattgggagccgggtttgtcttatttggaagattgcatgttgcgatgggaggtgatgcgaggtccgatcaaggatcacccaaaagtgcttaaaaacgcccaccaggcgcgtgaatcccaagattggattcgcggcggtcattcagcacgcgcgattcgaacttgtcggcacacgtatctgtcagggtattcaacgattgcttagcggtcccctgtgatactgaggggagactcgcagcgtcgctgttccacaccgaccaacacccagtccgacctccacggcgaggcgtggactgccgagcgcgttccaaactcagctcacaaatgtcaccaaacatgcttctgagataattctcctcctagggacggatacctcgatgcgggccggctcccctcaaccagcacactaggagggacgaccaaatctccccacaccctggacgccttgcactggcaggcgccgggccctgcatggcctccgggtggggcccggagccctttgagatcctggatggtgggaccaaggaggaggctgccgatgcacgtgccggggaggcagagtttggtgcctctggtgtcaaggcatctgctggaggtgagttgaaaaggagggcacagtggagaaaggggtgaggaaaagtgggggcgcaatgctttttaaatgaccacagacaaggtgttgcatgcttgcgaggtggtcacaggggctgcaggttgtgggtcagcttcccgctgccccaaccgccagccgggctcgctgccccgtggcctcgctccatcacccatcacgctccgctcaccctgcccctgccgacatggacacccaccctccacagataccccactccacatcacaggcccccccccacccccaaccgccgtgtcgcggcgcgaggcggcctacatgatggccatcttctgcctgacggggtgcctgctgtttgcggaccagaacctgatggccccaaacctcaccgccgtggcccgagactttggcttcagccccgaccagcgcgaccgcctgctgggcggcgtggtcgcggccagcttctacctggtgggcgcccccgcggccctgctcttcggctggctctgcgaccgcgtggaccgcaggcgcctgctcttcgccgccgtggtgctgggcgaggcccccgccctgctcaccctggccgtgcgccactactggcagctcctcctcctgcgcgtgctcaccggcatctccctgggcggcgccttccccctcatcttcagcctggtgggggacctgaccaccaccgcccggcgcgccaccgccgcagccgtcatccaggtgtccctgggcgcgggcctggcggtgggccagggcatcgccggcttcgtggggccgtcgctgggctggcgggcgccctttgccatcgtcgcggcgcccacggtcgtgctggcggtgctcatgctgtgcacgacgcgggacccgccgcgcggccgcaccgaggaggcgctggccgaggtctttgaggtgggtgatttgtgatggtattggagctgcgttgggggaaggtgtggcccattctactcatgccagccgattccctcacccacctcccccccatacccaagcacacacacacacataaaccagggcaacccaggcttcgtgtacgacgagcgtatgacatggtccaaggccggcatcctgctgcgcacacccaccaacatctgcgccatcggccaaggcctcttcggctgcatcccctggggcatgctgctcaccttcctcaatgacttcctggcccaggagcgacgcctgagcgtccaggcggccaccacggtcctgctctgcatcggcatcggcggcgccctgggcgtgctggggggcgggctcctgggccagtggatctacaaccgcaggaaggccgccatgcccgtgttcatcggtgagcgcatgcccagaggggttggttgtgggatgcgtgggtggggtgggtgggcgggaggcggccgcaggattcctggcctggcctccggggcagcagtgagggcgggccggtcatcgctggctccatgctgcgtctggctgctggggccgggccaggcctgccgcaccaccccacttggctgtcaggctcaaccacatcgctcccatcatctccccgctccgccgcccccgcgctcaaagctgtctgcccacacccacgccattccccttgcacctcgtcaccgcaacccccactcaacccctcctcaaacaaacacacaggcttgagcaccatgctgggcacgctgcccatgtggtacgtgctcaacggcgacgtcggccggcgctacacggcggcgctggtggcggccctgggcgtgggcttcgccagctccaccatgggtcccaacgcccgggccatgctgctgaacgtgaacgagccggagatgagggggctggccctggcgctgcaaagcatgctggacgacctggggaaaggtgagggggggctgggatgggagaggggaggaggagggggccctcctttgcagcgcgggtctcgtctcaggcgcatacagcgtatgggccaggcagcagcagctgccggcagtgggaggggttgccgggggaatgatactcccacatgtctgggagggtgtcggtcccaaggtgggtttattgctatggttggagacgctatctggggcgacggaaggaccccccgcccccgcctctgacgaccgccgtgagagcatttcccccccttcctgcccaggcctaaaaggtcccatccaccaatacccccccaccctcctctcctctttgcgttgcaggcctgggaccggtgtttgttgcggccctgatctctggcctgggtcgaacggcggcgctgaacgtggcagctgccggctggctgccctgcggcgcgctcatcctgctggccgccttctcggtggagcgagacgaggaggcggtgcaggccaggctgcgccagtcaatcgtccgcatggcagaggaaggtgtgtgggcgtgggtcggggagcaaagtgggccaagaggggtttgaatgcgggggagggagcatgcatggcgaggaggagcaggccctggtcgctaggtgccatgctgtgggatgccaggtggaagcttgggggggatggcagtgtggcagtgagcatgctgatgacaaggacctgctcaaggtatatgaggcccggcaggtggcattgcggatggtttggacgatcacccatcacaaagatttcgtactcgattgacgtcgtgcacgtggtcacccctgctcaccacctacctcaccgtgacagtgggagagcgggagctactcactgctgccgggtctcagcactgatgcagggcagaggctcgccaacatcagttctgcagcaggttgagaccatgcgtgcccaggagactcattgtcttcacttttcgtgtgtgcgtttccccccctctgctcctgcttccaagatgtcggcaaggctgaccggctggccggaaaatctgttacaagttgaagagggccacgagcagtataccactgcccgcctgctcatacatcatctaaaagtacaggccgtgcagcgtcagggggagcagggtgggctcgagcacggtgcgcgtggcaaagtaggccagcgtgcccagcgcgatggagatgggcagcgcgggcagcgccgagtgcgcgaccgagagccagagcagcgtgcaggccagccccgccacgacagcgaggaaggccgcgccggcggccagcgcgctgtgcatgctggcgcgcgccacgagcaccgagtaaaagatgaagtcgcccatgcccaagcggatgccgtcggggagccagacgccatcctcgctcccgcgctctgaggcagcggggtgcggtgatggggcggggcgctgctgggattcggggccggtcgctgtgccccgcagcaggcctgggtggtctgtccgggtccacagcgagatgggaaagggtggtgggccgtccggctggccggaggtgctcgaccggggccgcagcaggcgctctgattccaccgcggggcccggcgaggcgtcgtccggcgcagtctcgcgtccagcctggaccgccagctctgcggggggcgccctggagtcctgactacagtgcgttctgatccaatgacgtggtctggcagagcccacagtccctgcaaagccatgcaagactccctctctttgcctctgccgcgcgagagtcaactcgcaccatgccctccacgcccgcccacctgtctcaccggggacgggcacagggcgggcaggtctggccaggagcgggcctgcttcagcgctccgtgcgcccgccgcctcagcagcacctccggcgggccgggcggagtacaccagggccgggatggggtcgccgctctcgctggccaggtccaccagctccttcagggggccccagggcgccagaactgtgcggaaaatggcgatccaggagggtcagggtgaagggcgaagagcctctgcaccccactcgggagttgcctgtccacatgcaggcacaccagatggtgtcaagtgccccacatgtcgcgactccctttccccctgggagctgtgcaacagaggctgtctttcaatcccatagcctgcacgccctgaacctgcccagtccagccacctgcggcgatgtcatagagggccatggccaccagcagcgtccagctggtccactccgggacaaaggtgaaggtgaaggcggtgcccacccccacggcaatgaggttggcctgcttcagcaggaggggggcggggaagtggaacagggtggccgcccccagcaccgccgtattgtaaaggaggagggtgagggagacccagtcgaagggcagggagaaggcctggagcagctccacgcagatcaggccgttgagcgtgaagaagacgctgaacacggagaagcacatgtacaggaagatccagcgggtgtactgcaggagagggtgggggttggcgggagttgggggaagaggagtattgtatgcttttttgaatctgggcctgcacagtcatgttgcaagcggtggaagctcgcacccctcgcttgacggcagcgaccagcccaaaggtgnnnnnnnnnngatctgggcctgcacagtcatgttgcaagcagtggaagctcgccaagcgcaatcgcaccccccgcttgacggcagcgaccagcccaaaggtggcgatgccgatgaatgcgacgaagataaaggcattcagcaggctgccccggaacttggtccagtcagagtcggtgtcctgtgagcaagcatggggaaggtgatggcctggacatggggaaccaggagtcaacagggcaacaattgggggcagaggcacggcatgccacccgatgcctcgcagccaggacatgttttccctcaagatggtgacgttccccgctcacgtcctcggcgtaggctgcggtggcgatcgacatggcccgggcgttgctctggccgtcggggttcagcactgccacgagccacaccgtgatggcaatgcagatgctgacgggggccacgacagccgtcagctctgaccccaggtcatcgaggacactgggcgccatgcccctcccaggcttgggtgcctggcgccggtgagggggtgtcgggacgagacagggctaccggcctgacgcccggccctgccaggaagtatacctcctgtgcattccctggccagaacaaggatgaaacactgtgtagataatgacgagacctctagtcagtggataggccagccccagtactacactttaggctcgagattcgactgcgcacgagatctcggcaaatgctttgccccaactgtgatgtatgccattggccggcatgactcgcgcctagccaatcatttccaccttccatctagccctagtgtacagcagcaaggtaagaaggggtgcctgggggcactgtcggaggagcctgaccgaccagcaagcgagaaggaggagcagagtggagcgcagcggccgcgaccggcgacccaggatcggtgccggccgcctgccccgcgtcgtgggccggcagcatccggcggcccaggcaatcgcatggcaatgcgtgctgcctgggccgggacccggtctgtgcagctgcagagcctcttccggccgccgactgccgcagacactcagcctttgcacagcgtcctctggccaccagaccgagcccgggcccctcaggcgtgcctcgcggcaaactcccgcatgaagtcggcgagggtctgcacaccctccaggggcatgaagttgtagatggaggcgcgcatgccgcccacggagcggtgccccttgagctgcaccatgcccgcctgggccgcctcggcgatgaaggccttctccaggtcggggctggaggggatggtgaagggcacgttggtcagcgagcgcgcctcgcgcgccactgggctggcgtagaagccgttgctggcctcgacggcgtcgtaaaccagcttggccttctgcggcagccaaaggaggagtaccacgggggcgggtgaggaaagggtggggggcgatgtatgacgaatggggagagccttgatggggcatggatggtgtgaatgtgtgagtcccacgtgagcgtcgcaggcacctcatacacgcctaattcagcaccacaatcgccaggttcctctttgcccttcattgacgcccccccccccctccctccatcagaccttctcgttgttggcctcaaccgcctccaggccgccgttggcaaggacgtgtgcgaacaccaggccgcacatgtagatggaccagcagggcggcgtgttgtacatgctgccgtccttggccgccacggaccagtccagcatggcgggggtggaggcgcgggcccggcccagcaggtcctcgcgtacgatgacgatggtgacgcccgcggggccgatgtttttctgggcgcctggatggggtggggttcagggagaggcgaggtgggaagccttgcggaccgagggttggagagtcaatgagaccgagggttggagagtcgatgagaccgagggttggagagtcgatgagatgagtagaaaggggtgcagcttgagtttgatgatgccgagcgggggcggctgtcgacgatgctccgtgcgcatccnnnnnnnnnntcagtagaaaggggtgcagcttgaatttgatgatgcctagcgggtgcggctgtcgacgatgctccgtgcgcatcctacacttgaaggtgctacccacatcgcatgtcgcagcaccctacactcaccggcgtagatgacaccgtacttggacacatccacggggcgggcgcaaaagttgctgctcatgtcgacgaccaggggggcgtcgcccacgctggggggagcctgggaggatgggagtggtgggaggacagggactagtggcgcgtgttctcggacggctgggctgcggcaggtcggcctcgcaggccattgactggtggctggcggacaaggtacatggcatggcatgagcttgggactggtcatcatgtcggcatggccaagcgccaacgaatgccccttcccacgcaccatgactannnnnnnnnntggcatgagcttgggactggtcgtcatgtcggcatggccgagcgccgacgaatgccccttcccacgcaccatgactaccatccctctcccctcgtcccacatccaagcctctcccatcaccccgccttccccccagccctacaaacagcaccttgaactccacgccgccgatggtctcgttggcgcagtagtgcacgtacttggcgccctcggtcaggttccaggtggaggggtcgggaatgctcttgttgtcgcccgtggccgcggcgttggcctgcaggaagcgcttgccctcgccgatggccttcttggaccaggcccccgtgaccacgtagtccgccttgtcgccctcctccgccaggttcagggggatggcggcgaactgggtggaggccccgccctgcaagaacaggaccttgtagttgtccgggatggagagcaggctgcgcaggtcggcctccgccttgtcggtgatggcgatgaagtccttgccgcgatggctcatctccatcacgctcatccctgtgtgggagggatgaagatcaaggggtgggcgcggctgcaccgaggtctgatggcctggcaagcaggcaggagcaggtgggagactgaaagggcttggttgcctcccgacccgctgtcgcagagtccattcgagacgcttgcgcggatggcgtgacagctgatcacaactccctgctcaaactctaggtatgattatcgcacaataatactctccccggagccacctcacgcaccgctgccctgccagttgaggagatcggcctgggcctgctccagcacggcggctggtaggcaggcagggccagcggagaagttgaatacgcggccatgactttgaagcttgggggcggtagggcgatcggcgctcgccacggcgctggtgctcacctgctcatataggttggtggtaagggagtgtgcagtgcgtcagaataatgccctctgccatgcgcacgcgaaggacagttgaagcagcagcaaaactcgcacccaaccacgctgatattttctcaccgtcctggcagcacggggacggacatggctgggtcgagtcatagaccgggtgcaggaagcacccgcgacggctgcaccagcaatagcagacataatactgtttgcttacaaagttaaggggatattgccttgcaattcagatgcctcaaagccagttgttaaattgcatgcatgagcagcgctgggctatgaaacaacacgtttgctcagctcatggacgaccccgtgctccgtgctacggggcccgcccagcattctcctcccggcgcgcgcagagcgttgcagggccggccgactggactggctgtccgagggcatgagccattcgtacgttatattcgaaactactactacacaagagcgaaagcaaccgattcgtggccgtccgtggagtgctgggctcgtacatgcaagcatgggcttgccaccggtagccaaattcatcaagaagaaggcgaaacatgggaatggtacgatcttcattgtgctagggttttcatttgcggctgttgcgccctgctcgtggctccacagaggggtctcctcgtatcccaggcactcaacacttgcccggttgcccaggccacaccgccgcagaggaggtccctcgcaagctgaagaagcagaaggtcaccaaggaaggtgcgcatcgcgcgtctccattgttccatcgcagcctgagtgtaacatcgcatggtgggtgcaaggagggagcgagattcccgtcactgtcacctcctccttccctgcagacgcgacaccgcaggaggaggccgcggcggtgcctgtggctgatccagagccagccgcacctgcagcaacaaatggaggggagcattccgtgcggccgccccctggcaatgtgtcggggatcatgtcgcagcaggtgcggggaggttggtggggtaggggcgctggtcagccaaggacttgggcgcccgacactgaagcgaatcctcaggaatccagtcgttcgccaatgctccactttcccgtggcccccgcgcctccactcgcctcttcactcccctcnnnnnnnnnntgagtcgttcgccaatgctccactttcctgtggccctcgcgcctccactcgcctcttcactcccctcgtcatcagacctttgactcgctggaggtttcggatcagaccaagaaggccattgccagcatggggttcacatacatgacggaggtccaggcccggactatcccgcccctcctcctggggaaggatgtcctgggtgccgccaagactggtgagactgaggtcggggggcaccctcttgaggatttccaggcaggcaaacggcgctgggttgtcgtgctgtcagccctggggaagttctctgagattctccagcatgcttatctgctgacctgcctggcctgcaggccgccctgcagctgcgttggtcggannnnnnnnnntgccctgcgaaatttctctgagattctccagcatgcttttctgctgacctgcctggccagcaggccgccctgcagctgcgttggtcggatttggggctagggtagtctttcccactccctgaaggtgcaagactgcaccctgcgtgcagctgattgggttcaaggggcgcaccatgcactcactcccccacccgaagactctgatcacccatcaccattccccgcacaggctccggcaagacgctcgcctttctgatcccggcgctggagctgctgtaccgcgccaagttcatgccacgcaacggcacgggcgtgctggtcatctcccccacgcgcgagctggcgctgcagatctacaacgtggcggtggacctcatgatgggccactcccagacccacggcctggtgatgggcgggggcaaccgccgggccgaggctgagcgcctgaccaagggcgtgagcctgctggtggccacgccggggcgcctgctggaccacctgcagaacaccaaggggttcctggtgcgcaacctggcctgcctggtcatcgacgaggccgaccgcatcctggaggtggggtttgaggaggagatgcgccagatcatgaagctgctgccgcgggagcgccagacggccctcttctccgccacgcagaccaccaaggtgtggttgtgtcccctgtcggggggaacgagcaggtgttcagggggtcaggggaaagaacccactcatgggccgggggatggtggtggtggggggggggggggcnnnnnnnnnnctccagcaacattctcaattcgactcttgaccccccacaaccccccccactaccatctccttcctcaggtggaggacctggcgaggnnnnnnnnnngaggtgttcggggggtcaggggaaggaacccactcatggaccgggggatggtggggggggttggggtcgaacagttttgtgaacatgcatcttgcaaggtatctcaaggcccaaaagaagtgggattctgaggcccagcatcgcacaagcagggcactgccagcaacattctcaattcgactcttgacgccccacaaccccccctccccaccacctccttcctcaggtggaggacctggcgaggctgtcctttaagaacaagccggtgtacattgcagtggatgaggccaacaccacggccacgcgggaaggcctggagcaggcatgcagggcgggggaccgggggctaagcagttcaatcactggaatgtcatgtcggtcgtcctgccaggggccatgctgtgctgcttcagtcgagttgtagggcgtgctgatgtcctcactccaggcacggctcgtattcccggcgcagggctactgtgtcgtgcctggggacaagcgcttcctcctcctcttcacattcctcaagcgaaacaccagcaagaaggtaggatgagcaatggctggtacttggcttgtgcggaggaggggnnnnnnnnnnattgtagggcgtgctgatgtcctcactcctggcacgactcgtgttcccggcgcagggctactgtgtcgtgcctnnnnnnnnnnatccacttgacagagtctccagtgcgcatcgaggactgacatggtgaggagacgatcatgacgccccccccattcctttgccccacaggtcatggtctnnnnnnnnnngtccacttgacagagtctccagcgcgcatcgaggactgacatggtggggagacgatcatgacgccccacccattcctttgccccacaggtcatggtcttctgctcctcctgcaatgccgtcaagtactactccgacctgctcaactacatcgatatcccggtgaacgccatccacggcaagcaaaagcaggccaagcggaccgccaccttttttgagttctgccaggtgtgtggaaatttgggttggctgggagagcatcagtgggacctgcgtgaagagggaggccagttgttgcgctgtgaccaacatacccagcgacccattgccatcgccaggccaccaccggcatcctgctgtgcacggatgtcgcggcgcgcggcctggacatccccgccgtggactggatcatccagttcgacccgccggacgaccccagggagtacatccaccgcgtcggacggtgagaggcttgggtggagagggaggggctgaagagagggggagggacgcccattctggttgcgcctggggggctgacctctctggctcatggcgcagggcctgctgaggaaagtaacccacatttattcaccttgctgagcctcccagttaagaacttgcatgatctccacaggacggcgcgggggaggagcgggaagggcaaggcgctcctcatgctgctgcccgaggaactcaagttcctgcagtacctcaaggtgagccaaaccagcgttacttcaccgaaaagctggcagtgcagggcactgcatggggtccctcaaaggtctgggatgtacagtgtcgtggggtacaggcaggagctgcttgtgcatgctgcttcccactcgcatgacctgccctcaaccatcctcaccccccctgagttcaggccgccaaggtgccgctggcagagtacgactttccagtgtccaagctggccaacgtccagacgcagctggagaacctggtgtcgaagaactacttcctgcaccaagccgctaaggaggccttcaggtagggctgcgcagctgagtgcggtccatacgcgttgtgcatggttgcagggtggattcctgggcgacgtatgctcaagtggtttcagccatcatgcatccaccaaacactttcctggctgagaccaaccttgtgcacaacccggcatcctcaatcacacggtgcaggtcgtacattctggcctacaactcccaccaactcaaggaggtgttcaatgtccacgctctggatctgaaggcggtggcacgtagctttggattcgagacacccccaaaggtgtgctgtgggggttaattcaggcaccactggactgcaggagcccgctgagtaatgctgtactccacgcatgcatggctccctggcatcgcacaagaggcactccacggctccacgcctccacatctatacacgccaatgctccctccaggtgaacatcaatctcgagagcaagnnnnnnnnnntgcacaggagggcactccatggctccacgccttcacatctttgcacaccaatgctcactccaggtgaacatcaatctcgagagcaaggcggcacactcgcggaaatcgaggaacgcggtctaccaaaagccgcgaacgcattactagcgtcaccatgaccctcctttgcctttgcctgctcccccacatgggtgtagtacggattgaccaggttgtccttgtatggaagggaaccataccnnnnnnnnnnnnnnnnnnnnnnnnnnnnnnnnnnttggagtatattgctgaacagccctcctctgcaggatggcgggaacctgacagcgcgccagcatgcnnnnnnnnnnacacactgcttatagccactaaaatggagtacaaggcatggcaagggcaccgaaagggcaactcctggagtatattgctgaacagccattctctgcaggttggcgggaacctgacagcgcgccagcatgcgtccgaatatttgaaattcctctcgaccaacccgtgtgcacctctcaagatcggaggcatgcggcaagagagccggccctctcacctgaggagaacttggcatctagaatattcaatacgatcatggccagcgatggggagcaaagcctcacaggtgaggccgctgccgtcgtaccaggcacatcccggacgtgtgcagcgacatcccctggagtggatgccggtcactatctgcatcttcccacccactgccattcaaaccactgcaggcacacttgggacgcacaatggtgccgggagcgtcatgggcgccccctcacctcgaccagccaacagtctgtcgcagatgaccccaggagcttcgcagcaacatgggggatactccacacagcctacccccgtgggaagagcggatctgggctactacatcggtcaccgtcccaacactgtctctgggacagggcgaggttcggtgctcgcgccctcggtacgtgtttggtgtcagaggggcatggcgagttgaacacgagggccgggttcgccaggtcccaatgggttactgctggtgacggccgcgccataaaagacaggctcgagcatcgaacacctctaattaatcaattggttgctctcctctcaggaatcctttgctgccatggaggatgcagagggcgacgctgatgccaccttcatctggggcaccaacctctcagtgagcagggtgcagtcccgcttcacatccttcatcaagaccttccgcctccctgaagagttcgaccccaagtacctgcagctgctccaggaggtggggtgcacgggacaggctccaggcaattggagcttgcatcgggtttggcggggtgcctgggagctgagcccctcggcagctggccagggaagatgtggagactgattttgtgctgacaagtgcatgtaggtggaacatgttcagtgcgactatgtttcttgaaagatgatttatttctttccccctatcaatgtgccaccttgccctcctttcccatacagacacgtgagcggggcgaggtgtccttcaacatcgacggacaccacatgcacgatttcgatcgcaccctctacatgtgggccatcacctacccagctgaaactggtgagcctgtctcccgggcacacgcatgcgtaatcattggacacacttgcaggatgctggacagtgcagtacttgctggctgggactgagcgtactgaacgagtgtcgaggctgagagagacataagtcgacatcctactccttgtgcgccccaatgtcagtctccaagtacggcgtcgccgcggtcagctccctccgtgcccccccccctccctcctgtccacagttcccatctttgacggtcagctgtcggccatcgccgctgagctggaggggacagaccctgaagagatccaagtgcaggtgggttccgggttgggagctcctgataccttcccctcagcagcagcatgttgatgctcaaggtcccatcatgctcctctcccccctgccgccaccatgctcaccctgcaggcacgcatctacaacctgctggagatcaaggtgatcagggacttgaacccctcggacatcaaccgcatgatcgccgtgagcggcatggtcacccgcaccagcggcgtcatcccggaccagaggtgtgatgaggagggtggggggggcgggggggtccgggagctcagagtggagctgtgtgacaggaaacgggcagtgcctatcgagtcagatgcataccagagaggctgccggtggttggttccagcaagcgcggcgatctcgtgcattcatgccatgccagggtccttgcatcacattccacatcccccatgcggagccgcaaaccaatcccctccctggtcctactttgcagcctggccctgttccgctgcatgcagtnnnnnnnnnnctcatgccatgccagggtcctcgcatcacattccacataccccatgcggagccgcaaaccacccccctccctgccccctacttcgcagcctggccctgttccgctgcatgcagtgcgggcacgaggtggtggagtggaacgataggggcaaggtgaacgagccctccacctgccccagcccctcctgccaggtgcgggcaggggtgtgtgttgcctggggactggagtgggccgagcgggaatgcccagggggaatgggagtgggagcccgcctgggcctgggcccggcactagggagcacagactgcactcaaggtggcagtggcatggacgtcgttcacccctacaccatgccctgccacaccctccacatgcaatcctcccaccaccacccatcctgcgctgcaggcgcggtacagcatgcagatgctgtacaaccgctcctgcttcctggacaagcagctgatgaagatgcaggagaaccccaacgacatcccggagggcgagacgccgcacaccgtcaccatgttttcacgccaggcacgcttgcagagggcgggagggaggcgtcagggacctgatgttcggcctgcatgcacgtctgcgtgaccgtcgctggtgctgggggggtgtgcacgaggctgagcctcccaccggggaggaccactgggtcatggaaagggctcctggaacctgctggaacctccaactcagtagactcggccatgggccccctcatcacacaggatctggtggacctggccaagccgggcgaccgcatcaccgtcaccggcgtgtatcgagctgcaggcgtacgcgtgaacccccgcctgcgcgaaaccaaggcgagtggaaggggaccgggggggaaagggcgttttcaggaggcgcgtcgcttgagatgttgggtcggggggtgctcctcggtagtggtgatggatcagactggggccttgctgcctcccaatcacgtggctgccttgccaaatgttcacagaaacatgctccacccttcctcatctgcccacaggctgtgtacaagacctacctggacgtggtccacgtggagaagaacgagtcgacctccctcttctccctctccgacacgctggccgccgaggagggcgaggtgaggcccctgtgcgtgtggggggggtggggacaggaggcttggagaaggccaggctgtgcatggggtccaggcatttgttcatgtgactgttgcccaagcttccctcctttcttacagcaggcaaacccagcctcaccccctcacgccaccccgctcccaggagctgcccgctcacctgacggcggcggccaaggccggcgacgcccagaacaacggggtgcgcaccaacaacgtgacgggggaggagatggcggagaagaggacgcagctgcaggccatcgccgccgacccggatgtgtacgagaagctggcggcctcgctggcgccctccatctggcagctggacgacgtgaagaagggcctcctctgccagctgtttggtggggtgtccaaggtgagggcttgtctttgtgggggtggaggggcgggtgctctggatgcgaggacagtcttgtgaggagtcgtacaagcagagcgcgttgctgcttgatcgacctgcgcctcagagacggggggtagggccaatcttgccattggattgccctgtccctgtgctctgtagggccggaaccccagatccctgacctcatcatccctccacaccctcaaatacacacacacagaccctgcccggtgtcaagacgcgtggggagatcaatgtgctgctcgtgggagacccgggagtgtccaagtcccaaatcctaaggtattggatggtggggttgctgggagggacaacggtgggacaggctgtgctgagctgatggtgtggcttgtgccctctccaatgcagccagaacccgcccgctatgcctggcagagtcttgcaggcaggtatccccgagcggtcaattccagccaggatcgagcagttgcccaccaatctcctcactcacccgctacccgaccgacagctnnnnnnnnnnactatgcctggcagaggcttgcaggcaggtatccctgagcggtcgattccagccagtatcgagcagttgcccaccaatcccctcactcacccgctacccgaccgacagctatgtgcacaagcttgcgccaaggggaatctacacctccggcaagggatcctcggcagtgggattgacagcctacgttacgcgggtgagggtgggggggttgagggaacctgtcggatggcgggacatgaaggtgatggcagaggcaacttgctggcctgtgaggctggaggatgatcgctggcccatcgtatggctgatcgggatttccatctccttccgtattggtattctttgtgcacatgtgcggccttccttccaacatggtcaggtcttttggacacccatcctcagatgnnnnnnnnnnaatcgggatttccatttccttccgtattggtattctttgtgcacatatgcggccttccttccgacatgatcaggtcttttggacacccatcctcagatggatgtcaaatcctcagtcctcatcctccaccttcaccaatcctcacccaggaccccgagaccaaggaaatggtgctggagagcggagccctggtgctctcagatcgcggcatctgctgcatcgatgagtttgacaagatgtccgaggcggcacgcagcatggtgaggggggaggatggaagatagatatctgaggagcatgatgcgaggctgtggctgtaattcgtgcaagactgtgaggaggtccacctctcaagcgcagcgctcctggtggccaactgtgnnnnnnnnnnagtagatacctgaggagcatgatacgaggctgtggctgtcattcgtgcaagactgtgaggaggtccaccttgcaagcgcagcgctcctggtggccaactgtgttctgagaatcgaaaccagccatcatcatccgccagggtgtaaaggggtctaagcttgccagctcacattcccctgtcctcctcccctgaatcctgcccacagttgcatgaggtcatggagcagcagaccatctcggtcgcaaaagccggcatcattgccaccctgaatgcccggacttctggtgagctgacagcccagaatgcctcatcgaaacctgagatcgagttttgtcacgcggaaacctttacatgcgtgactcaaggtggatgatcagtcttcttcccacctccactccacctccattccccgtcccctgtacagtgctggccagcgccaaccccgtcggctcccggtacaacccccagctgagcgtggtggagaacatccagctccccccttccctcatgtcccgcttcgacctcatctacctgctgctggacaagcccaacgaggcatctgaccggaagctggccaaacacctggtctccctgttcggggacaggtccaacctggaggccaagaaggtggggcggcagtgcctggacgagggtcttggtttgcgcggtgcagtggaagcctgagcctgtgtgacagcggtgcttggatcaatgccatggggattcatgccgacatgcgcgtggcgtacttggctttggaacaaggcggatgctgggatggtcaccttggcccccaagtctcaccttttccacgtcaatgcaagacctccacacacttccctgctgcccaacaggccccgattgccgccgaactgctcaaggaatacatcgcctttgcgcgcgccacctgccacccggccctgtcctccgaggcggccgaggccctggcgacatcgtacgccgagatgcggagcatgggcatgagccggaaggtgtgtgagataggcatgccagggcttcgttgtttgggggggggaggggagtgaactggaaggggggacatgcccgcatgtaggatgtggtgcgtgcagcgtcgagggagactgccgcccaaaaatcatgcgaggcggcgagccaggggcactggatcttacatacaggcgtgcatgcnnnnnnnnnnaggggggtgaactggaaggggggatgtggtgcgtgcagcgtcgagggagacnnnnnnnnnnnnnnnaccgtgcaagcaggatcataacaccagcatgtcctgccaccctgcaaacatccacgccagccaccatcaacagccgccaaaccagaagctcacaacctcctcccccaccccaccccaccccacccccgnnnnnnnnnnnnnnnnnnnnnnnnnttgcagacggtgagtgccacgccgcgccagctggagtccctgatccggctgtcggagtcgctggcacgcatgcgcctggcggccacggtgacggtggacgacgtgacggaagcggtgcgcctgatgaaggtggcgatgcagcagagctccatcgacccgcgcacggggcagatcgacatggacgtcatccagaccggggtgtcggccgcggagcgcggcatgaaggcccggctgtccggcgaggtccgcgccctgctccaggcgcggcttggtggccagggcatgcgcctggcagagctgctggaaggcatgaacgcgcaggccagcgtccacgtcagcgagcgcgatctgcgcctggccctgtccgagctggaggaggactaccgcctggccgccggggtcatcaccgcgcggacctgacaagggattttgggggggggatgtgccagaccctgggcacggctctttcctccattggatctaagtctcagaagttccacctacccacccatccattaagaccctctgcttgaccagcctgacccatttccgagagggtatgtacatcacgatgacacgagaacaagagcacagagctagaaatgaagctggcattccacactgtccatnnnnnnnnnnggagggtgtgtacatcacgatgacacgagaacaagggcacagagctggaaatgaagctggcattccacactgtccatcagcttcccggcaggtcctgctgccgcacacgctgcaggacgacggcctgggagtccaggcgcgcgtagagcgggcccagtgagtcgcggcacagctcgccgccctccacgtcctgggtccagtatctgtatgtgtgtgtgcgttttgggggaagaggggtgagggaagtggcaaggagggtcagcggcagtgtccaccagcgggtatagcagagtgggtggggggcggtggggcggaggggcttgcaatcgcctctgttgtgagggcacccaactcatactcaaccatgtttccctctttccnnnnnnnnnngggagggtcagcggcggtgtctgccagcgggtatagcagagtgggtggggagcggtggggcggaggggcttgcaaccgcctctgttgtgcgggcacccgactcatactcaaccatgtttccctctttccacctcagccgtcgcgcacgtgtaggtggagtggatggtgatgcgggaggtgggcatgacgaagatgccctcgtgcctggtctccaccccctccagcgccgtcagcgtgtcccacccctcggtcacctcactggcgtggacgggggcggtattggggcattgaggagtgagcgacttggcgggtctggccaggggagccaaggtgcttggcacacccatggcacgaaataatgacatagcccacccaggctcgtcctccatgccggggcgcacccaaacacggtgtactgcatgtccaggtggggggctgggccaagcaggattgagaaggaggagcccccagactcggggtcgctgtgcctcgccaacgaaagcacgccgcgcttgtcgtgcttcaccgcgggagtgacctccaggggcacgtgctttgctgccagatcctgttggggggggggggggggggggggggnnnnnnnnnntaggggcacgtgctttgctgccagatcctgtccgggaggggtggtgcagtgtgtggttgtattttaggaaacatgtccatggtcacagtgcaggagcacatgtgtcaccacacaaaccgcattgccaggtggcttgacggacacaccccacactctcatcaccgcgtctgccgtcccacactcaagaagcttcccaccctctgacgccagtccatggctgccaggcggccgccggccacatccgcagtctgcgccacgaagcccttatccacgcggaagaaatggttggtgttgtatgctccagcctccatgagactgtatatgaggtcgacggtcttgggtgcgacctgaggggtgcagggcaagctgataaggaggggcctctggcaatcatgtgaggagagactccagggagtaggtcagcaagcaccccactccagccgggaggaggagagcggggcatctgcagaaacccacgttggcatagaaggccatgtggatgtctccatggtccgtctggaacacggctctaaagttactcaggtctggcccggccactgccacggcgaggcaggccataatgacgaggctcccggtccagcccttcgacatcattgtgtatgggcacgcagcgagagtcttttgcttctccagctactacgatattgtagtggtggagggagcacagggacaatgttgtgcagggtttcaacttttggttccggggcgcgcgcgatcgctcgcatcgcatgaaaaccagcccagaaaactcaggtaccctgacactttgcgatgcagagcgaccaggtttcgatgaacctgcttcgcaaatcgtatctgattgagatgcttagaccggctgagggcgatgtcacagagggatgagaccattaggttgcctccagaggacacacacccggcagacggcnnnnnnnnnntctgtttcgcaaatcgtgtctgattgagatgcttagaccgactgagggtgatgtcgcagagggatgagaccatcaggttacctccagaggacacacacccggcagacggcaagcattgaacaggagagtcagccatgtcgcagccttcggacgtcgaagattttcatggagaagagagcgatcgggaactcgagtcgactgggtgagaattggcgcttttgcatcgaagagggttcggttcgagctgcttgtggtcgtcagttgccctgatctcagcgcatctgtacaagccactgacatacaagcactgttccttattttctgatcctccaccgcgtcccaatcctatacccatgcatccaaatctaggactgccctggagaaggcgcataaattcgcccatcatggcttcatggacactaccagggcgagtttggtccgactgacagcatggtgactgcatgcatcccccatgttcctcactccttcccagcagcaagaatgaaatcctttgcaggaacgaaagtatcatgctgcagnnnnnnnnnngttttctgatccttcaccgcgtcccaatcctatacccatgcatctaaatctaggactgccctggagaaggcgcatnnnnnnnnnntagcatggtgactgcatgcatcccccatgctcctcgctccttcccagcagcaagaataaaatgctttgcaggaacgaaagtatcatgctgcagtcgtgtcaggcttgtcccgggccctgtccgagagtgggtgcagcaaggatatcgtggcgtccttcttggccacagtcctgacctccgaggtggggggaatgctgccctgtgtgacatggaagtttcagatcctttgtgccatgcaaaactggttccctgcacagtgacctcctgannnnnnnnnnaagtgggtgcagcaaggacaccgtggcgtccttcttggccacagtactgacctccgaggtgggcggaatgctgccctgtatgacatggaagtttcagaacctttgtgacatgcaaactggttccctgcacagtgacctcctgattggacaccctcgatcacatttcagaattaggggtgcagtgctcccaagtataccatcacctactgcgggccccctgtgcaccgcccattcccttgctccctgcttgcagtaccatgagagcatggacaagaaatggcagtttgcacatccagcactccatgcccgatatgcagaagccctggatgcgggtgggcagagggagagggtgttgggacgtatgtggagggcctattctcgacctcctcagctgactaggcacgtgacccagctcccccctcaagagcacaaatccaggggattgcttaccccaaagcagaggattatatcctccttgcagtcccgcttaggctgagaccttctccacatatcacgttggcatcatcttgtccccttaccctcgcgtccgtccagggtataatctgttgagctcgggccaggagcacgccacactggatcagcgcaagcgcttcctgcggcgcgcccagagctaccacccggcgaaggacgatcgggccagggtattcttgagactggcccggcttctcctcgagcatgtgagggcaagaaggtcttgttgtaggcgtgtgtggcttggaaaccccgttttcccgacctctgcaaccacggctacccacaccacgccatgcctcctgtgacagggcggcgcagcagaggcctacgacctcctcaccagtggggatcgcctgctggagagggacagtgccaggcaggaggttgcgagcctgtgcggtcgcatccgccatcagcagtggactggggtgagtgtcatttggaggggtcagcgggaggtggtggtctgtactagacctgtcaccctgggggagcagcatgcgtgccttgaaagtctgcaggccgcagcctcctggggtacctgcgatgtggtctccaccatctacctcccccgccaccccgatctcccaggcgatggcggatgcatggagcaggggacgcggtgtgtccaccaggacccgggaagagtgggaccctgtgaggaacgaccctgcgctggtggctctggcaggacggctggcaagggagctggcgacggagggagaggcgcacctgacggtacgaccgggaatcgagtaccgggggctggtctgtgcgtgagttgtggtgttcaacgccctgacatgggttggcagtgtcaagcatgcaaacccgtgcgtctggccccttgatccacagacagccctgacaagcggccctgcaagttcggcggccgcctggccgctcatggagattctcttgacacagggacagatgttcagtgagtgatagcatgagaggatggtgtgggaaggcagggcgcccacgtgttgcattgcttgcgcagaggagaggatggcgcagaggtggaaagggtgcatgggttccagcagacccctgggacgacctgaccgtcgaccgatcatctgtacctgggaccgctcatcgcacaacaacaagcccccctggggcaccgattccggctcaacctccgtttggctgcgctgcttgagcacttcccacccctgcctcgctctcctccccttcctccctgtccagnnnnnnnnnntcccctggggcaccgattccggctcaagctccgtttgattgcgctgcttgaccacttcccacccctgtctcgctctcctccccttcctccctgtccagaggcgaggtccatcgcctcccgccttcccgaagccgatgctgacgctgcagccctgcgagccctgcttgccttccccacccccgacaccaaggcagccgaggagggctttgatgcagaggaagtcgtacgcaacctagtccagatcctccgctcctggcctgggaacgctgaggcagcttcaggtgatgcctgggcagggtgggtggtggattacatggtgcagggtgctccctgcgaggacctctgcgtggaagaaacttccggattgcacatcaggtagatgagcagattccagcgctgggctgatctgctggagcgcactccggcctcccctgtgctccgctcttcatcgctggatgcattccacatgtcagccactgtcctgcagatctatcgctttaaatgtcctccccccatccatcccatgctgcagcgcttctgaccctgcacgcgatgcagggccctgtggtcggcctggcgcagggtctctgcctctggctcgacgtcgtggggcaccccgacctgggcgccgcgccgccggacctggtgacgcgaggtgccccggccggttttggaggtggttggcgttgccctacgcctcggcgcttgcaccgccggactcgcttggccaacagaacgcatgtgacaggcgcggccggagagcgctgcatactgctcatcaccnnnnnnnnnntgccggactcgcttagccaacagaacgcatgacaggcgcagccggagagcgctgcatactgctcatcacctggcccctcctccatccttcctcccactgcaggctggctgggcttggccacctgcctggtgcaggtcgggcagggcctgtgcgaagcgcacgctcagcgtctcgaggccggcagcggccactcacaggggggcgccccgcaggccgacacaggcgccagctttctcgccctccagggggcggtggcggcttggcaggagtgccgcgccgcgctggacgacaggggttggtggctggacgcccacctgaccaggtcgtcccttggcgagccctgccgggcagaggcggggggttgggtgcccggcgcactcctcgtcctgaaagtgttgctgaggggagaaagcgtgaatagctcgccgtgagtagtagcggtttggagtggcagtatgggatggaactcgcagctggcttggcaagggagcagatttgagactctgctgggtgggtcttgcccagcgtccttgggactgtgctcgtgtcgtgtggctgagcctggctcatgcatcactccctttcccatccaatgcatcaccctcaaacgtcgagcatgatgcgtgactttttccacacagcccttgcatactccgcacaaggcagctgcccatctccctgggacacaacctgtcacttgcctgtagcaccggcaatccctcgcaggccgtctagccnnnnnnnnnntgcacaaggcagctgcccgtctccccgtgacacaacctgtcacttgcctgtaacaccggcaatccctcgcaggccgtctagccgcacaaggctcgggattcaggatctggagaccctgctgctggaacacattgatgtcaaaatgcggctaggccttagggttgacctggccaccgtgtctcaggccatcaggtgcgaggggtgttgacagcgtgctatggagggcaatcactgagccgctcgggtggcggcctgcagcctgaatcaccctggtaggacggcggaagaatcatgacaggcaccaggtagcaacgcatcaggtgcaatgcttcccaagatcgaaaatcctcgacgtcctcgacagtgtggatgaggagtggcgggagctgcagagccgccagtggcaggaattcagcaaagggttgtcctggtgacctggcactggcatgtggcgagcgcatcaagccgggccggcccgcactgagcggacaaactccacaaacgccgtaaagcctgccgcttgtagaggggcagacaaggtaataccgtgacacaacactcgatagattgagcatgcttgatccttnnnnnnnnnngagccgggccggcccgcactgagcggacaacaaactccacagtcgccatcaagcctgccacttggagaggggcagactaggtaataccgtgacacagcactcgatagattgagcatgcttgatcctttctccccttgtggcatgttgctcgccctggaaacctttcagcatgatgcacagcatccctggatgtgcgagtgcatgccgcgttcaggagaatcaccaactgggaatggtcgcaccagactgcacatgagccacccatgtcaaggtcatcatgtgtacccagactgcatcttgagtggctgccaccaggacacgtgtgtcgcaacggctccctgatctcagtcctccatgaggaaatcgaatcgggtcctgaacgtgcccttcattcgctctgcctccttgtcagctttctgtatcctccgaatctctgcctcaggcacctggtggcgggtgggaccagtggcataagtatcaggatggcaagcctgcttgatcccactcctgtcttaccctatccctgccaataatttaacatctatctccaagcgcgcctgcccttcagcctaccagggagaggccggggggagggtccagggagggatcgatgtcgcccaggagaacgacgttctcccccctgacaatgtgcaggcccatgtccacttcagcatactggctccccactacgatgcgctcctttgtgcctgaagtgtattgcaggtctggtggattaggacaagataggcagtacctctggtaggacagctgctgccgccataatcctcactgctcataggcacaggctcatgcacatcaagacgcatactggctgcctccctccaaattctgttagatccgacccccccgaccttctagtacgaggttggcatactgatcgaaggagcgtagtgttcccaatagttttctgccatcgcgtagctgcacgaggagaggcttgtccagctctagcaccaaggccagtcccgggggagggacgtcatcgatattcggcggtaggatgaggggtgggtccatgatcgggaaaaagctccacgcccctcctgctatgtggcttgaggccggttggggccggaggactagccctggcgtgctaccatgctcagcgatcccctctcacaaaactgcagcttcaaacaagtctttgggatggtatcgtaagcatggacatgagttagacattgcatcatgcgtggacgttgggccatcccctcgtcccgtcgcgcgcgctggtctctctgtttcgtcgtcaagcaggaccagaagaatctggtgagccacaggaaaagcggtgcgacatacctcgactccagtcatagtatatcatcaaaaggcccaaaaattgttagatcgagtctgatcgcttaacccagcgcttgagaggtggagcgtaacgcgtctcaacctttggtggcattcgcaaagattgcttctgagcgtgcacgccatggcggactcccggttgtgtaccatcctactcgtggtggcatgcctgttgcacctgggcaatgcatctcgtccccacatggagcatgcattgcgtgagcacgatgacgttcctgccctcacatccgcaccatggttttgccatgacatcgactgccccaagtacacggtcgtgaacacgtccacggattacgaggtgggtgatgggccacagacagttgcggggcattttcaccgtgaggcgctgccctgggattccaggccggtgtgccggtgcatgcacccttgggacaggctctcgggccaacagatccctcgcccgccgtcgcacaatgctgatcgcgtcggtgttttctccactcttgcaggtccggcactacaaagcatgtaggtgtcaaagatgattcatggcgtgtctcgcttgtcactgtatggaatgatgtctgcattgagagcagcaagggcgctctcttagacatgcggcactgataccagccgcaagacgctttggcctcaagtatcaatccgcgcacccctctccgacacccagcaacctgggcatccactgatgtccaagcctatgcgactgccctggcttcgaccgtcggcttcaaggtatagtctgtggcctgggtgcaagcctctggagattcatggaaccctgcattttcgtgctgagtaaccagccatgcacatcatctcatacctcctgcccacggccgtcacttgcccaatgccgaacagcgcctgtatgcctacattgggggggccaatgaggaggaggtcaagatccccatgacatcccctgttcgtgtggaagtggaggccgcggccggaccattctgcaagaacaatttcaccgtgtccttctttgtgcccttctcctacgaggtgacctaggctgaggtggtttgaagggaaggatatagcttgtcactttcttgtttcagtgagactgagttggaggtacaacctatcaaggtcaactcactgactccacactgctatagaaagcaagatacagatgtcgagcnnnnnnnnnncttcttgtttcagtgagactgagttggagttacaacccatcaaggtcaactcactgactccacaccgctatagaaagcaagatacagatgtcgagctcatgtactgttcgccctccaggttgggaaccattgcagctagcctgtgcattcccaccttgacccatttacacacaggggaaaccgccggcacccaattccacggatgtctacattcaacatgtgagctggggtttgtgaagtgagttgcagcgtcaattctcgtagtaactattcgcacgataggtcctaccaggtgctcgggagtccagtttcaccagccaggcctctgatgtttgcctatgtttctaatgcctcagccttccctctgcacccacaggttcctgccttcacggcatatgtgtcccagttcggggggtactacatggatgactggtccatctccaagaaggcaattgccctgctcgaggtaccaggggtagccagctcactgaggtgttttgcatggatgcagggagactccataggattttcatgagccggtgtggatgtggatgaatcaacctgagctgaggtcatgcaacagaactcaccatgctatcacatgccactcaacatcccgcccgcaggccatccagcgtgatcatggcgcggtggagggtgatgggtacacctttgcagggtatgaccctcctttcagggtgagtgtgggcgtggatgcccagggagcagcggatgggagggcaggggttctatgtgagggttcatagtgtaatggcttcaggcgggacctgcgtgtgacctcgggctgaaggcatcacagcccccttgctccccctcccacgtcatggcagctgcaaaaccgccataatgagatctggatcagagccgctgagcaagtctgagacatgggcagcagccaccctctgtcccagaggagctgctggtgaatgaccaggatgtttgattgcaggcttgagcccatttctggacttctctgcatttgttctcttggaagagcagaggtctatcgtccttttgcagccttctgtaccccagccacgctatttgtaaaaagctttttgaggtcttgtgagaatgttggcaaggtatcatggacacccagcaagtggggcgcaaaaactgatgtagacatttaccaagctctgagactctcacaagatgatgatgaagagcacggcgcagcgcgcgcgaaagtaggggtgtgagacccacgatctggcaagcagttgcccttgcttccattgcattgtactttattcactgaataacacagtggacgttgccactcccgttccctgccagccaacgcccacacccacaccggttccctgaaactcctttccgctcatttcacctcgtcgaccaccacaatctcattcgaggtcgaatcagaaactcaactctttacatctgacactgttgcactggatgnnnnnnnnnncgagttgcagcgtcacttctcgtagtaactgttcgcacgatagatcctaccatgtgctcgggagtccagtttcaccagccaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtcatgagccggtgtgggtgtggacgagtcatcctgagctgaggtcatgcaacagagctcaccgtggtatcacatgccactcaacttcccgcccgcaggccatccagcgtgatcatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgagacacgggcagcagccaccctctatctcagaggagctgctggtgaatgaccaagatgtttgattgcagggcttgagcccctttctcgacttctctgcatttgttcccttggaagagcagaggtctatcgtccttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaggtgtgagacctacgatctgccaagcagttgcccttcaatgcttccattgcattgtactttattcactgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacaccggtcccctgaaactcctttccgctcgtttcacctcgtcgaccaccaccatctcattcgaggtcgaatcagaaactcaagtctttacatctgacactgttgcactggatgcttaaggcccggcacgcctgcaccagccgcttgccatcaggtgtggtccccctgctccacagaagtctgtccaccatgagcccatcatggacgcccatcacagaccgcggccccagattccggcaatacgttcgagcaagggtgggcattgatgggtcagccctgctgttcggggttcaatcagctgagccagccgtcgaggccctgggaggtgtgatgacgtcctccagctcctccacctccctttgaatcccagcaaatcgtcctggggcccatgaaggcgtccatcccagaggatcgcctgcgcatcctctcctacaacatcctggcagagtcgctggcgcatgagtttggggcccacctgtatcgcggcacctccgcacatgaactggcatgggacaggagatgcgccgccttcctgaagtgaggaggagagatgctggcagggagcctggtttgaatggtggtctggcccacgggcggccgtgccacagaggagtgtgcgtccccctgtcacctcccgcccccaccccgccaccttccccccttcagggagatcgaggcacactccccagatgtgctctgcctgcaggaggtcgatcacttcacccagctgaagcgcgagctggctgctcgcgggtaggcagggaaggagtgctgggccagggcccacactacgcgtctgagatcccggagaggaagtgatcgtctcagcaccaccttcagagcacagatgtgtggcattccagcctctgggcctccacttccagtcgcctgtcgcgtgcaccagacgccaacccagcttcccacccttgcaccctggcccctccgcccaggtaccagggtcgttacttgaagcgaacaggcgcacgggtggatggactcgccattttctggaggacggcgcgtctgcgccaaggtgagcctctgcgtgggggacctggggttgctctcggcgagatgggaggtgtggggtgtacgaaggcatgtccgcctgtcagaggctggtcatgcaagagattttttcctgcatggcgcagaattgagctcaatgccttgctgcaccctgcccggcatgtggatacctcatccccatcaccctcctccaaccacgctccccccgccaccacatttgcatgtgcagtcttcatggacaacatccggtttgcggagtcggggctgcgagacaacgtggcgcaggtggccacctttgagctgctgccagccgaggagcagggcagggagcgggagggcagccccgtccccagcagcccccctccctcccccggccggccagcgtcgttgctgagggaggaggtgctgcagcagcagcgctcctgggcccagtggcagcgccggcggaggcaggcggccggggaggggagcggacaggcgtcccccagacagccggggtccgacccccccgggtcgaggggcgaggccacctccgccgccgccgccnnnnnnnnnnggccggggtctgaccccaccgggtcaaggggcgaggccacctccgccgccgccgccgccgccatcctccccttcaccttcatagtgagcaatgtgcacgtgctgttcaaccccaagcgcggcgacgtgaagctggcgcagacccggaacctgctgcacgcggttcatggtgcgagccgccgcgcgggcggcgcgccggccgtcgtctgcggcgacttcaactcggcggcctacagcgacgttcactgcttcatcacctcgggcgagctggggctgcaggccgtggatcgacgctgggcgtccggccaggtgcggggcggtatgtgtgtcgagccggaggtgggagatgaggcggagccggcgcgtgcgtgcgtcgactgctgtgtgttgtgcgtcgggcgatgtctacagagaggcgtggnnnnnnnnnncgagggagaggcggcgcatgcgtcgactgctgtgtgttgcgcgtcgggcgatgtctacagagaggcgtggcacgctcgacacacgcggcatcgccgtgtgattgcgctgcccaaacccaggccggtactgagcacacccctgccggcctgcgctgccatcgcaggtcgagggcatcggccgcggctggtaccgcatgcgccggcgcctgctggacgagctggcgtccggggtcattcgcggctacgcccccaaggtccccgtcccctggacggaggaggagctggcggtggcctttgcgcgcctcaggtcccggccgggcgtggaggaggaggggggcgaggagttcgacggcgcgggggcgggcgggctgaacggcgcgggggcgggcgtgggcagctcggccggcggaccgcggagtggcgactggatcccggacggcctacccgacaccgatccaaggaggaagatgctnnnnnnnnnnccccggccgggcgtggaggaggaggggggagaggagtgcgacggcgcgggggcgggtgggctgaatggcgcgggggcgggcgtgggcagctcggcttgcgaaccgcggagcggcgactggatcccggagggcccacccgacaccgatccaaggaggaagatgctgctgacacacccgctgaccctgcactccgcgtaccaggccgtgacgggggaggagccggtgtggaccacctgccatgacggctacatgggcaccgtggactacatcttctacagcctggagccgaatggggcccccagcctggagccgcgcggcgtgctgctgccgcccgtggcgcagtcgctgcgctcgggcctgcccaatgcgcactggcccagcgaccacgtctgcctggtggcggactttgacgcgcgcagggcgtgaggtttgctcatttcttttgtggagaaggctgctgggcggctggactgcacctccatcacagagtccagggtgtgcccttccagcactggctaacccgcagcatgcgtccttgttgtgggctttgacacacaatccccaggtagaagattacattcatcctagcacctcccccctggcannnnnnnnnntagggcgtgaggtttgctcatttttttgtggagaaggctgctgggcggctggattgcacctccatcacagactccagggtgtgcccttccagcactgactgacccgcagcatgcgtccttgttgtgggcttggacacacactccccaggtagaagaatacattcatcctagcacctcccccctggcaccgctcacgagctcaccggcgacgacagggcgtgctccttacacagtccagagtccagacaggcacaaatggcacggggaggacctgccacacatacgcaacactcactcgtagatctgggagtagaggacgggggtgttgtccaccaggccctcggggaaccagagcgccagctccttctgcgcgttctccacagtgtcggagccgtggatgatgttgcgcccgatgtcgatgcagaactggccgcggatggagccaggatcggccgccagggggttggtggcgccgatgatcttgcgcgcctgctccaccacgcacttgccctccagggcgatggccacgacggggccgctggtgatgtactcgatgaggcctgtgtgtggggggtgtgggggggtgtgggggggtgaggaggagatgagtggtgccatgatcagcggcaaggagatggtgtgtgggtgtttgtgtgtgtttgtgtgtttgtgtgtgccgttcctcgggtannnnnnnnnnacaaggagatggtgtgtgtgtgtttatgtgtgtttgtgtgtgccgttcctcgggtagcgccgctcacacagaatgcatctgccacaccccggaccaagttccccacctccgaagaagggcttggaggagaggtcggcgtagtggcgctcggcgtgctccttggacacgttcaggaacttgaggccacgcagggtgtagcccttttgggggagggcagattgagaggggcttgcacggattggaaaccctctgctaacgtcagcgacaccttgcaggaacccgcccctccttggcagccgtgcttgctggccccaccttgctcaggaagcgctccaggattggcgcgaccagaccgcgctggacgccgtcaggcttgatcatcacctgcgcagaggggtaggtgggaagagtgggcgtggtggcaacacgatggcggatggatgccaggacccggcggtcgagctctcaacccataagaccggcgctgatctccaactcacataggtggtctgcgaggggaagaaggttacgagggtgaactcggtacataattgttatatggaattgcagatgcaggtcagcatcattcctctgcacgtgctcggtgcagcgcaagacggcatgcgccaacctcaactgcgacccacgcacctcagtcgccatagtatcgaaggtttgtgattaccaatgatcaaaatccaggaagggctagagagcgagagagggagtcaaggcgctgggctcggccataaggcccgtttgctgtgggtgaagatgctcatggagtaccgcgcgccggtggcagtaccaaactcaaagactcacaataagaatgctgcaaacaggtaaagggacccactttgatgcgatttaatttcttttgttgaagtaatgctgggaaatgtgactctgcaataccaattaggacgtgagagtgtcctgccctcgtggattggctgtatggctgggacattgtactttgatcgatcgacatgaaaacccatatgaaactcggcagagtccaccaagctcatcctgtagttctttgaaagtatctgggattgagatgtcatcgagatgtttgtctgggtcgcattggtctgacagtactatccaatcactgtcaacctacaatgaaacaatgcagcgcgcgcgccatgtccttccttgcgcagtgctctcgtacattagctgcaggcccggtgggaatgacgatcttgactcgactccttgcttactctacatcacctgtaatggagatggcgtcgttgtagatatactccctgcggcggagcgtcgacatggtggaggcggagggccaagccgtggcaggacccagcttcgattcatcccgattcgagctgttgagccaaggggctgaagctgtgagtcgacgcacgtcatcggactggatgtatgcagcatttgttacctaaacaggacctcaagtctccactcccccgcccattatttgccagagggtgtggactggcactttcctgcagcgccctgtggtcgtgaagcaacgcttccccaaggcgtaccgccatccagctctggatgcaaagctcacacagcagcggctcaaagcggtgcgaggctggtgcagcggcagacgggcacttcactgctgagccctgcagttgccagaaggacatgggtctgctgggcacctcagcaagagcagccccttgatggtccttgcacaccagttggataagggtagttcttcgaactgtcccccccacgctaccacttgctctcccttccccttcttgctcccaggaagtgaggggcctgctcaaggcccggaaactgggggtgtccacccccgtcctcttccacgtagacacagcgacagcctgcatatacatggagcgcctggagggtagctctgtcaagcatatcctgcactcgcagagcatggacgacgcaggtgaagctcccgaggttggtatgctggtcgtggagcttgctgtaaacctgtcttcagtgtgtgtcacaagcagtgcggcctccaaaggtactcgttcgcttcctgcaccgccatgtcctgcgcatggatgcctcgtgagccagtgcttcatgcaggctcccccccacaccatccagccagcccgcaacacccaacacagccacgaatgcgctgctgcaaggcatcggccagaccgtggccaagctgcacgatgcggggctggtgcacggcgacctgaccacgagcaacatggtggtcaggactgtgggtaacaatgagctggtgaggtgggg

SEQ ID NO: 44915 - DNA, 61 bp, Chlorella protothecoides
gcaggcctgatcgcgctgaaggggctgggggacaccaccttccgcggctccaacagccaga

SEQ ID NO: 44916 - DNA, 61 bp, Chlorella protothecoides
ccatgagcaggaggaggcctggctcggggggcgtgcccagtgctctcttcacacgtagtgc

SEQ ID NO: 44917 - DNA, 61 bp, Chlorella protothecoides
ctggcctcccccggcctgctggaggcgggggggaactttggggcggggacgatgttcgaga

SEQ ID NO: 44918 - DNA, 100 bp, Chlorella protothecoides
ggggcagtccgggagggcgaggggtccgggggggcgacggcggccaccgcagcgccggcgccgcggcccagcgcggagcgcgcggcgctggtgcgctcgc

SEQ ID NO: 44919 - DNA, 77 bp, Chlorella protothecoides
gcaggcttgatggggtcgttgccattttttcaccaggcgcatgcccgtgtgtgtacgttttcccggacccctgagca

SEQ ID NO: 44920 - DNA, 61 bp, Chlorella protothecoides
gggacgatccacgcgacccgcgacaggagcccctctgtgctcgctgtcttataggtcgggc

SEQ ID NO: 44921 - DNA, 61 bp, Chlorella protothecoides
cccacgctttatcgcagaggcagccatggggaagatcccggtcaagttcagggaggtggtc

SEQ ID NO: 44922 - DNA, 61 bp, Chlorella protothecoides
agtgtccctcctgcactcacgtgagcggggggctgacccttttctaggctgatggcacgac

SEQ ID NO: 44923 - DNA, 61 bp, Chlorella protothecoides
tcttgaaatgacgggaatagtgtcctggggggtaactatgttttggagcaatgagtacctg

SEQ ID NO: 44924 - DNA, 61 bp, Chlorella protothecoides
taaactgtgcggtgttgggtgggtggggggggattccattgcaaccctgactcgagcagag

SEQ ID NO: 44925 - DNA, 113 bp, Chlorella protothecoides
ggctccaccagggccagctcctggaaggattagggaaggaagaatagagcggccagggtcgggcacgcgagcagaggccggagggtgtgggggggggggggggggggggggcg

SEQ ID NO: 44926 - DNA, 61 bp, Chlorella protothecoides
acccagggggcactgccgctgcgcgatcggcccagactcaagccactgtgatggtgatgtg

SEQ ID NO: 44927 - DNA, 61 bp, Chlorella protothecoides
cactgcagatccaggaggaggcggggcacccgcgcgcgaaagtggacgacctgacgttgac

SEQ ID NO: 44928 - DNA, 61 bp, Chlorella protothecoides
gagcatccgcaagcagcacggcgggagggggccagccccgggatcagaaccagctcaggac

SEQ ID NO: 44929 - DNA, 61 bp, Chlorella protothecoides
gagggaaagggtctggatgggcggggaggggacaagattgtaaccttgcatgaagaatcga

SEQ ID NO: 44930 - DNA, 61 bp, Chlorella protothecoides
ctggcgaatagcggcagcgccgcgagacgggttcaacgccggacgctgcatgatggatggt

SEQ ID NO: 44931 - DNA, 61 bp, Chlorella protothecoides
ccaggcaccaccccttgcggtcacggcagggggcgatcgtacggccggccgctgcccagct

SEQ ID NO: 44932 - DNA, 61 bp, Chlorella protothecoides
gcgacgttcagtcctctcaagggaggcggggccgttttcctccctcggcatcactggccag

SEQ ID NO: 44933 - DNA, 61 bp, Chlorella protothecoides
actcctgggcattcggcctccagatggaatcctcaccgaaatcactgctccgagttcagac

SEQ ID NO: 44934 - DNA, 61 bp, Chlorella protothecoides
ctcaagttatgggatcctgaggcgcggcatcccccccaaatgtcaccttaatctaggatca

SEQ ID NO: 44935 - DNA, 61 bp, Chlorella protothecoides
gttggggagcagaggttgggcagtggcggggagcgaagagggggccacggcatcgcctgga

SEQ ID NO: 44936 - DNA, 61 bp, Chlorella protothecoides
ggggggttgggtggagaggagggggggagggggggaggagggaggaagggcgctgtcgggc

SEQ ID NO: 44937 - DNA, 76 bp, Chlorella protothecoides
gtggacctaccaggccatgctgcacgaggtactgggcatcgtcggggggtgcgtggaccttcgccacgtccccggg

SEQ ID NO: 44938 - DNA, 61 bp, Chlorella protothecoides
atctgttggagaggatggcggggatgagggggaggtgtaggaagacagagtccggatgccg

SEQ ID NO: 44939 - DNA, 61 bp, Chlorella protothecoides
agtcggcgtcgctcctcagcggcggggcggggaagaggtcgaggggcggatcgactcgccc

SEQ ID NO: 44940 - DNA, 61 bp, Chlorella protothecoides
ccccagccccaagtctcccagccccagcccaaagagccccagcccgagccccaagagccca

SEQ ID NO: 44941 - DNA, 61 bp, Chlorella protothecoides
agagggccctgtgtgtttgggtattggcttttgcttgattcacacgtgcttgagaaggcac

SEQ ID NO: 44942 - DNA, 61 bp, Chlorella protothecoides
gattcagcgaaaccaatccgcggcatttaggagcggtaaagttagaccaaaccatgaaacc

SEQ ID NO: 44943 - DNA, 61 bp, Chlorella protothecoides
ctggctgcggctcacgctcatttgccggggggccctgccactgaggactgtgcatgctgct

SEQ ID NO: 44944 - DNA, 71 bp, Chlorella protothecoides
cgggggacggcgcggggtggagctatgcgcgcgccgggccgcccacggcccggcctcccagcctgcagcac

SEQ ID NO: 44945 - DNA, 64 bp, Chlorella protothecoides
tcaaccaggtagctgtggggagggggcggggcgagggaccgcggcggccagacccagaaaggcc

SEQ ID NO: 44946 - DNA, 61 bp, Chlorella protothecoides
agagcctgctcagcgtggaacggcagggggggggctggtttgaggtcttgaacgggtctgc

SEQ ID NO: 44947 - DNA, 61 bp, Chlorella protothecoides
gtggacaggcttgaaccaggcttgcggagggtccagaggtggggaggagcatgtgtcgccc

SEQ ID NO: 44948 - DNA, 61 bp, Chlorella protothecoides
tgacacgcttcgcccttgtccgagcaccccccccccccccctttctctgcactcttccctc

SEQ ID NO: 44949 - DNA, 61 bp, Chlorella protothecoides
cggcccagtcctccccggccatggcaggggggcgacccttgtcctcacatgctcgacagcg

SEQ ID NO: 44950 - DNA, 61 bp, Chlorella protothecoides
gtgggtgtgtgacagcgtgcgtagaggcggggaccatcctttcacagtctttgagcgtgct

SEQ ID NO: 44951 - DNA, 61 bp, Chlorella protothecoides
aagtgtacatggattgcttgcgctggcggggacggttgagaagatggattggggcatcctc

SEQ ID NO: 44952 - DNA, 89 bp, Chlorella protothecoides
tagtgtgcacccccctccccctaaccctccttagggttagggttagggttaggtttagctttagggttagggttagggttagggttagg

SEQ ID NO: 44953 - DNA, 61 bp, Chlorella protothecoides
ccacctgggcggggcggcggcgggggccgcgttcaacgcgccccccccaccgccgccgctc

SEQ ID NO: 44954 - DNA, 80 bp, Chlorella protothecoides
gcgacgatggccagggcgcggcgggggtggcggggggcccccactcccccgcgctgcgccacgcctgccgcctgctgggc

SEQ ID NO: 44955 - DNA, 61 bp, Chlorella protothecoides
caagaatcagctgttcgagctggggccgggggcgcagatcaaggccatggtcaagcgcatt

SEQ ID NO: 44956 - DNA, 74 bp, Chlorella protothecoides
cgtgccgccgcccgtccaggcgagtgcgggtggggtgatgtccgtgccgggggggggggggggggggggggggg

SEQ ID NO: 44957 - DNA, 72 bp, Chlorella protothecoides
gggggtgatggtagcgcacttgatgcccacgttgtacttctgtgggggtggggggggggggggggggggggg

SEQ ID NO: 44958 - DNA, 61 bp, Chlorella protothecoides
cgacgatgcagagcgtaatggccaggcagggcgccgacttctgtcgtagcattcctacaac

SEQ ID NO: 44959 - DNA, 61 bp, Chlorella protothecoides
ggggaggatagtctgagtagcggaggaggggccaggggttggacagcaggaacgatcaggg

SEQ ID NO: 44960 - DNA, 61 bp, Chlorella protothecoides
ggcaaaagatagcacgtcaggatggaggaggggggggggtcaatgggggaacaggcgctgt

SEQ ID NO: 44961 - DNA, 61 bp, Chlorella protothecoides
tggcatctgccggcaaggcgatggcggcggggggcgccgccgccgacctccccggcgccca

SEQ ID NO: 44962 - DNA, 61 bp, Chlorella protothecoides
ggaagagcattgccgctgggatggcaaggggggggggaccgccgccccagcatgtgagacc

SEQ ID NO: 44963 - DNA, 61 bp, Chlorella protothecoides
agaattgactgcagctgagatgcggaagggggagactgggcagaggagtgcatcgcacggc

SEQ ID NO: 44964 - DNA, 61 bp, Chlorella protothecoides
aaggctgccacaggaagagattgctgcggggggaccccctgccagcaggccatcgagtata

SEQ ID NO: 44965 - DNA, 61 bp, Chlorella protothecoides
gccctgatcagaggagtctggcgtggctggggtggactcttgcttccatgaccctggtgac

SEQ ID NO: 44966 - DNA, 61 bp, Chlorella protothecoides
cagcttcagctgtgacggggtgcggcggggggattcagggggttgatgccgccacaccgcg

SEQ ID NO: 44967 - DNA, 61 bp, Chlorella protothecoides
gtcttccccccgagctcttgtattggcgagggcagcaccagctaaaaacatgcaacgccga

SEQ ID NO: 44968 - DNA, 61 bp, Chlorella protothecoides
cagtgtgagtaccttgctgaatggaggggggggaaggatgaattggagagcgcggagggtt

SEQ ID NO: 44969 - DNA, 65 bp, Chlorella protothecoides
ggggctggcgcgggggctggggctggggctcgcccgggggctggggctggggctggcaggctcgg

SEQ ID NO: 44970 - DNA, 61 bp, Chlorella protothecoides
tgctggggtcagggcaggagtggtgggaggggcaggcccaggctccaaagcgtcaggaggc

SEQ ID NO: 44971 - DNA, 61 bp, Chlorella protothecoides
cgatgcttgcggatgttgctaagcacaaggggtgcgtccgcctctacgtgcgtcggccttg

SEQ ID NO: 44972 - DNA, 61 bp, Chlorella protothecoides
gccccgaggagtcaccctctccaagccctgcggagtctcccagtcccagcccacaacaggc

SEQ ID NO: 44973 - DNA, 61 bp, Chlorella protothecoides
cctgccctggctggcgtggtggcggggcggggggcgagcctgagtgccggggactccgtgt

SEQ ID NO: 44974 - DNA, 150 bp, Chlorella protothecoides
gtgggacaattcctggctccttgccctgtacccactcctatatacattgaacgagtgcaagtgctaatgggtgccttggatatcacgggacgcccccctcaccatcctctgcacaaaaacccatgattctcccccccccccccccccaag

SEQ ID NO: 44975 - DNA, 106 bp, Chlorella protothecoides
cggggggtccgatggggttgggggggggggcgagcggcgccgggccccgctccaagggggattcctctggccgcccgacgctcccccctttccccccacgccccaa

SEQ ID NO: 44976 - DNA, 61 bp, Chlorella protothecoides
agagagatctgcaggaacgtcaatttgtgggggccgcaattctcagcagttgatctgcact

SEQ ID NO: 44977 - DNA, 61 bp, Chlorella protothecoides
cccctccctgttgagtggtgtagtgtcgtgggcacccccctccccctaaccctcccctccc

SEQ ID NO: 44978 - DNA, 61 bp, Chlorella protothecoides
gcaccaggtgggtgtccagaggcttgtcggggatgttgcgcagggcatccaccaccagggg

SEQ ID NO: 44979 - DNA, 61 bp, Chlorella protothecoides
cgaacaaggccatctcgcacatggcaggggggtgcggtctctgttcgcagcccttcgaccc

SEQ ID NO: 44980 - DNA, 61 bp, Chlorella protothecoides
gaagcaggccgaggcaggggcgcaggtgggggccgccaatggcgcacacaagccctcacct

SEQ ID NO: 44981 - DNA, 61 bp, Chlorella protothecoides
gagtcagatgcataccagagaggctaccgggggttggttccagcaagcgcggcgatctcgt

SEQ ID NO: 44982 - DNA, 61 bp, Chlorella protothecoides
gctccgggtcgtccacggcaatggtgggggggacggcgctgtccacgatggccatcttcac

SEQ ID NO: 44983 - DNA, 61 bp, Chlorella protothecoides
ccaggtgcgcactgatggcaggattggagggggcacgcgcttgctcaaggatcccatctcc

SEQ ID NO: 44984 - DNA, 7725 bp, Chlorella protothecoides
  modified_base (100)..(139): a, c, t, g, unknown or other
  modified_base (220)..(305): a, c, t, g, unknown or other
  modified_base (514)..(523): a, c, t, g, unknown or other
  modified_base (2317)..(2326): a, c, t, g, unknown or other
  modified_base (2666)..(2675): a, c, t, g, unknown or other
  modified_base (3074)..(3083): a, c, t, g, unknown or other
  modified_base (3460)..(3469): a, c, t, g, unknown or other
  modified_base (3793)..(3802): a, c, t, g, unknown or other
  modified_base (4254)..(4263): a, c, t, g, unknown or other
  modified_base (4620)..(4629): a, c, t, g, unknown or other
  modified_base (4906)..(4915): a, c, t, g, unknown or other
  modified_base (5159)..(5168): a, c, t, g, unknown or other
  modified_base (5469)..(5478): a, c, t, g, unknown or other
  modified_base (6007)..(6016): a, c, t, g, unknown or other
  modified_base (7431)..(7440): a, c, t, g, unknown or other
  modified_base (7651)..(7660): a, c, t, g, unknown or other
gcgccgccctcggccgcggggcgcgactgcaggtgcggcacaccccagccctgcgtcgaccccgggaggggcccggcgccgccgccggcgccgggccggnnnnnnnnnnnnnnnnnnnnnnnnnnnnnnnnnnnnnnnnagcgagtagccggcgcgctgcgcggggagggccaggccgtcgaaggacagggcctgaccgggcagcggcaggggcccgccnnnnnnnnnnnnnnnnnnnnnnnnnnnnnnnnnnnnnnnnnnnnnnnnnnnnnnnnnnnnnnnnnnnnnnnnnnnnnnnnnnnnnncccgccgcccgccgccggctgctggggcagcaggaggaaggggggattgtgagagggcacgccggcggcgggcggcggcgccagggaggaggcgccgccggcgccggggcccagcgggcgccccgtcagcacgccggcagggccgggctggccgccgtaggcctcgtgggggttggtcccgaaggcggcgcccatggacccgctgaagnnnnnnnnnnagggcccagcgggcgccccgtcagcacgccgccggggccaggctggccgccgtaggcctcgtggggggtggtgccgaaggcggcgcccatggacccgctgaagctgggcgtgccgcccgagtgggtgtgactgggcgacgcgctgcgcacgctgctctgcgtgggcacggcagcgggcaggccaaagaccccggggtcgaaccaggggcctgcagggtacgccatcccggggaactgcatgagggagggtgcgcccggctgctggccggactgccgctgctgctgctgctgctcctgctgctggggattgagagggttcatgccgcaaagccgagaaccaagcgcatgtccctgcgaggcccggggggacgagggggaggggtctgacctcgggcaaatggggtcccccggccgaggaccgccccaccaccttgtcccggggttttgctgcatatttcagctgcggggaggttgtcgcgactcacctcgagacgcaacccgatgcaggagtgtcaggccaatgtgtgggagagcccgggtcgcgcgacagagtaaactgagcgagggtggggaggcttccgaacagagggtcgggggagggagcagcccgacggggcaggggacgatttgacactcctttcagctgaaaagcatgcgaggattggggcaggcggagggggctcgagtatgagctgtggcccgtgcgcggaagacgagatgaaacaagatgggacccgaggaggggctcgtgctttcttgggccgatcagtaggtcgaaaccccactcctccgaaaccggcgcagcgttctccagtttcggaatgcactgtcaggtcttcctagtggagttggagggttggggttctcagatttataggacccgtgtagagctacaaggggtgggtgggaccttgtctggtaggactgtccctggtgcactctgcactgcaacaccctcacgccgcacgaccctttgaatgacccaagcatgtgtattagacacagatcagctgtaggattgactttagtgagctccgagccctactccttgcaaacttggtcaatgtgtggggcgccagtgctattgcagtgagtggatgctggccgggcgtcaaagggtgggattggacgtccagaggacctcacaacgtctgagccacaggaaatcgattgattcgttgcatgtcgggcctcctctctttggggatcagcccaaaggtgcctgaatgtcaatgtcatggcttggggagtactgtcctgaaaaggtaaggggttggtgatgcctgccatccagcttagagatggggtgtacaaagtagtaaggtcggcataccgcatccaggcaggtacaaacacatggtgttggccccagggtatcctgacaggacccaaaatgcatgcaccacctgtgttcaaggaaggatacgcatgaatgcttttgccattggatgagttgttcatttcgttggcccgtgcgtggctgggggatcatccctgtagggagccctcacctcacacagctcgacattcaaaagcccactgcgccaggggtccggccagcaggatcgaacaggcaccgagccaacagagggttgcggtttcattatgacatatgccttgccatgcgctcgtccatctgctgttgcattcccatacgcggagttctagagcggggctcgttgctgatggaggtttctcaggagagcccatggggtgtgacgctttgcttcaaagacccccagctcgaggccgactttcatcatgaccacgcagcgcgacaccgccgggaggatnnnnnnnnnncctcggtgctcatggaggcatcgcaggggagcccatggggtgtgacgctttgtttcaaagacccccagctcgaggccgacttcgccctcgaccatgccgcgcgacaccgccgggaggatgccatagggtccttcatcctgactgcagctttgtacgtaatgatcgtcctgaccaaaactggcatggtgagggcaggaagcgacgtgccgggtttcgggaccttgagttcattaaccacatcccgcaacagccatctgccgagcactgcgtccctccaccacaccataccaagacggaccaatcatggaccatgccgatggatgagctgcgaccgatgagnnnnnnnnnntggatccttcatcctgactgcagctttgtacgcaatgattgtcctgaccaaaactggcatggtgagagcggggagcgacgtgccgggtttcgggatcttgagttcattaagcacaacccgcaacagccatctgccgagcactgcgtccttccaccacaccttataccaagacggaccaatcgtgggtcatgccgatggatgagctgcgaccgatgagcatgttcgccacggtcgaggtgggtggggtgggggcctgagtgggttaatgcgcagtgcccctcaacccgcacgcccacgaggggcgggatattggattcttccaccagcgcgggctgagactactcgagctccactttgacatccactatagaaagtgcttagagctgggtgtggaacacnnnnnnnnnngcaatctgcacgcccacgaggggcgggatactggattcttccaccagcgcgggctgagactcctcgagctccactttcacatccactacagaaagtgcttagagctgggtgtggaacacctttactggaacagtccatggagctctgccgatgttggccccaaacaacagccatcaatcgaccctcgtcacaatcagcccatccctccctcccatgcaggcccttcccggtctgctggcggtcctgctcccctgccagacctacctgcgccttcgcacccggatccaccaggcaagtctcctggccacggccgccgtcctacccttccacggctatcggcgctcggctgacctcgtctccggggaggagaatcgcannnnnnnnnntcatcatggtattcgaggtccttgggcgccagctcctgctgcgccaccgcctccctttcttgctgccatgggcatgcatgtcgctccagagccacatggacttctgccgggtgcgggggtggacgggcgccagcggcgtagccatctacgacgcgcatgctgccctcacgcatgtggcaaacactgggcttggagagtggccccttggtgtgccgacctcgccgacccaggcatgtgcaatcgcgataaactggtgctatctggtcatggggctgattatccccaacttcttcctctacaccatgggtgagaggggggggggtnnnnnnnnnngatggcgctgcagcgcaacatggaccactgccgggtgcgggctttcacgactgacagtggagtggccatccacgatgcgcacgtggtggcaatccgcgcggcaaacattgggctgggcgagtggcccctggggtcaccaagactgccgacccagggatgcgctgtcttgaccacttggtgcttcttggtcatggggctgactctcccaaacatcttcctctacaccatgggtgcgtgatgagagggttggggagggagggggcggcaacatacgctagcgggggaggtggcttgaacagatgcctgcatcctcccacacgtggcatgatgggctggttgggatgtgtgaagggggcgtgggctggagctggttgacagctgctgaattccttggcacctgcccgatccccgtatgcagaagtgcgcgagcggacgcggtatctggtggagcnnnnnnnnnnggggggggatgtgccaggagctgatagacagctgctacattccttggcacctgcccaatccccgtatgcagaattgcgcgagcggacgcggtatctggtggagcgcgggttgcccccgcccaggctcaagctgagcaagggtctggaagagaacttcctactcctgccctccgtcctaggagggatgtggctgttggccaacgcacttgccgctgtgccgccgaacaagctgagctccctcttcgcgcgctggaacgcctatctcatgcagaccggggtcccggagatcacatggtgatggaacgggccaagcccaagcccgacaaggctgaagacagttcactctctcttctactnnnnnnnnnnggagaatttcctactcctgccctccgtcctaggggggatgtggctgctggccaacgcacttgcggctgtgccgccgaacaagctgagctccctcttcgcgcactggaatgctttcctcttgcagaccgaggtcccggagatcacatggtgatggaagggaccaagcccaagcctggcacggctgaagacagttcactctctcttctactaaattaaatgtaagggtgggagttggcggagggggcgtggagatgtggcgggactcttgcttgaaagnnnnnnnnnngcgacccaatggaattcgtgctcagtttgacgtgaaagacggtccaagcctcacccccttctccaagatgctgtgcagtgtcccccgcttcgagatggtgtggagtggtgctgaagtatcacggggggaggaggtccttggaaggcctagcatcagagaaagagctagaagggatggagcagtgaattgcggggcgagagtggccatgagtcatcctgcagggcacagccgtgacagtgtacannnnnnnnnnagggcgagagtggccatgagtcctcctgcagggcacagccgtgacggtgtacacccacaattaaagcccaagcgcattcatacggcggatactcgctgtgggtatcgtccttataatctcccattctgagctttcacaaggtcaatctgagtaaaaggggacaatgttgctgtaccaggctcgtattggtcgggcgtctgggtatgtgaatggatgtacagatgacctcgccaagtatgatccggggagcctgtgaaaatcttgtacctcacggctgtggagtgcaaggagatgccaattnnnnnnnnnntaagcatgatccgggggagcctgtgaaaatcttgtaccttacggctgtggagtgcaaggagatgccaattcgtgagcttcagtgaggcatgctgtgctcgacagggaaccacggatgattggtgtgttgtgattgaaagtgtagtggcgtcagatggggtgtgtgagcgtacttaacagcgtgtatcttttcaagcaggttccctagcattatgtggggccagctcacatattcttggccccccacatgtgcaccacctgcatctggcggtatgtgagcattcgaagtgcccatacgatggactctgaaagtttcgttggcgtgtgcatggctcgagacttgctcgaagagtgttggcacctcgccccccaagcccacaacatttgcttctctgcgccaattgcgcgctcccgaacagacacctaaccaagcggatggccgtctcattacgacgtctgacctgcaattaacctgaccaggttctgtgtaaaccccatgccttgagctcaacagcgggcctcgctgctcnnnnnnnnnntgagacttgatccaacagcggtggcacctcactcaactcacaacatttacgtctctgcgccaatcgcgcgttcccgaacagacacctagccaagcggatggccgtctcattgagacatctgacctgcactaaacctggccagttgctacgtaaaccccataccttgagctcaacagcggccttcgctgctcatggcggcatcgccggcgagctcctggggtgtgacgctttgcttcaaggacccccagctcgaggccgatttctgccacgaccatgcccgccaacaccgcagggaagatgccatgggatccttcctcgttgcaatactcctctatgtaatgatagtcctgacgaagactgccatggtgaggcagggagcggctcaccgagcacccacggtaacggagtcgacttcatgcagcacaccctaggacagccatgcaaaaagccctgcgcccttccccctgcatcattacagacggaccaggaatggtccatgcccatggatgagcttcgacccatgagcatcttcgccacagtcgaggtgatggattcatcggatggtggggtccggatacgcttgcaagcggtgactcgtgccctcggggaatgggatccatggtttgatcgtactactggacaccggcccccccccagccccactccatcaaagactatgaatgatggtttgagccattcttagggctcactgtgccataccagctcatgcggcactgccggatctggtcccaaaccactggcacccacccatgaccagatctcccgccccgcccacccgctcatgcaggcgcttcccgggctgctggcggtcctgctccccagccagacctacctgcgccatcgtaccaggatccaccaggcaagtctcctggccacggccgccttcctgcccttccacggctatcgacgctctccagacttcatctccggggaggaggaccctgtccgggcggccaggcgcgccgcttcacgcttggcgggcaactcccgctttgtgttcatggtgttcgagctccttgggcgccagctcctcctgcgccaccgcctccctttcctgctgccctgggtcctggtggtgctccaatgcaacatggacgtttgcagggcgcggcccttcacagccgccagtggcgtggcaatccacgaagcgcacgctgtcattgtccgcgtggcaaacaccgggctgggagagtggcccctcgggccggcgaggtcgccgacccaggcgtgcgcagtggtgacaaactggtggtacctggtcatggggctggtcttccccaacgtcgtcctctacaccatgggtatgttggcagggcggaatgggaaggggtgacgaaatatagacttgggttgccaggggataattagattggatgcctgcatccccagaagannnnnnnnnnatcgtcctctacaccatgggtgtgttggcagggcggaatgggaaggggtgacaaaggatagacttgggttgccagggcatgattagattggatgcctgcatccccagaagagctgtatatgggacagactgggatgtgtgacgtccacctatcctaggagaggctggatgcccctcagcgctctcctcctgcccggcttccatttgcagannnnnnnnnnaacttatcctaggaaaggctggatgcccctcagccctctcctcctgcccggcttccatttgcaga

SEQ ID NO: 44985 - DNA, 61 bp, Chlorella protothecoides
agctgtcatcaagaaggtctgagtggcggggagggcaaagccacccagaagcctggggcat

SEQ ID NO: 44986 - DNA, 61 bp, Chlorella protothecoides
gcggcttcctgaacagaacggcagggggggggaatggtctgggatgtgagacaccccgctg

SEQ ID NO: 44987 - DNA, 61 bp, Chlorella protothecoides
gcgtccacgataccgatgccgcggcggggggactctaggagcaggggccagaggaagtcga

SEQ ID NO: 44988 - DNA, 61 bp, Chlorella protothecoides
acatatcggtgagtcgtgtggtctggggggggaaggagtaatggggggacccctcctctgc

SEQ ID NO: 44989 - DNA, 61 bp, Chlorella protothecoides
tccgcaactggctgggacctggctctcacgcccaccaccccggtggtcgtgtttgctgaag

SEQ ID NO: 44990 - DNA, 4826 bp, Chlorella protothecoides
  modified_base (3764)..(3873): a, c, t, g, unknown or other
  modified_base (3970)..(4012): a, c, t, g, unknown or other
  modified_base (4585)..(4669): a, c, t, g, unknown or other
aggggggcgggatggggggcgggggagggggggagatggaggagtcgccaatggggtaagggccgacactcattacgactccgtggtacatgactgaagccgtgaccgtcccagaggacgaaactcccgagacaagcgtcttgtacgtcatcttcaaggagttggtgtactcccttcgctccgattttgggccgcccaccatgtcaaagatgagccacacctctgagggcagctccaggaatgtcatttcaacggtgcatgcgacctcttgatagtacgccttgcggcaaagggcggagtcgattgcaatcttggcggggggtgggggtgaaggagcaggcggcggcggtgaaataggaggtgggaccgggtgtgggggaggggggctcgcataggggctgatgggaatgtcgttggaacggataatgctcccatcagaagccttataccatgcgtgagcactgccaacgacggaggaccccgtagtgttccaggtgttgtaggtggtcagatggttgggtttgaatgtgaagtcgctctcgaaatgacccaaactgtagtcgattgtgtaggagtccagaggtaactcggagaccgtcacgcttgcggtgcatgtaataacgtcgacaggtggggtccagttggaggctttggcgcactccatgaaattcagggtgatggtggggttgtcctgtacggagcagccggaagaagaaaggggaggttacggctggacggcctgcaacagggtgtgtcgaggccttcacgcattggagcttcttcccctcaccgctgcggcaggactcgcgtgccaaaccaccaggagcgcccctagcagagcggccgcccgggggccgatcatcaggaaggtgcccttgtagcaggtactggtcaaattgcaggcagtgttcacgcgcaagctgattcaattttggactcggggcgatgaagaggaacacatcaatctttactgtactgtgtacggtgtgcatccctacatgtttacgatttctcaggcagtacgctgcccatttcgcgagccggatgcggacatccagcgcgacccccggttctacatgggaaatcgtcgggagcgtgccatctgttcgcatggctgtcaatggagaaagttcagcgctttcacagcagtatataggagtcgtttcgcctttctgtaaaagtctctgagatgcttgtgtagagtactgcgagaagacattgcagcgaccaagaacagggatagatttcgcaacatcctcaggtgagggcagcggcgttcaggtgagaccagtatcgtgtatggtgattcaattttggttcgaattatcgtggggatacctttcatgctgagatacttgatgtttggctagatggtcaagcaaggaagtacttctctgcaagttggaaagcgaatagaataatagatgagaacgacttaggcatgtgcggatcctttacaaagaagaaatgcgctgtggcgatgctcaagttttctcattagccgagtgcctgagtagagtcggatctcctatcccgcgatggtttcgcgccctccaagcgtccgagagcgcgcgcgatcttgacttccgtgccctgctcaaacgcgttgctgatcacagccgatgcgcagcgtgagcgtgacatcagcacacccttataagtctcttcaaggcatcaaccacatacaagggtagcatgggcgtgagtggccctgcttctccagctgggctgacacctcctgtcgagtatttggacccaatatccaatgacgtcatgcaggatcccgtggtgctaggagacacgggcaacacctacgagcgaagcaccatatccatgtggctggagcgctgtgcgcgtgcgggccgggccgctacagatccgctcaccggcctcgtcgtgggggatgctcccaaggtgaggctcgtcatgggccccgatggtctcaaccagaggctatgcgtgcacgcgcaaccagttcagtgcaggaacctcctatgcatgggacgtcatcccttattgccgctctgggaatggcctgaacccacacccttccccatgtgaagtagtcatctgtctgcacaaaaatgctctccttaggtgcctcccctggacttccacctaccgcctttgtcccccgatccacccgtgcagctcattcccaaccacacattaaagagcctgatccagggctgggcctcccgccactacatcgtcgacctggggcgcttcagcaaggcacggaggacgaagcgggccaccccctcaaagcagcctgcaaccgaggcggcgattgggacgagtggcagtccttccaccacaccagcctctcccaggaccgccgagcaccagggctcggactcgcccacccaccgactggagggcggggcatcgaggagtgagggacaccatgccgagccgcctgcccttcccccgcccagccctgccaggccgctctaccctgaccccggcgaccccgcctcggcccgactggggctggacggcgtacccgaggccctggcggccctgcacccctcccgcctcgccgccggcgggtaccccgcgcaggccaaagcggcctacgctgcacgcacgctgagcacgctggcctcccagcgggaggcgcaggatgccatgatggaggtgagggcgcgggtgctatgggtccagtgtgttcgcagaaagcccagattgtgcgggcgtcgctggggcttgacatgttgcatctggaactgggttctggatccgccgacttcctgctcctcgggtgggtggggacgcttgttcctggaattgtacccagctgaatctcttgccccaccttccctctgccccatcctgagcaccgcagcaccaagcagtgccactggccctcgtcctgctgggcaggcggctggcgccagcagacgccacgccccacctcctccgaatcctgcagcggctggcaggtgcgggtggctggccgcggcacctctcgccatcatgtgctggcgggggggatgagcacgacttgttttgccttgcatccctgctggccggaacgcgttctctcccatggcaagccctccccagcccgaccttgggcgggcctgctccgtgccccacactcgccctccctctttcacccccccccaaaaaactactaaaccctcttccatctgtgcagcctggcgtggcgacgtcgcccaggagattgtggcctgcggtggcatcctcacggcggccagcctcctgtcggagcctgcccccgaggtgcgggccgccgcggcctccctcctctatttcctggtccagcagcaaccggggcgggggcgccaggccgccctggacgccctggccgggcaggccgcgcgtgggcgcatgccgccgcgcccgctgatggccttctggcgctggcatcggccggtgccaggggccgaggccggggcagggccagagggcgagaccgaggctggcgcgtcggcgggcgcgctggcggcggccgacgccagcctggcatgcctggtgcatgcgctggtctccggggatgtgggattctgccgcgcagacgccctggacgcgcgggacacagccgtgccggcggccctggctcgggcgctgctggcggcggggccgcgcggcgacgcggccacgagctgcgcagcggaggaagcgctggccggcctggccgagcacgcccctgccggcctggcgtcgctcgtgacggcggcgctggaggccggagcggggtcggcggcgagaggggcggcggcagaggcggcggcgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcgcctctgccccctcggaagctgtggagcagctggccgggctgtgccgcgggctgtggctgctgtgcgccgcccgcggcaccgacccgggggccnnnnnnnnnnnnnnnnnnnnnnnnnnnnnnnnnnnnnnnnnnnccgtgcgcgcggcgtgccacgccagcccccacttccccgagttcgtgcgcggcgtgctgcgctgtgcggctctggaccccggctcgcccctgctcccccggctcctgggctggctgggggcgctgtgccacgagccgcgctccccctccgcctcgctggccgcggccacggagggcgtgcgcgccgccctggcgaccgtgctgccggacctgctgccggcgctgctgcgggaggtggaggcggggacggcctcgcccccaggcaagcgatgctggtggtggttgggaggtggggtggagaggcggcgctgtgtcgggtagctcaatcgaagcttgcagatgaggttgccgggcgcggcgatgaccaccccgccgtcaagcgcctgtgcccacgcgctgccatgacgtcggaccggcctacccaagcgcgatctcccgaatccctccccccaaccacccatcatcgctcccctcccacacccctccctgcaggctcgctgcgccgcgccgagctggcatgcacgctgacgtgcaacctggcggccagccgcggcggggcaggcctcggcccctnnnnnnnnnnnnnnnnnnnnnnnnnnnnnnnnnnnnnnnnnnnnnnnnnnnnnnnnnnnnnnnnnnnnnnnnnnnnnnnnnnnnncgggcgcctccaggaggggctgaccgccatgctccgcggcaccggccaggacccccgcgtcctgctggccgccgcgctgtgcacgctgctgtgcgccgcgctgggcgcactggaccgagccaacgcggcgctggccgccgggctggccgccgccgcg

SEQ ID NO: 44991 - DNA, 61 bp, Chlorella protothecoides
ctgtagtattagctgttgtggttatttacgccggggacgctctaaaaggccttcttgcaaa

SEQ ID NO: 44992 - DNA, 61 bp, Chlorella protothecoides
acgtgaatagtaaaagcatgaatatgatgctctaaaaaatcagctgtacctaatggaattg

SEQ ID NO: 44993 - DNA, 63 bp, Chlorella protothecoides
gttcccaaggagaggggtagtgaaggggggggggttcccaaggagaggggtagtgaagggggg

SEQ ID NO: 44994 - DNA, 3630 bp, Chlorella protothecoides
  modified_base (182)..(378): a, c, t, g, unknown or other
  modified_base (1074)..(1083): a, c, t, g, unknown or other
  modified_base (1170)..(1284): a, c, t, g, unknown or other
  modified_base (2606)..(2615): a, c, t, g, unknown or other
  modified_base (2705)..(2866): a, c, t, g, unknown or other
ccaggggcagccccgcgccgcgttcgcctgcggaggcgccgacccacgaggcgactgccccggccgccgctgcgggcgcgccggagtccacgcgtccggccggcgctgcgaaacccatcacgctgcccgccggcatcgactggggcgcgctgtcggcgctggccgccagcctggggcagggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcccagcgtgccgatggcacgcgtcgcccccggcgcggcggcggtggctccgcaggctcctccgcatacggcgccgtacgcagcacccggcgcgtccggcacagccgccgcaccgctggcggggccggggcccatgcgccggttgggccaggaaggcgccccgcagcaggtatacggcgcggcgccgcagttccgccccgaggggccgggccagtacgcggcgccggcgccctacgcgccgcgcccgccgcaggatccatacgcgccgcaccccccgagcctccatcccgggcagttcccgcagtcccatgccggaccggcgccgctcccggactggcaggcgccgcacgccgggccgcacagcgacggcccccagcggcagtacggcggccggggaggggcctggcagggcggcagggggaggggccgaggctggcgaggacgggggtgatgatccttattggcgtgctggtgctcgtgtcttttactcctcgcacggtcgttcgagctcgaggtgtggggcagcagcatgcacagcatgtcgatgagagtcgcaactcagcctctcgacacctcgctgtcgacgctgcacaggatgctgaggccaggactatctctgtgagctggaataatctatgaggaaagaagtggcttgagatccaggttcgctgtgccggtgcatcgctccagtgccnnnnnnnnnntggctggcgaggacgggggtgatgatcctccttggcgtgctggtgctcgtgtcttgtactcctcgcacggtcgttcgagctcgaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgactatctctgtgaactggaataatcgatgaggaaagaaggggcttgagatcaggcttcgctgtgccggtgcatcgctccagtgccccaagactcgcgaggaacccctcctccctgcgcctgtcctccacgcacttgttgtcatgccaccaaagggatcaagggggaagaagaagaccgaaaagaatatcgatgtgaatgaggaggaggaggaggacctggacgcgctgtggaacggtgggtgagggtgccctgcgatgtccgaggggcacaccgggtgggcctcgacgcctgtagtatgaagactgttgcacccagccaccccatgacattgtgcagatgggcccagcgtagctgccagaccggtggtcctcccagccagcccctctccatcaagcgacgacagctactttcaggaggagaacgcagcgactgcagcgtgagggattgggggacaagggccgttgtggggtgtcttcatgcttttgttctgatcagggcagtgcacccttattcaccaaacgtttgatcactatgcagggatgagatgacccgagctgctgaggatgaggacgaggatgaggagggtgccgagtcaataccgggtggtgacccgtccacgaagcccaagctcctcccggcgctcacagcatttcagagtgtgtctgggcctcccgccttcctgaatcccgaggtaggcatgcgcggggaatctatccctgaggaggggcctcgctgggtgtcgccttgttgcacaggctcggtctcacctcctgtcctccctccctcaggccacgagacccgtggcggccccagcacgtcagccaaggcctgcacagccagattcaatcgcgtctggcaaagggaagggcggtggcaggggcgacggctcctgggacgtcagcaagatggcacccaagctcaaggaggaggcggcagcggcggggcctggcgtcatcaaggcatcagccgtgcagtatcgtgggggcgaggggcccacgcctgtctcggctgcagccatcgccctccttggaggtggggggtgttgaggtagctgtggtgtgactcggcacaggcacgatatccgaatccatgtggcatggaatcatgtcgttgtgacaaacctcttcccctccccctcacaccaatgtcaatgacaggcggtgaaaagccggatcgtggcaagcccagcaaggccatgggtgtggaggaattcctggacaagggcgctggaggagcggtgctgcccaggaagaggtagggtggggtggggaatggcaacgtcctgagcctggctactgtactgctgattttgggaggtnnnnnnnnnnggccatcgccctccttggaggtggggggtgtcgaggtggctgtggtgtgacttggcactggcacgatatccgaatccatgtggcatggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggggtggggtggggaatggcggcgtcctgagctggctactgtactgctgattttgggaggtacaagagccgatggagcgagttgcaggggcgatgactggcggaacccaccccttgttccacacagacaggagcgcaaagacagggagaaggacaagcgcagcaagggccagagctcgcacgccgcctggaagtcggaggcggagatggtgctgcgccagcagtacgactgatgcgggacttggccgctgccgaggccatgttgaccttcatctgtacacgtccctctgcctgactcgcattcatggtccatcactgcatcgcatttcagtcattacatttctcagaggtatcaccgagggtgcaggggcagttctcagggtgcttgtcaatgctacatggcacgccggcagcggccaggaccgtcctcaagactgagagtaacacaaggagggcagctgtgtctggctctctggcctacctggccccaccgtcccagctggaggtggcgggggactgcagggtcgacccctcccgcagcaggtcgtcaaaggcggtggcggccaccaggctcctcagccccggggccagcgcggcgcggcccacctccgcctccaccgccgccaggatggccgcgcccagcgccgccaccagcccatccaccagcgagctggcggcggggccgggatccagcgcttgctggcccccttcggtgcgtgccgggcgatctgcgtcgggcgcgccgccggcgtcggcggcgcgccc
